United States Patent 11,559,588 (MATERIALS AND METHODS FOR TREATMENT OF SPINOCEREBELLAR ATAXIA TYPE 1 (SCA1) AND OTHER SPINOCEREBELLAR ATAXIA TYPE 1 PROTEIN (ATXN1) GENE RELATED CONDITIONS OR DISORDERS) - sequence listing, part 9

SEQ ID NO: 121622 - DNA, 20 bp, Artificial Sequence
  Description of Artificial Sequence: Synthetic oligonucleotide
  Target: ATXN1; (+) strand; PAM type: NRG; PAM sequence: TGG
catgtagctattttctttcc

SEQ ID NO: 121623 - DNA, 20 bp, Artificial Sequence
  Description of Artificial Sequence: Synthetic oligonucleotide
  Target: ATXN1; (+) strand; PAM type: NRG; PAM sequence: CAG
cctaactgtgttttgtgaca

SEQ ID NO: 121624 - DNA, 20 bp, Artificial Sequence
  Description of Artificial Sequence: Synthetic oligonucleotide
  Target: ATXN1; (+) strand; PAM type: NRG; PAM sequence: CAG
ctgtgttttgtgacacagtc

SEQ ID NO: 121625 - DNA, 20 bp, Artificial Sequence
  Description of Artificial Sequence: Synthetic oligonucleotide
  Target: ATXN1; (+) strand; PAM type: NRG; PAM sequence: AAG
ttgtgacacagtccagcaac

SEQ ID NO: 121626 - DNA, 20 bp, Artificial Sequence
  Description of Artificial Sequence: Synthetic oligonucleotide
  Target: ATXN1; (+) strand; PAM type: NRG; PAM sequence: AGG
tgtgacacagtccagcaaca

SEQ ID NO: 121627 - DNA, 20 bp, Artificial Sequence
  Description of Artificial Sequence: Synthetic oligonucleotide
  Target: ATXN1; (+) strand; PAM type: NRG; PAM sequence: TAG
cagcaacaaggtaaattctc

SEQ ID NO: 121628 - DNA, 20 bp, Artificial Sequence
  Description of Artificial Sequence: Synthetic oligonucleotide
  Target: ATXN1; (+) strand; PAM type: NRG; PAM sequence: AAG
aacaaggtaaattctctaga

SEQ ID NO: 121629 - DNA, 20 bp, Artificial Sequence
  Description of Artificial Sequence: Synthetic oligonucleotide
  Target: ATXN1; (+) strand; PAM type: NRG; PAM sequence: TAG
aaggtaaattctctagaaag

SEQ ID NO: 121630 - DNA, 20 bp, Artificial Sequence
  Description of Artificial Sequence: Synthetic oligonucleotide
  Target: ATXN1; (+) strand; PAM type: NRG; PAM sequence: AGG
aggtaaattctctagaaagt

SEQ ID NO: 121631 - DNA, 20 bp, Artificial Sequence
  Description of Artificial Sequence: Synthetic oligonucleotide
  Target: ATXN1; (+) strand; PAM type: NRG; PAM sequence: GAG
gtaaattctctagaaagtag

SEQ ID NO: 121632 - DNA, 20 bp, Artificial Sequence
  Description of Artificial Sequence: Synthetic oligonucleotide
  Target: ATXN1; (+) strand; PAM type: NRG; PAM sequence: AGG
taaattctctagaaagtagg

SEQ ID NO: 121633 - DNA, 20 bp, Artificial Sequence
  Description of Artificial Sequence: Synthetic oligonucleotide
  Target: ATXN1; (+) strand; PAM type: NRG; PAM sequence: GGG
aaattctctagaaagtagga

SEQ ID NO: 121634 - DNA, 20 bp, Artificial Sequence
  Description of Artificial Sequence: Synthetic oligonucleotide
  Target: ATXN1; (+) strand; PAM type: NRG; PAM sequence: GAG
ctctagaaagtaggagggct

SEQ ID NO: 121635 - DNA, 20 bp, Artificial Sequence
  Description of Artificial Sequence: Synthetic oligonucleotide
  Target: ATXN1; (+) strand; PAM type: NRG; PAM sequence: TAG
agcacctttgcattatttcc

SEQ ID NO: 121636 - DNA, 20 bp, Artificial Sequence
  Description of Artificial Sequence: Synthetic oligonucleotide
  Target: ATXN1; (+) strand; PAM type: NRG; PAM sequence: TGG
acctttgcattatttcctag

SEQ ID NO: 121637 - DNA, 20 bp, Artificial Sequence
  Description of Artificial Sequence: Synthetic oligonucleotide
  Target: ATXN1; (+) strand; PAM type: NRG; PAM sequence: AAG
tttgcattatttcctagtgg

SEQ ID NO: 121638 - DNA, 20 bp, Artificial Sequence
  Description of Artificial Sequence: Synthetic oligonucleotide
  Target: ATXN1; (+) strand; PAM type: NRG; PAM sequence: AGG
ttgcattatttcctagtgga

SEQ ID NO: 121639 - DNA, 20 bp, Artificial Sequence
  Description of Artificial Sequence: Synthetic oligonucleotide
  Target: ATXN1; (+) strand; PAM type: NRG; PAM sequence: GGG
tgcattatttcctagtggaa

SEQ ID NO: 121640 - DNA, 20 bp, Artificial Sequence
  Description of Artificial Sequence: Synthetic oligonucleotide
  Target: ATXN1; (+) strand; PAM type: NRG; PAM sequence: AAG
cctagtggaagggctccctg

SEQ ID NO: 121641 - DNA, 20 bp, Artificial Sequence
  Description of Artificial Sequence: Synthetic oligonucleotide
  Target: ATXN1; (+) strand; PAM type: NRG; PAM sequence: AAG
gacactaaaacttctcatgc

SEQ ID NO: 121642 - DNA, 20 bp, Artificial Sequence
  Description of Artificial Sequence: Synthetic oligonucleotide
  Target: ATXN1; (+) strand; PAM type: NRG; PAM sequence: AGG
acactaaaacttctcatgca

SEQ ID NO: 121643 - DNA, 20 bp, Artificial Sequence
  Description of Artificial Sequence: Synthetic oligonucleotide
  Target: ATXN1; (+) strand; PAM type: NRG; PAM sequence: CGG
ctaaaacttctcatgcaagg

SEQ ID NO: 121644 - DNA, 20 bp, Artificial Sequence
  Description of Artificial Sequence: Synthetic oligonucleotide
  Target: ATXN1; (+) strand; PAM type: NRG; PAM sequence: CAG
ttctcatgcaaggcggccat

SEQ ID NO: 121645 - DNA, 20 bp, Artificial Sequence
  Description of Artificial Sequence: Synthetic oligonucleotide
  Target: ATXN1; (+) strand; PAM type: NRG; PAM sequence: AGG
tctcatgcaaggcggccatc

SEQ ID NO: 121646 - DNA, 20 bp, Artificial Sequence
  Description of Artificial Sequence: Synthetic oligonucleotide
  Target: ATXN1; (+) strand; PAM type: NRG; PAM sequence: TGG
ggcggccatcaggtgacatg

SEQ ID NO: 121647 - DNA, 20 bp, Artificial Sequence
  Description of Artificial Sequence: Synthetic oligonucleotide
  Target: ATXN1; (+) strand; PAM type: NRG; PAM sequence: GGG
gcggccatcaggtgacatgt

SEQ ID NO: 121648 - DNA, 20 bp, Artificial Sequence
  Description of Artificial Sequence: Synthetic oligonucleotide
  Target: ATXN1; (+) strand; PAM type: NRG; PAM sequence: AAG
tttactaatctcaaaatccc

SEQ ID NO: 121649 - DNA, 20 bp, Artificial Sequence
  Description of Artificial Sequence: Synthetic oligonucleotide
  Target: ATXN1; (+) strand; PAM type: NRG; PAM sequence: CAG
ctaatctcaaaatcccaagc

SEQ ID NO: 121650 - DNA, 20 bp, Artificial Sequence
  Description of Artificial Sequence: Synthetic oligonucleotide
  Target: ATXN1; (+) strand; PAM type: NRG; PAM sequence: CAG
agccagtaactgatcaaaac

SEQ ID NO: 121651 - DNA, 20 bp, Artificial Sequence
  Description of Artificial Sequence: Synthetic oligonucleotide
  Target: ATXN1; (+) strand; PAM type: NRG; PAM sequence: CAG
actgatcaaaaccagtaaat

SEQ ID NO: 121652 - DNA, 20 bp, Artificial Sequence
  Description of Artificial Sequence: Synthetic oligonucleotide
  Target: ATXN1; (+) strand; PAM type: NRG; PAM sequence: AAG
ccagtaaatcagctcatttt

SEQ ID NO: 121653 - DNA, 20 bp, Artificial Sequence
  Description of Artificial Sequence: Synthetic oligonucleotide
  Target: ATXN1; (+) strand; PAM type: NRG; PAM sequence: AAG
taaatcagctcattttaagt

SEQ ID NO: 121654 - DNA, 20 bp, Artificial Sequence
  Description of Artificial Sequence: Synthetic oligonucleotide
  Target: ATXN1; (+) strand; PAM type: NRG; PAM sequence: AGG
aaatcagctcattttaagta

SEQ ID NO: 121655 - DNA, 20 bp, Artificial Sequence
  Description of Artificial Sequence: Synthetic oligonucleotide
  Target: ATXN1; (+) strand; PAM type: NRG; PAM sequence: GGG
aatcagctcattttaagtaa

SEQ ID NO: 121656 - DNA, 20 bp, Artificial Sequence
  Description of Artificial Sequence: Synthetic oligonucleotide
  Target: ATXN1; (+) strand; PAM type: NRG; PAM sequence: AAG
cagctcattttaagtaaggg

SEQ ID NO: 121657 - DNA, 20 bp, Artificial Sequence
  Description of Artificial Sequence: Synthetic oligonucleotide
  Target: ATXN1; (+) strand; PAM type: NRG; PAM sequence: AAG
gcttgtaacttgcatacctc

SEQ ID NO: 121658 - DNA, 20 bp, Artificial Sequence
  Description of Artificial Sequence: Synthetic oligonucleotide
  Target: ATXN1; (+) strand; PAM type: NRG; PAM sequence: AAG
tgcatacctcaagattttac

SEQ ID NO: 121659 - DNA, 20 bp, Artificial Sequence
  Description of Artificial Sequence: Synthetic oligonucleotide
  Target: ATXN1; (+) strand; PAM type: NRG; PAM sequence: CAG
tacctcaagattttacaagc

SEQ ID NO: 121660 - DNA, 20 bp, Artificial Sequence
  Description of Artificial Sequence: Synthetic oligonucleotide
  Target: ATXN1; (+) strand; PAM type: NRG; PAM sequence: GAG
cctcaagattttacaagcca

SEQ ID NO: 121661 - DNA, 20 bp, Artificial Sequence
  Description of Artificial Sequence: Synthetic oligonucleotide
  Target: ATXN1; (+) strand; PAM type: NRG; PAM sequence: GAG
tcaagattttacaagccaga

SEQ ID NO: 121662 - DNA, 20 bp, Artificial Sequence
  Description of Artificial Sequence: Synthetic oligonucleotide
  Target: ATXN1; (+) strand; PAM type: NRG; PAM sequence: CAG
attttcatcaactgcacata

SEQ ID NO: 121663 - DNA, 20 bp, Artificial Sequence
  Description of Artificial Sequence: Synthetic oligonucleotide
  Target: ATXN1; (+) strand; PAM type: NRG; PAM sequence: AAG
ttcatcaactgcacatacag

SEQ ID NO: 121664 - DNA, 20 bp, Artificial Sequence
  Description of Artificial Sequence: Synthetic oligonucleotide
  Target: ATXN1; (+) strand; PAM type: NRG; PAM sequence: TGG
acatacagaagaataattgc

SEQ ID NO: 121665 - DNA, 20 bp, Artificial Sequence
  Description of Artificial Sequence: Synthetic oligonucleotide
  Target: ATXN1; (+) strand; PAM type: NRG; PAM sequence: TGG
acagaagaataattgctgga

SEQ ID NO: 121666 - DNA, 20 bp, Artificial Sequence
  Description of Artificial Sequence: Synthetic oligonucleotide
  Target: ATXN1; (+) strand; PAM type: NRG; PAM sequence: TAG
aaactctgattgctaatcct

SEQ ID NO: 121667 - DNA, 20 bp, Artificial Sequence
  Description of Artificial Sequence: Synthetic oligonucleotide
  Target: ATXN1; (+) strand; PAM type: NRG; PAM sequence: TGG
ctgattgctaatccttagcc

SEQ ID NO: 121668 - DNA, 20 bp, Artificial Sequence
  Description of Artificial Sequence: Synthetic oligonucleotide
  Target: ATXN1; (+) strand; PAM type: NRG; PAM sequence: GAG
gattgctaatccttagcctg

SEQ ID NO: 121669 - DNA, 20 bp, Artificial Sequence
  Description of Artificial Sequence: Synthetic oligonucleotide
  Target: ATXN1; (+) strand; PAM type: NRG; PAM sequence: AAG
ccccctactcaccaacctaa

SEQ ID NO: 121670 - DNA, 20 bp, Artificial Sequence
  Description of Artificial Sequence: Synthetic oligonucleotide
  Target: ATXN1; (+) strand; PAM type: NRG; PAM sequence: CAG
ccaacctaaaagaactgcaa

SEQ ID NO: 121671 - DNA, 20 bp, Artificial Sequence
  Description of Artificial Sequence: Synthetic oligonucleotide
  Target: ATXN1; (+) strand; PAM type: NRG; PAM sequence: CAG
ctaaaagaactgcaacagcc

SEQ ID NO: 121672 - DNA, 20 bp, Artificial Sequence
  Description of Artificial Sequence: Synthetic oligonucleotide
  Target: ATXN1; (+) strand; PAM type: NRG; PAM sequence: AAG
aactgcaacagcccagttta

SEQ ID NO: 121673 - DNA, 20 bp, Artificial Sequence
  Description of Artificial Sequence: Synthetic oligonucleotide
  Target: ATXN1; (+) strand; PAM type: NRG; PAM sequence: AGG
actgcaacagcccagtttaa

SEQ ID NO: 121674 - DNA, 20 bp, Artificial Sequence
  Description of Artificial Sequence: Synthetic oligonucleotide
  Target: ATXN1; (+) strand; PAM type: NRG; PAM sequence: GGG
ctgcaacagcccagtttaaa

SEQ ID NO: 121675 - DNA, 20 bp, Artificial Sequence
  Description of Artificial Sequence: Synthetic oligonucleotide
  Target: ATXN1; (+) strand; PAM type: NRG; PAM sequence: GGG
tgcaacagcccagtttaaag

SEQ ID NO: 121676 - DNA, 20 bp, Artificial Sequence
  Description of Artificial Sequence: Synthetic oligonucleotide
  Target: ATXN1; (+) strand; PAM type: NRG; PAM sequence: CAG
ctgatactatttgactgtac

SEQ ID NO: 121677 - DNA, 20 bp, Artificial Sequence
  Description of Artificial Sequence: Synthetic oligonucleotide
  Target: ATXN1; (+) strand; PAM type: NRG; PAM sequence: TAG
atactatttgactgtaccag

SEQ ID NO: 121678 - DNA, 20 bp, Artificial Sequence
  Description of Artificial Sequence: Synthetic oligonucleotide
  Target: ATXN1; (+) strand; PAM type: NRG; PAM sequence: AAG
atttgactgtaccagtagaa

SEQ ID NO: 121679 - DNA, 20 bp, Artificial Sequence
  Description of Artificial Sequence: Synthetic oligonucleotide
  Target: ATXN1; (+) strand; PAM type: NRG; PAM sequence: AGG
tttgactgtaccagtagaaa

SEQ ID NO: 121680 - DNA, 20 bp, Artificial Sequence
  Description of Artificial Sequence: Synthetic oligonucleotide
  Target: ATXN1; (+) strand; PAM type: NRG; PAM sequence: AAG
aaaaggtgttcctacaatga

SEQ ID NO: 121681 - DNA, 20 bp, Artificial Sequence
  Description of Artificial Sequence: Synthetic oligonucleotide
  Target: ATXN1; (+) strand; PAM type: NRG; PAM sequence: AAG
attccatccttttattcctg

SEQ ID NO: 121682 - DNA, 20 bp, Artificial Sequence
  Description of Artificial Sequence: Synthetic oligonucleotide
  Target: ATXN1; (+) strand; PAM type: NRG; PAM sequence: TAG
ccatccttttattcctgaag

SEQ ID NO: 121683 - DNA, 20 bp, Artificial Sequence
  Description of Artificial Sequence: Synthetic oligonucleotide
  Target: ATXN1; (+) strand; PAM type: NRG; PAM sequence: TAG
ccttttattcctgaagtaga

SEQ ID NO: 121684 - DNA, 20 bp, Artificial Sequence
  Description of Artificial Sequence: Synthetic oligonucleotide
  Target: ATXN1; (+) strand; PAM type: NRG; PAM sequence: CAG
ttcctgaagtagatagtttg

SEQ ID NO: 121685 - DNA, 20 bp, Artificial Sequence
  Description of Artificial Sequence: Synthetic oligonucleotide
  Target: ATXN1; (+) strand; PAM type: NRG; PAM sequence: TAG
agatagtttgcagcatgcca

SEQ ID NO: 121686 - DNA, 20 bp, Artificial Sequence
  Description of Artificial Sequence: Synthetic oligonucleotide
  Target: ATXN1; (+) strand; PAM type: NRG; PAM sequence: AAG
tagtttgcagcatgccatag

SEQ ID NO: 121687 - DNA, 20 bp, Artificial Sequence
  Description of Artificial Sequence: Synthetic oligonucleotide
  Target: ATXN1; (+) strand; PAM type: NRG; PAM sequence: GAG
tgcagcatgccatagaagcc

SEQ ID NO: 121688 - DNA, 20 bp, Artificial Sequence
  Description of Artificial Sequence: Synthetic oligonucleotide
  Target: ATXN1; (+) strand; PAM type: NRG; PAM sequence: GAG
cagcatgccatagaagccga

SEQ ID NO: 121689 - DNA, 20 bp, Artificial Sequence
  Description of Artificial Sequence: Synthetic oligonucleotide
  Target: ATXN1; (+) strand; PAM type: NRG; PAM sequence: AAG
atgccatagaagccgagaga

SEQ ID NO: 121690 - DNA, 20 bp, Artificial Sequence
  Description of Artificial Sequence: Synthetic oligonucleotide
  Target: ATXN1; (+) strand; PAM type: NRG; PAM sequence: AGG
tgccatagaagccgagagaa

SEQ ID NO: 121691 - DNA, 20 bp, Artificial Sequence
  Description of Artificial Sequence: Synthetic oligonucleotide
  Target: ATXN1; (+) strand; PAM type: NRG; PAM sequence: AAG
atagaagccgagagaaaggc

SEQ ID NO: 121692 - DNA, 20 bp, Artificial Sequence
  Description of Artificial Sequence: Synthetic oligonucleotide
  Target: ATXN1; (+) strand; PAM type: NRG; PAM sequence: CAG
gccgagagaaaggcaagttc

SEQ ID NO: 121693 - DNA, 20 bp, Artificial Sequence
  Description of Artificial Sequence: Synthetic oligonucleotide
  Target: ATXN1; (+) strand; PAM type: NRG; PAM sequence: CAG
caagttccagcaaatacaaa

SEQ ID NO: 121694 - DNA, 20 bp, Artificial Sequence
  Description of Artificial Sequence: Synthetic oligonucleotide
  Target: ATXN1; (+) strand; PAM type: NRG; PAM sequence: AGG
aagttccagcaaatacaaac

SEQ ID NO: 121695 - DNA, 20 bp, Artificial Sequence
  Description of Artificial Sequence: Synthetic oligonucleotide
  Target: ATXN1; (+) strand; PAM type: NRG; PAM sequence: AAG
aattcccttccaattaaaaa

SEQ ID NO: 121696 - DNA, 20 bp, Artificial Sequence
  Description of Artificial Sequence: Synthetic oligonucleotide
  Target: ATXN1; (+) strand; PAM type: NRG; PAM sequence: TGG
aattaaaaaaagaaattaat

SEQ ID NO: 121697 - DNA, 20 bp, Artificial Sequence
  Description of Artificial Sequence: Synthetic oligonucleotide
  Target: ATXN1; (+) strand; PAM type: NRG; PAM sequence: TAG
aaattaattggacgatcacc

SEQ ID NO: 121698 - DNA, 20 bp, Artificial Sequence
  Description of Artificial Sequence: Synthetic oligonucleotide
  Target: ATXN1; (+) strand; PAM type: NRG; PAM sequence: GAG
attaattggacgatcaccta

SEQ ID NO: 121699 - DNA, 20 bp, Artificial Sequence
  Description of Artificial Sequence: Synthetic oligonucleotide
  Target: ATXN1; (+) strand; PAM type: NRG; PAM sequence: TGG
gctaataccccttcaacacc

SEQ ID NO: 121700 - DNA, 20 bp, Artificial Sequence
  Description of Artificial Sequence: Synthetic oligonucleotide
  Target: ATXN1; (+) strand; PAM type: NRG; PAM sequence: CGG
taccccttcaacacctggct

SEQ ID NO: 121701 - DNA, 20 bp, Artificial Sequence
  Description of Artificial Sequence: Synthetic oligonucleotide
  Target: ATXN1; (+) strand; PAM type: NRG; PAM sequence: AAG
acacctggctcggttacatc

SEQ ID NO: 121702 - DNA, 20 bp, Artificial Sequence
  Description of Artificial Sequence: Synthetic oligonucleotide
  Target: ATXN1; (+) strand; PAM type: NRG; PAM sequence: AAG
aagtgattcatgaatcctac

SEQ ID NO: 121703 - DNA, 20 bp, Artificial Sequence
  Description of Artificial Sequence: Synthetic oligonucleotide
  Target: ATXN1; (+) strand; PAM type: NRG; PAM sequence: AGG
agtgattcatgaatcctaca

SEQ ID NO: 121704 - DNA, 20 bp, Artificial Sequence
  Description of Artificial Sequence: Synthetic oligonucleotide
  Target: ATXN1; (+) strand; PAM type: NRG; PAM sequence: AAG
attcatgaatcctacaaggc

SEQ ID NO: 121705 - DNA, 20 bp, Artificial Sequence
  Description of Artificial Sequence: Synthetic oligonucleotide
  Target: ATXN1; (+) strand; PAM type: NRG; PAM sequence: TGG
gccactacacatattgttct

SEQ ID NO: 121706 - DNA, 20 bp, Artificial Sequence
  Description of Artificial Sequence: Synthetic oligonucleotide
  Target: ATXN1; (+) strand; PAM type: NRG; PAM sequence: CAG
cattcactgcgtactgttca

SEQ ID NO: 121707 - DNA, 20 bp, Artificial Sequence
  Description of Artificial Sequence: Synthetic oligonucleotide
  Target: ATXN1; (+) strand; PAM type: NRG; PAM sequence: AGG
attcactgcgtactgttcac

SEQ ID NO: 121708 - DNA, 20 bp, Artificial Sequence
  Description of Artificial Sequence: Synthetic oligonucleotide
  Target: ATXN1; (+) strand; PAM type: NRG; PAM sequence: TAG
cactgcgtactgttcacagg

SEQ ID NO: 121709 - DNA, 20 bp, Artificial Sequence
  Description of Artificial Sequence: Synthetic oligonucleotide
  Target: ATXN1; (+) strand; PAM type: NRG; PAM sequence: CAG
gtactgttcacaggtagcct

SEQ ID NO: 121710 - DNA, 20 bp, Artificial Sequence
  Description of Artificial Sequence: Synthetic oligonucleotide
  Target: ATXN1; (+) strand; PAM type: NRG; PAM sequence: TGG
cctcagcctatacttcacca

SEQ ID NO: 121711 - DNA, 20 bp, Artificial Sequence
  Description of Artificial Sequence: Synthetic oligonucleotide
  Target: ATXN1; (+) strand; PAM type: NRG; PAM sequence: GAG
tcagcctatacttcaccatg

SEQ ID NO: 121712 - DNA, 20 bp, Artificial Sequence
  Description of Artificial Sequence: Synthetic oligonucleotide
  Target: ATXN1; (+) strand; PAM type: NRG; PAM sequence: CAG
ttcaccatggagacttccca

SEQ ID NO: 121713 - DNA, 20 bp, Artificial Sequence
  Description of Artificial Sequence: Synthetic oligonucleotide
  Target: ATXN1; (+) strand; PAM type: NRG; PAM sequence: AGG
tcaccatggagacttcccac

SEQ ID NO: 121714 - DNA, 20 bp, Artificial Sequence
  Description of Artificial Sequence: Synthetic oligonucleotide
  Target: ATXN1; (+) strand; PAM type: NRG; PAM sequence: TGG
tggagacttcccacaggctc

SEQ ID NO: 121715 - DNA, 20 bp, Artificial Sequence
  Description of Artificial Sequence: Synthetic oligonucleotide
  Target: ATXN1; (+) strand; PAM type: NRG; PAM sequence: GAG
gagacttcccacaggctctg

SEQ ID NO: 121716 - DNA, 20 bp, Artificial Sequence
  Description of Artificial Sequence: Synthetic oligonucleotide
  Target: ATXN1; (+) strand; PAM type: NRG; PAM sequence: AGG
agacttcccacaggctctgg

SEQ ID NO: 121717 - DNA, 20 bp, Artificial Sequence
  Description of Artificial Sequence: Synthetic oligonucleotide
  Target: ATXN1; (+) strand; PAM type: NRG; PAM sequence: GGG
gacttcccacaggctctgga

SEQ ID NO: 121718 - DNA, 20 bp, Artificial Sequence
  Description of Artificial Sequence: Synthetic oligonucleotide
  Target: ATXN1; (+) strand; PAM type: NRG; PAM sequence: GAG
acaggctctggagggctcct

SEQ ID NO: 121719 - DNA, 20 bp, Artificial Sequence
  Description of Artificial Sequence: Synthetic oligonucleotide
  Target: ATXN1; (+) strand; PAM type: NRG; PAM sequence: AGG
caggctctggagggctcctg

SEQ ID NO: 121720 - DNA, 20 bp, Artificial Sequence
  Description of Artificial Sequence: Synthetic oligonucleotide
  Target: ATXN1; (+) strand; PAM type: NRG; PAM sequence: GGG
aggctctggagggctcctga

SEQ ID NO: 121721 - DNA, 20 bp, Artificial Sequence
  Description of Artificial Sequence: Synthetic oligonucleotide
  Target: ATXN1; (+) strand; PAM type: NRG; PAM sequence: TGG
ggagggctcctgagggctct

SEQ ID NO: 121722 - DNA, 20 bp, Artificial Sequence
  Description of Artificial Sequence: Synthetic oligonucleotide
  Target: ATXN1; (+) strand; PAM type: NRG; PAM sequence: GGG
gagggctcctgagggctctt

SEQ ID NO: 121723 - DNA, 20 bp, Artificial Sequence
  Description of Artificial Sequence: Synthetic oligonucleotide
  Target: ATXN1; (+) strand; PAM type: NRG; PAM sequence: CAG
ctcctgagggctcttgggct

SEQ ID NO: 121724 - DNA, 20 bp, Artificial Sequence
  Description of Artificial Sequence: Synthetic oligonucleotide
  Target: ATXN1; (+) strand; PAM type: NRG; PAM sequence: AGG
tcctgagggctcttgggctc

SEQ ID NO: 121725 - DNA, 20 bp, Artificial Sequence
  Description of Artificial Sequence: Synthetic oligonucleotide
  Target: ATXN1; (+) strand; PAM type: NRG; PAM sequence: CAG
cgtgttctttcttcctttca

SEQ ID NO: 121726 - DNA, 20 bp, Artificial Sequence
  Description of Artificial Sequence: Synthetic oligonucleotide
  Target: ATXN1; (+) strand; PAM type: NRG; PAM sequence: GAG
tgttctttcttcctttcaca

SEQ ID NO: 121727 - DNA, 20 bp, Artificial Sequence
  Description of Artificial Sequence: Synthetic oligonucleotide
  Target: ATXN1; (+) strand; PAM type: NRG; PAM sequence: AAG
tctttcttcctttcacagag

SEQ ID NO: 121728 - DNA, 20 bp, Artificial Sequence
  Description of Artificial Sequence: Synthetic oligonucleotide
  Target: ATXN1; (+) strand; PAM type: NRG; PAM sequence: GAG
tcttcctttcacagagaagt

SEQ ID NO: 121729 - DNA, 20 bp, Artificial Sequence
  Description of Artificial Sequence: Synthetic oligonucleotide
  Target: ATXN1; (+) strand; PAM type: NRG; PAM sequence: TAG
acagagaagtgagaaatacc

SEQ ID NO: 121730 - DNA, 20 bp, Artificial Sequence
  Description of Artificial Sequence: Synthetic oligonucleotide
  Target: ATXN1; (+) strand; PAM type: NRG; PAM sequence: TGG
gaagtgagaaatacctagca

SEQ ID NO: 121731 - DNA, 20 bp, Artificial Sequence
  Description of Artificial Sequence: Synthetic oligonucleotide
  Target: ATXN1; (+) strand; PAM type: NRG; PAM sequence: TAG
agaaatacctagcatggaaa

SEQ ID NO: 121732 - DNA, 20 bp, Artificial Sequence
  Description of Artificial Sequence: Synthetic oligonucleotide
  Target: ATXN1; (+) strand; PAM type: NRG; PAM sequence: CAG
tacctagcatggaaatagaa

SEQ ID NO: 121733 - DNA, 20 bp, Artificial Sequence
  Description of Artificial Sequence: Synthetic oligonucleotide
  Target: ATXN1; (+) strand; PAM type: NRG; PAM sequence: AAG
ctagcatggaaatagaacag

SEQ ID NO: 121734 - DNA, 20 bp, Artificial Sequence
  Description of Artificial Sequence: Synthetic oligonucleotide
  Target: ATXN1; (+) strand; PAM type: NRG; PAM sequence: AAG
tggaaatagaacagaagaaa

SEQ ID NO: 121735 - DNA, 20 bp, Artificial Sequence
  Description of Artificial Sequence: Synthetic oligonucleotide
  Target: ATXN1; (+) strand; PAM type: NRG; PAM sequence: AAG
tagaacagaagaaaaagaaa

SEQ ID NO: 121736 - DNA, 20 bp, Artificial Sequence
  Description of Artificial Sequence: Synthetic oligonucleotide
  Target: ATXN1; (+) strand; PAM type: NRG; PAM sequence: AGG
agaacagaagaaaaagaaaa

SEQ ID NO: 121737 - DNA, 20 bp, Artificial Sequence
  Description of Artificial Sequence: Synthetic oligonucleotide
  Target: ATXN1; (+) strand; PAM type: NRG; PAM sequence: CAG
acttgttatctgaacaaata

SEQ ID NO: 121738 - DNA, 20 bp, Artificial Sequence
  Description of Artificial Sequence: Synthetic oligonucleotide
  Target: ATXN1; (+) strand; PAM type: NRG; PAM sequence: TAG
aatacagtctcacgaccaat

SEQ ID NO: 121739 - DNA, 20 bp, Artificial Sequence
  Description of Artificial Sequence: Synthetic oligonucleotide
  Target: ATXN1; (+) strand; PAM type: NRG; PAM sequence: TAG
cgaccaattagacgaattga

SEQ ID NO: 121740 - DNA, 20 bp, Artificial Sequence
  Description of Artificial Sequence: Synthetic oligonucleotide
  Target: ATXN1; (+) strand; PAM type: NRG; PAM sequence: AAG
gacgaattgatagttcacca

SEQ ID NO: 121741 - DNA, 20 bp, Artificial Sequence
  Description of Artificial Sequence: Synthetic oligonucleotide
  Target: ATXN1; (+) strand; PAM type: NRG; PAM sequence: AAG
caaagaccattttcttaaaa

SEQ ID NO: 121742 - DNA, 20 bp, Artificial Sequence
  Description of Artificial Sequence: Synthetic oligonucleotide
  Target: ATXN1; (+) strand; PAM type: NRG; PAM sequence: AAG
agaccattttcttaaaaaag

SEQ ID NO: 121743 - DNA, 20 bp, Artificial Sequence
  Description of Artificial Sequence: Synthetic oligonucleotide
  Target: ATXN1; (+) strand; PAM type: NRG; PAM sequence: AAG
gttcttgctcttttcccaaa

SEQ ID NO: 121744 - DNA, 20 bp, Artificial Sequence
  Description of Artificial Sequence: Synthetic oligonucleotide
  Target: ATXN1; (+) strand; PAM type: NRG; PAM sequence: TGG
ttcccaaaaagaacacaaca

SEQ ID NO: 121745 - DNA, 20 bp, Artificial Sequence
  Description of Artificial Sequence: Synthetic oligonucleotide
  Target: ATXN1; (+) strand; PAM type: NRG; PAM sequence: CAG
aaaaagaacacaacatggta

SEQ ID NO: 121746 - DNA, 20 bp, Artificial Sequence
  Description of Artificial Sequence: Synthetic oligonucleotide
  Target: ATXN1; (+) strand; PAM type: NRG; PAM sequence: CAG
agaacacaacatggtacagc

SEQ ID NO: 121747 - DNA, 20 bp, Artificial Sequence
  Description of Artificial Sequence: Synthetic oligonucleotide
  Target: ATXN1; (+) strand; PAM type: NRG; PAM sequence: AAG
gccagcctctcctcacccca

SEQ ID NO: 121748 - DNA, 20 bp, Artificial Sequence
  Description of Artificial Sequence: Synthetic oligonucleotide
  Target: ATXN1; (+) strand; PAM type: NRG; PAM sequence: AAG
ctctcctcaccccaaagttg

SEQ ID NO: 121749 - DNA, 20 bp, Artificial Sequence
  Description of Artificial Sequence: Synthetic oligonucleotide
  Target: ATXN1; (+) strand; PAM type: NRG; PAM sequence: TGG
cccaaagttgaagccatttc

SEQ ID NO: 121750 - DNA, 20 bp, Artificial Sequence
  Description of Artificial Sequence: Synthetic oligonucleotide
  Target: ATXN1; (+) strand; PAM type: NRG; PAM sequence: GGG
ccaaagttgaagccatttct

SEQ ID NO: 121751 - DNA, 20 bp, Artificial Sequence
  Description of Artificial Sequence: Synthetic oligonucleotide
  Target: ATXN1; (+) strand; PAM type: NRG; PAM sequence: GAG
aaagttgaagccatttctgg

SEQ ID NO: 121752 - DNA, 20 bp, Artificial Sequence
  Description of Artificial Sequence: Synthetic oligonucleotide
  Target: ATXN1; (+) strand; PAM type: NRG; PAM sequence: CAG
aagccatttctgggagactt

SEQ ID NO: 121753 - DNA, 20 bp, Artificial Sequence
  Description of Artificial Sequence: Synthetic oligonucleotide
  Target: ATXN1; (+) strand; PAM type: NRG; PAM sequence: TAG
ggagacttcagacacaatct

SEQ ID NO: 121754 - DNA, 20 bp, Artificial Sequence
  Description of Artificial Sequence: Synthetic oligonucleotide
  Target: ATXN1; (+) strand; PAM type: NRG; PAM sequence: GAG
cttcagacacaatcttagct

SEQ ID NO: 121755 - DNA, 20 bp, Artificial Sequence
  Description of Artificial Sequence: Synthetic oligonucleotide
  Target: ATXN1; (+) strand; PAM type: NRG; PAM sequence: AAG
gctgagatgcaaacttgcaa

SEQ ID NO: 121756 - DNA, 20 bp, Artificial Sequence
  Description of Artificial Sequence: Synthetic oligonucleotide
  Target: ATXN1; (+) strand; PAM type: NRG; PAM sequence: CAG
aacttgcaaaagcctcaaaa

SEQ ID NO: 121757 - DNA, 20 bp, Artificial Sequence
  Description of Artificial Sequence: Synthetic oligonucleotide
  Target: ATXN1; (+) strand; PAM type: NRG; PAM sequence: AGG
acttgcaaaagcctcaaaac

SEQ ID NO: 121758 - DNA, 20 bp, Artificial Sequence
  Description of Artificial Sequence: Synthetic oligonucleotide
  Target: ATXN1; (+) strand; PAM type: NRG; PAM sequence: TGG
aagcctcaaaacaggccact

SEQ ID NO: 121759 - DNA, 20 bp, Artificial Sequence
  Description of Artificial Sequence: Synthetic oligonucleotide
  Target: ATXN1; (+) strand; PAM type: NRG; PAM sequence: AAG
ttggctttactcttctgcaa

SEQ ID NO: 121760 - DNA, 20 bp, Artificial Sequence
  Description of Artificial Sequence: Synthetic oligonucleotide
  Target: ATXN1; (+) strand; PAM type: NRG; PAM sequence: AGG
tggctttactcttctgcaaa

SEQ ID NO: 121761 - DNA, 20 bp, Artificial Sequence
  Description of Artificial Sequence: Synthetic oligonucleotide
  Target: ATXN1; (+) strand; PAM type: NRG; PAM sequence: GAG
gctttactcttctgcaaaag

SEQ ID NO: 121762 - DNA, 20 bp, Artificial Sequence
  Description of Artificial Sequence: Synthetic oligonucleotide
  Target: ATXN1; (+) strand; PAM type: NRG; PAM sequence: AGG
ctttactcttctgcaaaagg

SEQ ID NO: 121763 - DNA, 20 bp, Artificial Sequence
  Description of Artificial Sequence: Synthetic oligonucleotide
  Target: ATXN1; (+) strand; PAM type: NRG; PAM sequence: AAG
actcttctgcaaaaggaggc

SEQ ID NO: 121764 - DNA, 20 bp, Artificial Sequence
  Description of Artificial Sequence: Synthetic oligonucleotide
  Target: ATXN1; (+) strand; PAM type: NRG; PAM sequence: AGG
ctcttctgcaaaaggaggca

SEQ ID NO: 121765 - DNA, 20 bp, Artificial Sequence
  Description of Artificial Sequence: Synthetic oligonucleotide
  Target: ATXN1; (+) strand; PAM type: NRG; PAM sequence: TAG
ctgcaaaaggaggcaaggac

SEQ ID NO: 121766 - DNA, 20 bp, Artificial Sequence
  Description of Artificial Sequence: Synthetic oligonucleotide
  Target: ATXN1; (+) strand; PAM type: NRG; PAM sequence: TGG
ctgccactgtcatatcttac

SEQ ID NO: 121767 - DNA, 20 bp, Artificial Sequence
  Description of Artificial Sequence: Synthetic oligonucleotide
  Target: ATXN1; (+) strand; PAM type: NRG; PAM sequence: GGG
tgccactgtcatatcttact

SEQ ID NO: 121768 - DNA, 20 bp, Artificial Sequence
  Description of Artificial Sequence: Synthetic oligonucleotide
  Target: ATXN1; (+) strand; PAM type: NRG; PAM sequence: TGG
tgtcatatcttactgggtca

SEQ ID NO: 121769 - DNA, 20 bp, Artificial Sequence
  Description of Artificial Sequence: Synthetic oligonucleotide
  Target: ATXN1; (+) strand; PAM type: NRG; PAM sequence: GAG
tcatatcttactgggtcatg

SEQ ID NO: 121770 - DNA, 20 bp, Artificial Sequence
  Description of Artificial Sequence: Synthetic oligonucleotide
  Target: ATXN1; (+) strand; PAM type: NRG; PAM sequence: AAG
tatcttactgggtcatggag

SEQ ID NO: 121771 - DNA, 20 bp, Artificial Sequence
  Description of Artificial Sequence: Synthetic oligonucleotide
  Target: ATXN1; (+) strand; PAM type: NRG; PAM sequence: AAG
actgggtcatggagaagatc

SEQ ID NO: 121772 - DNA, 20 bp, Artificial Sequence
  Description of Artificial Sequence: Synthetic oligonucleotide
  Target: ATXN1; (+) strand; PAM type: NRG; PAM sequence: AAG
gggtcatggagaagatcaag

SEQ ID NO: 121773 - DNA, 20 bp, Artificial Sequence
  Description of Artificial Sequence: Synthetic oligonucleotide
  Target: ATXN1; (+) strand; PAM type: NRG; PAM sequence: AAG
tcaagaagatcattcttgca

SEQ ID NO: 121774 - DNA, 20 bp, Artificial Sequence
  Description of Artificial Sequence: Synthetic oligonucleotide
  Target: ATXN1; (+) strand; PAM type: NRG; PAM sequence: CAG
tcattcttgcaaagcacaca

SEQ ID NO: 121775 - DNA, 20 bp, Artificial Sequence
  Description of Artificial Sequence: Synthetic oligonucleotide
  Target: ATXN1; (+) strand; PAM type: NRG; PAM sequence: GAG
gcaaagcacacacagttccc

SEQ ID NO: 121776 - DNA, 20 bp, Artificial Sequence
  Description of Artificial Sequence: Synthetic oligonucleotide
  Target: ATXN1; (+) strand; PAM type: NRG; PAM sequence: AAG
aagcacacacagttcccgag

SEQ ID NO: 121777 - DNA, 20 bp, Artificial Sequence
  Description of Artificial Sequence: Synthetic oligonucleotide
  Target: ATXN1; (+) strand; PAM type: NRG; PAM sequence: AAG
aaatccactatgttaatgca

SEQ ID NO: 121778 - DNA, 20 bp, Artificial Sequence
  Description of Artificial Sequence: Synthetic oligonucleotide
  Target: ATXN1; (+) strand; PAM type: NRG; PAM sequence: TGG
atgttaatgcaaagcgttgt

SEQ ID NO: 121779 - DNA, 20 bp, Artificial Sequence
  Description of Artificial Sequence: Synthetic oligonucleotide
  Target: ATXN1; (+) strand; PAM type: NRG; PAM sequence: TGG
ttaatgcaaagcgttgttgg

SEQ ID NO: 121780 - DNA, 20 bp, Artificial Sequence
  Description of Artificial Sequence: Synthetic oligonucleotide
  Target: ATXN1; (+) strand; PAM type: NRG; PAM sequence: AAG
aaagcgttgttggtggtcat

SEQ ID NO: 121781 - DNA, 20 bp, Artificial Sequence
  Description of Artificial Sequence: Synthetic oligonucleotide
  Target: ATXN1; (+) strand; PAM type: NRG; PAM sequence: GAG
gtggtcataagcctgttcct

SEQ ID NO: 121782 - DNA, 20 bp, Artificial Sequence
  Description of Artificial Sequence: Synthetic oligonucleotide
  Target: ATXN1; (+) strand; PAM type: NRG; PAM sequence: TGG
ataagcctgttcctgagctc

SEQ ID NO: 121783 - DNA, 20 bp, Artificial Sequence
  Description of Artificial Sequence: Synthetic oligonucleotide
  Target: ATXN1; (+) strand; PAM type: NRG; PAM sequence: GAG
aagcctgttcctgagctctg

SEQ ID NO: 121784 - DNA, 20 bp, Artificial Sequence
  Description of Artificial Sequence: Synthetic oligonucleotide
  Target: ATXN1; (+) strand; PAM type: NRG; PAM sequence: CAG
ctgttcctgagctctggagc

SEQ ID NO: 121785 - DNA, 20 bp, Artificial Sequence
  Description of Artificial Sequence: Synthetic oligonucleotide
  Target: ATXN1; (+) strand; PAM type: NRG; PAM sequence: AAG
gctctggagccagaatacaa

SEQ ID NO: 121786 - DNA, 20 bp, Artificial Sequence
  Description of Artificial Sequence: Synthetic oligonucleotide
  Target: ATXN1; (+) strand; PAM type: NRG; PAM sequence: CAG
tggagccagaatacaaaagc

SEQ ID NO: 121787 - DNA, 20 bp, Artificial Sequence
  Description of Artificial Sequence: Synthetic oligonucleotide
  Target: ATXN1; (+) strand; PAM type: NRG; PAM sequence: TGG
cagaatacaaaagccagcac

SEQ ID NO: 121788 - DNA, 20 bp, Artificial Sequence
  Description of Artificial Sequence: Synthetic oligonucleotide
  Target: ATXN1; (+) strand; PAM type: NRG; PAM sequence: AAG
atacaaaagccagcactggt

SEQ ID NO: 121789 - DNA, 20 bp, Artificial Sequence
  Description of Artificial Sequence: Synthetic oligonucleotide
  Target: ATXN1; (+) strand; PAM type: NRG; PAM sequence: AGG
tacaaaagccagcactggta

SEQ ID NO: 121790 - DNA, 20 bp, Artificial Sequence
  Description of Artificial Sequence: Synthetic oligonucleotide
  Target: ATXN1; (+) strand; PAM type: NRG; PAM sequence: CGG
gcaccaatcatcaactatcc

SEQ ID NO: 121791 - DNA, 20 bp, Artificial Sequence
  Description of Artificial Sequence: Synthetic oligonucleotide
  Target: ATXN1; (+) strand; PAM type: NRG; PAM sequence: GGG
caccaatcatcaactatccc

SEQ ID NO: 121792 - DNA, 20 bp, Artificial Sequence
  Description of Artificial Sequence: Synthetic oligonucleotide
  Target: ATXN1; (+) strand; PAM type: NRG; PAM sequence: GAG
ccaatcatcaactatcccgg

SEQ ID NO: 121793 - DNA, 20 bp, Artificial Sequence
  Description of Artificial Sequence: Synthetic oligonucleotide
  Target: ATXN1; (+) strand; PAM type: NRG; PAM sequence: GAG
tctgcatgccctactgtgct

SEQ ID NO: 121794 - DNA, 20 bp, Artificial Sequence
  Description of Artificial Sequence: Synthetic oligonucleotide
  Target: ATXN1; (+) strand; PAM type: NRG; PAM sequence: CAG
tgccctactgtgctgagttt

SEQ ID NO: 121795 - DNA, 20 bp, Artificial Sequence
  Description of Artificial Sequence: Synthetic oligonucleotide
  Target: ATXN1; (+) strand; PAM type: NRG; PAM sequence: AGG
gccctactgtgctgagtttc

SEQ ID NO: 121796 - DNA, 20 bp, Artificial Sequence
  Description of Artificial Sequence: Synthetic oligonucleotide
  Target: ATXN1; (+) strand; PAM type: NRG; PAM sequence: AAG
tactgtgctgagtttcagga

SEQ ID NO: 121797 - DNA, 20 bp, Artificial Sequence
  Description of Artificial Sequence: Synthetic oligonucleotide
  Target: ATXN1; (+) strand; PAM type: NRG; PAM sequence: TAG
tgctgagtttcaggaaagaa

SEQ ID NO: 121798 - DNA, 20 bp, Artificial Sequence
  Description of Artificial Sequence: Synthetic oligonucleotide
  Target: ATXN1; (+) strand; PAM type: NRG; PAM sequence: AGG
gctgagtttcaggaaagaat

SEQ ID NO: 121799 - DNA, 20 bp, Artificial Sequence
  Description of Artificial Sequence: Synthetic oligonucleotide
  Target: ATXN1; (+) strand; PAM type: NRG; PAM sequence: CAG
gtttcaggaaagaataggaa

SEQ ID NO: 121800 - DNA, 20 bp, Artificial Sequence
  Description of Artificial Sequence: Synthetic oligonucleotide
  Target: ATXN1; (+) strand; PAM type: NRG; PAM sequence: AAG
aaagaataggaacagaaacg

SEQ ID NO: 121801 - DNA, 20 bp, Artificial Sequence
  Description of Artificial Sequence: Synthetic oligonucleotide
  Target: ATXN1; (+) strand; PAM type: NRG; PAM sequence: TGG
aggaacagaaacgaagaatc

SEQ ID NO: 121802 - DNA, 20 bp, Artificial Sequence
  Description of Artificial Sequence: Synthetic oligonucleotide
  Target: ATXN1; (+) strand; PAM type: NRG; PAM sequence: CGG
aacgaagaatctggaatctc

SEQ ID NO: 121803 - DNA, 20 bp, Artificial Sequence
  Description of Artificial Sequence: Synthetic oligonucleotide
  Target: ATXN1; (+) strand; PAM type: NRG; PAM sequence: GGG
acgaagaatctggaatctcc

SEQ ID NO: 121804 - DNA, 20 bp, Artificial Sequence
  Description of Artificial Sequence: Synthetic oligonucleotide
  Target: ATXN1; (+) strand; PAM type: NRG; PAM sequence: AAG
aatctggaatctccgggaaa

SEQ ID NO: 121805 - DNA, 20 bp, Artificial Sequence
  Description of Artificial Sequence: Synthetic oligonucleotide
  Target: ATXN1; (+) strand; PAM type: NRG; PAM sequence: AAG
tggaatctccgggaaaaaga

SEQ ID NO: 121806 - DNA, 20 bp, Artificial Sequence
  Description of Artificial Sequence: Synthetic oligonucleotide
  Target: ATXN1; (+) strand; PAM type: NRG; PAM sequence: AAG
tctccgggaaaaagaaagtg

SEQ ID NO: 121807 - DNA, 20 bp, Artificial Sequence
  Description of Artificial Sequence: Synthetic oligonucleotide
  Target: ATXN1; (+) strand; PAM type: NRG; PAM sequence: AGG
ctccgggaaaaagaaagtga

SEQ ID NO: 121808 - DNA, 20 bp, Artificial Sequence
  Description of Artificial Sequence: Synthetic oligonucleotide
  Target: ATXN1; (+) strand; PAM type: NRG; PAM sequence: CAG
aagaaagtgaaggcatcacg

SEQ ID NO: 121809 - DNA, 20 bp, Artificial Sequence
  Description of Artificial Sequence: Synthetic oligonucleotide
  Target: ATXN1; (+) strand; PAM type: NRG; PAM sequence: AGG
agaaagtgaaggcatcacgc

SEQ ID NO: 121810 - DNA, 20 bp, Artificial Sequence
  Description of Artificial Sequence: Synthetic oligonucleotide
  Target: ATXN1; (+) strand; PAM type: NRG; PAM sequence: AAG
aagtgaaggcatcacgcagg

SEQ ID NO: 121811 - DNA, 20 bp, Artificial Sequence
  Description of Artificial Sequence: Synthetic oligonucleotide
  Target: ATXN1; (+) strand; PAM type: NRG; PAM sequence: TAG
gaaggcatcacgcaggaagc

SEQ ID NO: 121812 - DNA, 20 bp, Artificial Sequence
  Description of Artificial Sequence: Synthetic oligonucleotide
  Target: ATXN1; (+) strand; PAM type: NRG; PAM sequence: AGG
aaggcatcacgcaggaagct

SEQ ID NO: 121813 - DNA, 20 bp, Artificial Sequence
  Description of Artificial Sequence: Synthetic oligonucleotide
  Target: ATXN1; (+) strand; PAM type: NRG; PAM sequence: GAG
ggcatcacgcaggaagctag

SEQ ID NO: 121814 - DNA, 20 bp, Artificial Sequence
  Description of Artificial Sequence: Synthetic oligonucleotide
  Target: ATXN1; (+) strand; PAM type: NRG; PAM sequence: AAG
tcacgcaggaagctaggaga

SEQ ID NO: 121815 - DNA, 20 bp, Artificial Sequence
  Description of Artificial Sequence: Synthetic oligonucleotide
  Target: ATXN1; (+) strand; PAM type: NRG; PAM sequence: GAG
acgcaggaagctaggagaaa

SEQ ID NO: 121816 - DNA, 20 bp, Artificial Sequence
  Description of Artificial Sequence: Synthetic oligonucleotide
  Target: ATXN1; (+) strand; PAM type: NRG; PAM sequence: AAG
gaagctaggagaaagagtgt

SEQ ID NO: 121817 - DNA, 20 bp, Artificial Sequence
  Description of Artificial Sequence: Synthetic oligonucleotide
  Target: ATXN1; (+) strand; PAM type: NRG; PAM sequence: AGG
aagctaggagaaagagtgta

SEQ ID NO: 121818 - DNA, 20 bp, Artificial Sequence
  Description of Artificial Sequence: Synthetic oligonucleotide
  Target: ATXN1; (+) strand; PAM type: NRG; PAM sequence: TGG
ctaggagaaagagtgtaagg

SEQ ID NO: 121819 - DNA, 20 bp, Artificial Sequence
  Description of Artificial Sequence: Synthetic oligonucleotide
  Target: ATXN1; (+) strand; PAM type: NRG; PAM sequence: GGG
taggagaaagagtgtaaggt

SEQ ID NO: 121820 - DNA, 20 bp, Artificial Sequence
  Description of Artificial Sequence: Synthetic oligonucleotide
  Target: ATXN1; (+) strand; PAM type: NRG; PAM sequence: CAG
gagaaagagtgtaaggtggg

SEQ ID NO: 121821 - DNA, 20 bp, Artificial Sequence
  Description of Artificial Sequence: Synthetic oligonucleotide
  Target: ATXN1; (+) strand; PAM type: NRG; PAM sequence: TAG
aaagagtgtaaggtgggcag

SEQ ID NO: 121822 - DNA, 20 bp, Artificial Sequence
  Description of Artificial Sequence: Synthetic oligonucleotide
  Target: ATXN1; (+) strand; PAM type: NRG; PAM sequence: AGG
aagagtgtaaggtgggcagt

SEQ ID NO: 121823 - DNA, 20 bp, Artificial Sequence
  Description of Artificial Sequence: Synthetic oligonucleotide
  Target: ATXN1; (+) strand; PAM type: NRG; PAM sequence: GGG
agagtgtaaggtgggcagta

SEQ ID NO: 121824 - DNA, 20 bp, Artificial Sequence
  Description of Artificial Sequence: Synthetic oligonucleotide
  Target: ATXN1; (+) strand; PAM type: NRG; PAM sequence: CAG
ggtgggcagtagggcacatg

SEQ ID NO: 121825 - DNA, 20 bp, Artificial Sequence
  Description of Artificial Sequence: Synthetic oligonucleotide
  Target: ATXN1; (+) strand; PAM type: NRG; PAM sequence: AGG
gtgggcagtagggcacatgc

SEQ ID NO: 121826 - DNA, 20 bp, Artificial Sequence
  Description of Artificial Sequence: Synthetic oligonucleotide
  Target: ATXN1; (+) strand; PAM type: NRG; PAM sequence: GAG
gggcagtagggcacatgcag

SEQ ID NO: 121827 - DNA, 20 bp, Artificial Sequence
  Description of Artificial Sequence: Synthetic oligonucleotide
  Target: ATXN1; (+) strand; PAM type: NRG; PAM sequence: TGG
gtagggcacatgcaggagcg

SEQ ID NO: 121828 - DNA, 20 bp, Artificial Sequence
  Description of Artificial Sequence: Synthetic oligonucleotide
  Target: ATXN1; (+) strand; PAM type: NRG; PAM sequence: TGG
catgcaggagcgtggttatt

SEQ ID NO: 121829 - DNA, 20 bp, Artificial Sequence
  Description of Artificial Sequence: Synthetic oligonucleotide
  Target: ATXN1; (+) strand; PAM type: NRG; PAM sequence: CGG
gagcgtggttatttggtaca

SEQ ID NO: 121830 - DNA, 20 bp, Artificial Sequence
  Description of Artificial Sequence: Synthetic oligonucleotide
  Target: ATXN1; (+) strand; PAM type: NRG; PAM sequence: CAG
tatttggtacacggctccct

SEQ ID NO: 121831 - DNA, 20 bp, Artificial Sequence
  Description of Artificial Sequence: Synthetic oligonucleotide
  Target: ATXN1; (+) strand; PAM type: NRG; PAM sequence: TGG
acacggctccctcagattgc

SEQ ID NO: 121832 - DNA, 20 bp, Artificial Sequence
  Description of Artificial Sequence: Synthetic oligonucleotide
  Target: ATXN1; (+) strand; PAM type: NRG; PAM sequence: CAG
tccctcagattgctggtttg

SEQ ID NO: 121833 - DNA, 20 bp, Artificial Sequence
  Description of Artificial Sequence: Synthetic oligonucleotide
  Target: ATXN1; (+) strand; PAM type: NRG; PAM sequence: TGG
acactgtgaaattttccact

SEQ ID NO: 121834 - DNA, 20 bp, Artificial Sequence
  Description of Artificial Sequence: Synthetic oligonucleotide
  Target: ATXN1; (+) strand; PAM type: NRG; PAM sequence: AAG
tctgccatttccgcccaccg

SEQ ID NO: 121835 - DNA, 20 bp, Artificial Sequence
  Description of Artificial Sequence: Synthetic oligonucleotide
  Target: ATXN1; (+) strand; PAM type: NRG; PAM sequence: CAG
aagacaacacttacacccac

SEQ ID NO: 121836 - DNA, 20 bp, Artificial Sequence
  Description of Artificial Sequence: Synthetic oligonucleotide
  Target: ATXN1; (+) strand; PAM type: NRG; PAM sequence: GAG
gacaacacttacacccacca

SEQ ID NO: 121837 - DNA, 20 bp, Artificial Sequence
  Description of Artificial Sequence: Synthetic oligonucleotide
  Target: ATXN1; (+) strand; PAM type: NRG; PAM sequence: TGG
aacacttacacccaccagag

SEQ ID NO: 121838 - DNA, 20 bp, Artificial Sequence
  Description of Artificial Sequence: Synthetic oligonucleotide
  Target: ATXN1; (+) strand; PAM type: NRG; PAM sequence: CAG
ttacacccaccagagtggca

SEQ ID NO: 121839 - DNA, 20 bp, Artificial Sequence
  Description of Artificial Sequence: Synthetic oligonucleotide
  Target: ATXN1; (+) strand; PAM type: NRG; PAM sequence: GAG
acccaccagagtggcacagc

SEQ ID NO: 121840 - DNA, 20 bp, Artificial Sequence
  Description of Artificial Sequence: Synthetic oligonucleotide
  Target: ATXN1; (+) strand; PAM type: NRG; PAM sequence: AGG
cccaccagagtggcacagcg

SEQ ID NO: 121841 - DNA, 20 bp, Artificial Sequence
  Description of Artificial Sequence: Synthetic oligonucleotide
  Target: ATXN1; (+) strand; PAM type: NRG; PAM sequence: TGG
gtggcacagcgaggccctgc

SEQ ID NO: 121842 - DNA, 20 bp, Artificial Sequence
  Description of Artificial Sequence: Synthetic oligonucleotide
  Target: ATXN1; (+) strand; PAM type: NRG; PAM sequence: AAG
acagcgaggccctgctggaa

SEQ ID NO: 121843 - DNA, 20 bp, Artificial Sequence
  Description of Artificial Sequence: Synthetic oligonucleotide
  Target: ATXN1; (+) strand; PAM type: NRG; PAM sequence: AGG
cagcgaggccctgctggaaa

SEQ ID NO: 121844 - DNA, 20 bp, Artificial Sequence
  Description of Artificial Sequence: Synthetic oligonucleotide
  Target: ATXN1; (+) strand; PAM type: NRG; PAM sequence: TGG
aggccctgctggaaaaggat

SEQ ID NO: 121845 - DNA, 20 bp, Artificial Sequence
  Description of Artificial Sequence: Synthetic oligonucleotide
  Target: ATXN1; (+) strand; PAM type: NRG; PAM sequence: AAG
ttgctgttgcttttaatgaa

SEQ ID NO: 121846 - DNA, 20 bp, Artificial Sequence
  Description of Artificial Sequence: Synthetic oligonucleotide
  Target: ATXN1; (+) strand; PAM type: NRG; PAM sequence: TGG
tcattaatattttccacacc

SEQ ID NO: 121847 - DNA, 20 bp, Artificial Sequence
  Description of Artificial Sequence: Synthetic oligonucleotide
  Target: ATXN1; (+) strand; PAM type: NRG; PAM sequence: AAG
ttgatttttttccccctttc

SEQ ID NO: 121848 - DNA, 20 bp, Artificial Sequence
  Description of Artificial Sequence: Synthetic oligonucleotide
  Target: ATXN1; (+) strand; PAM type: NRG; PAM sequence: AGG
tgatttttttccccctttca

SEQ ID NO: 121849 - DNA, 20 bp, Artificial Sequence
  Description of Artificial Sequence: Synthetic oligonucleotide
  Target: ATXN1; (+) strand; PAM type: NRG; PAM sequence: CAG
tccccctttcaaggctgacc

SEQ ID NO: 121850 - DNA, 20 bp, Artificial Sequence
  Description of Artificial Sequence: Synthetic oligonucleotide
  Target: ATXN1; (+) strand; PAM type: NRG; PAM sequence: AGG
ccccctttcaaggctgaccc

SEQ ID NO: 121851 - DNA, 20 bp, Artificial Sequence
  Description of Artificial Sequence: Synthetic oligonucleotide
  Target: ATXN1; (+) strand; PAM type: NRG; PAM sequence: CAG
tttcaaggctgacccaggaa

SEQ ID NO: 121852 - DNA, 20 bp, Artificial Sequence
  Description of Artificial Sequence: Synthetic oligonucleotide
  Target: ATXN1; (+) strand; PAM type: NRG; PAM sequence: TGG
gacccaggaacagcttctcc

SEQ ID NO: 121853 - DNA, 20 bp, Artificial Sequence
  Description of Artificial Sequence: Synthetic oligonucleotide
  Target: ATXN1; (+) strand; PAM type: NRG; PAM sequence: GAG
atttcgccttgtatactttt

SEQ ID NO: 121854 - DNA, 20 bp, Artificial Sequence
  Description of Artificial Sequence: Synthetic oligonucleotide
  Target: ATXN1; (+) strand; PAM type: NRG; PAM sequence: AAG
tcgccttgtatacttttgag

SEQ ID NO: 121855 - DNA, 20 bp, Artificial Sequence
  Description of Artificial Sequence: Synthetic oligonucleotide
  Target: ATXN1; (+) strand; PAM type: NRG; PAM sequence: GAG
tacttttgagaagcacactt

SEQ ID NO: 121856 - DNA, 20 bp, Artificial Sequence
  Description of Artificial Sequence: Synthetic oligonucleotide
  Target: ATXN1; (+) strand; PAM type: NRG; PAM sequence: AGG
acttttgagaagcacacttg

SEQ ID NO: 121857 - DNA, 20 bp, Artificial Sequence
  Description of Artificial Sequence: Synthetic oligonucleotide
  Target: ATXN1; (+) strand; PAM type: NRG; PAM sequence: AAG
tgagaagcacacttgaggca

SEQ ID NO: 121858 - DNA, 20 bp, Artificial Sequence
  Description of Artificial Sequence: Synthetic oligonucleotide
  Target: ATXN1; (+) strand; PAM type: NRG; PAM sequence: AGG
gagaagcacacttgaggcaa

SEQ ID NO: 121859 - DNA, 20 bp, Artificial Sequence
  Description of Artificial Sequence: Synthetic oligonucleotide
  Target: ATXN1; (+) strand; PAM type: NRG; PAM sequence: TAG
tgaggcaaaggaacttgtat

SEQ ID NO: 121860 - DNA, 20 bp, Artificial Sequence
  Description of Artificial Sequence: Synthetic oligonucleotide
  Target: ATXN1; (+) strand; PAM type: NRG; PAM sequence: CAG
ggcaaaggaacttgtattag

SEQ ID NO: 121861 - DNA, 20 bp, Artificial Sequence
  Description of Artificial Sequence: Synthetic oligonucleotide
  Target: ATXN1; (+) strand; PAM type: NRG; PAM sequence: GAG
gaacttgtattagcagcttt

SEQ ID NO: 121862 - DNA, 20 bp, Artificial Sequence
  Description of Artificial Sequence: Synthetic oligonucleotide
  Target: ATXN1; (+) strand; PAM type: NRG; PAM sequence: AGG
aacttgtattagcagctttg

SEQ ID NO: 121863 - DNA, 20 bp, Artificial Sequence
  Description of Artificial Sequence: Synthetic oligonucleotide
  Target: ATXN1; (+) strand; PAM type: NRG; PAM sequence: AAG
ttagcagctttgaggatgac

SEQ ID NO: 121864 - DNA, 20 bp, Artificial Sequence
  Description of Artificial Sequence: Synthetic oligonucleotide
  Target: ATXN1; (+) strand; PAM type: NRG; PAM sequence: CAG
gctttgaggatgacaagaaa

SEQ ID NO: 121865 - DNA, 20 bp, Artificial Sequence
  Description of Artificial Sequence: Synthetic oligonucleotide
  Target: ATXN1; (+) strand; PAM type: NRG; PAM sequence: AAG
gatgacaagaaacagaattt

SEQ ID NO: 121866 - DNA, 20 bp, Artificial Sequence
  Description of Artificial Sequence: Synthetic oligonucleotide
  Target: ATXN1; (+) strand; PAM type: NRG; PAM sequence: TAG
acagaatttaagtgctacac

SEQ ID NO: 121867 - DNA, 20 bp, Artificial Sequence
  Description of Artificial Sequence: Synthetic oligonucleotide
  Target: ATXN1; (+) strand; PAM type: NRG; PAM sequence: AAG
tcccaaatacatcatcgaca

SEQ ID NO: 121868 - DNA, 20 bp, Artificial Sequence
  Description of Artificial Sequence: Synthetic oligonucleotide
  Target: ATXN1; (+) strand; PAM type: NRG; PAM sequence: AGG
cccaaatacatcatcgacaa

SEQ ID NO: 121869 - DNA, 20 bp, Artificial Sequence
  Description of Artificial Sequence: Synthetic oligonucleotide
  Target: ATXN1; (+) strand; PAM type: NRG; PAM sequence: CAG
aatacatcatcgacaaaggc

SEQ ID NO: 121870 - DNA, 20 bp, Artificial Sequence
  Description of Artificial Sequence: Synthetic oligonucleotide
  Target: ATXN1; (+) strand; PAM type: NRG; PAM sequence: GAG
tgtttttcctttcaaatcat

SEQ ID NO: 121871 - DNA, 20 bp, Artificial Sequence
  Description of Artificial Sequence: Synthetic oligonucleotide
  Target: ATXN1; (+) strand; PAM type: NRG; PAM sequence: CAG
tttcaaatcatgagcatgca

SEQ ID NO: 121872 - DNA, 20 bp, Artificial Sequence
  Description of Artificial Sequence: Synthetic oligonucleotide
  Target: ATXN1; (+) strand; PAM type: NRG; PAM sequence: CAG
atgagcatgcacagaaaaaa

SEQ ID NO: 121873 - DNA, 20 bp, Artificial Sequence
  Description of Artificial Sequence: Synthetic oligonucleotide
  Target: ATXN1; (+) strand; PAM type: NRG; PAM sequence: TAG
atgcacagaaaaaacagttg

SEQ ID NO: 121874 - DNA, 20 bp, Artificial Sequence
  Description of Artificial Sequence: Synthetic oligonucleotide
  Target: ATXN1; (+) strand; PAM type: NRG; PAM sequence: TAG
agaaaaaacagttgtagtat

SEQ ID NO: 121875 - DNA, 20 bp, Artificial Sequence
  Description of Artificial Sequence: Synthetic oligonucleotide
  Target: ATXN1; (+) strand; PAM type: NRG; PAM sequence: TGG
cagttgtagtattagcattg

SEQ ID NO: 121876 - DNA, 20 bp, Artificial Sequence
  Description of Artificial Sequence: Synthetic oligonucleotide
  Target: ATXN1; (+) strand; PAM type: NRG; PAM sequence: GGG
agttgtagtattagcattgt

SEQ ID NO: 121877 - DNA, 20 bp, Artificial Sequence
  Description of Artificial Sequence: Synthetic oligonucleotide
  Target: ATXN1; (+) strand; PAM type: NRG; PAM sequence: TAG
agcattgtgggtgtcattaa

SEQ ID NO: 121878 - DNA, 20 bp, Artificial Sequence
  Description of Artificial Sequence: Synthetic oligonucleotide
  Target: ATXN1; (+) strand; PAM type: NRG; PAM sequence: GAG
gtgtcattaatagcatttct

SEQ ID NO: 121879 - DNA, 20 bp, Artificial Sequence
  Description of Artificial Sequence: Synthetic oligonucleotide
  Target: ATXN1; (+) strand; PAM type: NRG; PAM sequence: AGG
tgtcattaatagcatttctg

SEQ ID NO: 121880 - DNA, 20 bp, Artificial Sequence
  Description of Artificial Sequence: Synthetic oligonucleotide
  Target: ATXN1; (+) strand; PAM type: NRG; PAM sequence: AAG
tctgaggaaaaaaaacaaaa

SEQ ID NO: 121881 - DNA, 20 bp, Artificial Sequence
  Description of Artificial Sequence: Synthetic oligonucleotide
  Target: ATXN1; (+) strand; PAM type: NRG; PAM sequence: GAG
tgaggaaaaaaaacaaaaaa

SEQ ID NO: 121882 - DNA, 20 bp, Artificial Sequence
  Description of Artificial Sequence: Synthetic oligonucleotide
  Target: ATXN1; (+) strand; PAM type: NRG; PAM sequence: TGG
ggaaaaaaaacaaaaaagag

SEQ ID NO: 121883 - DNA, 20 bp, Artificial Sequence
  Description of Artificial Sequence: Synthetic oligonucleotide
  Target: ATXN1; (+) strand; PAM type: NRG; PAM sequence: AAG
tggtcctttatctctaaaaa

SEQ ID NO: 121884 - DNA, 20 bp, Artificial Sequence
  Description of Artificial Sequence: Synthetic oligonucleotide
  Target: ATXN1; (+) strand; PAM type: NRG; PAM sequence: AGG
ggtcctttatctctaaaaaa

SEQ ID NO: 121885 - DNA, 20 bp, Artificial Sequence
  Description of Artificial Sequence: Synthetic oligonucleotide
  Target: ATXN1; (+) strand; PAM type: NRG; PAM sequence: AAG
ctttatctctaaaaaaaggc

SEQ ID NO: 121886 - DNA, 20 bp, Artificial Sequence
  Description of Artificial Sequence: Synthetic oligonucleotide
  Target: ATXN1; (+) strand; PAM type: NRG; PAM sequence: TAG
gaatgaataataacaaatct

SEQ ID NO: 121887 - DNA, 20 bp, Artificial Sequence
  Description of Artificial Sequence: Synthetic oligonucleotide
  Target: ATXN1; (+) strand; PAM type: NRG; PAM sequence: TGG
ataataacaaatcttagatt

SEQ ID NO: 121888 - DNA, 20 bp, Artificial Sequence
  Description of Artificial Sequence: Synthetic oligonucleotide
  Target: ATXN1; (+) strand; PAM type: NRG; PAM sequence: TGG
acaaatcttagatttggaat

SEQ ID NO: 121889 - DNA, 20 bp, Artificial Sequence
  Description of Artificial Sequence: Synthetic oligonucleotide
  Target: ATXN1; (+) strand; PAM type: NRG; PAM sequence: AAG
ggaattggtaacacactgac

SEQ ID NO: 121890 - DNA, 20 bp, Artificial Sequence
  Description of Artificial Sequence: Synthetic oligonucleotide
  Target: ATXN1; (+) strand; PAM type: NRG; PAM sequence: AAG
gacaagtatatctcaaaata

SEQ ID NO: 121891 - DNA, 20 bp, Artificial Sequence
  Description of Artificial Sequence: Synthetic oligonucleotide
  Target: ATXN1; (+) strand; PAM type: NRG; PAM sequence: TGG
aataaagaactaataaaaaa

SEQ ID NO: 121892 - DNA, 20 bp, Artificial Sequence
  Description of Artificial Sequence: Synthetic oligonucleotide
  Target: ATXN1; (+) strand; PAM type: NRG; PAM sequence: GAG
taaagaactaataaaaaatg

SEQ ID NO: 121893 - DNA, 20 bp, Artificial Sequence
  Description of Artificial Sequence: Synthetic oligonucleotide
  Target: ATXN1; (+) strand; PAM type: NRG; PAM sequence: GAG
aagaactaataaaaaatgga

SEQ ID NO: 121894 - DNA, 20 bp, Artificial Sequence
  Description of Artificial Sequence: Synthetic oligonucleotide
  Target: ATXN1; (+) strand; PAM type: NRG; PAM sequence: TGG
aaaaaatggagagacaaaat

SEQ ID NO: 121895 - DNA, 20 bp, Artificial Sequence
  Description of Artificial Sequence: Synthetic oligonucleotide
  Target: ATXN1; (+) strand; PAM type: NRG; PAM sequence: GGG
aaaaatggagagacaaaatt

SEQ ID NO: 121896 - DNA, 20 bp, Artificial Sequence
  Description of Artificial Sequence: Synthetic oligonucleotide
  Target: ATXN1; (+) strand; PAM type: NRG; PAM sequence: CAG
atggagagacaaaattggga

SEQ ID NO: 121897 - DNA, 20 bp, Artificial Sequence
  Description of Artificial Sequence: Synthetic oligonucleotide
  Target: ATXN1; (+) strand; PAM type: NRG; PAM sequence: AAG
gagagacaaaattgggacag

SEQ ID NO: 121898 - DNA, 20 bp, Artificial Sequence
  Description of Artificial Sequence: Synthetic oligonucleotide
  Target: ATXN1; (+) strand; PAM type: NRG; PAM sequence: GAG
gagacaaaattgggacagaa

SEQ ID NO: 121899 - DNA, 20 bp, Artificial Sequence
  Description of Artificial Sequence: Synthetic oligonucleotide
  Target: ATXN1; (+) strand; PAM type: NRG; PAM sequence: GAG
gacaaaattgggacagaaga

SEQ ID NO: 121900 - DNA, 20 bp, Artificial Sequence
  Description of Artificial Sequence: Synthetic oligonucleotide
  Target: ATXN1; (+) strand; PAM type: NRG; PAM sequence: AAG
aaattgggacagaagagaga

SEQ ID NO: 121901 - DNA, 20 bp, Artificial Sequence
  Description of Artificial Sequence: Synthetic oligonucleotide
  Target: ATXN1; (+) strand; PAM type: NRG; PAM sequence: AGG
aattgggacagaagagagaa

SEQ ID NO: 121902 - DNA, 20 bp, Artificial Sequence
  Description of Artificial Sequence: Synthetic oligonucleotide
  Target: ATXN1; (+) strand; PAM type: NRG; PAM sequence: GAG
ttgggacagaagagagaaag

SEQ ID NO: 121903 - DNA, 20 bp, Artificial Sequence
  Description of Artificial Sequence: Synthetic oligonucleotide
  Target: ATXN1; (+) strand; PAM type: NRG; PAM sequence: AGG
tgggacagaagagagaaagg

SEQ ID NO: 121904 - DNA, 20 bp, Artificial Sequence
  Description of Artificial Sequence: Synthetic oligonucleotide
  Target: ATXN1; (+) strand; PAM type: NRG; PAM sequence: CAG
catcactttcataatgaata

SEQ ID NO: 121905 - DNA, 20 bp, Artificial Sequence
  Description of Artificial Sequence: Synthetic oligonucleotide
  Target: ATXN1; (+) strand; PAM type: NRG; PAM sequence: AAG
cataatgaatacagtttacc

SEQ ID NO: 121906 - DNA, 20 bp, Artificial Sequence
  Description of Artificial Sequence: Synthetic oligonucleotide
  Target: ATXN1; (+) strand; PAM type: NRG; PAM sequence: TGG
tcgcttgatacaattttact

SEQ ID NO: 121907 - DNA, 20 bp, Artificial Sequence
  Description of Artificial Sequence: Synthetic oligonucleotide
  Target: ATXN1; (+) strand; PAM type: NRG; PAM sequence: CAG
ttggtacttgctaaatccac

SEQ ID NO: 121908 - DNA, 20 bp, Artificial Sequence
  Description of Artificial Sequence: Synthetic oligonucleotide
  Target: ATXN1; (+) strand; PAM type: NRG; PAM sequence: AGG
tggtacttgctaaatccacc

SEQ ID NO: 121909 - DNA, 20 bp, Artificial Sequence
  Description of Artificial Sequence: Synthetic oligonucleotide
  Target: ATXN1; (+) strand; PAM type: NRG; PAM sequence: TGG
caccaggctctgtgttcaac

SEQ ID NO: 121910 - DNA, 20 bp, Artificial Sequence
  Description of Artificial Sequence: Synthetic oligonucleotide
  Target: ATXN1; (+) strand; PAM type: NRG; PAM sequence: GGG
accaggctctgtgttcaact

SEQ ID NO: 121911 - DNA, 20 bp, Artificial Sequence
  Description of Artificial Sequence: Synthetic oligonucleotide
  Target: ATXN1; (+) strand; PAM type: NRG; PAM sequence: GGG
ccaggctctgtgttcaactg

SEQ ID NO: 121912 - DNA, 20 bp, Artificial Sequence
  Description of Artificial Sequence: Synthetic oligonucleotide
  Target: ATXN1; (+) strand; PAM type: NRG; PAM sequence: TGG
gtgttcaactggggaataca

SEQ ID NO: 121913 - DNA, 20 bp, Artificial Sequence
  Description of Artificial Sequence: Synthetic oligonucleotide
  Target: ATXN1; (+) strand; PAM type: NRG; PAM sequence: TAG
ggaatacatggtaaacaaaa

SEQ ID NO: 121914 - DNA, 20 bp, Artificial Sequence
  Description of Artificial Sequence: Synthetic oligonucleotide
  Target: ATXN1; (+) strand; PAM type: NRG; PAM sequence: CAG
acatggtaaacaaaatagcc

SEQ ID NO: 121915 - DNA, 20 bp, Artificial Sequence
  Description of Artificial Sequence: Synthetic oligonucleotide
  Target: ATXN1; (+) strand; PAM type: NRG; PAM sequence: AGG
catggtaaacaaaatagccc

SEQ ID NO: 121916 - DNA, 20 bp, Artificial Sequence
  Description of Artificial Sequence: Synthetic oligonucleotide
  Target: ATXN1; (+) strand; PAM type: NRG; PAM sequence: AAG
tagcccaggaccctgcaccc

SEQ ID NO: 121917 - DNA, 20 bp, Artificial Sequence
  Description of Artificial Sequence: Synthetic oligonucleotide
  Target: ATXN1; (+) strand; PAM type: NRG; PAM sequence: AGG
agcccaggaccctgcaccca

SEQ ID NO: 121918 - DNA, 20 bp, Artificial Sequence
  Description of Artificial Sequence: Synthetic oligonucleotide
  Target: ATXN1; (+) strand; PAM type: NRG; PAM sequence: GAG
cccaggaccctgcacccaag

SEQ ID NO: 121919 - DNA, 20 bp, Artificial Sequence
  Description of Artificial Sequence: Synthetic oligonucleotide
  Target: ATXN1; (+) strand; PAM type: NRG; PAM sequence: AAG
cccaaggagctcactgcctc

SEQ ID NO: 121920 - DNA, 20 bp, Artificial Sequence
  Description of Artificial Sequence: Synthetic oligonucleotide
  Target: ATXN1; (+) strand; PAM type: NRG; PAM sequence: GAG
caaggagctcactgcctcaa

SEQ ID NO: 121921 - DNA, 20 bp, Artificial Sequence
  Description of Artificial Sequence: Synthetic oligonucleotide
  Target: ATXN1; (+) strand; PAM type: NRG; PAM sequence: AGG
aaggagctcactgcctcaag

SEQ ID NO: 121922 - DNA, 20 bp, Artificial Sequence
  Description of Artificial Sequence: Synthetic oligonucleotide
  Target: ATXN1; (+) strand; PAM type: NRG; PAM sequence: GGG
aggagctcactgcctcaaga

SEQ ID NO: 121923 - DNA, 20 bp, Artificial Sequence
  Description of Artificial Sequence: Synthetic oligonucleotide
  Target: ATXN1; (+) strand; PAM type: NRG; PAM sequence: CAG
gctcactgcctcaagaggga

SEQ ID NO: 121924 - DNA, 20 bp, Artificial Sequence
  Description of Artificial Sequence: Synthetic oligonucleotide
  Target: ATXN1; (+) strand; PAM type: NRG; PAM sequence: GAG
acagaattaaataattatat

SEQ ID NO: 121925 - DNA, 20 bp, Artificial Sequence
  Description of Artificial Sequence: Synthetic oligonucleotide
  Target: ATXN1; (+) strand; PAM type: NRG; PAM sequence: TAG
ttaaataattatatgagttt

SEQ ID NO: 121926 - DNA, 20 bp, Artificial Sequence
  Description of Artificial Sequence: Synthetic oligonucleotide
  Target: ATXN1; (+) strand; PAM type: NRG; PAM sequence: AGG
taaataattatatgagtttt

SEQ ID NO: 121927 - DNA, 20 bp, Artificial Sequence
  Description of Artificial Sequence: Synthetic oligonucleotide
  Target: ATXN1; (+) strand; PAM type: NRG; PAM sequence: GAG
aataattatatgagttttag

SEQ ID NO: 121928 - DNA, 20 bp, Artificial Sequence
  Description of Artificial Sequence: Synthetic oligonucleotide
  Target: ATXN1; (+) strand; PAM type: NRG; PAM sequence: TGG
gatgcataaaatttgaaaac

SEQ ID NO: 121929 - DNA, 20 bp, Artificial Sequence
  Description of Artificial Sequence: Synthetic oligonucleotide
  Target: ATXN1; (+) strand; PAM type: NRG; PAM sequence: TAG
cataaaatttgaaaactgga

SEQ ID NO: 121930 - DNA, 20 bp, Artificial Sequence
  Description of Artificial Sequence: Synthetic oligonucleotide
  Target: ATXN1; (+) strand; PAM type: NRG; PAM sequence: AGG
ataaaatttgaaaactggat

SEQ ID NO: 121931 - DNA, 20 bp, Artificial Sequence
  Description of Artificial Sequence: Synthetic oligonucleotide
  Target: ATXN1; (+) strand; PAM type: NRG; PAM sequence: AAG
aaaactggataggcaatatg

SEQ ID NO: 121932 - DNA, 20 bp, Artificial Sequence
  Description of Artificial Sequence: Synthetic oligonucleotide
  Target: ATXN1; (+) strand; PAM type: NRG; PAM sequence: AGG
aaactggataggcaatatga

SEQ ID NO: 121933 - DNA, 20 bp, Artificial Sequence
  Description of Artificial Sequence: Synthetic oligonucleotide
  Target: ATXN1; (+) strand; PAM type: NRG; PAM sequence: TAG
aaaatgaacattgtgatttg

SEQ ID NO: 121934 - DNA, 20 bp, Artificial Sequence
  Description of Artificial Sequence: Synthetic oligonucleotide
  Target: ATXN1; (+) strand; PAM type: NRG; PAM sequence: TGG
attgtgatttgtagtcatga

SEQ ID NO: 121935 - DNA, 20 bp, Artificial Sequence
  Description of Artificial Sequence: Synthetic oligonucleotide
  Target: ATXN1; (+) strand; PAM type: NRG; PAM sequence: GGG
ttgtgatttgtagtcatgat

SEQ ID NO: 121936 - DNA, 20 bp, Artificial Sequence
  Description of Artificial Sequence: Synthetic oligonucleotide
  Target: ATXN1; (+) strand; PAM type: NRG; PAM sequence: GGG
tgtgatttgtagtcatgatg

SEQ ID NO: 121937 - DNA, 20 bp, Artificial Sequence
  Description of Artificial Sequence: Synthetic oligonucleotide
  Target: ATXN1; (+) strand; PAM type: NRG; PAM sequence: GGG
gtgatttgtagtcatgatgg

SEQ ID NO: 121938 - DNA, 20 bp, Artificial Sequence
  Description of Artificial Sequence: Synthetic oligonucleotide
  Target: ATXN1; (+) strand; PAM type: NRG; PAM sequence: TAG
catgatgggggtacctcact

SEQ ID NO: 121939 - DNA, 20 bp, Artificial Sequence
  Description of Artificial Sequence: Synthetic oligonucleotide
  Target: ATXN1; (+) strand; PAM type: NRG; PAM sequence: AAG
gatgggggtacctcacttag

SEQ ID NO: 121940 - DNA, 20 bp, Artificial Sequence
  Description of Artificial Sequence: Synthetic oligonucleotide
  Target: ATXN1; (+) strand; PAM type: NRG; PAM sequence: AGG
atgggggtacctcacttaga

SEQ ID NO: 121941 - DNA, 20 bp, Artificial Sequence
  Description of Artificial Sequence: Synthetic oligonucleotide
  Target: ATXN1; (+) strand; PAM type: NRG; PAM sequence: GAG
gggggtacctcacttagaag

SEQ ID NO: 121942 - DNA, 20 bp, Artificial Sequence
  Description of Artificial Sequence: Synthetic oligonucleotide
  Target: ATXN1; (+) strand; PAM type: NRG; PAM sequence: AGG
ggggtacctcacttagaagg

SEQ ID NO: 121943 - DNA, 20 bp, Artificial Sequence
  Description of Artificial Sequence: Synthetic oligonucleotide
  Target: ATXN1; (+) strand; PAM type: NRG; PAM sequence: GGG
gggtacctcacttagaagga

SEQ ID NO: 121944 - DNA, 20 bp, Artificial Sequence
  Description of Artificial Sequence: Synthetic oligonucleotide
  Target: ATXN1; (+) strand; PAM type: NRG; PAM sequence: CAG
ctcacttagaaggagggtct

SEQ ID NO: 121945 - DNA, 20 bp, Artificial Sequence
  Description of Artificial Sequence: Synthetic oligonucleotide
  Target: ATXN1; (+) strand; PAM type: NRG; PAM sequence: AGG
tcacttagaaggagggtctc

SEQ ID NO: 121946 - DNA, 20 bp, Artificial Sequence
  Description of Artificial Sequence: Synthetic oligonucleotide
  Target: ATXN1; (+) strand; PAM type: NRG; PAM sequence: AAG
cttagaaggagggtctcagg

SEQ ID NO: 121947 - DNA, 20 bp, Artificial Sequence
  Description of Artificial Sequence: Synthetic oligonucleotide
  Target: ATXN1; (+) strand; PAM type: NRG; PAM sequence: AGG
ttagaaggagggtctcagga

SEQ ID NO: 121948 - DNA, 20 bp, Artificial Sequence
  Description of Artificial Sequence: Synthetic oligonucleotide
  Target: ATXN1; (+) strand; PAM type: NRG; PAM sequence: CAG
ttacaaaactaacattcgaa

SEQ ID NO: 121949 - DNA, 20 bp, Artificial Sequence
  Description of Artificial Sequence: Synthetic oligonucleotide
  Target: ATXN1; (+) strand; PAM type: NRG; PAM sequence: AGG
tacaaaactaacattcgaac

SEQ ID NO: 121950 - DNA, 20 bp, Artificial Sequence
  Description of Artificial Sequence: Synthetic oligonucleotide
  Target: ATXN1; (+) strand; PAM type: NRG; PAM sequence: AAG
aaactaacattcgaacagga

SEQ ID NO: 121951 - DNA, 20 bp, Artificial Sequence
  Description of Artificial Sequence: Synthetic oligonucleotide
  Target: ATXN1; (+) strand; PAM type: NRG; PAM sequence: GAG
cgaacaggaaagtcaaaaat

SEQ ID NO: 121952 - DNA, 20 bp, Artificial Sequence
  Description of Artificial Sequence: Synthetic oligonucleotide
  Target: ATXN1; (+) strand; PAM type: NRG; PAM sequence: CAG
acaggaaagtcaaaaatgag

SEQ ID NO: 121953 - DNA, 20 bp, Artificial Sequence
  Description of Artificial Sequence: Synthetic oligonucleotide
  Target: ATXN1; (+) strand; PAM type: NRG; PAM sequence: AAG
ggaaagtcaaaaatgagcag

SEQ ID NO: 121954 - DNA, 20 bp, Artificial Sequence
  Description of Artificial Sequence: Synthetic oligonucleotide
  Target: ATXN1; (+) strand; PAM type: NRG; PAM sequence: TAG
agtcaaaaatgagcagaagt

SEQ ID NO: 121955 - DNA, 20 bp, Artificial Sequence
  Description of Artificial Sequence: Synthetic oligonucleotide
  Target: ATXN1; (+) strand; PAM type: NRG; PAM sequence: CAG
aaaaatgagcagaagttagc

SEQ ID NO: 121956 - DNA, 20 bp, Artificial Sequence
  Description of Artificial Sequence: Synthetic oligonucleotide
  Target: ATXN1; (+) strand; PAM type: NRG; PAM sequence: AGG
aaaatgagcagaagttagcc

SEQ ID NO: 121957 - DNA, 20 bp, Artificial Sequence
  Description of Artificial Sequence: Synthetic oligonucleotide
  Target: ATXN1; (+) strand; PAM type: NRG; PAM sequence: CAG
agcagaagttagccaggcat

SEQ ID NO: 121958 - DNA, 20 bp, Artificial Sequence
  Description of Artificial Sequence: Synthetic oligonucleotide
  Target: ATXN1; (+) strand; PAM type: NRG; PAM sequence: AGG
gcagaagttagccaggcatc

SEQ ID NO: 121959 - DNA, 20 bp, Artificial Sequence
  Description of Artificial Sequence: Synthetic oligonucleotide
  Target: ATXN1; (+) strand; PAM type: NRG; PAM sequence: CAG
ttagccaggcatcaggtttc

SEQ ID NO: 121960 - DNA, 20 bp, Artificial Sequence
  Description of Artificial Sequence: Synthetic oligonucleotide
  Target: ATXN1; (+) strand; PAM type: NRG; PAM sequence: AGG
tagccaggcatcaggtttcc

SEQ ID NO: 121961 - DNA, 20 bp, Artificial Sequence
  Description of Artificial Sequence: Synthetic oligonucleotide
  Target: ATXN1; (+) strand; PAM type: NRG; PAM sequence: TAG
ccaggcatcaggtttccagg

SEQ ID NO: 121962 - DNA, 20 bp, Artificial Sequence
  Description of Artificial Sequence: Synthetic oligonucleotide
  Target: ATXN1; (+) strand; PAM type: NRG; PAM sequence: GAG
aggcatcaggtttccaggta

SEQ ID NO: 121963 - DNA, 20 bp, Artificial Sequence
  Description of Artificial Sequence: Synthetic oligonucleotide
  Target: ATXN1; (+) strand; PAM type: NRG; PAM sequence: AGG
ggcatcaggtttccaggtag

SEQ ID NO: 121964 - DNA, 20 bp, Artificial Sequence
  Description of Artificial Sequence: Synthetic oligonucleotide
  Target: ATXN1; (+) strand; PAM type: NRG; PAM sequence: CAG
aggtttccaggtagaggaaa

SEQ ID NO: 121965 - DNA, 20 bp, Artificial Sequence
  Description of Artificial Sequence: Synthetic oligonucleotide
  Target: ATXN1; (+) strand; PAM type: NRG; PAM sequence: TAG
ctgtattatacgaactgatc

SEQ ID NO: 121966 - DNA, 20 bp, Artificial Sequence
  Description of Artificial Sequence: Synthetic oligonucleotide
  Target: ATXN1; (+) strand; PAM type: NRG; PAM sequence: GAG
tttattttgccatttcaact

SEQ ID NO: 121967 - DNA, 20 bp, Artificial Sequence
  Description of Artificial Sequence: Synthetic oligonucleotide
  Target: ATXN1; (+) strand; PAM type: NRG; PAM sequence: AAG
tcaactgagtctccttgaaa

SEQ ID NO: 121968 - DNA, 20 bp, Artificial Sequence
  Description of Artificial Sequence: Synthetic oligonucleotide
  Target: ATXN1; (+) strand; PAM type: NRG; PAM sequence: GAG
agtctccttgaaaaagaaat

SEQ ID NO: 121969 - DNA, 20 bp, Artificial Sequence
  Description of Artificial Sequence: Synthetic oligonucleotide
  Target: ATXN1; (+) strand; PAM type: NRG; PAM sequence: AAG
tgttctccataccttgaaat

SEQ ID NO: 121970 - DNA, 20 bp, Artificial Sequence
  Description of Artificial Sequence: Synthetic oligonucleotide
  Target: ATXN1; (+) strand; PAM type: NRG; PAM sequence: GAG
ttctccataccttgaaataa

SEQ ID NO: 121971 - DNA, 20 bp, Artificial Sequence
  Description of Artificial Sequence: Synthetic oligonucleotide
  Target: ATXN1; (+) strand; PAM type: NRG; PAM sequence: TAG
tgattcatctttctgactgc

SEQ ID NO: 121972 - DNA, 20 bp, Artificial Sequence
  Description of Artificial Sequence: Synthetic oligonucleotide
  Target: ATXN1; (+) strand; PAM type: NRG; PAM sequence: AGG
gattcatctttctgactgct

SEQ ID NO: 121973 - DNA, 20 bp, Artificial Sequence
  Description of Artificial Sequence: Synthetic oligonucleotide
  Target: ATXN1; (+) strand; PAM type: NRG; PAM sequence: CAG
ctttctgactgctaggccat

SEQ ID NO: 121974 - DNA, 20 bp, Artificial Sequence
  Description of Artificial Sequence: Synthetic oligonucleotide
  Target: ATXN1; (+) strand; PAM type: NRG; PAM sequence: GAG
ttctgactgctaggccatca

SEQ ID NO: 121975 - DNA, 20 bp, Artificial Sequence
  Description of Artificial Sequence: Synthetic oligonucleotide
  Target: ATXN1; (+) strand; PAM type: NRG; PAM sequence: CGG
accttctctgtgattaattt

SEQ ID NO: 121976 - DNA, 20 bp, Artificial Sequence
  Description of Artificial Sequence: Synthetic oligonucleotide
  Target: ATXN1; (+) strand; PAM type: NRG; PAM sequence: GAG
tctctgtgattaatttcggt

SEQ ID NO: 121977 - DNA, 20 bp, Artificial Sequence
  Description of Artificial Sequence: Synthetic oligonucleotide
  Target: ATXN1; (+) strand; PAM type: NRG; PAM sequence: GAG
tctgtgattaatttcggtga

SEQ ID NO: 121978 - DNA, 20 bp, Artificial Sequence
  Description of Artificial Sequence: Synthetic oligonucleotide
  Target: ATXN1; (+) strand; PAM type: NRG; PAM sequence: AGG
ctgtgattaatttcggtgag

SEQ ID NO: 121979 - DNA, 20 bp, Artificial Sequence
  Description of Artificial Sequence: Synthetic oligonucleotide
  Target: ATXN1; (+) strand; PAM type: NRG; PAM sequence: CAG
tgagaggaacacccctgatg

SEQ ID NO: 121980 - DNA, 20 bp, Artificial Sequence
  Description of Artificial Sequence: Synthetic oligonucleotide
  Target: ATXN1; (+) strand; PAM type: NRG; PAM sequence: AGG
gagaggaacacccctgatgc

SEQ ID NO: 121981 - DNA, 20 bp, Artificial Sequence
  Description of Artificial Sequence: Synthetic oligonucleotide
  Target: ATXN1; (+) strand; PAM type: NRG; PAM sequence: CAG
aggtattattcttgatgtga

SEQ ID NO: 121982 - DNA, 20 bp, Artificial Sequence
  Description of Artificial Sequence: Synthetic oligonucleotide
  Target: ATXN1; (+) strand; PAM type: NRG; PAM sequence: AAG
cctgctctctaatgcacccc

SEQ ID NO: 121983 - DNA, 20 bp, Artificial Sequence
  Description of Artificial Sequence: Synthetic oligonucleotide
  Target: ATXN1; (+) strand; PAM type: NRG; PAM sequence: CAG
cccaagtcactccgttatca

SEQ ID NO: 121984 - DNA, 20 bp, Artificial Sequence
  Description of Artificial Sequence: Synthetic oligonucleotide
  Target: ATXN1; (+) strand; PAM type: NRG; PAM sequence: AAG
gtcactccgttatcacagtg

SEQ ID NO: 121985 - DNA, 20 bp, Artificial Sequence
  Description of Artificial Sequence: Synthetic oligonucleotide
  Target: ATXN1; (+) strand; PAM type: NRG; PAM sequence: AAG
ccgttatcacagtgaagtaa

SEQ ID NO: 121986 - DNA, 20 bp, Artificial Sequence
  Description of Artificial Sequence: Synthetic oligonucleotide
  Target: ATXN1; (+) strand; PAM type: NRG; PAM sequence: AGG
cgttatcacagtgaagtaaa

SEQ ID NO: 121987 - DNA, 20 bp, Artificial Sequence
  Description of Artificial Sequence: Synthetic oligonucleotide
  Target: ATXN1; (+) strand; PAM type: NRG; PAM sequence: AAG
tatcacagtgaagtaaaagg

SEQ ID NO: 121988 - DNA, 20 bp, Artificial Sequence
  Description of Artificial Sequence: Synthetic oligonucleotide
  Target: ATXN1; (+) strand; PAM type: NRG; PAM sequence: CAG
ttgttgacacctgcatgcca

SEQ ID NO: 121989 - DNA, 20 bp, Artificial Sequence
  Description of Artificial Sequence: Synthetic oligonucleotide
  Target: ATXN1; (+) strand; PAM type: NRG; PAM sequence: AAG
acacctgcatgccacagctg

SEQ ID NO: 121990 - DNA, 20 bp, Artificial Sequence
  Description of Artificial Sequence: Synthetic oligonucleotide
  Target: ATXN1; (+) strand; PAM type: NRG; PAM sequence: AAG
tgcatgccacagctgaagtt

SEQ ID NO: 121991 - DNA, 20 bp, Artificial Sequence
  Description of Artificial Sequence: Synthetic oligonucleotide
  Target: ATXN1; (+) strand; PAM type: NRG; PAM sequence: AAG
taagaaaaccctcccccaaa

SEQ ID NO: 121992 - DNA, 20 bp, Artificial Sequence
  Description of Artificial Sequence: Synthetic oligonucleotide
  Target: ATXN1; (+) strand; PAM type: NRG; PAM sequence: AGG
aagaaaaccctcccccaaaa

SEQ ID NO: 121993 - DNA, 20 bp, Artificial Sequence
  Description of Artificial Sequence: Synthetic oligonucleotide
  Target: ATXN1; (+) strand; PAM type: NRG; PAM sequence: CAG
cccccaaaaaggactgaaaa

SEQ ID NO: 121994 - DNA, 20 bp, Artificial Sequence
  Description of Artificial Sequence: Synthetic oligonucleotide
  Target: ATXN1; (+) strand; PAM type: NRG; PAM sequence: TAG
aaaacagatcacattacttg

SEQ ID NO: 121995 - DNA, 20 bp, Artificial Sequence
  Description of Artificial Sequence: Synthetic oligonucleotide
  Target: ATXN1; (+) strand; PAM type: NRG; PAM sequence: TAG
agacttctgaaaaacatctt

SEQ ID NO: 121996 - DNA, 20 bp, Artificial Sequence
  Description of Artificial Sequence: Synthetic oligonucleotide
  Target: ATXN1; (+) strand; PAM type: NRG; PAM sequence: AGG
gacttctgaaaaacatcttt

SEQ ID NO: 121997 - DNA, 20 bp, Artificial Sequence
  Description of Artificial Sequence: Synthetic oligonucleotide
  Target: ATXN1; (+) strand; PAM type: NRG; PAM sequence: TGG
gaaaaacatctttaggacct

SEQ ID NO: 121998 - DNA, 20 bp, Artificial Sequence
  Description of Artificial Sequence: Synthetic oligonucleotide
  Target: ATXN1; (+) strand; PAM type: NRG; PAM sequence: CAG
acatctttaggaccttggat

SEQ ID NO: 121999 - DNA, 20 bp, Artificial Sequence
  Description of Artificial Sequence: Synthetic oligonucleotide
  Target: ATXN1; (+) strand; PAM type: NRG; PAM sequence: AGG
catctttaggaccttggatc

SEQ ID NO: 122000 - DNA, 20 bp, Artificial Sequence
  Description of Artificial Sequence: Synthetic oligonucleotide
  Target: ATXN1; (+) strand; PAM type: NRG; PAM sequence: CAG
taggaccttggatcaggtac

SEQ ID NO: 122001 - DNA, 20 bp, Artificial Sequence
  Description of Artificial Sequence: Synthetic oligonucleotide
  Target: ATXN1; (+) strand; PAM type: NRG; PAM sequence: TGG
tggatcaggtaccagatttc

SEQ ID NO: 122002 - DNA, 20 bp, Artificial Sequence
  Description of Artificial Sequence: Synthetic oligonucleotide
  Target: ATXN1; (+) strand; PAM type: NRG; PAM sequence: CGG
tggcttccccttgatgatta

SEQ ID NO: 122003 - DNA, 20 bp, Artificial Sequence
  Description of Artificial Sequence: Synthetic oligonucleotide
  Target: ATXN1; (+) strand; PAM type: NRG; PAM sequence: TGG
tatttttactatttctctct

SEQ ID NO: 122004 - DNA, 20 bp, Artificial Sequence
  Description of Artificial Sequence: Synthetic oligonucleotide
  Target: ATXN1; (+) strand; PAM type: NRG; PAM sequence: CAG
atttctctcttggacttaaa

SEQ ID NO: 122005 - DNA, 20 bp, Artificial Sequence
  Description of Artificial Sequence: Synthetic oligonucleotide
  Target: ATXN1; (+) strand; PAM type: NRG; PAM sequence: CAG
gcttttatgcccaccgttaa

SEQ ID NO: 122006 - DNA, 20 bp, Artificial Sequence
  Description of Artificial Sequence: Synthetic oligonucleotide
  Target: ATXN1; (+) strand; PAM type: NRG; PAM sequence: TGG
gttccgtcaaccttctctct

SEQ ID NO: 122007 - DNA, 20 bp, Artificial Sequence
  Description of Artificial Sequence: Synthetic oligonucleotide
  Target: ATXN1; (+) strand; PAM type: NRG; PAM sequence: TGG
caaccttctctcttggttct

SEQ ID NO: 122008 - DNA, 20 bp, Artificial Sequence
  Description of Artificial Sequence: Synthetic oligonucleotide
  Target: ATXN1; (+) strand; PAM type: NRG; PAM sequence: CAG
ttctctcttggttcttggtt

SEQ ID NO: 122009 - DNA, 20 bp, Artificial Sequence
  Description of Artificial Sequence: Synthetic oligonucleotide
  Target: ATXN1; (+) strand; PAM type: NRG; PAM sequence: TGG
tctcttggttcttggttcag

SEQ ID NO: 122010 - DNA, 20 bp, Artificial Sequence
  Description of Artificial Sequence: Synthetic oligonucleotide
  Target: ATXN1; (+) strand; PAM type: NRG; PAM sequence: GAG
gtctgtttacttacccacat

SEQ ID NO: 122011 - DNA, 20 bp, Artificial Sequence
  Description of Artificial Sequence: Synthetic oligonucleotide
  Target: ATXN1; (+) strand; PAM type: NRG; PAM sequence: AAG
tacttacccacatgagccgc

SEQ ID NO: 122012 - DNA, 20 bp, Artificial Sequence
  Description of Artificial Sequence: Synthetic oligonucleotide
  Target: ATXN1; (+) strand; PAM type: NRG; PAM sequence: AAG
tacccacatgagccgcaagc

SEQ ID NO: 122013 - DNA, 20 bp, Artificial Sequence
  Description of Artificial Sequence: Synthetic oligonucleotide
  Target: ATXN1; (+) strand; PAM type: NRG; PAM sequence: AGG
acccacatgagccgcaagca

SEQ ID NO: 122014 - DNA, 20 bp, Artificial Sequence
  Description of Artificial Sequence: Synthetic oligonucleotide
  Target: ATXN1; (+) strand; PAM type: NRG; PAM sequence: AAG
tgagccgcaagcaaggtgca

SEQ ID NO: 122015 - DNA, 20 bp, Artificial Sequence
  Description of Artificial Sequence: Synthetic oligonucleotide
  Target: ATXN1; (+) strand; PAM type: NRG; PAM sequence: AAG
gcaaggtgcaaagaaattaa

SEQ ID NO: 122016 - DNA, 20 bp, Artificial Sequence
  Description of Artificial Sequence: Synthetic oligonucleotide
  Target: ATXN1; (+) strand; PAM type: NRG; PAM sequence: CAG
aggtgcaaagaaattaaaag

SEQ ID NO: 122017 - DNA, 20 bp, Artificial Sequence
  Description of Artificial Sequence: Synthetic oligonucleotide
  Target: ATXN1; (+) strand; PAM type: NRG; PAM sequence: TGG
tgcaaagaaattaaaagcag

SEQ ID NO: 122018 - DNA, 20 bp, Artificial Sequence
  Description of Artificial Sequence: Synthetic oligonucleotide
  Target: ATXN1; (+) strand; PAM type: NRG; PAM sequence: AAG
ggaaatgtcatgttcatctg

SEQ ID NO: 122019 - DNA, 20 bp, Artificial Sequence
  Description of Artificial Sequence: Synthetic oligonucleotide
  Target: ATXN1; (+) strand; PAM type: NRG; PAM sequence: TGG
cttccctatcatcccacatc

SEQ ID NO: 122020 - DNA, 20 bp, Artificial Sequence
  Description of Artificial Sequence: Synthetic oligonucleotide
  Target: ATXN1; (+) strand; PAM type: NRG; PAM sequence: AAG
ctcaacttaattcttccact

SEQ ID NO: 122021 - DNA, 20 bp, Artificial Sequence
  Description of Artificial Sequence: Synthetic oligonucleotide
  Target: ATXN1; (+) strand; PAM type: NRG; PAM sequence: AGG
tcaacttaattcttccacta

SEQ ID NO: 122022 - DNA, 20 bp, Artificial Sequence
  Description of Artificial Sequence: Synthetic oligonucleotide
  Target: ATXN1; (+) strand; PAM type: NRG; PAM sequence: CAG
attcttccactaaggaaaat

SEQ ID NO: 122023 - DNA, 20 bp, Artificial Sequence
  Description of Artificial Sequence: Synthetic oligonucleotide
  Target: ATXN1; (+) strand; PAM type: NRG; PAM sequence: TAG
cttccactaaggaaaatcag

SEQ ID NO: 122024 - DNA, 20 bp, Artificial Sequence
  Description of Artificial Sequence: Synthetic oligonucleotide
  Target: ATXN1; (+) strand; PAM type: NRG; PAM sequence: AAG
ttcttcatcctacaacatta

SEQ ID NO: 122025 - DNA, 20 bp, Artificial Sequence
  Description of Artificial Sequence: Synthetic oligonucleotide
  Target: ATXN1; (+) strand; PAM type: NRG; PAM sequence: CAG
aacattaaagcatcatccaa

SEQ ID NO: 122026 - DNA, 20 bp, Artificial Sequence
  Description of Artificial Sequence: Synthetic oligonucleotide
  Target: ATXN1; (+) strand; PAM type: NRG; PAM sequence: AGG
acattaaagcatcatccaac

SEQ ID NO: 122027 - DNA, 20 bp, Artificial Sequence
  Description of Artificial Sequence: Synthetic oligonucleotide
  Target: ATXN1; (+) strand; PAM type: NRG; PAM sequence: TGG
attcatgttctccccatgaa

SEQ ID NO: 122028 - DNA, 20 bp, Artificial Sequence
  Description of Artificial Sequence: Synthetic oligonucleotide
  Target: ATXN1; (+) strand; PAM type: NRG; PAM sequence: GAG
tcatgttctccccatgaatg

SEQ ID NO: 122029 - DNA, 20 bp, Artificial Sequence
  Description of Artificial Sequence: Synthetic oligonucleotide
  Target: ATXN1; (+) strand; PAM type: NRG; PAM sequence: AAG
gttctccccatgaatggagt

SEQ ID NO: 122030 - DNA, 20 bp, Artificial Sequence
  Description of Artificial Sequence: Synthetic oligonucleotide
  Target: ATXN1; (+) strand; PAM type: NRG; PAM sequence: AAG
catgaatggagtaagtctga

SEQ ID NO: 122031 - DNA, 20 bp, Artificial Sequence
  Description of Artificial Sequence: Synthetic oligonucleotide
  Target: ATXN1; (+) strand; PAM type: NRG; PAM sequence: GAG
aatatgccaaacttctattt

SEQ ID NO: 122032 - DNA, 20 bp, Artificial Sequence
  Description of Artificial Sequence: Synthetic oligonucleotide
  Target: ATXN1; (+) strand; PAM type: NRG; PAM sequence: AAG
tctttccatttaaaatgtcc

SEQ ID NO: 122033 - DNA, 20 bp, Artificial Sequence
  Description of Artificial Sequence: Synthetic oligonucleotide
  Target: ATXN1; (+) strand; PAM type: NRG; PAM sequence: AAG
taaaatgtaatttatcctac

SEQ ID NO: 122034 - DNA, 20 bp, Artificial Sequence
  Description of Artificial Sequence: Synthetic oligonucleotide
  Target: ATXN1; (+) strand; PAM type: NRG; PAM sequence: AAG
ttaacaatattccacattca

SEQ ID NO: 122035 - DNA, 20 bp, Artificial Sequence
  Description of Artificial Sequence: Synthetic oligonucleotide
  Target: ATXN1; (+) strand; PAM type: NRG; PAM sequence: CAG
atattccacattcaaagtct

SEQ ID NO: 122036 - DNA, 20 bp, Artificial Sequence
  Description of Artificial Sequence: Synthetic oligonucleotide
  Target: ATXN1; (+) strand; PAM type: NRG; PAM sequence: GAG
attccacattcaaagtctca

SEQ ID NO: 122037 - DNA, 20 bp, Artificial Sequence
  Description of Artificial Sequence: Synthetic oligonucleotide
  Target: ATXN1; (+) strand; PAM type: NRG; PAM sequence: TGG
tataaaccttcactttgacc

SEQ ID NO: 122038 - DNA, 20 bp, Artificial Sequence
  Description of Artificial Sequence: Synthetic oligonucleotide
  Target: ATXN1; (+) strand; PAM type: NRG; PAM sequence: CAG
cctggcaactttgacacact

SEQ ID NO: 122039 - DNA, 20 bp, Artificial Sequence
  Description of Artificial Sequence: Synthetic oligonucleotide
  Target: ATXN1; (+) strand; PAM type: NRG; PAM sequence: AAG
gcaactttgacacactcaga

SEQ ID NO: 122040 - DNA, 20 bp, Artificial Sequence
  Description of Artificial Sequence: Synthetic oligonucleotide
  Target: ATXN1; (+) strand; PAM type: NRG; PAM sequence: AGG
caactttgacacactcagaa

SEQ ID NO: 122041 - DNA, 20 bp, Artificial Sequence
  Description of Artificial Sequence: Synthetic oligonucleotide
  Target: ATXN1; (+) strand; PAM type: NRG; PAM sequence: GAG
actttgacacactcagaaag

SEQ ID NO: 122042 - DNA, 20 bp, Artificial Sequence
  Description of Artificial Sequence: Synthetic oligonucleotide
  Target: ATXN1; (+) strand; PAM type: NRG; PAM sequence: GAG
tttgacacactcagaaagga

SEQ ID NO: 122043 - DNA, 20 bp, Artificial Sequence
  Description of Artificial Sequence: Synthetic oligonucleotide
  Target: ATXN1; (+) strand; PAM type: NRG; PAM sequence: GAG
tgacacactcagaaaggaga

SEQ ID NO: 122044 - DNA, 20 bp, Artificial Sequence
  Description of Artificial Sequence: Synthetic oligonucleotide
  Target: ATXN1; (+) strand; PAM type: NRG; PAM sequence: GAG
acacactcagaaaggagaga

SEQ ID NO: 122045 - DNA, 20 bp, Artificial Sequence
  Description of Artificial Sequence: Synthetic oligonucleotide
  Target: ATXN1; (+) strand; PAM type: NRG; PAM sequence: AAG
tcagaaaggagagagagaac

SEQ ID NO: 122046 - DNA, 20 bp, Artificial Sequence
  Description of Artificial Sequence: Synthetic oligonucleotide
  Target: ATXN1; (+) strand; PAM type: NRG; PAM sequence: AAG
aggagagagagaacaagaaa

SEQ ID NO: 122047 - DNA, 20 bp, Artificial Sequence
  Description of Artificial Sequence: Synthetic oligonucleotide
  Target: ATXN1; (+) strand; PAM type: NRG; PAM sequence: AAG
acaagaaaaagcacttcctg

SEQ ID NO: 122048 - DNA, 20 bp, Artificial Sequence
  Description of Artificial Sequence: Synthetic oligonucleotide
  Target: ATXN1; (+) strand; PAM type: NRG; PAM sequence: AAG
aaaaagcacttcctgaagcc

SEQ ID NO: 122049 - DNA, 20 bp, Artificial Sequence
  Description of Artificial Sequence: Synthetic oligonucleotide
  Target: ATXN1; (+) strand; PAM type: NRG; PAM sequence: AGG
aaaagcacttcctgaagcca

SEQ ID NO: 122050 - DNA, 20 bp, Artificial Sequence
  Description of Artificial Sequence: Synthetic oligonucleotide
  Target: ATXN1; (+) strand; PAM type: NRG; PAM sequence: CGG
ggtgtccaatatcttgccat

SEQ ID NO: 122051 - DNA, 20 bp, Artificial Sequence
  Description of Artificial Sequence: Synthetic oligonucleotide
  Target: ATXN1; (+) strand; PAM type: NRG; PAM sequence: TGG
caatatcttgccatcggacc

SEQ ID NO: 122052 - DNA, 20 bp, Artificial Sequence
  Description of Artificial Sequence: Synthetic oligonucleotide
  Target: ATXN1; (+) strand; PAM type: NRG; PAM sequence: GGG
aatatcttgccatcggacct

SEQ ID NO: 122053 - DNA, 20 bp, Artificial Sequence
  Description of Artificial Sequence: Synthetic oligonucleotide
  Target: ATXN1; (+) strand; PAM type: NRG; PAM sequence: CAG
tcggacctgggaaattacgc

SEQ ID NO: 122054 - DNA, 20 bp, Artificial Sequence
  Description of Artificial Sequence: Synthetic oligonucleotide
  Target: ATXN1; (+) strand; PAM type: NRG; PAM sequence: AGG
cggacctgggaaattacgcc

SEQ ID NO: 122055 - DNA, 20 bp, Artificial Sequence
  Description of Artificial Sequence: Synthetic oligonucleotide
  Target: ATXN1; (+) strand; PAM type: NRG; PAM sequence: CAG
gggaaattacgccaggctgt

SEQ ID NO: 122056 - DNA, 20 bp, Artificial Sequence
  Description of Artificial Sequence: Synthetic oligonucleotide
  Target: ATXN1; (+) strand; PAM type: NRG; PAM sequence: TAG
tgtcagtttcatcctctgcc

SEQ ID NO: 122057 - DNA, 20 bp, Artificial Sequence
  Description of Artificial Sequence: Synthetic oligonucleotide
  Target: ATXN1; (+) strand; PAM type: NRG; PAM sequence: GAG
tcagtttcatcctctgccta

SEQ ID NO: 122058 - DNA, 20 bp, Artificial Sequence
  Description of Artificial Sequence: Synthetic oligonucleotide
  Target: ATXN1; (+) strand; PAM type: NRG; PAM sequence: AGG
cagtttcatcctctgcctag

SEQ ID NO: 122059 - DNA, 20 bp, Artificial Sequence
  Description of Artificial Sequence: Synthetic oligonucleotide
  Target: ATXN1; (+) strand; PAM type: NRG; PAM sequence: GAG
gtttcatcctctgcctagag

SEQ ID NO: 122060 - DNA, 20 bp, Artificial Sequence
  Description of Artificial Sequence: Synthetic oligonucleotide
  Target: ATXN1; (+) strand; PAM type: NRG; PAM sequence: CAG
ctccttcccctgactgccca

SEQ ID NO: 122061 - DNA, 20 bp, Artificial Sequence
  Description of Artificial Sequence: Synthetic oligonucleotide
  Target: ATXN1; (+) strand; PAM type: NRG; PAM sequence: CAG
ctgactgcccacagcactta

SEQ ID NO: 122062 - DNA, 20 bp, Artificial Sequence
  Description of Artificial Sequence: Synthetic oligonucleotide
  Target: ATXN1; (+) strand; PAM type: NRG; PAM sequence: AAG
tctaccacacattctgaccc

SEQ ID NO: 122063 - DNA, 20 bp, Artificial Sequence
  Description of Artificial Sequence: Synthetic oligonucleotide
  Target: ATXN1; (+) strand; PAM type: NRG; PAM sequence: AGG
ctaccacacattctgaccca

SEQ ID NO: 122064 - DNA, 20 bp, Artificial Sequence
  Description of Artificial Sequence: Synthetic oligonucleotide
  Target: ATXN1; (+) strand; PAM type: NRG; PAM sequence: CAG
ttctgacccaaggtcctttt

SEQ ID NO: 122065 - DNA, 20 bp, Artificial Sequence
  Description of Artificial Sequence: Synthetic oligonucleotide
  Target: ATXN1; (+) strand; PAM type: NRG; PAM sequence: CAG
acccaaggtccttttcagtt

SEQ ID NO: 122066 - DNA, 20 bp, Artificial Sequence
  Description of Artificial Sequence: Synthetic oligonucleotide
  Target: ATXN1; (+) strand; PAM type: NRG; PAM sequence: TGG
actgtctttttatactccac

SEQ ID NO: 122067 - DNA, 20 bp, Artificial Sequence
  Description of Artificial Sequence: Synthetic oligonucleotide
  Target: ATXN1; (+) strand; PAM type: NRG; PAM sequence: AAG
atactccactggatttattt

SEQ ID NO: 122068 - DNA, 20 bp, Artificial Sequence
  Description of Artificial Sequence: Synthetic oligonucleotide
  Target: ATXN1; (+) strand; PAM type: NRG; PAM sequence: AAG
ctggatttatttaagtcttg

SEQ ID NO: 122069 - DNA, 20 bp, Artificial Sequence
  Description of Artificial Sequence: Synthetic oligonucleotide
  Target: ATXN1; (+) strand; PAM type: NRG; PAM sequence: AGG
tggatttatttaagtcttga

SEQ ID NO: 122070 - DNA, 20 bp, Artificial Sequence
  Description of Artificial Sequence: Synthetic oligonucleotide
  Target: ATXN1; (+) strand; PAM type: NRG; PAM sequence: AAG
ttaagtcttgaaggctcaaa

SEQ ID NO: 122071 - DNA, 20 bp, Artificial Sequence
  Description of Artificial Sequence: Synthetic oligonucleotide
  Target: ATXN1; (+) strand; PAM type: NRG; PAM sequence: AAG
tgaaggctcaaaaagtttct

SEQ ID NO: 122072 - DNA, 20 bp, Artificial Sequence
  Description of Artificial Sequence: Synthetic oligonucleotide
  Target: ATXN1; (+) strand; PAM type: NRG; PAM sequence: AAG
gtttctaagctctctgatga

SEQ ID NO: 122073 - DNA, 20 bp, Artificial Sequence
  Description of Artificial Sequence: Synthetic oligonucleotide
  Target: ATXN1; (+) strand; PAM type: NRG; PAM sequence: CAG
cttcttttgcaacctcctaa

SEQ ID NO: 122074 - DNA, 20 bp, Artificial Sequence
  Description of Artificial Sequence: Synthetic oligonucleotide
  Target: ATXN1; (+) strand; PAM type: NRG; PAM sequence: TAG
tgcaacctcctaacagcatc

SEQ ID NO: 122075 - DNA, 20 bp, Artificial Sequence
  Description of Artificial Sequence: Synthetic oligonucleotide
  Target: ATXN1; (+) strand; PAM type: NRG; PAM sequence: TGG
aacctcctaacagcatctag

SEQ ID NO: 122076 - DNA, 20 bp, Artificial Sequence
  Description of Artificial Sequence: Synthetic oligonucleotide
  Target: ATXN1; (+) strand; PAM type: NRG; PAM sequence: AAG
ctcctaacagcatctagtgg

SEQ ID NO: 122077 - DNA, 20 bp, Artificial Sequence
  Description of Artificial Sequence: Synthetic oligonucleotide
  Target: ATXN1; (+) strand; PAM type: NRG; PAM sequence: GAG
cctaacagcatctagtggaa

SEQ ID NO: 122078 - DNA, 20 bp, Artificial Sequence
  Description of Artificial Sequence: Synthetic oligonucleotide
  Target: ATXN1; (+) strand; PAM type: NRG; PAM sequence: TGG
cagcatctagtggaagagcc

SEQ ID NO: 122079 - DNA, 20 bp, Artificial Sequence
  Description of Artificial Sequence: Synthetic oligonucleotide
  Target: ATXN1; (+) strand; PAM type: NRG; PAM sequence: TAG
tccatatccaaaacctgttc

SEQ ID NO: 122080 - DNA, 20 bp, Artificial Sequence
  Description of Artificial Sequence: Synthetic oligonucleotide
  Target: ATXN1; (+) strand; PAM type: NRG; PAM sequence: AGG
ccatatccaaaacctgttct

SEQ ID NO: 122081 - DNA, 20 bp, Artificial Sequence
  Description of Artificial Sequence: Synthetic oligonucleotide
  Target: ATXN1; (+) strand; PAM type: NRG; PAM sequence: AAG
ggacttaacccttactccaa

SEQ ID NO: 122082 - DNA, 20 bp, Artificial Sequence
  Description of Artificial Sequence: Synthetic oligonucleotide
  Target: ATXN1; (+) strand; PAM type: NRG; PAM sequence: CAG
ccttactccaaaagaatcac

SEQ ID NO: 122083 - DNA, 20 bp, Artificial Sequence
  Description of Artificial Sequence: Synthetic oligonucleotide
  Target: ATXN1; (+) strand; PAM type: NRG; PAM sequence: CAG
ccaaaagaatcaccagtcta

SEQ ID NO: 122084 - DNA, 20 bp, Artificial Sequence
  Description of Artificial Sequence: Synthetic oligonucleotide
  Target: ATXN1; (+) strand; PAM type: NRG; PAM sequence: AAG
ccagtctacagctatgcttt

SEQ ID NO: 122085 - DNA, 20 bp, Artificial Sequence
  Description of Artificial Sequence: Synthetic oligonucleotide
  Target: ATXN1; (+) strand; PAM type: NRG; PAM sequence: CAG
tttcacctttctctgtcttc

SEQ ID NO: 122086 - DNA, 20 bp, Artificial Sequence
  Description of Artificial Sequence: Synthetic oligonucleotide
  Target: ATXN1; (+) strand; PAM type: NRG; PAM sequence: AGG
ttcacctttctctgtcttcc

SEQ ID NO: 122087 - DNA, 20 bp, Artificial Sequence
  Description of Artificial Sequence: Synthetic oligonucleotide
  Target: ATXN1; (+) strand; PAM type: NRG; PAM sequence: GGG
tcacctttctctgtcttcca

SEQ ID NO: 122088 - DNA, 20 bp, Artificial Sequence
  Description of Artificial Sequence: Synthetic oligonucleotide
  Target: ATXN1; (+) strand; PAM type: NRG; PAM sequence: AAG
tctgtcttccagggacttga

SEQ ID NO: 122089 - DNA, 20 bp, Artificial Sequence
  Description of Artificial Sequence: Synthetic oligonucleotide
  Target: ATXN1; (+) strand; PAM type: NRG; PAM sequence: CAG
tgcctatcatcatcatgtgt

SEQ ID NO: 122090 - DNA, 20 bp, Artificial Sequence
  Description of Artificial Sequence: Synthetic oligonucleotide
  Target: ATXN1; (+) strand; PAM type: NRG; PAM sequence: TAG
aaaaaaattaaattacaact

SEQ ID NO: 122091 - DNA, 20 bp, Artificial Sequence
  Description of Artificial Sequence: Synthetic oligonucleotide
  Target: ATXN1; (+) strand; PAM type: NRG; PAM sequence: AAG
cttccaatccattacatctt

SEQ ID NO: 122092 - DNA, 20 bp, Artificial Sequence
  Description of Artificial Sequence: Synthetic oligonucleotide
  Target: ATXN1; (+) strand; PAM type: NRG; PAM sequence: TAG
tccattacatcttaagtcat

SEQ ID NO: 122093 - DNA, 20 bp, Artificial Sequence
  Description of Artificial Sequence: Synthetic oligonucleotide
  Target: ATXN1; (+) strand; PAM type: NRG; PAM sequence: TGG
attacatcttaagtcattag

SEQ ID NO: 122094 - DNA, 20 bp, Artificial Sequence
  Description of Artificial Sequence: Synthetic oligonucleotide
  Target: ATXN1; (+) strand; PAM type: NRG; PAM sequence: CAG
agtcattagtggaatttgaa

SEQ ID NO: 122095 - DNA, 20 bp, Artificial Sequence
  Description of Artificial Sequence: Synthetic oligonucleotide
  Target: ATXN1; (+) strand; PAM type: NRG; PAM sequence: AAG
aacagttgtcatctcctttc

SEQ ID NO: 122096 - DNA, 20 bp, Artificial Sequence
  Description of Artificial Sequence: Synthetic oligonucleotide
  Target: ATXN1; (+) strand; PAM type: NRG; PAM sequence: CAG
ctcccccatttcctcatcac

SEQ ID NO: 122097 - DNA, 20 bp, Artificial Sequence
  Description of Artificial Sequence: Synthetic oligonucleotide
  Target: ATXN1; (+) strand; PAM type: NRG; PAM sequence: CAG
ccccatttcctcatcaccag

SEQ ID NO: 122098 - DNA, 20 bp, Artificial Sequence
  Description of Artificial Sequence: Synthetic oligonucleotide
  Target: ATXN1; (+) strand; PAM type: NRG; PAM sequence: TAG
tcaccagcagcttacatcac

SEQ ID NO: 122099 - DNA, 20 bp, Artificial Sequence
  Description of Artificial Sequence: Synthetic oligonucleotide
  Target: ATXN1; (+) strand; PAM type: NRG; PAM sequence: TAG
gcttacatcactagctctca

SEQ ID NO: 122100 - DNA, 20 bp, Artificial Sequence
  Description of Artificial Sequence: Synthetic oligonucleotide
  Target: ATXN1; (+) strand; PAM type: NRG; PAM sequence: AAG
ctagctctcatagcttctca

SEQ ID NO: 122101 - DNA, 20 bp, Artificial Sequence
  Description of Artificial Sequence: Synthetic oligonucleotide
  Target: ATXN1; (+) strand; PAM type: NRG; PAM sequence: AAG
agcttctcaaagccactatt

SEQ ID NO: 122102 - DNA, 20 bp, Artificial Sequence
  Description of Artificial Sequence: Synthetic oligonucleotide
  Target: ATXN1; (+) strand; PAM type: NRG; PAM sequence: AGG
gcttctcaaagccactatta

SEQ ID NO: 122103 - DNA, 20 bp, Artificial Sequence
  Description of Artificial Sequence: Synthetic oligonucleotide
  Target: ATXN1; (+) strand; PAM type: NRG; PAM sequence: TGG
cactattaaggaaaccttca

SEQ ID NO: 122104 - DNA, 20 bp, Artificial Sequence
  Description of Artificial Sequence: Synthetic oligonucleotide
  Target: ATXN1; (+) strand; PAM type: NRG; PAM sequence: TGG
aaggaaaccttcatggcatg

SEQ ID NO: 122105 - DNA, 20 bp, Artificial Sequence
  Description of Artificial Sequence: Synthetic oligonucleotide
  Target: ATXN1; (+) strand; PAM type: NRG; PAM sequence: GAG
ggaaaccttcatggcatgtg

SEQ ID NO: 122106 - DNA, 20 bp, Artificial Sequence
  Description of Artificial Sequence: Synthetic oligonucleotide
  Target: ATXN1; (+) strand; PAM type: NRG; PAM sequence: AGG
gaaaccttcatggcatgtgg

SEQ ID NO: 122107 - DNA, 20 bp, Artificial Sequence
  Description of Artificial Sequence: Synthetic oligonucleotide
  Target: ATXN1; (+) strand; PAM type: NRG; PAM sequence: GGG
aaaccttcatggcatgtgga

SEQ ID NO: 122108 - DNA, 20 bp, Artificial Sequence
  Description of Artificial Sequence: Synthetic oligonucleotide
  Target: ATXN1; (+) strand; PAM type: NRG; PAM sequence: GGG
aaccttcatggcatgtggag

SEQ ID NO: 122109 - DNA, 20 bp, Artificial Sequence
  Description of Artificial Sequence: Synthetic oligonucleotide
  Target: ATXN1; (+) strand; PAM type: NRG; PAM sequence: GAG
ccttcatggcatgtggaggg

SEQ ID NO: 122110 - DNA, 20 bp, Artificial Sequence
  Description of Artificial Sequence: Synthetic oligonucleotide
  Target: ATXN1; (+) strand; PAM type: NRG; PAM sequence: CAG
tggcatgtggaggggagatg

SEQ ID NO: 122111 - DNA, 20 bp, Artificial Sequence
  Description of Artificial Sequence: Synthetic oligonucleotide
  Target: ATXN1; (+) strand; PAM type: NRG; PAM sequence: GAG
gaggggagatgcagacctct

SEQ ID NO: 122112 - DNA, 20 bp, Artificial Sequence
  Description of Artificial Sequence: Synthetic oligonucleotide
  Target: ATXN1; (+) strand; PAM type: NRG; PAM sequence: AGG
aggggagatgcagacctctg

SEQ ID NO: 122113 - DNA, 20 bp, Artificial Sequence
  Description of Artificial Sequence: Synthetic oligonucleotide
  Target: ATXN1; (+) strand; PAM type: NRG; PAM sequence: CAG
ggagatgcagacctctgagg

SEQ ID NO: 122114 - DNA, 20 bp, Artificial Sequence
  Description of Artificial Sequence: Synthetic oligonucleotide
  Target: ATXN1; (+) strand; PAM type: NRG; PAM sequence: AAG
ggcagtgatattcaaacttg

SEQ ID NO: 122115 - DNA, 20 bp, Artificial Sequence
  Description of Artificial Sequence: Synthetic oligonucleotide
  Target: ATXN1; (+) strand; PAM type: NRG; PAM sequence: CAG
agtgatattcaaacttgaag

SEQ ID NO: 122116 - DNA, 20 bp, Artificial Sequence
  Description of Artificial Sequence: Synthetic oligonucleotide
  Target: ATXN1; (+) strand; PAM type: NRG; PAM sequence: CAG
attcaaacttgaagcagcat

SEQ ID NO: 122117 - DNA, 20 bp, Artificial Sequence
  Description of Artificial Sequence: Synthetic oligonucleotide
  Target: ATXN1; (+) strand; PAM type: NRG; PAM sequence: TGG
acttgaagcagcatcagaaa

SEQ ID NO: 122118 - DNA, 20 bp, Artificial Sequence
  Description of Artificial Sequence: Synthetic oligonucleotide
  Target: ATXN1; (+) strand; PAM type: NRG; PAM sequence: TGG
gaagcagcatcagaaatggc

SEQ ID NO: 122119 - DNA, 20 bp, Artificial Sequence
  Description of Artificial Sequence: Synthetic oligonucleotide
  Target: ATXN1; (+) strand; PAM type: NRG; PAM sequence: GAG
agcagcatcagaaatggctg

SEQ ID NO: 122120 - DNA, 20 bp, Artificial Sequence
  Description of Artificial Sequence: Synthetic oligonucleotide
  Target: ATXN1; (+) strand; PAM type: NRG; PAM sequence: AAG
agcatcagaaatggctggag

SEQ ID NO: 122121 - DNA, 20 bp, Artificial Sequence
  Description of Artificial Sequence: Synthetic oligonucleotide
  Target: ATXN1; (+) strand; PAM type: NRG; PAM sequence: AGG
gcatcagaaatggctggaga

SEQ ID NO: 122122 - DNA, 20 bp, Artificial Sequence
  Description of Artificial Sequence: Synthetic oligonucleotide
  Target: ATXN1; (+) strand; PAM type: NRG; PAM sequence: CAG
cagaaatggctggagaaggc

SEQ ID NO: 122123 - DNA, 20 bp, Artificial Sequence
  Description of Artificial Sequence: Synthetic oligonucleotide
  Target: ATXN1; (+) strand; PAM type: NRG; PAM sequence: AGG
agaaatggctggagaaggcc

SEQ ID NO: 122124 - DNA, 20 bp, Artificial Sequence
  Description of Artificial Sequence: Synthetic oligonucleotide
  Target: ATXN1; (+) strand; PAM type: NRG; PAM sequence: CAG
tggctggagaaggccaggtg

SEQ ID NO: 122125 - DNA, 20 bp, Artificial Sequence
  Description of Artificial Sequence: Synthetic oligonucleotide
  Target: ATXN1; (+) strand; PAM type: NRG; PAM sequence: TGG
ctggagaaggccaggtgcag

SEQ ID NO: 122126 - DNA, 20 bp, Artificial Sequence
  Description of Artificial Sequence: Synthetic oligonucleotide
  Target: ATXN1; (+) strand; PAM type: NRG; PAM sequence: CAG
gtggctcacacctgtaatcc

SEQ ID NO: 122127 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatcccagcactt

SEQ ID NO: 122128 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccagcacttt

SEQ ID NO: 122129 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 122130 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 122131 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggct

SEQ ID NO: 122132 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggctg

SEQ ID NO: 122133 - DNA, 20 bp, Artificial Sequence
  Description of Artificial Sequence: Synthetic oligonucleotide
  Target: ATXN1; (+) strand; PAM type: NRG; PAM sequence: CAG
agcactttgggaggctgagg

SEQ ID NO: 122134 - DNA, 20 bp, Artificial Sequence
  Description of Artificial Sequence: Synthetic oligonucleotide
  Target: ATXN1; (+) strand; PAM type: NRG; PAM sequence: AGG
gcactttgggaggctgaggc

SEQ ID NO: 122135 - DNA, 20 bp, Artificial Sequence
  Description of Artificial Sequence: Synthetic oligonucleotide
  Target: ATXN1; (+) strand; PAM type: NRG; PAM sequence: AAG
ctttgggaggctgaggcagg

SEQ ID NO: 122136 - DNA, 20 bp, Artificial Sequence
  Description of Artificial Sequence: Synthetic oligonucleotide
  Target: ATXN1; (+) strand; PAM type: NRG; PAM sequence: AGG
tttgggaggctgaggcagga

SEQ ID NO: 122137 - DNA, 20 bp, Artificial Sequence
  Description of Artificial Sequence: Synthetic oligonucleotide
  Target: ATXN1; (+) strand; PAM type: NRG; PAM sequence: TGG
gggaggctgaggcaggaagg

SEQ ID NO: 122138 - DNA, 20 bp, Artificial Sequence
  Description of Artificial Sequence: Synthetic oligonucleotide
  Target: ATXN1; (+) strand; PAM type: NRG; PAM sequence: GAG
ctgaggcaggaaggtggctt

SEQ ID NO: 122139 - DNA, 20 bp, Artificial Sequence
  Description of Artificial Sequence: Synthetic oligonucleotide
  Target: ATXN1; (+) strand; PAM type: NRG; PAM sequence: CAG
gcaggaaggtggcttgagct

SEQ ID NO: 122140 - DNA, 20 bp, Artificial Sequence
  Description of Artificial Sequence: Synthetic oligonucleotide
  Target: ATXN1; (+) strand; PAM type: NRG; PAM sequence: AGG
caggaaggtggcttgagctc

SEQ ID NO: 122141 - DNA, 20 bp, Artificial Sequence
  Description of Artificial Sequence: Synthetic oligonucleotide
  Target: ATXN1; (+) strand; PAM type: NRG; PAM sequence: GAG
ggaaggtggcttgagctcag

SEQ ID NO: 122142 - DNA, 20 bp, Artificial Sequence
  Description of Artificial Sequence: Synthetic oligonucleotide
  Target: ATXN1; (+) strand; PAM type: NRG; PAM sequence: AAG
tggcttgagctcaggagttc

SEQ ID NO: 122143 - DNA, 20 bp, Artificial Sequence
  Description of Artificial Sequence: Synthetic oligonucleotide
  Target: ATXN1; (+) strand; PAM type: NRG; PAM sequence: AGG
ggcttgagctcaggagttca

SEQ ID NO: 122144 - DNA, 20 bp, Artificial Sequence
  Description of Artificial Sequence: Synthetic oligonucleotide
  Target: ATXN1; (+) strand; PAM type: NRG; PAM sequence: CAG
atgatcacgccactgtaccc

SEQ ID NO: 122145 - DNA, 20 bp, Artificial Sequence
  Description of Artificial Sequence: Synthetic oligonucleotide
  Target: ATXN1; (+) strand; PAM type: NRG; PAM sequence: TGG
cacgccactgtaccccagcc

SEQ ID NO: 122146 - DNA, 20 bp, Artificial Sequence
  Description of Artificial Sequence: Synthetic oligonucleotide
  Target: ATXN1; (+) strand; PAM type: NRG; PAM sequence: GGG
acgccactgtaccccagcct

SEQ ID NO: 122147 - DNA, 20 bp, Artificial Sequence
  Description of Artificial Sequence: Synthetic oligonucleotide
  Target: ATXN1; (+) strand; PAM type: NRG; PAM sequence: AAG
ctgtaccccagcctgggcga

SEQ ID NO: 122148 - DNA, 20 bp, Artificial Sequence
  Description of Artificial Sequence: Synthetic oligonucleotide
  Target: ATXN1; (+) strand; PAM type: NRG; PAM sequence: AAG
cccagcctgggcgaaagaac

SEQ ID NO: 122149 - DNA, 20 bp, Artificial Sequence
  Description of Artificial Sequence: Synthetic oligonucleotide
  Target: ATXN1; (+) strand; PAM type: NRG; PAM sequence: AAG
acaagactccgactcaaaaa

SEQ ID NO: 122150 - DNA, 20 bp, Artificial Sequence
  Description of Artificial Sequence: Synthetic oligonucleotide
  Target: ATXN1; (+) strand; PAM type: NRG; PAM sequence: AGG
caagactccgactcaaaaaa

SEQ ID NO: 122151 - DNA, 20 bp, Artificial Sequence
  Description of Artificial Sequence: Synthetic oligonucleotide
  Target: ATXN1; (+) strand; PAM type: NRG; PAM sequence: AAG
actccgactcaaaaaaagga

SEQ ID NO: 122152 - DNA, 20 bp, Artificial Sequence
  Description of Artificial Sequence: Synthetic oligonucleotide
  Target: ATXN1; (+) strand; PAM type: NRG; PAM sequence: TAG
aaaaaaaggaaagaaacgaa

SEQ ID NO: 122153 - DNA, 20 bp, Artificial Sequence
  Description of Artificial Sequence: Synthetic oligonucleotide
  Target: ATXN1; (+) strand; PAM type: NRG; PAM sequence: TGG
aggaaagaaacgaatagaaa

SEQ ID NO: 122154 - DNA, 20 bp, Artificial Sequence
  Description of Artificial Sequence: Synthetic oligonucleotide
  Target: ATXN1; (+) strand; PAM type: NRG; PAM sequence: TAG
aagaaacgaatagaaatggc

SEQ ID NO: 122155 - DNA, 20 bp, Artificial Sequence
  Description of Artificial Sequence: Synthetic oligonucleotide
  Target: ATXN1; (+) strand; PAM type: NRG; PAM sequence: GAG
gaaacgaatagaaatggcta

SEQ ID NO: 122156 - DNA, 20 bp, Artificial Sequence
  Description of Artificial Sequence: Synthetic oligonucleotide
  Target: ATXN1; (+) strand; PAM type: NRG; PAM sequence: AGG
aaacgaatagaaatggctag

SEQ ID NO: 122157 - DNA, 20 bp, Artificial Sequence
  Description of Artificial Sequence: Synthetic oligonucleotide
  Target: ATXN1; (+) strand; PAM type: NRG; PAM sequence: GGG
aacgaatagaaatggctaga

SEQ ID NO: 122158 - DNA, 20 bp, Artificial Sequence
  Description of Artificial Sequence: Synthetic oligonucleotide
  Target: ATXN1; (+) strand; PAM type: NRG; PAM sequence: CAG
gctagagggtcttgttaaat

SEQ ID NO: 122159 - DNA, 20 bp, Artificial Sequence
  Description of Artificial Sequence: Synthetic oligonucleotide
  Target: ATXN1; (+) strand; PAM type: NRG; PAM sequence: GAG
tagagggtcttgttaaatca

SEQ ID NO: 122160 - DNA, 20 bp, Artificial Sequence
  Description of Artificial Sequence: Synthetic oligonucleotide
  Target: ATXN1; (+) strand; PAM type: NRG; PAM sequence: AAG
ttgttaaatcagagaatgct

SEQ ID NO: 122161 - DNA, 20 bp, Artificial Sequence
  Description of Artificial Sequence: Synthetic oligonucleotide
  Target: ATXN1; (+) strand; PAM type: NRG; PAM sequence: TAG
agaatgctaagacccatctg

SEQ ID NO: 122162 - DNA, 20 bp, Artificial Sequence
  Description of Artificial Sequence: Synthetic oligonucleotide
  Target: ATXN1; (+) strand; PAM type: NRG; PAM sequence: CAG
catctgtagaatttctgatt

SEQ ID NO: 122163 - DNA, 20 bp, Artificial Sequence
  Description of Artificial Sequence: Synthetic oligonucleotide
  Target: ATXN1; (+) strand; PAM type: NRG; PAM sequence: TAG
ctgtagaatttctgattcag

SEQ ID NO: 122164 - DNA, 20 bp, Artificial Sequence
  Description of Artificial Sequence: Synthetic oligonucleotide
  Target: ATXN1; (+) strand; PAM type: NRG; PAM sequence: AGG
tgtagaatttctgattcagt

SEQ ID NO: 122165 - DNA, 20 bp, Artificial Sequence
  Description of Artificial Sequence: Synthetic oligonucleotide
  Target: ATXN1; (+) strand; PAM type: NRG; PAM sequence: TGG
aatttctgattcagtaggct

SEQ ID NO: 122166 - DNA, 20 bp, Artificial Sequence
  Description of Artificial Sequence: Synthetic oligonucleotide
  Target: ATXN1; (+) strand; PAM type: NRG; PAM sequence: GGG
atttctgattcagtaggctt

SEQ ID NO: 122167 - DNA, 20 bp, Artificial Sequence
  Description of Artificial Sequence: Synthetic oligonucleotide
  Target: ATXN1; (+) strand; PAM type: NRG; PAM sequence: GGG
tttctgattcagtaggcttg

SEQ ID NO: 122168 - DNA, 20 bp, Artificial Sequence
  Description of Artificial Sequence: Synthetic oligonucleotide
  Target: ATXN1; (+) strand; PAM type: NRG; PAM sequence: TGG
ctgattcagtaggcttgggg

SEQ ID NO: 122169 - DNA, 20 bp, Artificial Sequence
  Description of Artificial Sequence: Synthetic oligonucleotide
  Target: ATXN1; (+) strand; PAM type: NRG; PAM sequence: GGG
tgattcagtaggcttggggt

SEQ ID NO: 122170 - DNA, 20 bp, Artificial Sequence
  Description of Artificial Sequence: Synthetic oligonucleotide
  Target: ATXN1; (+) strand; PAM type: NRG; PAM sequence: GGG
gattcagtaggcttggggtg

SEQ ID NO: 122171 - DNA, 20 bp, Artificial Sequence
  Description of Artificial Sequence: Synthetic oligonucleotide
  Target: ATXN1; (+) strand; PAM type: NRG; PAM sequence: CAG
cagtaggcttggggtggggt

SEQ ID NO: 122172 - DNA, 20 bp, Artificial Sequence
  Description of Artificial Sequence: Synthetic oligonucleotide
  Target: ATXN1; (+) strand; PAM type: NRG; PAM sequence: AAG
agataatttgtatttctgac

SEQ ID NO: 122173 - DNA, 20 bp, Artificial Sequence
  Description of Artificial Sequence: Synthetic oligonucleotide
  Target: ATXN1; (+) strand; PAM type: NRG; PAM sequence: CAG
ttgtatttctgacaagttcc

SEQ ID NO: 122174 - DNA, 20 bp, Artificial Sequence
  Description of Artificial Sequence: Synthetic oligonucleotide
  Target: ATXN1; (+) strand; PAM type: NRG; PAM sequence: AGG
tgtatttctgacaagttccc

SEQ ID NO: 122175 - DNA, 20 bp, Artificial Sequence
  Description of Artificial Sequence: Synthetic oligonucleotide
  Target: ATXN1; (+) strand; PAM type: NRG; PAM sequence: TGG
ccaggtgatgctgatactgc

SEQ ID NO: 122176 - DNA, 20 bp, Artificial Sequence
  Description of Artificial Sequence: Synthetic oligonucleotide
  Target: ATXN1; (+) strand; PAM type: NRG; PAM sequence: CAG
tgatgctgatactgctggtc

SEQ ID NO: 122177 - DNA, 20 bp, Artificial Sequence
  Description of Artificial Sequence: Synthetic oligonucleotide
  Target: ATXN1; (+) strand; PAM type: NRG; PAM sequence: AGG
gatgctgatactgctggtcc

SEQ ID NO: 122178 - DNA, 20 bp, Artificial Sequence
  Description of Artificial Sequence: Synthetic oligonucleotide
  Target: ATXN1; (+) strand; PAM type: NRG; PAM sequence: GGG
atgctgatactgctggtcca

SEQ ID NO: 122179 - DNA, 20 bp, Artificial Sequence
  Description of Artificial Sequence: Synthetic oligonucleotide
  Target: ATXN1; (+) strand; PAM type: NRG; PAM sequence: CAG
gatactgctggtccagggac

SEQ ID NO: 122180 - DNA, 20 bp, Artificial Sequence
  Description of Artificial Sequence: Synthetic oligonucleotide
  Target: ATXN1; (+) strand; PAM type: NRG; PAM sequence: GAG
tggtccagggaccagacttt

SEQ ID NO: 122181 - DNA, 20 bp, Artificial Sequence
  Description of Artificial Sequence: Synthetic oligonucleotide
  Target: ATXN1; (+) strand; PAM type: NRG; PAM sequence: AAG
actttgagaaccacttctct

SEQ ID NO: 122182 - DNA, 20 bp, Artificial Sequence
  Description of Artificial Sequence: Synthetic oligonucleotide
  Target: ATXN1; (+) strand; PAM type: NRG; PAM sequence: AGG
ctttgagaaccacttctcta

SEQ ID NO: 122183 - DNA, 20 bp, Artificial Sequence
  Description of Artificial Sequence: Synthetic oligonucleotide
  Target: ATXN1; (+) strand; PAM type: NRG; PAM sequence: CAG
ttaaatgtttctgtcaatta

SEQ ID NO: 122184 - DNA, 20 bp, Artificial Sequence
  Description of Artificial Sequence: Synthetic oligonucleotide
  Target: ATXN1; (+) strand; PAM type: NRG; PAM sequence: AGG
taaatgtttctgtcaattac

SEQ ID NO: 122185 - DNA, 20 bp, Artificial Sequence
  Description of Artificial Sequence: Synthetic oligonucleotide
  Target: ATXN1; (+) strand; PAM type: NRG; PAM sequence: GGG
aaatgtttctgtcaattaca

SEQ ID NO: 122186 - DNA, 20 bp, Artificial Sequence
  Description of Artificial Sequence: Synthetic oligonucleotide
  Target: ATXN1; (+) strand; PAM type: NRG; PAM sequence: CAG
gtttctgtcaattacagggc

SEQ ID NO: 122187 - DNA, 20 bp, Artificial Sequence
  Description of Artificial Sequence: Synthetic oligonucleotide
  Target: ATXN1; (+) strand; PAM type: NRG; PAM sequence: GAG
ttctgtcaattacagggcca

SEQ ID NO: 122188 - DNA, 20 bp, Artificial Sequence
  Description of Artificial Sequence: Synthetic oligonucleotide
  Target: ATXN1; (+) strand; PAM type: NRG; PAM sequence: GAG
ctgtcaattacagggccaga

SEQ ID NO: 122189 - DNA, 20 bp, Artificial Sequence
  Description of Artificial Sequence: Synthetic oligonucleotide
  Target: ATXN1; (+) strand; PAM type: NRG; PAM sequence: GAG
tacagggccagagagatgct

SEQ ID NO: 122190 - DNA, 20 bp, Artificial Sequence
  Description of Artificial Sequence: Synthetic oligonucleotide
  Target: ATXN1; (+) strand; PAM type: NRG; PAM sequence: AGG
acagggccagagagatgctg

SEQ ID NO: 122191 - DNA, 20 bp, Artificial Sequence
  Description of Artificial Sequence: Synthetic oligonucleotide
  Target: ATXN1; (+) strand; PAM type: NRG; PAM sequence: GAG
agagatgctgaggatctttt

SEQ ID NO: 122192 - DNA, 20 bp, Artificial Sequence
  Description of Artificial Sequence: Synthetic oligonucleotide
  Target: ATXN1; (+) strand; PAM type: NRG; PAM sequence: TAG
tacatttaatcaccatttga

SEQ ID NO: 122193 - DNA, 20 bp, Artificial Sequence
  Description of Artificial Sequence: Synthetic oligonucleotide
  Target: ATXN1; (+) strand; PAM type: NRG; PAM sequence: AAG
ccatttgatagctacattga

SEQ ID NO: 122194 - DNA, 20 bp, Artificial Sequence
  Description of Artificial Sequence: Synthetic oligonucleotide
  Target: ATXN1; (+) strand; PAM type: NRG; PAM sequence: AAG
aatgatacctgtctatttca

SEQ ID NO: 122195 - DNA, 20 bp, Artificial Sequence
  Description of Artificial Sequence: Synthetic oligonucleotide
  Target: ATXN1; (+) strand; PAM type: NRG; PAM sequence: AAG
gatacctgtctatttcaaag

SEQ ID NO: 122196 - DNA, 20 bp, Artificial Sequence
  Description of Artificial Sequence: Synthetic oligonucleotide
  Target: ATXN1; (+) strand; PAM type: NRG; PAM sequence: CAG
acttcacacactatattacc

SEQ ID NO: 122197 - DNA, 20 bp, Artificial Sequence
  Description of Artificial Sequence: Synthetic oligonucleotide
  Target: ATXN1; (+) strand; PAM type: NRG; PAM sequence: AGG
cttcacacactatattaccc

SEQ ID NO: 122198 - DNA, 20 bp, Artificial Sequence
  Description of Artificial Sequence: Synthetic oligonucleotide
  Target: ATXN1; (+) strand; PAM type: NRG; PAM sequence: TGG
ccaggttattacactgtgtg

SEQ ID NO: 122199 - DNA, 20 bp, Artificial Sequence
  Description of Artificial Sequence: Synthetic oligonucleotide
  Target: ATXN1; (+) strand; PAM type: NRG; PAM sequence: TGG
ctgtgtgtggcctctctact

SEQ ID NO: 122200 - DNA, 20 bp, Artificial Sequence
  Description of Artificial Sequence: Synthetic oligonucleotide
  Target: ATXN1; (+) strand; PAM type: NRG; PAM sequence: GAG
gtgtgtggcctctctacttg

SEQ ID NO: 122201 - DNA, 20 bp, Artificial Sequence
  Description of Artificial Sequence: Synthetic oligonucleotide
  Target: ATXN1; (+) strand; PAM type: NRG; PAM sequence: TGG
tgaatccattctcctcctac

SEQ ID NO: 122202 - DNA, 20 bp, Artificial Sequence
  Description of Artificial Sequence: Synthetic oligonucleotide
  Target: ATXN1; (+) strand; PAM type: NRG; PAM sequence: CAG
cattctcctcctactggttc

SEQ ID NO: 122203 - DNA, 20 bp, Artificial Sequence
  Description of Artificial Sequence: Synthetic oligonucleotide
  Target: ATXN1; (+) strand; PAM type: NRG; PAM sequence: TGG
ctactggttccagatcctgc

SEQ ID NO: 122204 - DNA, 20 bp, Artificial Sequence
  Description of Artificial Sequence: Synthetic oligonucleotide
  Target: ATXN1; (+) strand; PAM type: NRG; PAM sequence: GGG
tactggttccagatcctgct

SEQ ID NO: 122205 - DNA, 20 bp, Artificial Sequence
  Description of Artificial Sequence: Synthetic oligonucleotide
  Target: ATXN1; (+) strand; PAM type: NRG; PAM sequence: GGG
actggttccagatcctgctg

SEQ ID NO: 122206 - DNA, 20 bp, Artificial Sequence
  Description of Artificial Sequence: Synthetic oligonucleotide
  Target: ATXN1; (+) strand; PAM type: NRG; PAM sequence: CAG
ctctgctcccaacttccctt

SEQ ID NO: 122207 - DNA, 20 bp, Artificial Sequence
  Description of Artificial Sequence: Synthetic oligonucleotide
  Target: ATXN1; (+) strand; PAM type: NRG; PAM sequence: TGG
tcagtctttttcctctctac

SEQ ID NO: 122208 - DNA, 20 bp, Artificial Sequence
  Description of Artificial Sequence: Synthetic oligonucleotide
  Target: ATXN1; (+) strand; PAM type: NRG; PAM sequence: AAG
ctggaaatttctcacactcc

SEQ ID NO: 122209 - DNA, 20 bp, Artificial Sequence
  Description of Artificial Sequence: Synthetic oligonucleotide
  Target: ATXN1; (+) strand; PAM type: NRG; PAM sequence: CAG
tctcacactccaagcatact

SEQ ID NO: 122210 - DNA, 20 bp, Artificial Sequence
  Description of Artificial Sequence: Synthetic oligonucleotide
  Target: ATXN1; (+) strand; PAM type: NRG; PAM sequence: AAG
tcagtcactgctattcctaa

SEQ ID NO: 122211 - DNA, 20 bp, Artificial Sequence
  Description of Artificial Sequence: Synthetic oligonucleotide
  Target: ATXN1; (+) strand; PAM type: NRG; PAM sequence: CAG
aatttatccataccctaata

SEQ ID NO: 122212 - DNA, 20 bp, Artificial Sequence
  Description of Artificial Sequence: Synthetic oligonucleotide
  Target: ATXN1; (+) strand; PAM type: NRG; PAM sequence: TGG
taccctaatacagtcccaaa

SEQ ID NO: 122213 - DNA, 20 bp, Artificial Sequence
  Description of Artificial Sequence: Synthetic oligonucleotide
  Target: ATXN1; (+) strand; PAM type: NRG; PAM sequence: CAG
ctcttctgtttaccaacaaa

SEQ ID NO: 122214 - DNA, 20 bp, Artificial Sequence
  Description of Artificial Sequence: Synthetic oligonucleotide
  Target: ATXN1; (+) strand; PAM type: NRG; PAM sequence: CAG
ttgtactatacattcaatgc

SEQ ID NO: 122215 - DNA, 20 bp, Artificial Sequence
  Description of Artificial Sequence: Synthetic oligonucleotide
  Target: ATXN1; (+) strand; PAM type: NRG; PAM sequence: TGG
ccgcctacatcttaaaactc

SEQ ID NO: 122216 - DNA, 20 bp, Artificial Sequence
  Description of Artificial Sequence: Synthetic oligonucleotide
  Target: ATXN1; (+) strand; PAM type: NRG; PAM sequence: GAG
gcctacatcttaaaactctg

SEQ ID NO: 122217 - DNA, 20 bp, Artificial Sequence
  Description of Artificial Sequence: Synthetic oligonucleotide
  Target: ATXN1; (+) strand; PAM type: NRG; PAM sequence: TAG
tccaccacttttctctgtgt

SEQ ID NO: 122218 - DNA, 20 bp, Artificial Sequence
  Description of Artificial Sequence: Synthetic oligonucleotide
  Target: ATXN1; (+) strand; PAM type: NRG; PAM sequence: AAG
gtaaccttccttctcctcca

SEQ ID NO: 122219 - DNA, 20 bp, Artificial Sequence
  Description of Artificial Sequence: Synthetic oligonucleotide
  Target: ATXN1; (+) strand; PAM type: NRG; PAM sequence: AGG
taaccttccttctcctccaa

SEQ ID NO: 122220 - DNA, 20 bp, Artificial Sequence
  Description of Artificial Sequence: Synthetic oligonucleotide
  Target: ATXN1; (+) strand; PAM type: NRG; PAM sequence: AAG
ttccttctcctccaaaggtc

SEQ ID NO: 122221 - DNA, 20 bp, Artificial Sequence
  Description of Artificial Sequence: Synthetic oligonucleotide
  Target: ATXN1; (+) strand; PAM type: NRG; PAM sequence: TGG
tctcctccaaaggtcaagaa

SEQ ID NO: 122222 - DNA, 20 bp, Artificial Sequence
  Description of Artificial Sequence: Synthetic oligonucleotide
  Target: ATXN1; (+) strand; PAM type: NRG; PAM sequence: CAG
ggtttcctgccttctaaatg

SEQ ID NO: 122223 - DNA, 20 bp, Artificial Sequence
  Description of Artificial Sequence: Synthetic oligonucleotide
  Target: ATXN1; (+) strand; PAM type: NRG; PAM sequence: GAG
taaatgcagtgacctttgct

SEQ ID NO: 122224 - DNA, 20 bp, Artificial Sequence
  Description of Artificial Sequence: Synthetic oligonucleotide
  Target: ATXN1; (+) strand; PAM type: NRG; PAM sequence: CAG
ttctctaacaatgtctgata

SEQ ID NO: 122225 - DNA, 20 bp, Artificial Sequence
  Description of Artificial Sequence: Synthetic oligonucleotide
  Target: ATXN1; (+) strand; PAM type: NRG; PAM sequence: TAG
caatgtctgatacagttcac

SEQ ID NO: 122226 - DNA, 20 bp, Artificial Sequence
  Description of Artificial Sequence: Synthetic oligonucleotide
  Target: ATXN1; (+) strand; PAM type: NRG; PAM sequence: TAG
ctgatacagttcactagtaa

SEQ ID NO: 122227 - DNA, 20 bp, Artificial Sequence
  Description of Artificial Sequence: Synthetic oligonucleotide
  Target: ATXN1; (+) strand; PAM type: NRG; PAM sequence: TAG
cattttcttttccttttatt

SEQ ID NO: 122228 - DNA, 20 bp, Artificial Sequence
  Description of Artificial Sequence: Synthetic oligonucleotide
  Target: ATXN1; (+) strand; PAM type: NRG; PAM sequence: TAG
tttcttttccttttatttag

SEQ ID NO: 122229 - DNA, 20 bp, Artificial Sequence
  Description of Artificial Sequence: Synthetic oligonucleotide
  Target: ATXN1; (+) strand; PAM type: NRG; PAM sequence: TAG
tttccttttatttagtagac

SEQ ID NO: 122230 - DNA, 20 bp, Artificial Sequence
  Description of Artificial Sequence: Synthetic oligonucleotide
  Target: ATXN1; (+) strand; PAM type: NRG; PAM sequence: CAG
gactagcatttttgcctgaa

SEQ ID NO: 122231 - DNA, 20 bp, Artificial Sequence
  Description of Artificial Sequence: Synthetic oligonucleotide
  Target: ATXN1; (+) strand; PAM type: NRG; PAM sequence: TGG
tgcctgaacagcatcttttc

SEQ ID NO: 122232 - DNA, 20 bp, Artificial Sequence
  Description of Artificial Sequence: Synthetic oligonucleotide
  Target: ATXN1; (+) strand; PAM type: NRG; PAM sequence: TGG
tctggaatgatctctcccct

SEQ ID NO: 122233 - DNA, 20 bp, Artificial Sequence
  Description of Artificial Sequence: Synthetic oligonucleotide
  Target: ATXN1; (+) strand; PAM type: NRG; PAM sequence: TGG
ctctccccttggctgttatc

SEQ ID NO: 122234 - DNA, 20 bp, Artificial Sequence
  Description of Artificial Sequence: Synthetic oligonucleotide
  Target: ATXN1; (+) strand; PAM type: NRG; PAM sequence: GGG
tctccccttggctgttatct

SEQ ID NO: 122235 - DNA, 20 bp, Artificial Sequence
  Description of Artificial Sequence: Synthetic oligonucleotide
  Target: ATXN1; (+) strand; PAM type: NRG; PAM sequence: TGG
cccttggctgttatctgggc

SEQ ID NO: 122236 - DNA, 20 bp, Artificial Sequence
  Description of Artificial Sequence: Synthetic oligonucleotide
  Target: ATXN1; (+) strand; PAM type: NRG; PAM sequence: GGG
ccttggctgttatctgggct

SEQ ID NO: 122237 - DNA, 20 bp, Artificial Sequence
  Description of Artificial Sequence: Synthetic oligonucleotide
  Target: ATXN1; (+) strand; PAM type: NRG; PAM sequence: TGG
gctgggatgacttcacacat

SEQ ID NO: 122238 - DNA, 20 bp, Artificial Sequence
  Description of Artificial Sequence: Synthetic oligonucleotide
  Target: ATXN1; (+) strand; PAM type: NRG; PAM sequence: TGG
gatgacttcacacattggcc

SEQ ID NO: 122239 - DNA, 20 bp, Artificial Sequence
  Description of Artificial Sequence: Synthetic oligonucleotide
  Target: ATXN1; (+) strand; PAM type: NRG; PAM sequence: AAG
gacttcacacattggcctgg

SEQ ID NO: 122240 - DNA, 20 bp, Artificial Sequence
  Description of Artificial Sequence: Synthetic oligonucleotide
  Target: ATXN1; (+) strand; PAM type: NRG; PAM sequence: TGG
tcacacattggcctggaaga

SEQ ID NO: 122241 - DNA, 20 bp, Artificial Sequence
  Description of Artificial Sequence: Synthetic oligonucleotide
  Target: ATXN1; (+) strand; PAM type: NRG; PAM sequence: CAG
tggaagatggacatatgacc

SEQ ID NO: 122242 - DNA, 20 bp, Artificial Sequence
  Description of Artificial Sequence: Synthetic oligonucleotide
  Target: ATXN1; (+) strand; PAM type: NRG; PAM sequence: AGG
ggaagatggacatatgaccc

SEQ ID NO: 122243 - DNA, 20 bp, Artificial Sequence
  Description of Artificial Sequence: Synthetic oligonucleotide
  Target: ATXN1; (+) strand; PAM type: NRG; PAM sequence: TGG
atggacatatgacccaggtc

SEQ ID NO: 122244 - DNA, 20 bp, Artificial Sequence
  Description of Artificial Sequence: Synthetic oligonucleotide
  Target: ATXN1; (+) strand; PAM type: NRG; PAM sequence: GGG
tggacatatgacccaggtct

SEQ ID NO: 122245 - DNA, 20 bp, Artificial Sequence
  Description of Artificial Sequence: Synthetic oligonucleotide
  Target: ATXN1; (+) strand; PAM type: NRG; PAM sequence: CAG
atcgtaatacaacaaccctc

SEQ ID NO: 122246 - DNA, 20 bp, Artificial Sequence
  Description of Artificial Sequence: Synthetic oligonucleotide
  Target: ATXN1; (+) strand; PAM type: NRG; PAM sequence: CAG
atacaacaaccctccagcca

SEQ ID NO: 122247 - DNA, 20 bp, Artificial Sequence
  Description of Artificial Sequence: Synthetic oligonucleotide
  Target: ATXN1; (+) strand; PAM type: NRG; PAM sequence: TGG
aaccctccagccacagtgac

SEQ ID NO: 122248 - DNA, 20 bp, Artificial Sequence
  Description of Artificial Sequence: Synthetic oligonucleotide
  Target: ATXN1; (+) strand; PAM type: NRG; PAM sequence: TAG
tccagccacagtgactggcc

SEQ ID NO: 122249 - DNA, 20 bp, Artificial Sequence
  Description of Artificial Sequence: Synthetic oligonucleotide
  Target: ATXN1; (+) strand; PAM type: NRG; PAM sequence: AGG
ccagccacagtgactggcct

SEQ ID NO: 122250 - DNA, 20 bp, Artificial Sequence
  Description of Artificial Sequence: Synthetic oligonucleotide
  Target: ATXN1; (+) strand; PAM type: NRG; PAM sequence: GGG
cagccacagtgactggccta

SEQ ID NO: 122251 - DNA, 20 bp, Artificial Sequence
  Description of Artificial Sequence: Synthetic oligonucleotide
  Target: ATXN1; (+) strand; PAM type: NRG; PAM sequence: GGG
agccacagtgactggcctag

SEQ ID NO: 122252 - DNA, 20 bp, Artificial Sequence
  Description of Artificial Sequence: Synthetic oligonucleotide
  Target: ATXN1; (+) strand; PAM type: NRG; PAM sequence: TAG
cacagtgactggcctagggg

SEQ ID NO: 122253 - DNA, 20 bp, Artificial Sequence
  Description of Artificial Sequence: Synthetic oligonucleotide
  Target: ATXN1; (+) strand; PAM type: NRG; PAM sequence: AGG
acagtgactggcctaggggt

SEQ ID NO: 122254 - DNA, 20 bp, Artificial Sequence
  Description of Artificial Sequence: Synthetic oligonucleotide
  Target: ATXN1; (+) strand; PAM type: NRG; PAM sequence: AAG
ctaggggtaggcatgtaccc

SEQ ID NO: 122255 - DNA, 20 bp, Artificial Sequence
  Description of Artificial Sequence: Synthetic oligonucleotide
  Target: ATXN1; (+) strand; PAM type: NRG; PAM sequence: AGG
taggggtaggcatgtaccca

SEQ ID NO: 122256 - DNA, 20 bp, Artificial Sequence
  Description of Artificial Sequence: Synthetic oligonucleotide
  Target: ATXN1; (+) strand; PAM type: NRG; PAM sequence: AAG
ggtaggcatgtacccaaggc

SEQ ID NO: 122257 - DNA, 20 bp, Artificial Sequence
  Description of Artificial Sequence: Synthetic oligonucleotide
  Target: ATXN1; (+) strand; PAM type: NRG; PAM sequence: AAG
tacccaaggcaagccaatca

SEQ ID NO: 122258 - DNA, 20 bp, Artificial Sequence
  Description of Artificial Sequence: Synthetic oligonucleotide
  Target: ATXN1; (+) strand; PAM type: NRG; PAM sequence: AGG
acccaaggcaagccaatcaa

SEQ ID NO: 122259 - DNA, 20 bp, Artificial Sequence
  Description of Artificial Sequence: Synthetic oligonucleotide
  Target: ATXN1; (+) strand; PAM type: NRG; PAM sequence: CAG
agccaatcaaaggcctctct

SEQ ID NO: 122260 - DNA, 20 bp, Artificial Sequence
  Description of Artificial Sequence: Synthetic oligonucleotide
  Target: ATXN1; (+) strand; PAM type: NRG; PAM sequence: TGG
aaggcctctctcagactacc

SEQ ID NO: 122261 - DNA, 20 bp, Artificial Sequence
  Description of Artificial Sequence: Synthetic oligonucleotide
  Target: ATXN1; (+) strand; PAM type: NRG; PAM sequence: AAG
ctctcagactacctggaact

SEQ ID NO: 122262 - DNA, 20 bp, Artificial Sequence
  Description of Artificial Sequence: Synthetic oligonucleotide
  Target: ATXN1; (+) strand; PAM type: NRG; PAM sequence: GAG
ctcagactacctggaactaa

SEQ ID NO: 122263 - DNA, 20 bp, Artificial Sequence
  Description of Artificial Sequence: Synthetic oligonucleotide
  Target: ATXN1; (+) strand; PAM type: NRG; PAM sequence: AGG
tcagactacctggaactaag

SEQ ID NO: 122264 - DNA, 20 bp, Artificial Sequence
  Description of Artificial Sequence: Synthetic oligonucleotide
  Target: ATXN1; (+) strand; PAM type: NRG; PAM sequence: GAG
agactacctggaactaagag

SEQ ID NO: 122265 - DNA, 20 bp, Artificial Sequence
  Description of Artificial Sequence: Synthetic oligonucleotide
  Target: ATXN1; (+) strand; PAM type: NRG; PAM sequence: TAG
aggagcaacacactctttcc

SEQ ID NO: 122266 - DNA, 20 bp, Artificial Sequence
  Description of Artificial Sequence: Synthetic oligonucleotide
  Target: ATXN1; (+) strand; PAM type: NRG; PAM sequence: GAG
gcaacacactctttcctagt

SEQ ID NO: 122267 - DNA, 20 bp, Artificial Sequence
  Description of Artificial Sequence: Synthetic oligonucleotide
  Target: ATXN1; (+) strand; PAM type: NRG; PAM sequence: CGG
actctttcctagtgagacca

SEQ ID NO: 122268 - DNA, 20 bp, Artificial Sequence
  Description of Artificial Sequence: Synthetic oligonucleotide
  Target: ATXN1; (+) strand; PAM type: NRG; PAM sequence: GGG
ctctttcctagtgagaccac

SEQ ID NO: 122269 - DNA, 20 bp, Artificial Sequence
  Description of Artificial Sequence: Synthetic oligonucleotide
  Target: ATXN1; (+) strand; PAM type: NRG; PAM sequence: GAG
ctttcctagtgagaccacgg

SEQ ID NO: 122270 - DNA, 20 bp, Artificial Sequence
  Description of Artificial Sequence: Synthetic oligonucleotide
  Target: ATXN1; (+) strand; PAM type: NRG; PAM sequence: CAG
cgggagcatgatgctactaa

SEQ ID NO: 122271 - DNA, 20 bp, Artificial Sequence
  Description of Artificial Sequence: Synthetic oligonucleotide
  Target: ATXN1; (+) strand; PAM type: NRG; PAM sequence: TGG
agcatgatgctactaacagc

SEQ ID NO: 122272 - DNA, 20 bp, Artificial Sequence
  Description of Artificial Sequence: Synthetic oligonucleotide
  Target: ATXN1; (+) strand; PAM type: NRG; PAM sequence: TAG
ctactaacagctggtttctt

SEQ ID NO: 122273 - DNA, 20 bp, Artificial Sequence
  Description of Artificial Sequence: Synthetic oligonucleotide
  Target: ATXN1; (+) strand; PAM type: NRG; PAM sequence: CAG
gtttctttagccacctctta

SEQ ID NO: 122274 - DNA, 20 bp, Artificial Sequence
  Description of Artificial Sequence: Synthetic oligonucleotide
  Target: ATXN1; (+) strand; PAM type: NRG; PAM sequence: AAG
ctttagccacctcttacaga

SEQ ID NO: 122275 - DNA, 20 bp, Artificial Sequence
  Description of Artificial Sequence: Synthetic oligonucleotide
  Target: ATXN1; (+) strand; PAM type: NRG; PAM sequence: TGG
acctcttacagaaagcccac

SEQ ID NO: 122276 - DNA, 20 bp, Artificial Sequence
  Description of Artificial Sequence: Synthetic oligonucleotide
  Target: ATXN1; (+) strand; PAM type: NRG; PAM sequence: GAG
ctcttacagaaagcccactg

SEQ ID NO: 122277 - DNA, 20 bp, Artificial Sequence
  Description of Artificial Sequence: Synthetic oligonucleotide
  Target: ATXN1; (+) strand; PAM type: NRG; PAM sequence: AAG
ttacagaaagcccactggag

SEQ ID NO: 122278 - DNA, 20 bp, Artificial Sequence
  Description of Artificial Sequence: Synthetic oligonucleotide
  Target: ATXN1; (+) strand; PAM type: NRG; PAM sequence: AGG
tacagaaagcccactggaga

SEQ ID NO: 122279 - DNA, 20 bp, Artificial Sequence
  Description of Artificial Sequence: Synthetic oligonucleotide
  Target: ATXN1; (+) strand; PAM type: NRG; PAM sequence: AAG
agaaagcccactggagaagg

SEQ ID NO: 122280 - DNA, 20 bp, Artificial Sequence
  Description of Artificial Sequence: Synthetic oligonucleotide
  Target: ATXN1; (+) strand; PAM type: NRG; PAM sequence: CAG
cactggagaaggaagcttcc

SEQ ID NO: 122281 - DNA, 20 bp, Artificial Sequence
  Description of Artificial Sequence: Synthetic oligonucleotide
  Target: ATXN1; (+) strand; PAM type: NRG; PAM sequence: CAG
gagaaggaagcttcccagta

SEQ ID NO: 122282 - DNA, 20 bp, Artificial Sequence
  Description of Artificial Sequence: Synthetic oligonucleotide
  Target: ATXN1; (+) strand; PAM type: NRG; PAM sequence: GAG
gaaggaagcttcccagtaca

SEQ ID NO: 122283 - DNA, 20 bp, Artificial Sequence
  Description of Artificial Sequence: Synthetic oligonucleotide
  Target: ATXN1; (+) strand; PAM type: NRG; PAM sequence: AAG
aagcttcccagtacagagaa

SEQ ID NO: 122284 - DNA, 20 bp, Artificial Sequence
  Description of Artificial Sequence: Synthetic oligonucleotide
  Target: ATXN1; (+) strand; PAM type: NRG; PAM sequence: AAG
ccagtacagagaaaagctga

SEQ ID NO: 122285 - DNA, 20 bp, Artificial Sequence
  Description of Artificial Sequence: Synthetic oligonucleotide
  Target: ATXN1; (+) strand; PAM type: NRG; PAM sequence: CAG
tacagagaaaagctgaaaga

SEQ ID NO: 122286 - DNA, 20 bp, Artificial Sequence
  Description of Artificial Sequence: Synthetic oligonucleotide
  Target: ATXN1; (+) strand; PAM type: NRG; PAM sequence: GAG
agctgaaagacagaaaatct

SEQ ID NO: 122287 - DNA, 20 bp, Artificial Sequence
  Description of Artificial Sequence: Synthetic oligonucleotide
  Target: ATXN1; (+) strand; PAM type: NRG; PAM sequence: CAG
gaaaatctgagtcctgatga

SEQ ID NO: 122288 - DNA, 20 bp, Artificial Sequence
  Description of Artificial Sequence: Synthetic oligonucleotide
  Target: ATXN1; (+) strand; PAM type: NRG; PAM sequence: AAG
tctgagtcctgatgacagta

SEQ ID NO: 122289 - DNA, 20 bp, Artificial Sequence
  Description of Artificial Sequence: Synthetic oligonucleotide
  Target: ATXN1; (+) strand; PAM type: NRG; PAM sequence: TGG
ctgatgacagtaaagtccct

SEQ ID NO: 122290 - DNA, 20 bp, Artificial Sequence
  Description of Artificial Sequence: Synthetic oligonucleotide
  Target: ATXN1; (+) strand; PAM type: NRG; PAM sequence: TAG
acagtaaagtcccttggatt

SEQ ID NO: 122291 - DNA, 20 bp, Artificial Sequence
  Description of Artificial Sequence: Synthetic oligonucleotide
  Target: ATXN1; (+) strand; PAM type: NRG; PAM sequence: CAG
tcccttggatttagccatgc

SEQ ID NO: 122292 - DNA, 20 bp, Artificial Sequence
  Description of Artificial Sequence: Synthetic oligonucleotide
  Target: ATXN1; (+) strand; PAM type: NRG; PAM sequence: AAG
cttggatttagccatgccag

SEQ ID NO: 122293 - DNA, 20 bp, Artificial Sequence
  Description of Artificial Sequence: Synthetic oligonucleotide
  Target: ATXN1; (+) strand; PAM type: NRG; PAM sequence: TAG
gatttagccatgccagaagt

SEQ ID NO: 122294 - DNA, 20 bp, Artificial Sequence
  Description of Artificial Sequence: Synthetic oligonucleotide
  Target: ATXN1; (+) strand; PAM type: NRG; PAM sequence: CGG
tagccatgccagaagttaga

SEQ ID NO: 122295 - DNA, 20 bp, Artificial Sequence
  Description of Artificial Sequence: Synthetic oligonucleotide
  Target: ATXN1; (+) strand; PAM type: NRG; PAM sequence: TGG
ccagaagttagacggatccc

SEQ ID NO: 122296 - DNA, 20 bp, Artificial Sequence
  Description of Artificial Sequence: Synthetic oligonucleotide
  Target: ATXN1; (+) strand; PAM type: NRG; PAM sequence: GAG
tttttttttttttttttttt

SEQ ID NO: 122297 - DNA, 20 bp, Artificial Sequence
  Description of Artificial Sequence: Synthetic oligonucleotide
  Target: ATXN1; (+) strand; PAM type: NRG; PAM sequence: AAG
ttttttttttttttgagacg

SEQ ID NO: 122298 - DNA, 20 bp, Artificial Sequence
  Description of Artificial Sequence: Synthetic oligonucleotide
  Target: ATXN1; (+) strand; PAM type: NRG; PAM sequence: CAG
cgaagtcttgctccatcacc

SEQ ID NO: 122299 - DNA, 20 bp, Artificial Sequence
  Description of Artificial Sequence: Synthetic oligonucleotide
  Target: ATXN1; (+) strand; PAM type: NRG; PAM sequence: CAG
gtcttgctccatcacccaga

SEQ ID NO: 122300 - DNA, 20 bp, Artificial Sequence
  Description of Artificial Sequence: Synthetic oligonucleotide
  Target: ATXN1; (+) strand; PAM type: NRG; PAM sequence: GAG
cttgctccatcacccagaca

SEQ ID NO: 122301 - DNA, 20 bp, Artificial Sequence
  Description of Artificial Sequence: Synthetic oligonucleotide
  Target: ATXN1; (+) strand; PAM type: NRG; PAM sequence: CAG
gctccatcacccagacagag

SEQ ID NO: 122302 - DNA, 20 bp, Artificial Sequence
  Description of Artificial Sequence: Synthetic oligonucleotide
  Target: ATXN1; (+) strand; PAM type: NRG; PAM sequence: TGG
ccatcacccagacagagcag

SEQ ID NO: 122303 - DNA, 20 bp, Artificial Sequence
  Description of Artificial Sequence: Synthetic oligonucleotide
  Target: ATXN1; (+) strand; PAM type: NRG; PAM sequence: CGG
acccagacagagcagtggca

SEQ ID NO: 122304 - DNA, 20 bp, Artificial Sequence
  Description of Artificial Sequence: Synthetic oligonucleotide
  Target: ATXN1; (+) strand; PAM type: NRG; PAM sequence: GAG
tcactgcaacctctgactcc

SEQ ID NO: 122305 - DNA, 20 bp, Artificial Sequence
  Description of Artificial Sequence: Synthetic oligonucleotide
  Target: ATXN1; (+) strand; PAM type: NRG; PAM sequence: AAG
caacctctgactccgagttc

SEQ ID NO: 122306 - DNA, 20 bp, Artificial Sequence
  Description of Artificial Sequence: Synthetic oligonucleotide
  Target: ATXN1; (+) strand; PAM type: NRG; PAM sequence: CAG
ttcaagcaatactcctgact

SEQ ID NO: 122307 - DNA, 20 bp, Artificial Sequence
  Description of Artificial Sequence: Synthetic oligonucleotide
  Target: ATXN1; (+) strand; PAM type: NRG; PAM sequence: GAG
tactcctgactcagcctccc

SEQ ID NO: 122308 - DNA, 20 bp, Artificial Sequence
  Description of Artificial Sequence: Synthetic oligonucleotide
  Target: ATXN1; (+) strand; PAM type: NRG; PAM sequence: TAG
tcctgactcagcctcccgag

SEQ ID NO: 122309 - DNA, 20 bp, Artificial Sequence
  Description of Artificial Sequence: Synthetic oligonucleotide
  Target: ATXN1; (+) strand; PAM type: NRG; PAM sequence: TGG
gactcagcctcccgagtagc

SEQ ID NO: 122310 - DNA, 20 bp, Artificial Sequence
  Description of Artificial Sequence: Synthetic oligonucleotide
  Target: ATXN1; (+) strand; PAM type: NRG; PAM sequence: GGG
actcagcctcccgagtagct

SEQ ID NO: 122311 - DNA, 20 bp, Artificial Sequence
  Description of Artificial Sequence: Synthetic oligonucleotide
  Target: ATXN1; (+) strand; PAM type: NRG; PAM sequence: TAG
ctcccgagtagctgggatta

SEQ ID NO: 122312 - DNA, 20 bp, Artificial Sequence
  Description of Artificial Sequence: Synthetic oligonucleotide
  Target: ATXN1; (+) strand; PAM type: NRG; PAM sequence: AGG
tcccgagtagctgggattat

SEQ ID NO: 122313 - DNA, 20 bp, Artificial Sequence
  Description of Artificial Sequence: Synthetic oligonucleotide
  Target: ATXN1; (+) strand; PAM type: NRG; PAM sequence: TGG
taggcatatgccaccacacc

SEQ ID NO: 122314 - DNA, 20 bp, Artificial Sequence
  Description of Artificial Sequence: Synthetic oligonucleotide
  Target: ATXN1; (+) strand; PAM type: NRG; PAM sequence: AAG
tttttttttttttttgatac

SEQ ID NO: 122315 - DNA, 20 bp, Artificial Sequence
  Description of Artificial Sequence: Synthetic oligonucleotide
  Target: ATXN1; (+) strand; PAM type: NRG; PAM sequence: AGG
ttttttttttttttgataca

SEQ ID NO: 122316 - DNA, 20 bp, Artificial Sequence
  Description of Artificial Sequence: Synthetic oligonucleotide
  Target: ATXN1; (+) strand; PAM type: NRG; PAM sequence: CAG
aaggtttcgctcttgttgcc

SEQ ID NO: 122317 - DNA, 20 bp, Artificial Sequence
  Description of Artificial Sequence: Synthetic oligonucleotide
  Target: ATXN1; (+) strand; PAM type: NRG; PAM sequence: AGG
aggtttcgctcttgttgccc

SEQ ID NO: 122318 - DNA, 20 bp, Artificial Sequence
  Description of Artificial Sequence: Synthetic oligonucleotide
  Target: ATXN1; (+) strand; PAM type: NRG; PAM sequence: TGG
ttcgctcttgttgcccaggc

SEQ ID NO: 122319 - DNA, 20 bp, Artificial Sequence
  Description of Artificial Sequence: Synthetic oligonucleotide
  Target: ATXN1; (+) strand; PAM type: NRG; PAM sequence: GAG
cgctcttgttgcccaggctg

SEQ ID NO: 122320 - DNA, 20 bp, Artificial Sequence
  Description of Artificial Sequence: Synthetic oligonucleotide
  Target: ATXN1; (+) strand; PAM type: NRG; PAM sequence: TGG
ttgcccaggctggagtgcaa

SEQ ID NO: 122321 - DNA, 20 bp, Artificial Sequence
  Description of Artificial Sequence: Synthetic oligonucleotide
  Target: ATXN1; (+) strand; PAM type: NRG; PAM sequence: CAG
ggagtgcaatggcgcaatct

SEQ ID NO: 122322 - DNA, 20 bp, Artificial Sequence
  Description of Artificial Sequence: Synthetic oligonucleotide
  Target: ATXN1; (+) strand; PAM type: NRG; PAM sequence: CAG
tcactgcaacctctgcctcc

SEQ ID NO: 122323 - DNA, 20 bp, Artificial Sequence
  Description of Artificial Sequence: Synthetic oligonucleotide
  Target: ATXN1; (+) strand; PAM type: NRG; PAM sequence: AGG
cactgcaacctctgcctccc

SEQ ID NO: 122324 - DNA, 20 bp, Artificial Sequence
  Description of Artificial Sequence: Synthetic oligonucleotide
  Target: ATXN1; (+) strand; PAM type: NRG; PAM sequence: AAG
aacctctgcctcccaggttc

SEQ ID NO: 122325 - DNA, 20 bp, Artificial Sequence
  Description of Artificial Sequence: Synthetic oligonucleotide
  Target: ATXN1; (+) strand; PAM type: NRG; PAM sequence: CAG
ttcaagcaattctcctgtct

SEQ ID NO: 122326 - DNA, 20 bp, Artificial Sequence
  Description of Artificial Sequence: Synthetic oligonucleotide
  Target: ATXN1; (+) strand; PAM type: NRG; PAM sequence: GAG
ttctcctgtctcagcctcct

SEQ ID NO: 122327 - DNA, 20 bp, Artificial Sequence
  Description of Artificial Sequence: Synthetic oligonucleotide
  Target: ATXN1; (+) strand; PAM type: NRG; PAM sequence: TAG
tcctgtctcagcctcctgag

SEQ ID NO: 122328 - DNA, 20 bp, Artificial Sequence
  Description of Artificial Sequence: Synthetic oligonucleotide
  Target: ATXN1; (+) strand; PAM type: NRG; PAM sequence: TGG
gtctcagcctcctgagtagc

SEQ ID NO: 122329 - DNA, 20 bp, Artificial Sequence
  Description of Artificial Sequence: Synthetic oligonucleotide
  Target: ATXN1; (+) strand; PAM type: NRG; PAM sequence: GGG
tctcagcctcctgagtagct

SEQ ID NO: 122330 - DNA, 20 bp, Artificial Sequence
  Description of Artificial Sequence: Synthetic oligonucleotide
  Target: ATXN1; (+) strand; PAM type: NRG; PAM sequence: CAG
ctcctgagtagctgggactg

SEQ ID NO: 122331 - DNA, 20 bp, Artificial Sequence
  Description of Artificial Sequence: Synthetic oligonucleotide
  Target: ATXN1; (+) strand; PAM type: NRG; PAM sequence: AGG
tcctgagtagctgggactgc

SEQ ID NO: 122332 - DNA, 20 bp, Artificial Sequence
  Description of Artificial Sequence: Synthetic oligonucleotide
  Target: ATXN1; (+) strand; PAM type: NRG; PAM sequence: CAG
gtagctgggactgcaggcac

SEQ ID NO: 122333 - DNA, 20 bp, Artificial Sequence
  Description of Artificial Sequence: Synthetic oligonucleotide
  Target: ATXN1; (+) strand; PAM type: NRG; PAM sequence: CGG
caggcaccagccactacgcc

SEQ ID NO: 122334 - DNA, 20 bp, Artificial Sequence
  Description of Artificial Sequence: Synthetic oligonucleotide
  Target: ATXN1; (+) strand; PAM type: NRG; PAM sequence: TGG
cactacgcccggctaatttt

SEQ ID NO: 122335 - DNA, 20 bp, Artificial Sequence
  Description of Artificial Sequence: Synthetic oligonucleotide
  Target: ATXN1; (+) strand; PAM type: NRG; PAM sequence: TAG
cggctaatttttggtatttt

SEQ ID NO: 122336 - DNA, 20 bp, Artificial Sequence
  Description of Artificial Sequence: Synthetic oligonucleotide
  Target: ATXN1; (+) strand; PAM type: NRG; PAM sequence: TAG
ctaatttttggtatttttag

SEQ ID NO: 122337 - DNA, 20 bp, Artificial Sequence
  Description of Artificial Sequence: Synthetic oligonucleotide
  Target: ATXN1; (+) strand; PAM type: NRG; PAM sequence: GAG
aatttttggtatttttagta

SEQ ID NO: 122338 - DNA, 20 bp, Artificial Sequence
  Description of Artificial Sequence: Synthetic oligonucleotide
  Target: ATXN1; (+) strand; PAM type: NRG; PAM sequence: CAG
tttggtatttttagtagaga

SEQ ID NO: 122339 - DNA, 20 bp, Artificial Sequence
  Description of Artificial Sequence: Synthetic oligonucleotide
  Target: ATXN1; (+) strand; PAM type: NRG; PAM sequence: AGG
ttggtatttttagtagagac

SEQ ID NO: 122340 - DNA, 20 bp, Artificial Sequence
  Description of Artificial Sequence: Synthetic oligonucleotide
  Target: ATXN1; (+) strand; PAM type: NRG; PAM sequence: GGG
tggtatttttagtagagaca

SEQ ID NO: 122341 - DNA, 20 bp, Artificial Sequence
  Description of Artificial Sequence: Synthetic oligonucleotide
  Target: ATXN1; (+) strand; PAM type: NRG; PAM sequence: TGG
gagacagggtttcaccatgt

SEQ ID NO: 122342 - DNA, 20 bp, Artificial Sequence
  Description of Artificial Sequence: Synthetic oligonucleotide
  Target: ATXN1; (+) strand; PAM type: NRG; PAM sequence: AAG
tcaccatgttggccatgttc

SEQ ID NO: 122343 - DNA, 20 bp, Artificial Sequence
  Description of Artificial Sequence: Synthetic oligonucleotide
  Target: ATXN1; (+) strand; PAM type: NRG; PAM sequence: CAG
catgttggccatgttcaaga

SEQ ID NO: 122344 - DNA, 20 bp, Artificial Sequence
  Description of Artificial Sequence: Synthetic oligonucleotide
  Target: ATXN1; (+) strand; PAM type: NRG; PAM sequence: AGG
atgttggccatgttcaagac

SEQ ID NO: 122345 - DNA, 20 bp, Artificial Sequence
  Description of Artificial Sequence: Synthetic oligonucleotide
  Target: ATXN1; (+) strand; PAM type: NRG; PAM sequence: TGG
tggccatgttcaagacaggc

SEQ ID NO: 122346 - DNA, 20 bp, Artificial Sequence
  Description of Artificial Sequence: Synthetic oligonucleotide
  Target: ATXN1; (+) strand; PAM type: NRG; PAM sequence: TGG
acaggctggtcttgaactcc

SEQ ID NO: 122347 - DNA, 20 bp, Artificial Sequence
  Description of Artificial Sequence: Synthetic oligonucleotide
  Target: ATXN1; (+) strand; PAM type: NRG; PAM sequence: AAG
ggtcttgaactcctggcctc

SEQ ID NO: 122348 - DNA, 20 bp, Artificial Sequence
  Description of Artificial Sequence: Synthetic oligonucleotide
  Target: ATXN1; (+) strand; PAM type: NRG; PAM sequence: CAG
ctcaagtgatccacctgcct

SEQ ID NO: 122349 - DNA, 20 bp, Artificial Sequence
  Description of Artificial Sequence: Synthetic oligonucleotide
  Target: ATXN1; (+) strand; PAM type: NRG; PAM sequence: AAG
ccacctgcctcagcctccca

SEQ ID NO: 122350 - DNA, 20 bp, Artificial Sequence
  Description of Artificial Sequence: Synthetic oligonucleotide
  Target: ATXN1; (+) strand; PAM type: NRG; PAM sequence: CGG
gcctcagcctcccaaagtgc

SEQ ID NO: 122351 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaaagtgcc

SEQ ID NO: 122352 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgccgggatta

SEQ ID NO: 122353 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgccgggattac

SEQ ID NO: 122354 - DNA, 20 bp, Artificial Sequence
  Description of Artificial Sequence: Synthetic oligonucleotide
  Target: ATXN1; (+) strand; PAM type: NRG; PAM sequence: GAG
agtgccgggattacaggtgt

SEQ ID NO: 122355 - DNA, 20 bp, Artificial Sequence
  Description of Artificial Sequence: Synthetic oligonucleotide
  Target: ATXN1; (+) strand; PAM type: NRG; PAM sequence: TGG
gggattacaggtgtgagcca

SEQ ID NO: 122356 - DNA, 20 bp, Artificial Sequence
  Description of Artificial Sequence: Synthetic oligonucleotide
  Target: ATXN1; (+) strand; PAM type: NRG; PAM sequence: CGG
caggtgtgagccatggcgcc

SEQ ID NO: 122357 - DNA, 20 bp, Artificial Sequence
  Description of Artificial Sequence: Synthetic oligonucleotide
  Target: ATXN1; (+) strand; PAM type: NRG; PAM sequence: TGG
atggcgcccggcctgatccc

SEQ ID NO: 122358 - DNA, 20 bp, Artificial Sequence
  Description of Artificial Sequence: Synthetic oligonucleotide
  Target: ATXN1; (+) strand; PAM type: NRG; PAM sequence: TAG
ggcctgatccctggaatttt

SEQ ID NO: 122359 - DNA, 20 bp, Artificial Sequence
  Description of Artificial Sequence: Synthetic oligonucleotide
  Target: ATXN1; (+) strand; PAM type: NRG; PAM sequence: TAG
aatttttagttatattatga

SEQ ID NO: 122360 - DNA, 20 bp, Artificial Sequence
  Description of Artificial Sequence: Synthetic oligonucleotide
  Target: ATXN1; (+) strand; PAM type: NRG; PAM sequence: TAG
tgatagaccaaattctaacg

SEQ ID NO: 122361 - DNA, 20 bp, Artificial Sequence
  Description of Artificial Sequence: Synthetic oligonucleotide
  Target: ATXN1; (+) strand; PAM type: NRG; PAM sequence: AAG
caaattctaacgtagcccac

SEQ ID NO: 122362 - DNA, 20 bp, Artificial Sequence
  Description of Artificial Sequence: Synthetic oligonucleotide
  Target: ATXN1; (+) strand; PAM type: NRG; PAM sequence: CAG
aagattgccatgtcccctgc

SEQ ID NO: 122363 - DNA, 20 bp, Artificial Sequence
  Description of Artificial Sequence: Synthetic oligonucleotide
  Target: ATXN1; (+) strand; PAM type: NRG; PAM sequence: CAG
gccagacacacacctcttcc

SEQ ID NO: 122364 - DNA, 20 bp, Artificial Sequence
  Description of Artificial Sequence: Synthetic oligonucleotide
  Target: ATXN1; (+) strand; PAM type: NRG; PAM sequence: TAG
gacacacacctcttcccagt

SEQ ID NO: 122365 - DNA, 20 bp, Artificial Sequence
  Description of Artificial Sequence: Synthetic oligonucleotide
  Target: ATXN1; (+) strand; PAM type: NRG; PAM sequence: CAG
cacacctcttcccagttagt

SEQ ID NO: 122366 - DNA, 20 bp, Artificial Sequence
  Description of Artificial Sequence: Synthetic oligonucleotide
  Target: ATXN1; (+) strand; PAM type: NRG; PAM sequence: TGG
acctcttcccagttagtcag

SEQ ID NO: 122367 - DNA, 20 bp, Artificial Sequence
  Description of Artificial Sequence: Synthetic oligonucleotide
  Target: ATXN1; (+) strand; PAM type: NRG; PAM sequence: GGG
cctcttcccagttagtcagt

SEQ ID NO: 122368 - DNA, 20 bp, Artificial Sequence
  Description of Artificial Sequence: Synthetic oligonucleotide
  Target: ATXN1; (+) strand; PAM type: NRG; PAM sequence: CAG
ttcccagttagtcagtggga

SEQ ID NO: 122369 - DNA, 20 bp, Artificial Sequence
  Description of Artificial Sequence: Synthetic oligonucleotide
  Target: ATXN1; (+) strand; PAM type: NRG; PAM sequence: AAG
tagtcagtgggacagtaatc

SEQ ID NO: 122370 - DNA, 20 bp, Artificial Sequence
  Description of Artificial Sequence: Synthetic oligonucleotide
  Target: ATXN1; (+) strand; PAM type: NRG; PAM sequence: AGG
agtcagtgggacagtaatca

SEQ ID NO: 122371 - DNA, 20 bp, Artificial Sequence
  Description of Artificial Sequence: Synthetic oligonucleotide
  Target: ATXN1; (+) strand; PAM type: NRG; PAM sequence: AAG
atcaaggttctgctgttgtg

SEQ ID NO: 122372 - DNA, 20 bp, Artificial Sequence
  Description of Artificial Sequence: Synthetic oligonucleotide
  Target: ATXN1; (+) strand; PAM type: NRG; PAM sequence: AGG
tcaaggttctgctgttgtga

SEQ ID NO: 122373 - DNA, 20 bp, Artificial Sequence
  Description of Artificial Sequence: Synthetic oligonucleotide
  Target: ATXN1; (+) strand; PAM type: NRG; PAM sequence: GGG
caaggttctgctgttgtgaa

SEQ ID NO: 122374 - DNA, 20 bp, Artificial Sequence
  Description of Artificial Sequence: Synthetic oligonucleotide
  Target: ATXN1; (+) strand; PAM type: NRG; PAM sequence: AAG
tgaagggattttgcaaatat

SEQ ID NO: 122375 - DNA, 20 bp, Artificial Sequence
  Description of Artificial Sequence: Synthetic oligonucleotide
  Target: ATXN1; (+) strand; PAM type: NRG; PAM sequence: GAG
gggattttgcaaatataagt

SEQ ID NO: 122376 - DNA, 20 bp, Artificial Sequence
  Description of Artificial Sequence: Synthetic oligonucleotide
  Target: ATXN1; (+) strand; PAM type: NRG; PAM sequence: AGG
ggattttgcaaatataagtg

SEQ ID NO: 122377 - DNA, 20 bp, Artificial Sequence
  Description of Artificial Sequence: Synthetic oligonucleotide
  Target: ATXN1; (+) strand; PAM type: NRG; PAM sequence: AAG
gcaaatataagtgaggtcca

SEQ ID NO: 122378 - DNA, 20 bp, Artificial Sequence
  Description of Artificial Sequence: Synthetic oligonucleotide
  Target: ATXN1; (+) strand; PAM type: NRG; PAM sequence: TAG
aaagtcaaccaaccttaaaa

SEQ ID NO: 122379 - DNA, 20 bp, Artificial Sequence
  Description of Artificial Sequence: Synthetic oligonucleotide
  Target: ATXN1; (+) strand; PAM type: NRG; PAM sequence: GAG
agtcaaccaaccttaaaata

SEQ ID NO: 122380 - DNA, 20 bp, Artificial Sequence
  Description of Artificial Sequence: Synthetic oligonucleotide
  Target: ATXN1; (+) strand; PAM type: NRG; PAM sequence: GAG
tcaaccaaccttaaaataga

SEQ ID NO: 122381 - DNA, 20 bp, Artificial Sequence
  Description of Artificial Sequence: Synthetic oligonucleotide
  Target: ATXN1; (+) strand; PAM type: NRG; PAM sequence: TGG
ttaaaatagagagattatct

SEQ ID NO: 122382 - DNA, 20 bp, Artificial Sequence
  Description of Artificial Sequence: Synthetic oligonucleotide
  Target: ATXN1; (+) strand; PAM type: NRG; PAM sequence: GAG
aatagagagattatcttggt

SEQ ID NO: 122383 - DNA, 20 bp, Artificial Sequence
  Description of Artificial Sequence: Synthetic oligonucleotide
  Target: ATXN1; (+) strand; PAM type: NRG; PAM sequence: AAG
ttggtgagcctgatctaatt

SEQ ID NO: 122384 - DNA, 20 bp, Artificial Sequence
  Description of Artificial Sequence: Synthetic oligonucleotide
  Target: ATXN1; (+) strand; PAM type: NRG; PAM sequence: GAG
ggtgagcctgatctaattaa

SEQ ID NO: 122385 - DNA, 20 bp, Artificial Sequence
  Description of Artificial Sequence: Synthetic oligonucleotide
  Target: ATXN1; (+) strand; PAM type: NRG; PAM sequence: AAG
tctaattaagagaaccctaa

SEQ ID NO: 122386 - DNA, 20 bp, Artificial Sequence
  Description of Artificial Sequence: Synthetic oligonucleotide
  Target: ATXN1; (+) strand; PAM type: NRG; PAM sequence: AGG
ctaattaagagaaccctaaa

SEQ ID NO: 122387 - DNA, 20 bp, Artificial Sequence
  Description of Artificial Sequence: Synthetic oligonucleotide
  Target: ATXN1; (+) strand; PAM type: NRG; PAM sequence: GGG
taattaagagaaccctaaaa

SEQ ID NO: 122388 - DNA, 20 bp, Artificial Sequence
  Description of Artificial Sequence: Synthetic oligonucleotide
  Target: ATXN1; (+) strand; PAM type: NRG; PAM sequence: TGG
taagagaaccctaaaaggga

SEQ ID NO: 122389 - DNA, 20 bp, Artificial Sequence
  Description of Artificial Sequence: Synthetic oligonucleotide
  Target: ATXN1; (+) strand; PAM type: NRG; PAM sequence: GGG
aagagaaccctaaaagggat

SEQ ID NO: 122390 - DNA, 20 bp, Artificial Sequence
  Description of Artificial Sequence: Synthetic oligonucleotide
  Target: ATXN1; (+) strand; PAM type: NRG; PAM sequence: GGG
agagaaccctaaaagggatg

SEQ ID NO: 122391 - DNA, 20 bp, Artificial Sequence
  Description of Artificial Sequence: Synthetic oligonucleotide
  Target: ATXN1; (+) strand; PAM type: NRG; PAM sequence: CAG
taaaagggatggggctttac

SEQ ID NO: 122392 - DNA, 20 bp, Artificial Sequence
  Description of Artificial Sequence: Synthetic oligonucleotide
  Target: ATXN1; (+) strand; PAM type: NRG; PAM sequence: AGG
aaaagggatggggctttacc

SEQ ID NO: 122393 - DNA, 20 bp, Artificial Sequence
  Description of Artificial Sequence: Synthetic oligonucleotide
  Target: ATXN1; (+) strand; PAM type: NRG; PAM sequence: GAG
gatggggctttaccaggaat

SEQ ID NO: 122394 - DNA, 20 bp, Artificial Sequence
  Description of Artificial Sequence: Synthetic oligonucleotide
  Target: ATXN1; (+) strand; PAM type: NRG; PAM sequence: AAG
tttaccaggaatgagattca

SEQ ID NO: 122395 - DNA, 20 bp, Artificial Sequence
  Description of Artificial Sequence: Synthetic oligonucleotide
  Target: ATXN1; (+) strand; PAM type: NRG; PAM sequence: GAG
ccaggaatgagattcaaagt

SEQ ID NO: 122396 - DNA, 20 bp, Artificial Sequence
  Description of Artificial Sequence: Synthetic oligonucleotide
  Target: ATXN1; (+) strand; PAM type: NRG; PAM sequence: GAG
aggaatgagattcaaagtga

SEQ ID NO: 122397 - DNA, 20 bp, Artificial Sequence
  Description of Artificial Sequence: Synthetic oligonucleotide
  Target: ATXN1; (+) strand; PAM type: NRG; PAM sequence: GAG
gaatgagattcaaagtgaga

SEQ ID NO: 122398 - DNA, 20 bp, Artificial Sequence
  Description of Artificial Sequence: Synthetic oligonucleotide
  Target: ATXN1; (+) strand; PAM type: NRG; PAM sequence: AGG
aatgagattcaaagtgagag

SEQ ID NO: 122399 - DNA, 20 bp, Artificial Sequence
  Description of Artificial Sequence: Synthetic oligonucleotide
  Target: ATXN1; (+) strand; PAM type: NRG; PAM sequence: TGG
agtgagagaggacatgttga

SEQ ID NO: 122400 - DNA, 20 bp, Artificial Sequence
  Description of Artificial Sequence: Synthetic oligonucleotide
  Target: ATXN1; (+) strand; PAM type: NRG; PAM sequence: GAG
tgagagaggacatgttgatg

SEQ ID NO: 122401 - DNA, 20 bp, Artificial Sequence
  Description of Artificial Sequence: Synthetic oligonucleotide
  Target: ATXN1; (+) strand; PAM type: NRG; PAM sequence: AGG
gagagaggacatgttgatgg

SEQ ID NO: 122402 - DNA, 20 bp, Artificial Sequence
  Description of Artificial Sequence: Synthetic oligonucleotide
  Target: ATXN1; (+) strand; PAM type: NRG; PAM sequence: GAG
gagaggacatgttgatggag

SEQ ID NO: 122403 - DNA, 20 bp, Artificial Sequence
  Description of Artificial Sequence: Synthetic oligonucleotide
  Target: ATXN1; (+) strand; PAM type: NRG; PAM sequence: AGG
agaggacatgttgatggagg

SEQ ID NO: 122404 - DNA, 20 bp, Artificial Sequence
  Description of Artificial Sequence: Synthetic oligonucleotide
  Target: ATXN1; (+) strand; PAM type: NRG; PAM sequence: AAG
gacatgttgatggaggaggc

SEQ ID NO: 122405 - DNA, 20 bp, Artificial Sequence
  Description of Artificial Sequence: Synthetic oligonucleotide
  Target: ATXN1; (+) strand; PAM type: NRG; PAM sequence: TGG
gatggaggaggcaagtcata

SEQ ID NO: 122406 - DNA, 20 bp, Artificial Sequence
  Description of Artificial Sequence: Synthetic oligonucleotide
  Target: ATXN1; (+) strand; PAM type: NRG; PAM sequence: AAG
gaggaggcaagtcatatggc

SEQ ID NO: 122407 - DNA, 20 bp, Artificial Sequence
  Description of Artificial Sequence: Synthetic oligonucleotide
  Target: ATXN1; (+) strand; PAM type: NRG; PAM sequence: AGG
aggaggcaagtcatatggca

SEQ ID NO: 122408 - DNA, 20 bp, Artificial Sequence
  Description of Artificial Sequence: Synthetic oligonucleotide
  Target: ATXN1; (+) strand; PAM type: NRG; PAM sequence: AAG
agtcatatggcaaggaactg

SEQ ID NO: 122409 - DNA, 20 bp, Artificial Sequence
  Description of Artificial Sequence: Synthetic oligonucleotide
  Target: ATXN1; (+) strand; PAM type: NRG; PAM sequence: AGG
gtcatatggcaaggaactga

SEQ ID NO: 122410 - DNA, 20 bp, Artificial Sequence
  Description of Artificial Sequence: Synthetic oligonucleotide
  Target: ATXN1; (+) strand; PAM type: NRG; PAM sequence: CAG
aaggaactgaaggtgaatgc

SEQ ID NO: 122411 - DNA, 20 bp, Artificial Sequence
  Description of Artificial Sequence: Synthetic oligonucleotide
  Target: ATXN1; (+) strand; PAM type: NRG; PAM sequence: AGG
aggaactgaaggtgaatgcc

SEQ ID NO: 122412 - DNA, 20 bp, Artificial Sequence
  Description of Artificial Sequence: Synthetic oligonucleotide
  Target: ATXN1; (+) strand; PAM type: NRG; PAM sequence: GAG
gaaggtgaatgccaggacct

SEQ ID NO: 122413 - DNA, 20 bp, Artificial Sequence
  Description of Artificial Sequence: Synthetic oligonucleotide
  Target: ATXN1; (+) strand; PAM type: NRG; PAM sequence: GAG
aggtgaatgccaggacctga

SEQ ID NO: 122414 - DNA, 20 bp, Artificial Sequence
  Description of Artificial Sequence: Synthetic oligonucleotide
  Target: ATXN1; (+) strand; PAM type: NRG; PAM sequence: TGG
tgaatgccaggacctgagag

SEQ ID NO: 122415 - DNA, 20 bp, Artificial Sequence
  Description of Artificial Sequence: Synthetic oligonucleotide
  Target: ATXN1; (+) strand; PAM type: NRG; PAM sequence: CAG
caggacctgagagtggcccc

SEQ ID NO: 122416 - DNA, 20 bp, Artificial Sequence
  Description of Artificial Sequence: Synthetic oligonucleotide
  Target: ATXN1; (+) strand; PAM type: NRG; PAM sequence: CAG
tgagagtggcccccagctca

SEQ ID NO: 122417 - DNA, 20 bp, Artificial Sequence
  Description of Artificial Sequence: Synthetic oligonucleotide
  Target: ATXN1; (+) strand; PAM type: NRG; PAM sequence: CAG
agtggcccccagctcacagc

SEQ ID NO: 122418 - DNA, 20 bp, Artificial Sequence
  Description of Artificial Sequence: Synthetic oligonucleotide
  Target: ATXN1; (+) strand; PAM type: NRG; PAM sequence: TGG
ccccagctcacagccagcaa

SEQ ID NO: 122419 - DNA, 20 bp, Artificial Sequence
  Description of Artificial Sequence: Synthetic oligonucleotide
  Target: ATXN1; (+) strand; PAM type: NRG; PAM sequence: CGG
gctcacagccagcaatggaa

SEQ ID NO: 122420 - DNA, 20 bp, Artificial Sequence
  Description of Artificial Sequence: Synthetic oligonucleotide
  Target: ATXN1; (+) strand; PAM type: NRG; PAM sequence: GGG
ctcacagccagcaatggaac

SEQ ID NO: 122421 - DNA, 20 bp, Artificial Sequence
  Description of Artificial Sequence: Synthetic oligonucleotide
  Target: ATXN1; (+) strand; PAM type: NRG; PAM sequence: TGG
ccagcaatggaacgggacct

SEQ ID NO: 122422 - DNA, 20 bp, Artificial Sequence
  Description of Artificial Sequence: Synthetic oligonucleotide
  Target: ATXN1; (+) strand; PAM type: NRG; PAM sequence: AAG
gaccttggtcctacgaccac

SEQ ID NO: 122423 - DNA, 20 bp, Artificial Sequence
  Description of Artificial Sequence: Synthetic oligonucleotide
  Target: ATXN1; (+) strand; PAM type: NRG; PAM sequence: GAG
ctaaatacaaaaaaccatgt

SEQ ID NO: 122424 - DNA, 20 bp, Artificial Sequence
  Description of Artificial Sequence: Synthetic oligonucleotide
  Target: ATXN1; (+) strand; PAM type: NRG; PAM sequence: AAG
aaaaccatgtgagcttgaaa

SEQ ID NO: 122425 - DNA, 20 bp, Artificial Sequence
  Description of Artificial Sequence: Synthetic oligonucleotide
  Target: ATXN1; (+) strand; PAM type: NRG; PAM sequence: AGG
aaaccatgtgagcttgaaaa

SEQ ID NO: 122426 - DNA, 20 bp, Artificial Sequence
  Description of Artificial Sequence: Synthetic oligonucleotide
  Target: ATXN1; (+) strand; PAM type: NRG; PAM sequence: GAG
tgagcttgaaaaaggaccat

SEQ ID NO: 122427 - DNA, 20 bp, Artificial Sequence
  Description of Artificial Sequence: Synthetic oligonucleotide
  Target: ATXN1; (+) strand; PAM type: NRG; PAM sequence: CAG
tgaaaaaggaccatgagctc

SEQ ID NO: 122428 - DNA, 20 bp, Artificial Sequence
  Description of Artificial Sequence: Synthetic oligonucleotide
  Target: ATXN1; (+) strand; PAM type: NRG; PAM sequence: AAG
gaccatgagctccagataat

SEQ ID NO: 122429 - DNA, 20 bp, Artificial Sequence
  Description of Artificial Sequence: Synthetic oligonucleotide
  Target: ATXN1; (+) strand; PAM type: NRG; PAM sequence: AGG
accatgagctccagataata

SEQ ID NO: 122430 - DNA, 20 bp, Artificial Sequence
  Description of Artificial Sequence: Synthetic oligonucleotide
  Target: ATXN1; (+) strand; PAM type: NRG; PAM sequence: CAG
atgagctccagataataagg

SEQ ID NO: 122431 - DNA, 20 bp, Artificial Sequence
  Description of Artificial Sequence: Synthetic oligonucleotide
  Target: ATXN1; (+) strand; PAM type: NRG; PAM sequence: CAG
ccctgttgacacctcaattt

SEQ ID NO: 122432 - DNA, 20 bp, Artificial Sequence
  Description of Artificial Sequence: Synthetic oligonucleotide
  Target: ATXN1; (+) strand; PAM type: NRG; PAM sequence: CAG
cagtcttatgaaaccctgaa

SEQ ID NO: 122433 - DNA, 20 bp, Artificial Sequence
  Description of Artificial Sequence: Synthetic oligonucleotide
  Target: ATXN1; (+) strand; PAM type: NRG; PAM sequence: CAG
gaaaccctgaacagataatt

SEQ ID NO: 122434 - DNA, 20 bp, Artificial Sequence
  Description of Artificial Sequence: Synthetic oligonucleotide
  Target: ATXN1; (+) strand; PAM type: NRG; PAM sequence: AAG
cctgaacagataattcagct

SEQ ID NO: 122435 - DNA, 20 bp, Artificial Sequence
  Description of Artificial Sequence: Synthetic oligonucleotide
  Target: ATXN1; (+) strand; PAM type: NRG; PAM sequence: TGG
taattcagctaagccatgcc

SEQ ID NO: 122436 - DNA, 20 bp, Artificial Sequence
  Description of Artificial Sequence: Synthetic oligonucleotide
  Target: ATXN1; (+) strand; PAM type: NRG; PAM sequence: CGG
gctaagccatgcctggactt

SEQ ID NO: 122437 - DNA, 20 bp, Artificial Sequence
  Description of Artificial Sequence: Synthetic oligonucleotide
  Target: ATXN1; (+) strand; PAM type: NRG; PAM sequence: CAG
cctggacttcggacctccaa

SEQ ID NO: 122438 - DNA, 20 bp, Artificial Sequence
  Description of Artificial Sequence: Synthetic oligonucleotide
  Target: ATXN1; (+) strand; PAM type: NRG; PAM sequence: AAG
ctccaacagataattcaact

SEQ ID NO: 122439 - DNA, 20 bp, Artificial Sequence
  Description of Artificial Sequence: Synthetic oligonucleotide
  Target: ATXN1; (+) strand; PAM type: NRG; PAM sequence: TGG
taattcaactaagccatgcc

SEQ ID NO: 122440 - DNA, 20 bp, Artificial Sequence
  Description of Artificial Sequence: Synthetic oligonucleotide
  Target: ATXN1; (+) strand; PAM type: NRG; PAM sequence: CAG
atgcctggacttcgcacctc

SEQ ID NO: 122441 - DNA, 20 bp, Artificial Sequence
  Description of Artificial Sequence: Synthetic oligonucleotide
  Target: ATXN1; (+) strand; PAM type: NRG; PAM sequence: GAG
ttcgcacctccagaaactgt

SEQ ID NO: 122442 - DNA, 20 bp, Artificial Sequence
  Description of Artificial Sequence: Synthetic oligonucleotide
  Target: ATXN1; (+) strand; PAM type: NRG; PAM sequence: TAG
agaaactgtgagataataaa

SEQ ID NO: 122443 - DNA, 20 bp, Artificial Sequence
  Description of Artificial Sequence: Synthetic oligonucleotide
  Target: ATXN1; (+) strand; PAM type: NRG; PAM sequence: AGG
gaaactgtgagataataaat

SEQ ID NO: 122444 - DNA, 20 bp, Artificial Sequence
  Description of Artificial Sequence: Synthetic oligonucleotide
  Target: ATXN1; (+) strand; PAM type: NRG; PAM sequence: TAG
ataataaataggtattgtta

SEQ ID NO: 122445 - DNA, 20 bp, Artificial Sequence
  Description of Artificial Sequence: Synthetic oligonucleotide
  Target: ATXN1; (+) strand; PAM type: NRG; PAM sequence: AGG
taataaataggtattgttat

SEQ ID NO: 122446 - DNA, 20 bp, Artificial Sequence
  Description of Artificial Sequence: Synthetic oligonucleotide
  Target: ATXN1; (+) strand; PAM type: NRG; PAM sequence: TGG
taaataggtattgttatagg

SEQ ID NO: 122447 - DNA, 20 bp, Artificial Sequence
  Description of Artificial Sequence: Synthetic oligonucleotide
  Target: ATXN1; (+) strand; PAM type: NRG; PAM sequence: GGG
aaataggtattgttataggt

SEQ ID NO: 122448 - DNA, 20 bp, Artificial Sequence
  Description of Artificial Sequence: Synthetic oligonucleotide
  Target: ATXN1; (+) strand; PAM type: NRG; PAM sequence: GAG
ataggtgggaattgaacaat

SEQ ID NO: 122449 - DNA, 20 bp, Artificial Sequence
  Description of Artificial Sequence: Synthetic oligonucleotide
  Target: ATXN1; (+) strand; PAM type: NRG; PAM sequence: TGG
aattgaacaatgagaacaca

SEQ ID NO: 122450 - DNA, 20 bp, Artificial Sequence
  Description of Artificial Sequence: Synthetic oligonucleotide
  Target: ATXN1; (+) strand; PAM type: NRG; PAM sequence: CAG
acaatgagaacacatggaca

SEQ ID NO: 122451 - DNA, 20 bp, Artificial Sequence
  Description of Artificial Sequence: Synthetic oligonucleotide
  Target: ATXN1; (+) strand; PAM type: NRG; PAM sequence: AGG
caatgagaacacatggacac

SEQ ID NO: 122452 - DNA, 20 bp, Artificial Sequence
  Description of Artificial Sequence: Synthetic oligonucleotide
  Target: ATXN1; (+) strand; PAM type: NRG; PAM sequence: AAG
tgagaacacatggacacagg

SEQ ID NO: 122453 - DNA, 20 bp, Artificial Sequence
  Description of Artificial Sequence: Synthetic oligonucleotide
  Target: ATXN1; (+) strand; PAM type: NRG; PAM sequence: AGG
gagaacacatggacacagga

SEQ ID NO: 122454 - DNA, 20 bp, Artificial Sequence
  Description of Artificial Sequence: Synthetic oligonucleotide
  Target: ATXN1; (+) strand; PAM type: NRG; PAM sequence: GGG
agaacacatggacacaggaa

SEQ ID NO: 122455 - DNA, 20 bp, Artificial Sequence
  Description of Artificial Sequence: Synthetic oligonucleotide
  Target: ATXN1; (+) strand; PAM type: NRG; PAM sequence: GGG
gaacacatggacacaggaag

SEQ ID NO: 122456 - DNA, 20 bp, Artificial Sequence
  Description of Artificial Sequence: Synthetic oligonucleotide
  Target: ATXN1; (+) strand; PAM type: NRG; PAM sequence: TGG
ggaaggggaacatcacactc

SEQ ID NO: 122457 - DNA, 20 bp, Artificial Sequence
  Description of Artificial Sequence: Synthetic oligonucleotide
  Target: ATXN1; (+) strand; PAM type: NRG; PAM sequence: GGG
gaaggggaacatcacactct

SEQ ID NO: 122458 - DNA, 20 bp, Artificial Sequence
  Description of Artificial Sequence: Synthetic oligonucleotide
  Target: ATXN1; (+) strand; PAM type: NRG; PAM sequence: GGG
aaggggaacatcacactctg

SEQ ID NO: 122459 - DNA, 20 bp, Artificial Sequence
  Description of Artificial Sequence: Synthetic oligonucleotide
  Target: ATXN1; (+) strand; PAM type: NRG; PAM sequence: TAG
acatcacactctggggactg

SEQ ID NO: 122460 - DNA, 20 bp, Artificial Sequence
  Description of Artificial Sequence: Synthetic oligonucleotide
  Target: ATXN1; (+) strand; PAM type: NRG; PAM sequence: TGG
tcacactctggggactgtag

SEQ ID NO: 122461 - DNA, 20 bp, Artificial Sequence
  Description of Artificial Sequence: Synthetic oligonucleotide
  Target: ATXN1; (+) strand; PAM type: NRG; PAM sequence: GGG
cacactctggggactgtagt

SEQ ID NO: 122462 - DNA, 20 bp, Artificial Sequence
  Description of Artificial Sequence: Synthetic oligonucleotide
  Target: ATXN1; (+) strand; PAM type: NRG; PAM sequence: GGG
acactctggggactgtagtg

SEQ ID NO: 122463 - DNA, 20 bp, Artificial Sequence
  Description of Artificial Sequence: Synthetic oligonucleotide
  Target: ATXN1; (+) strand; PAM type: NRG; PAM sequence: TGG
ctctggggactgtagtgggg

SEQ ID NO: 122464 - DNA, 20 bp, Artificial Sequence
  Description of Artificial Sequence: Synthetic oligonucleotide
  Target: ATXN1; (+) strand; PAM type: NRG; PAM sequence: GGG
tctggggactgtagtggggt

SEQ ID NO: 122465 - DNA, 20 bp, Artificial Sequence
  Description of Artificial Sequence: Synthetic oligonucleotide
  Target: ATXN1; (+) strand; PAM type: NRG; PAM sequence: GGG
ctggggactgtagtggggtg

SEQ ID NO: 122466 - DNA, 20 bp, Artificial Sequence
  Description of Artificial Sequence: Synthetic oligonucleotide
  Target: ATXN1; (+) strand; PAM type: NRG; PAM sequence: GGG
tggggactgtagtggggtgg

SEQ ID NO: 122467 - DNA, 20 bp, Artificial Sequence
  Description of Artificial Sequence: Synthetic oligonucleotide
  Target: ATXN1; (+) strand; PAM type: NRG; PAM sequence: GGG
ggggactgtagtggggtggg

SEQ ID NO: 122468 - DNA, 20 bp, Artificial Sequence
  Description of Artificial Sequence: Synthetic oligonucleotide
  Target: ATXN1; (+) strand; PAM type: NRG; PAM sequence: GAG
ggactgtagtggggtggggg

SEQ ID NO: 122469 - DNA, 20 bp, Artificial Sequence
  Description of Artificial Sequence: Synthetic oligonucleotide
  Target: ATXN1; (+) strand; PAM type: NRG; PAM sequence: CGG
ctgtagtggggtggggggag

SEQ ID NO: 122470 - DNA, 20 bp, Artificial Sequence
  Description of Artificial Sequence: Synthetic oligonucleotide
  Target: ATXN1; (+) strand; PAM type: NRG; PAM sequence: GGG
tgtagtggggtggggggagc

SEQ ID NO: 122471 - DNA, 20 bp, Artificial Sequence
  Description of Artificial Sequence: Synthetic oligonucleotide
  Target: ATXN1; (+) strand; PAM type: NRG; PAM sequence: GGG
gtagtggggtggggggagcg

SEQ ID NO: 122472 - DNA, 20 bp, Artificial Sequence
  Description of Artificial Sequence: Synthetic oligonucleotide
  Target: ATXN1; (+) strand; PAM type: NRG; PAM sequence: GAG
agtggggtggggggagcggg

SEQ ID NO: 122473 - DNA, 20 bp, Artificial Sequence
  Description of Artificial Sequence: Synthetic oligonucleotide
  Target: ATXN1; (+) strand; PAM type: NRG; PAM sequence: AGG
gtggggtggggggagcgggg

SEQ ID NO: 122474 - DNA, 20 bp, Artificial Sequence
  Description of Artificial Sequence: Synthetic oligonucleotide
  Target: ATXN1; (+) strand; PAM type: NRG; PAM sequence: GGG
tggggtggggggagcgggga

SEQ ID NO: 122475 - DNA, 20 bp, Artificial Sequence
  Description of Artificial Sequence: Synthetic oligonucleotide
  Target: ATXN1; (+) strand; PAM type: NRG; PAM sequence: TAG
gtggggggagcggggaggga

SEQ ID NO: 122476 - DNA, 20 bp, Artificial Sequence
  Description of Artificial Sequence: Synthetic oligonucleotide
  Target: ATXN1; (+) strand; PAM type: NRG; PAM sequence: TAG
ggagcggggagggatagcat

SEQ ID NO: 122477 - DNA, 20 bp, Artificial Sequence
  Description of Artificial Sequence: Synthetic oligonucleotide
  Target: ATXN1; (+) strand; PAM type: NRG; PAM sequence: AGG
gagcggggagggatagcatt

SEQ ID NO: 122478 - DNA, 20 bp, Artificial Sequence
  Description of Artificial Sequence: Synthetic oligonucleotide
  Target: ATXN1; (+) strand; PAM type: NRG; PAM sequence: GAG
gcggggagggatagcattag

SEQ ID NO: 122479 - DNA, 20 bp, Artificial Sequence
  Description of Artificial Sequence: Synthetic oligonucleotide
  Target: ATXN1; (+) strand; PAM type: NRG; PAM sequence: TAG
ttaggagatatacctaatgc

SEQ ID NO: 122480 - DNA, 20 bp, Artificial Sequence
  Description of Artificial Sequence: Synthetic oligonucleotide
  Target: ATXN1; (+) strand; PAM type: NRG; PAM sequence: GAG
tatacctaatgctagatgac

SEQ ID NO: 122481 - DNA, 20 bp, Artificial Sequence
  Description of Artificial Sequence: Synthetic oligonucleotide
  Target: ATXN1; (+) strand; PAM type: NRG; PAM sequence: TGG
aatgctagatgacgagttaa

SEQ ID NO: 122482 - DNA, 20 bp, Artificial Sequence
  Description of Artificial Sequence: Synthetic oligonucleotide
  Target: ATXN1; (+) strand; PAM type: NRG; PAM sequence: GGG
atgctagatgacgagttaat

SEQ ID NO: 122483 - DNA, 20 bp, Artificial Sequence
  Description of Artificial Sequence: Synthetic oligonucleotide
  Target: ATXN1; (+) strand; PAM type: NRG; PAM sequence: CAG
agatgacgagttaatgggtg

SEQ ID NO: 122484 - DNA, 20 bp, Artificial Sequence
  Description of Artificial Sequence: Synthetic oligonucleotide
  Target: ATXN1; (+) strand; PAM type: NRG; PAM sequence: CAG
agttaatgggtgcagcacac

SEQ ID NO: 122485 - DNA, 20 bp, Artificial Sequence
  Description of Artificial Sequence: Synthetic oligonucleotide
  Target: ATXN1; (+) strand; PAM type: NRG; PAM sequence: TGG
atgggtgcagcacaccagca

SEQ ID NO: 122486 - DNA, 20 bp, Artificial Sequence
  Description of Artificial Sequence: Synthetic oligonucleotide
  Target: ATXN1; (+) strand; PAM type: NRG; PAM sequence: AAG
cacatgtaccctaaaaccta

SEQ ID NO: 122487 - DNA, 20 bp, Artificial Sequence
  Description of Artificial Sequence: Synthetic oligonucleotide
  Target: ATXN1; (+) strand; PAM type: NRG; PAM sequence: AAG
aataacataaaaaataaaaa

SEQ ID NO: 122488 - DNA, 20 bp, Artificial Sequence
  Description of Artificial Sequence: Synthetic oligonucleotide
  Target: ATXN1; (+) strand; PAM type: NRG; PAM sequence: AAG
cataaaaaataaaaaaagaa

SEQ ID NO: 122489 - DNA, 20 bp, Artificial Sequence
  Description of Artificial Sequence: Synthetic oligonucleotide
  Target: ATXN1; (+) strand; PAM type: NRG; PAM sequence: TAG
cacacacaaaaaaaaataaa

SEQ ID NO: 122490 - DNA, 20 bp, Artificial Sequence
  Description of Artificial Sequence: Synthetic oligonucleotide
  Target: ATXN1; (+) strand; PAM type: NRG; PAM sequence: AGG
acacacaaaaaaaaataaat

SEQ ID NO: 122491 - DNA, 20 bp, Artificial Sequence
  Description of Artificial Sequence: Synthetic oligonucleotide
  Target: ATXN1; (+) strand; PAM type: NRG; PAM sequence: AAG
aaaataaataggtgttgttt

SEQ ID NO: 122492 - DNA, 20 bp, Artificial Sequence
  Description of Artificial Sequence: Synthetic oligonucleotide
  Target: ATXN1; (+) strand; PAM type: NRG; PAM sequence: TAG
tgtttaagtcactatatttg

SEQ ID NO: 122493 - DNA, 20 bp, Artificial Sequence
  Description of Artificial Sequence: Synthetic oligonucleotide
  Target: ATXN1; (+) strand; PAM type: NRG; PAM sequence: CAG
tatatttgtagtttgtcata

SEQ ID NO: 122494 - DNA, 20 bp, Artificial Sequence
  Description of Artificial Sequence: Synthetic oligonucleotide
  Target: ATXN1; (+) strand; PAM type: NRG; PAM sequence: TAG
tgtagtttgtcatacagcaa

SEQ ID NO: 122495 - DNA, 20 bp, Artificial Sequence
  Description of Artificial Sequence: Synthetic oligonucleotide
  Target: ATXN1; (+) strand; PAM type: NRG; PAM sequence: GAG
ttttttgcttgaatcacttt

SEQ ID NO: 122496 - DNA, 20 bp, Artificial Sequence
  Description of Artificial Sequence: Synthetic oligonucleotide
  Target: ATXN1; (+) strand; PAM type: NRG; PAM sequence: GAG
caaatattcttaatttctct

SEQ ID NO: 122497 - DNA, 20 bp, Artificial Sequence
  Description of Artificial Sequence: Synthetic oligonucleotide
  Target: ATXN1; (+) strand; PAM type: NRG; PAM sequence: TGG
tattcttaatttctctgaga

SEQ ID NO: 122498 - DNA, 20 bp, Artificial Sequence
  Description of Artificial Sequence: Synthetic oligonucleotide
  Target: ATXN1; (+) strand; PAM type: NRG; PAM sequence: TGG
tctctgagatggtactttct

SEQ ID NO: 122499 - DNA, 20 bp, Artificial Sequence
  Description of Artificial Sequence: Synthetic oligonucleotide
  Target: ATXN1; (+) strand; PAM type: NRG; PAM sequence: GGG
ctctgagatggtactttctt

SEQ ID NO: 122500 - DNA, 20 bp, Artificial Sequence
  Description of Artificial Sequence: Synthetic oligonucleotide
  Target: ATXN1; (+) strand; PAM type: NRG; PAM sequence: TGG
gttccttatattactcctta

SEQ ID NO: 122501 - DNA, 20 bp, Artificial Sequence
  Description of Artificial Sequence: Synthetic oligonucleotide
  Target: ATXN1; (+) strand; PAM type: NRG; PAM sequence: CAG
tactccttatggcccctctg

SEQ ID NO: 122502 - DNA, 20 bp, Artificial Sequence
  Description of Artificial Sequence: Synthetic oligonucleotide
  Target: ATXN1; (+) strand; PAM type: NRG; PAM sequence: TAG
ctctctgttctttctaactc

SEQ ID NO: 122503 - DNA, 20 bp, Artificial Sequence
  Description of Artificial Sequence: Synthetic oligonucleotide
  Target: ATXN1; (+) strand; PAM type: NRG; PAM sequence: AGG
tctctgttctttctaactct

SEQ ID NO: 122504 - DNA, 20 bp, Artificial Sequence
  Description of Artificial Sequence: Synthetic oligonucleotide
  Target: ATXN1; (+) strand; PAM type: NRG; PAM sequence: GGG
ctctgttctttctaactcta

SEQ ID NO: 122505 - DNA, 20 bp, Artificial Sequence
  Description of Artificial Sequence: Synthetic oligonucleotide
  Target: ATXN1; (+) strand; PAM type: NRG; PAM sequence: GGG
tctgttctttctaactctag

SEQ ID NO: 122506 - DNA, 20 bp, Artificial Sequence
  Description of Artificial Sequence: Synthetic oligonucleotide
  Target: ATXN1; (+) strand; PAM type: NRG; PAM sequence: CAG
ttctttctaactctagggga

SEQ ID NO: 122507 - DNA, 20 bp, Artificial Sequence
  Description of Artificial Sequence: Synthetic oligonucleotide
  Target: ATXN1; (+) strand; PAM type: NRG; PAM sequence: AAG
ctctaggggacagatttcct

SEQ ID NO: 122508 - DNA, 20 bp, Artificial Sequence
  Description of Artificial Sequence: Synthetic oligonucleotide
  Target: ATXN1; (+) strand; PAM type: NRG; PAM sequence: AGG
tctaggggacagatttccta

SEQ ID NO: 122509 - DNA, 20 bp, Artificial Sequence
  Description of Artificial Sequence: Synthetic oligonucleotide
  Target: ATXN1; (+) strand; PAM type: NRG; PAM sequence: CAG
atttcctaaggctatctgct

SEQ ID NO: 122510 - DNA, 20 bp, Artificial Sequence
  Description of Artificial Sequence: Synthetic oligonucleotide
  Target: ATXN1; (+) strand; PAM type: NRG; PAM sequence: TGG
tcgttcttaaatctgtatcc

SEQ ID NO: 122511 - DNA, 20 bp, Artificial Sequence
  Description of Artificial Sequence: Synthetic oligonucleotide
  Target: ATXN1; (+) strand; PAM type: NRG; PAM sequence: TGG
taaatctgtatcctggtccc

SEQ ID NO: 122512 - DNA, 20 bp, Artificial Sequence
  Description of Artificial Sequence: Synthetic oligonucleotide
  Target: ATXN1; (+) strand; PAM type: NRG; PAM sequence: TGG
tatctccccctacaaactcc

SEQ ID NO: 122513 - DNA, 20 bp, Artificial Sequence
  Description of Artificial Sequence: Synthetic oligonucleotide
  Target: ATXN1; (+) strand; PAM type: NRG; PAM sequence: CAG
tacaaactcctggatatatg

SEQ ID NO: 122514 - DNA, 20 bp, Artificial Sequence
  Description of Artificial Sequence: Synthetic oligonucleotide
  Target: ATXN1; (+) strand; PAM type: NRG; PAM sequence: TGG
aaactcctggatatatgcag

SEQ ID NO: 122515 - DNA, 20 bp, Artificial Sequence
  Description of Artificial Sequence: Synthetic oligonucleotide
  Target: ATXN1; (+) strand; PAM type: NRG; PAM sequence: CAG
atgtttatttcaaactttcc

SEQ ID NO: 122516 - DNA, 20 bp, Artificial Sequence
  Description of Artificial Sequence: Synthetic oligonucleotide
  Target: ATXN1; (+) strand; PAM type: NRG; PAM sequence: CAG
ccagtcccttgctccaaacc

SEQ ID NO: 122517 - DNA, 20 bp, Artificial Sequence
  Description of Artificial Sequence: Synthetic oligonucleotide
  Target: ATXN1; (+) strand; PAM type: NRG; PAM sequence: TGG
tcctcctctttaatttctga

SEQ ID NO: 122518 - DNA, 20 bp, Artificial Sequence
  Description of Artificial Sequence: Synthetic oligonucleotide
  Target: ATXN1; (+) strand; PAM type: NRG; PAM sequence: AAG
tcctctttaatttctgatgg

SEQ ID NO: 122519 - DNA, 20 bp, Artificial Sequence
  Description of Artificial Sequence: Synthetic oligonucleotide
  Target: ATXN1; (+) strand; PAM type: NRG; PAM sequence: CAG
taatttctgatggaagctga

SEQ ID NO: 122520 - DNA, 20 bp, Artificial Sequence
  Description of Artificial Sequence: Synthetic oligonucleotide
  Target: ATXN1; (+) strand; PAM type: NRG; PAM sequence: CGG
ctctttctcccacattccat

SEQ ID NO: 122521 - DNA, 20 bp, Artificial Sequence
  Description of Artificial Sequence: Synthetic oligonucleotide
  Target: ATXN1; (+) strand; PAM type: NRG; PAM sequence: AAG
cccacattccatcggtttcc

SEQ ID NO: 122522 - DNA, 20 bp, Artificial Sequence
  Description of Artificial Sequence: Synthetic oligonucleotide
  Target: ATXN1; (+) strand; PAM type: NRG; PAM sequence: TAG
ctatcttcaccgccccatgc

SEQ ID NO: 122523 - DNA, 20 bp, Artificial Sequence
  Description of Artificial Sequence: Synthetic oligonucleotide
  Target: ATXN1; (+) strand; PAM type: NRG; PAM sequence: CAG
ttcaccgccccatgctagct

SEQ ID NO: 122524 - DNA, 20 bp, Artificial Sequence
  Description of Artificial Sequence: Synthetic oligonucleotide
  Target: ATXN1; (+) strand; PAM type: NRG; PAM sequence: CAG
ctcagactgaattcctctca

SEQ ID NO: 122525 - DNA, 20 bp, Artificial Sequence
  Description of Artificial Sequence: Synthetic oligonucleotide
  Target: ATXN1; (+) strand; PAM type: NRG; PAM sequence: CAG
agactgaattcctctcacag

SEQ ID NO: 122526 - DNA, 20 bp, Artificial Sequence
  Description of Artificial Sequence: Synthetic oligonucleotide
  Target: ATXN1; (+) strand; PAM type: NRG; PAM sequence: TGG
tctcacagcagcctgctcat

SEQ ID NO: 122527 - DNA, 20 bp, Artificial Sequence
  Description of Artificial Sequence: Synthetic oligonucleotide
  Target: ATXN1; (+) strand; PAM type: NRG; PAM sequence: GAG
tttctctctctaaaccattt

SEQ ID NO: 122528 - DNA, 20 bp, Artificial Sequence
  Description of Artificial Sequence: Synthetic oligonucleotide
  Target: ATXN1; (+) strand; PAM type: NRG; PAM sequence: TGG
accatttgagtcatccctgt

SEQ ID NO: 122529 - DNA, 20 bp, Artificial Sequence
  Description of Artificial Sequence: Synthetic oligonucleotide
  Target: ATXN1; (+) strand; PAM type: NRG; PAM sequence: AAG
ctgttggatcgaacttccta

SEQ ID NO: 122530 - DNA, 20 bp, Artificial Sequence
  Description of Artificial Sequence: Synthetic oligonucleotide
  Target: ATXN1; (+) strand; PAM type: NRG; PAM sequence: TAG
ttggatcgaacttcctaaag

SEQ ID NO: 122531 - DNA, 20 bp, Artificial Sequence
  Description of Artificial Sequence: Synthetic oligonucleotide
  Target: ATXN1; (+) strand; PAM type: NRG; PAM sequence: TGG
cgtgccatccataccttcat

SEQ ID NO: 122532 - DNA, 20 bp, Artificial Sequence
  Description of Artificial Sequence: Synthetic oligonucleotide
  Target: ATXN1; (+) strand; PAM type: NRG; PAM sequence: CAG
cataccttcattggttccta

SEQ ID NO: 122533 - DNA, 20 bp, Artificial Sequence
  Description of Artificial Sequence: Synthetic oligonucleotide
  Target: ATXN1; (+) strand; PAM type: NRG; PAM sequence: AAG
aaattctttatttgatgctg

SEQ ID NO: 122534 - DNA, 20 bp, Artificial Sequence
  Description of Artificial Sequence: Synthetic oligonucleotide
  Target: ATXN1; (+) strand; PAM type: NRG; PAM sequence: TGG
tgctgaagatcttcacaatc

SEQ ID NO: 122535 - DNA, 20 bp, Artificial Sequence
  Description of Artificial Sequence: Synthetic oligonucleotide
  Target: ATXN1; (+) strand; PAM type: NRG; PAM sequence: CAG
agatcttcacaatctggccc

SEQ ID NO: 122536 - DNA, 20 bp, Artificial Sequence
  Description of Artificial Sequence: Synthetic oligonucleotide
  Target: ATXN1; (+) strand; PAM type: NRG; PAM sequence: AAG
ttctcccctcatgcacactg

SEQ ID NO: 122537 - DNA, 20 bp, Artificial Sequence
  Description of Artificial Sequence: Synthetic oligonucleotide
  Target: ATXN1; (+) strand; PAM type: NRG; PAM sequence: CAG
tcccctcatgcacactgaag

SEQ ID NO: 122538 - DNA, 20 bp, Artificial Sequence
  Description of Artificial Sequence: Synthetic oligonucleotide
  Target: ATXN1; (+) strand; PAM type: NRG; PAM sequence: CAG
catgcacactgaagcagcca

SEQ ID NO: 122539 - DNA, 20 bp, Artificial Sequence
  Description of Artificial Sequence: Synthetic oligonucleotide
  Target: ATXN1; (+) strand; PAM type: NRG; PAM sequence: GAG
cacactgaagcagccacagt

SEQ ID NO: 122540 - DNA, 20 bp, Artificial Sequence
  Description of Artificial Sequence: Synthetic oligonucleotide
  Target: ATXN1; (+) strand; PAM type: NRG; PAM sequence: GAG
gagcttctcacttcctctct

SEQ ID NO: 122541 - DNA, 20 bp, Artificial Sequence
  Description of Artificial Sequence: Synthetic oligonucleotide
  Target: ATXN1; (+) strand; PAM type: NRG; PAM sequence: GAG
gcttctcacttcctctctga

SEQ ID NO: 122542 - DNA, 20 bp, Artificial Sequence
  Description of Artificial Sequence: Synthetic oligonucleotide
  Target: ATXN1; (+) strand; PAM type: NRG; PAM sequence: AAG
tactccacgtgtcaaaatgt

SEQ ID NO: 122543 - DNA, 20 bp, Artificial Sequence
  Description of Artificial Sequence: Synthetic oligonucleotide
  Target: ATXN1; (+) strand; PAM type: NRG; PAM sequence: CAG
ccacgtgtcaaaatgtaagc

SEQ ID NO: 122544 - DNA, 20 bp, Artificial Sequence
  Description of Artificial Sequence: Synthetic oligonucleotide
  Target: ATXN1; (+) strand; PAM type: NRG; PAM sequence: AAG
aaatgtaagccagacctccc

SEQ ID NO: 122545 - DNA, 20 bp, Artificial Sequence
  Description of Artificial Sequence: Synthetic oligonucleotide
  Target: ATXN1; (+) strand; PAM type: NRG; PAM sequence: CAG
taagccagacctcccaagac

SEQ ID NO: 122546 - DNA, 20 bp, Artificial Sequence
  Description of Artificial Sequence: Synthetic oligonucleotide
  Target: ATXN1; (+) strand; PAM type: NRG; PAM sequence: CAG
tattctacaactttctcaat

SEQ ID NO: 122547 - DNA, 20 bp, Artificial Sequence
  Description of Artificial Sequence: Synthetic oligonucleotide
  Target: ATXN1; (+) strand; PAM type: NRG; PAM sequence: AAG
tctacaactttctcaatcag

SEQ ID NO: 122548 - DNA, 20 bp, Artificial Sequence
  Description of Artificial Sequence: Synthetic oligonucleotide
  Target: ATXN1; (+) strand; PAM type: NRG; PAM sequence: TGG
agtttttttttttttttttt

SEQ ID NO: 122549 - DNA, 20 bp, Artificial Sequence
  Description of Artificial Sequence: Synthetic oligonucleotide
  Target: ATXN1; (+) strand; PAM type: NRG; PAM sequence: TGG
tttttgcatgtgaatgccta

SEQ ID NO: 122550 - DNA, 20 bp, Artificial Sequence
  Description of Artificial Sequence: Synthetic oligonucleotide
  Target: ATXN1; (+) strand; PAM type: NRG; PAM sequence: TAG
ttttattccttatcctacaa

SEQ ID NO: 122551 - DNA, 20 bp, Artificial Sequence
  Description of Artificial Sequence: Synthetic oligonucleotide
  Target: ATXN1; (+) strand; PAM type: NRG; PAM sequence: AGG
tttattccttatcctacaat

SEQ ID NO: 122552 - DNA, 20 bp, Artificial Sequence
  Description of Artificial Sequence: Synthetic oligonucleotide
  Target: ATXN1; (+) strand; PAM type: NRG; PAM sequence: AAG
acaataggtgtcatctcccc

SEQ ID NO: 122553 - DNA, 20 bp, Artificial Sequence
  Description of Artificial Sequence: Synthetic oligonucleotide
  Target: ATXN1; (+) strand; PAM type: NRG; PAM sequence: TGG
ataggtgtcatctccccaag

SEQ ID NO: 122554 - DNA, 20 bp, Artificial Sequence
  Description of Artificial Sequence: Synthetic oligonucleotide
  Target: ATXN1; (+) strand; PAM type: NRG; PAM sequence: TGG
tcatctccccaagtggaatg

SEQ ID NO: 122555 - DNA, 20 bp, Artificial Sequence
  Description of Artificial Sequence: Synthetic oligonucleotide
  Target: ATXN1; (+) strand; PAM type: NRG; PAM sequence: AAG
ggaatgtggtaacttccgta

SEQ ID NO: 122556 - DNA, 20 bp, Artificial Sequence
  Description of Artificial Sequence: Synthetic oligonucleotide
  Target: ATXN1; (+) strand; PAM type: NRG; PAM sequence: AGG
gaatgtggtaacttccgtaa

SEQ ID NO: 122557 - DNA, 20 bp, Artificial Sequence
  Description of Artificial Sequence: Synthetic oligonucleotide
  Target: ATXN1; (+) strand; PAM type: NRG; PAM sequence: TAG
tgtggtaacttccgtaaagg

SEQ ID NO: 122558 - DNA, 20 bp, Artificial Sequence
  Description of Artificial Sequence: Synthetic oligonucleotide
  Target: ATXN1; (+) strand; PAM type: NRG; PAM sequence: AGG
gtggtaacttccgtaaaggt

SEQ ID NO: 122559 - DNA, 20 bp, Artificial Sequence
  Description of Artificial Sequence: Synthetic oligonucleotide
  Target: ATXN1; (+) strand; PAM type: NRG; PAM sequence: GGG
tggtaacttccgtaaaggta

SEQ ID NO: 122560 - DNA, 20 bp, Artificial Sequence
  Description of Artificial Sequence: Synthetic oligonucleotide
  Target: ATXN1; (+) strand; PAM type: NRG; PAM sequence: AAG
tatgtctgtcttctttttgt

SEQ ID NO: 122561 - DNA, 20 bp, Artificial Sequence
  Description of Artificial Sequence: Synthetic oligonucleotide
  Target: ATXN1; (+) strand; PAM type: NRG; PAM sequence: CGG
tcttctttttgtaagcttca

SEQ ID NO: 122562 - DNA, 20 bp, Artificial Sequence
  Description of Artificial Sequence: Synthetic oligonucleotide
  Target: ATXN1; (+) strand; PAM type: NRG; PAM sequence: GGG
cttctttttgtaagcttcac

SEQ ID NO: 122563 - DNA, 20 bp, Artificial Sequence
  Description of Artificial Sequence: Synthetic oligonucleotide
  Target: ATXN1; (+) strand; PAM type: NRG; PAM sequence: GGG
ttctttttgtaagcttcacg

SEQ ID NO: 122564 - DNA, 20 bp, Artificial Sequence
  Description of Artificial Sequence: Synthetic oligonucleotide
  Target: ATXN1; (+) strand; PAM type: NRG; PAM sequence: TGG
tgattaactgattgataaca

SEQ ID NO: 122565 - DNA, 20 bp, Artificial Sequence
  Description of Artificial Sequence: Synthetic oligonucleotide
  Target: ATXN1; (+) strand; PAM type: NRG; PAM sequence: AAG
attatattacattatacttg

SEQ ID NO: 122566 - DNA, 20 bp, Artificial Sequence
  Description of Artificial Sequence: Synthetic oligonucleotide
  Target: ATXN1; (+) strand; PAM type: NRG; PAM sequence: GAG
tgaagacgttatatgtcttt

SEQ ID NO: 122567 - DNA, 20 bp, Artificial Sequence
  Description of Artificial Sequence: Synthetic oligonucleotide
  Target: ATXN1; (+) strand; PAM type: NRG; PAM sequence: TGG
ctttgagtctctgtcctcca

SEQ ID NO: 122568 - DNA, 20 bp, Artificial Sequence
  Description of Artificial Sequence: Synthetic oligonucleotide
  Target: ATXN1; (+) strand; PAM type: NRG; PAM sequence: AAG
tgagtctctgtcctccatgg

SEQ ID NO: 122569 - DNA, 20 bp, Artificial Sequence
  Description of Artificial Sequence: Synthetic oligonucleotide
  Target: ATXN1; (+) strand; PAM type: NRG; PAM sequence: GAG
agtctctgtcctccatggaa

SEQ ID NO: 122570 - DNA, 20 bp, Artificial Sequence
  Description of Artificial Sequence: Synthetic oligonucleotide
  Target: ATXN1; (+) strand; PAM type: NRG; PAM sequence: AGG
gtctctgtcctccatggaag

SEQ ID NO: 122571 - DNA, 20 bp, Artificial Sequence
  Description of Artificial Sequence: Synthetic oligonucleotide
  Target: ATXN1; (+) strand; PAM type: NRG; PAM sequence: CAG
ctgtcctccatggaagagga

SEQ ID NO: 122572 - DNA, 20 bp, Artificial Sequence
  Description of Artificial Sequence: Synthetic oligonucleotide
  Target: ATXN1; (+) strand; PAM type: NRG; PAM sequence: AGG
tgtcctccatggaagaggac

SEQ ID NO: 122573 - DNA, 20 bp, Artificial Sequence
  Description of Artificial Sequence: Synthetic oligonucleotide
  Target: ATXN1; (+) strand; PAM type: NRG; PAM sequence: TGG
gaagaggacaggtgttcaaa

SEQ ID NO: 122574 - DNA, 20 bp, Artificial Sequence
  Description of Artificial Sequence: Synthetic oligonucleotide
  Target: ATXN1; (+) strand; PAM type: NRG; PAM sequence: AAG
gaggacaggtgttcaaatgg

SEQ ID NO: 122575 - DNA, 20 bp, Artificial Sequence
  Description of Artificial Sequence: Synthetic oligonucleotide
  Target: ATXN1; (+) strand; PAM type: NRG; PAM sequence: TGG
caaatggaagaacacccttt

SEQ ID NO: 122576 - DNA, 20 bp, Artificial Sequence
  Description of Artificial Sequence: Synthetic oligonucleotide
  Target: ATXN1; (+) strand; PAM type: NRG; PAM sequence: GGG
aaatggaagaacaccctttt

SEQ ID NO: 122577 - DNA, 20 bp, Artificial Sequence
  Description of Artificial Sequence: Synthetic oligonucleotide
  Target: ATXN1; (+) strand; PAM type: NRG; PAM sequence: TGG
gaacacccttttgggtgact

SEQ ID NO: 122578 - DNA, 20 bp, Artificial Sequence
  Description of Artificial Sequence: Synthetic oligonucleotide
  Target: ATXN1; (+) strand; PAM type: NRG; PAM sequence: GAG
acacccttttgggtgacttg

SEQ ID NO: 122579 - DNA, 20 bp, Artificial Sequence
  Description of Artificial Sequence: Synthetic oligonucleotide
  Target: ATXN1; (+) strand; PAM type: NRG; PAM sequence: AAG
ttggagaaaaatcatcacat

SEQ ID NO: 122580 - DNA, 20 bp, Artificial Sequence
  Description of Artificial Sequence: Synthetic oligonucleotide
  Target: ATXN1; (+) strand; PAM type: NRG; PAM sequence: AAG
aaatcatcacataagtctct

SEQ ID NO: 122581 - DNA, 20 bp, Artificial Sequence
  Description of Artificial Sequence: Synthetic oligonucleotide
  Target: ATXN1; (+) strand; PAM type: NRG; PAM sequence: AGG
aatcatcacataagtctcta

SEQ ID NO: 122582 - DNA, 20 bp, Artificial Sequence
  Description of Artificial Sequence: Synthetic oligonucleotide
  Target: ATXN1; (+) strand; PAM type: NRG; PAM sequence: CAG
aagtctctaaggaaactgtg

SEQ ID NO: 122583 - DNA, 20 bp, Artificial Sequence
  Description of Artificial Sequence: Synthetic oligonucleotide
  Target: ATXN1; (+) strand; PAM type: NRG; PAM sequence: CAG
ctcaatgaaatgttccacaa

SEQ ID NO: 122584 - DNA, 20 bp, Artificial Sequence
  Description of Artificial Sequence: Synthetic oligonucleotide
  Target: ATXN1; (+) strand; PAM type: NRG; PAM sequence: CAG
aacagcctctttttccaact

SEQ ID NO: 122585 - DNA, 20 bp, Artificial Sequence
  Description of Artificial Sequence: Synthetic oligonucleotide
  Target: ATXN1; (+) strand; PAM type: NRG; PAM sequence: AAG
ctttttccaactcagaacta

SEQ ID NO: 122586 - DNA, 20 bp, Artificial Sequence
  Description of Artificial Sequence: Synthetic oligonucleotide
  Target: ATXN1; (+) strand; PAM type: NRG; PAM sequence: AGG
tttttccaactcagaactaa

SEQ ID NO: 122587 - DNA, 20 bp, Artificial Sequence
  Description of Artificial Sequence: Synthetic oligonucleotide
  Target: ATXN1; (+) strand; PAM type: NRG; PAM sequence: GAG
actctttgtatttcctttct

SEQ ID NO: 122588 - DNA, 20 bp, Artificial Sequence
  Description of Artificial Sequence: Synthetic oligonucleotide
  Target: ATXN1; (+) strand; PAM type: NRG; PAM sequence: AGG
ctctttgtatttcctttctg

SEQ ID NO: 122589 - DNA, 20 bp, Artificial Sequence
  Description of Artificial Sequence: Synthetic oligonucleotide
  Target: ATXN1; (+) strand; PAM type: NRG; PAM sequence: AAG
tatttcctttctgaggaata

SEQ ID NO: 122590 - DNA, 20 bp, Artificial Sequence
  Description of Artificial Sequence: Synthetic oligonucleotide
  Target: ATXN1; (+) strand; PAM type: NRG; PAM sequence: GAG
tttcctttctgaggaataaa

SEQ ID NO: 122591 - DNA, 20 bp, Artificial Sequence
  Description of Artificial Sequence: Synthetic oligonucleotide
  Target: ATXN1; (+) strand; PAM type: NRG; PAM sequence: AAG
cctttctgaggaataaagag

SEQ ID NO: 122592 - DNA, 20 bp, Artificial Sequence
  Description of Artificial Sequence: Synthetic oligonucleotide
  Target: ATXN1; (+) strand; PAM type: NRG; PAM sequence: CAG
gaggaataaagagaagctgc

SEQ ID NO: 122593 - DNA, 20 bp, Artificial Sequence
  Description of Artificial Sequence: Synthetic oligonucleotide
  Target: ATXN1; (+) strand; PAM type: NRG; PAM sequence: AGG
aggaataaagagaagctgcc

SEQ ID NO: 122594 - DNA, 20 bp, Artificial Sequence
  Description of Artificial Sequence: Synthetic oligonucleotide
  Target: ATXN1; (+) strand; PAM type: NRG; PAM sequence: GGG
ggaataaagagaagctgcca

SEQ ID NO: 122595 - DNA, 20 bp, Artificial Sequence
  Description of Artificial Sequence: Synthetic oligonucleotide
  Target: ATXN1; (+) strand; PAM type: NRG; PAM sequence: TGG
agagaagctgccagggctgc

SEQ ID NO: 122596 - DNA, 20 bp, Artificial Sequence
  Description of Artificial Sequence: Synthetic oligonucleotide
  Target: ATXN1; (+) strand; PAM type: NRG; PAM sequence: CAG
gccagggctgctggcaattg

SEQ ID NO: 122597 - DNA, 20 bp, Artificial Sequence
  Description of Artificial Sequence: Synthetic oligonucleotide
  Target: ATXN1; (+) strand; PAM type: NRG; PAM sequence: GAG
cagggctgctggcaattgca

SEQ ID NO: 122598 - DNA, 20 bp, Artificial Sequence
  Description of Artificial Sequence: Synthetic oligonucleotide
  Target: ATXN1; (+) strand; PAM type: NRG; PAM sequence: CAG
ctgctggcaattgcagagtt

SEQ ID NO: 122599 - DNA, 20 bp, Artificial Sequence
  Description of Artificial Sequence: Synthetic oligonucleotide
  Target: ATXN1; (+) strand; PAM type: NRG; PAM sequence: GAG
cagaaatgcttcctctgaat

SEQ ID NO: 122600 - DNA, 20 bp, Artificial Sequence
  Description of Artificial Sequence: Synthetic oligonucleotide
  Target: ATXN1; (+) strand; PAM type: NRG; PAM sequence: CAG
ttcctctgaatgagcacact

SEQ ID NO: 122601 - DNA, 20 bp, Artificial Sequence
  Description of Artificial Sequence: Synthetic oligonucleotide
  Target: ATXN1; (+) strand; PAM type: NRG; PAM sequence: CAG
ctgaatgagcacactcagcc

SEQ ID NO: 122602 - DNA, 20 bp, Artificial Sequence
  Description of Artificial Sequence: Synthetic oligonucleotide
  Target: ATXN1; (+) strand; PAM type: NRG; PAM sequence: CAG
aatgagcacactcagcccag

SEQ ID NO: 122603 - DNA, 20 bp, Artificial Sequence
  Description of Artificial Sequence: Synthetic oligonucleotide
  Target: ATXN1; (+) strand; PAM type: NRG; PAM sequence: AGG
atgagcacactcagcccagc

SEQ ID NO: 122604 - DNA, 20 bp, Artificial Sequence
  Description of Artificial Sequence: Synthetic oligonucleotide
  Target: ATXN1; (+) strand; PAM type: NRG; PAM sequence: GGG
tgagcacactcagcccagca

SEQ ID NO: 122605 - DNA, 20 bp, Artificial Sequence
  Description of Artificial Sequence: Synthetic oligonucleotide
  Target: ATXN1; (+) strand; PAM type: NRG; PAM sequence: CAG
acactcagcccagcagggtg

SEQ ID NO: 122606 - DNA, 20 bp, Artificial Sequence
  Description of Artificial Sequence: Synthetic oligonucleotide
  Target: ATXN1; (+) strand; PAM type: NRG; PAM sequence: GAG
actcagcccagcagggtgca

SEQ ID NO: 122607 - DNA, 20 bp, Artificial Sequence
  Description of Artificial Sequence: Synthetic oligonucleotide
  Target: ATXN1; (+) strand; PAM type: NRG; PAM sequence: AAG
ctgtctccaccctgcccacc

SEQ ID NO: 122608 - DNA, 20 bp, Artificial Sequence
  Description of Artificial Sequence: Synthetic oligonucleotide
  Target: ATXN1; (+) strand; PAM type: NRG; PAM sequence: AGG
tgtctccaccctgcccacca

SEQ ID NO: 122609 - DNA, 20 bp, Artificial Sequence
  Description of Artificial Sequence: Synthetic oligonucleotide
  Target: ATXN1; (+) strand; PAM type: NRG; PAM sequence: GAG
tctccaccctgcccaccaag

SEQ ID NO: 122610 - DNA, 20 bp, Artificial Sequence
  Description of Artificial Sequence: Synthetic oligonucleotide
  Target: ATXN1; (+) strand; PAM type: NRG; PAM sequence: AAG
ccctgcccaccaaggagctt

SEQ ID NO: 122611 - DNA, 20 bp, Artificial Sequence
  Description of Artificial Sequence: Synthetic oligonucleotide
  Target: ATXN1; (+) strand; PAM type: NRG; PAM sequence: TGG
tgcccaccaaggagcttaag

SEQ ID NO: 122612 - DNA, 20 bp, Artificial Sequence
  Description of Artificial Sequence: Synthetic oligonucleotide
  Target: ATXN1; (+) strand; PAM type: NRG; PAM sequence: CAG
ccaccaaggagcttaagtgg

SEQ ID NO: 122613 - DNA, 20 bp, Artificial Sequence
  Description of Artificial Sequence: Synthetic oligonucleotide
  Target: ATXN1; (+) strand; PAM type: NRG; PAM sequence: AGG
caccaaggagcttaagtggc

SEQ ID NO: 122614 - DNA, 20 bp, Artificial Sequence
  Description of Artificial Sequence: Synthetic oligonucleotide
  Target: ATXN1; (+) strand; PAM type: NRG; PAM sequence: TGG
agcttaagtggcaggcaaac

SEQ ID NO: 122615 - DNA, 20 bp, Artificial Sequence
  Description of Artificial Sequence: Synthetic oligonucleotide
  Target: ATXN1; (+) strand; PAM type: NRG; PAM sequence: GGG
gcttaagtggcaggcaaact

SEQ ID NO: 122616 - DNA, 20 bp, Artificial Sequence
  Description of Artificial Sequence: Synthetic oligonucleotide
  Target: ATXN1; (+) strand; PAM type: NRG; PAM sequence: TGG
ccaaaaacacccctttccca

SEQ ID NO: 122617 - DNA, 20 bp, Artificial Sequence
  Description of Artificial Sequence: Synthetic oligonucleotide
  Target: ATXN1; (+) strand; PAM type: NRG; PAM sequence: GAG
aaaaacacccctttcccatg

SEQ ID NO: 122618 - DNA, 20 bp, Artificial Sequence
  Description of Artificial Sequence: Synthetic oligonucleotide
  Target: ATXN1; (+) strand; PAM type: NRG; PAM sequence: GAG
aaacacccctttcccatgga

SEQ ID NO: 122619 - DNA, 20 bp, Artificial Sequence
  Description of Artificial Sequence: Synthetic oligonucleotide
  Target: ATXN1; (+) strand; PAM type: NRG; PAM sequence: AGG
aacacccctttcccatggag

SEQ ID NO: 122620 - DNA, 20 bp, Artificial Sequence
  Description of Artificial Sequence: Synthetic oligonucleotide
  Target: ATXN1; (+) strand; PAM type: NRG; PAM sequence: CAG
ttcccatggagaggcatctc

SEQ ID NO: 122621 - DNA, 20 bp, Artificial Sequence
  Description of Artificial Sequence: Synthetic oligonucleotide
  Target: ATXN1; (+) strand; PAM type: NRG; PAM sequence: CAG
atggagaggcatctccagtg

SEQ ID NO: 122622 - DNA, 20 bp, Artificial Sequence
  Description of Artificial Sequence: Synthetic oligonucleotide
  Target: ATXN1; (+) strand; PAM type: NRG; PAM sequence: AGG
tggagaggcatctccagtgc

SEQ ID NO: 122623 - DNA, 20 bp, Artificial Sequence
  Description of Artificial Sequence: Synthetic oligonucleotide
  Target: ATXN1; (+) strand; PAM type: NRG; PAM sequence: GGG
ggagaggcatctccagtgca

SEQ ID NO: 122624 - DNA, 20 bp, Artificial Sequence
  Description of Artificial Sequence: Synthetic oligonucleotide
  Target: ATXN1; (+) strand; PAM type: NRG; PAM sequence: TGG
aggcatctccagtgcagggc

SEQ ID NO: 122625 - DNA, 20 bp, Artificial Sequence
  Description of Artificial Sequence: Synthetic oligonucleotide
  Target: ATXN1; (+) strand; PAM type: NRG; PAM sequence: GAG
ctccagtgcagggctggact

SEQ ID NO: 122626 - DNA, 20 bp, Artificial Sequence
  Description of Artificial Sequence: Synthetic oligonucleotide
  Target: ATXN1; (+) strand; PAM type: NRG; PAM sequence: GAG
ccagtgcagggctggactga

SEQ ID NO: 122627 - DNA, 20 bp, Artificial Sequence
  Description of Artificial Sequence: Synthetic oligonucleotide
  Target: ATXN1; (+) strand; PAM type: NRG; PAM sequence: AGG
cagtgcagggctggactgag

SEQ ID NO: 122628 - DNA, 20 bp, Artificial Sequence
  Description of Artificial Sequence: Synthetic oligonucleotide
  Target: ATXN1; (+) strand; PAM type: NRG; PAM sequence: CAG
gctggactgagaggcatctc

SEQ ID NO: 122629 - DNA, 20 bp, Artificial Sequence
  Description of Artificial Sequence: Synthetic oligonucleotide
  Target: ATXN1; (+) strand; PAM type: NRG; PAM sequence: CAG
actgagaggcatctccagtg

SEQ ID NO: 122630 - DNA, 20 bp, Artificial Sequence
  Description of Artificial Sequence: Synthetic oligonucleotide
  Target: ATXN1; (+) strand; PAM type: NRG; PAM sequence: AGG
ctgagaggcatctccagtgc

SEQ ID NO: 122631 - DNA, 20 bp, Artificial Sequence
  Description of Artificial Sequence: Synthetic oligonucleotide
  Target: ATXN1; (+) strand; PAM type: NRG; PAM sequence: GGG
tgagaggcatctccagtgca

SEQ ID NO: 122632 - DNA, 20 bp, Artificial Sequence
  Description of Artificial Sequence: Synthetic oligonucleotide
  Target: ATXN1; (+) strand; PAM type: NRG; PAM sequence: TGG
aggcatctccagtgcagggc

SEQ ID NO: 122633 - DNA, 20 bp, Artificial Sequence
  Description of Artificial Sequence: Synthetic oligonucleotide
  Target: ATXN1; (+) strand; PAM type: NRG; PAM sequence: GAG
ctccagtgcagggctggact

SEQ ID NO: 122634 - DNA, 20 bp, Artificial Sequence
  Description of Artificial Sequence: Synthetic oligonucleotide
  Target: ATXN1; (+) strand; PAM type: NRG; PAM sequence: GAG
ccagtgcagggctggactga

SEQ ID NO: 122635 - DNA, 20 bp, Artificial Sequence
  Description of Artificial Sequence: Synthetic oligonucleotide
  Target: ATXN1; (+) strand; PAM type: NRG; PAM sequence: AGG
cagtgcagggctggactgag

SEQ ID NO: 122636 - DNA, 20 bp, Artificial Sequence
  Description of Artificial Sequence: Synthetic oligonucleotide
  Target: ATXN1; (+) strand; PAM type: NRG; PAM sequence: CAG
gctggactgagaggcatctc

SEQ ID NO: 122637 - DNA, 20 bp, Artificial Sequence
  Description of Artificial Sequence: Synthetic oligonucleotide
  Target: ATXN1; (+) strand; PAM type: NRG; PAM sequence: CAG
actgagaggcatctccagtg

SEQ ID NO: 122638 - DNA, 20 bp, Artificial Sequence
  Description of Artificial Sequence: Synthetic oligonucleotide
  Target: ATXN1; (+) strand; PAM type: NRG; PAM sequence: AGG
ctgagaggcatctccagtgc

SEQ ID NO: 122639 - DNA, 20 bp, Artificial Sequence
  Description of Artificial Sequence: Synthetic oligonucleotide
  Target: ATXN1; (+) strand; PAM type: NRG; PAM sequence: GGG
tgagaggcatctccagtgca

SEQ ID NO: 122640 - DNA, 20 bp, Artificial Sequence
  Description of Artificial Sequence: Synthetic oligonucleotide
  Target: ATXN1; (+) strand; PAM type: NRG; PAM sequence: TGG
aggcatctccagtgcagggc

SEQ ID NO: 122641 - DNA, 20 bp, Artificial Sequence
  Description of Artificial Sequence: Synthetic oligonucleotide
  Target: ATXN1; (+) strand; PAM type: NRG; PAM sequence: GAG
ctccagtgcagggctggact

SEQ ID NO: 122642 - DNA, 20 bp, Artificial Sequence
  Description of Artificial Sequence: Synthetic oligonucleotide
  Target: ATXN1; (+) strand; PAM type: NRG; PAM sequence: GAG
ccagtgcagggctggactga

SEQ ID NO: 122643 - DNA, 20 bp, Artificial Sequence
  Description of Artificial Sequence: Synthetic oligonucleotide
  Target: ATXN1; (+) strand; PAM type: NRG; PAM sequence: CAG
gcagggctggactgagagtc

SEQ ID NO: 122644 - DNA, 20 bp, Artificial Sequence
  Description of Artificial Sequence: Synthetic oligonucleotide
  Target: ATXN1; (+) strand; PAM type: NRG; PAM sequence: TAG
ggctggactgagagtccagt

SEQ ID NO: 122645 - DNA, 20 bp, Artificial Sequence
  Description of Artificial Sequence: Synthetic oligonucleotide
  Target: ATXN1; (+) strand; PAM type: NRG; PAM sequence: AAG
tgagagtccagttagacctc

SEQ ID NO: 122646 - DNA, 20 bp, Artificial Sequence
  Description of Artificial Sequence: Synthetic oligonucleotide
  Target: ATXN1; (+) strand; PAM type: NRG; PAM sequence: AAG
gagtccagttagacctcaag

SEQ ID NO: 122647 - DNA, 20 bp, Artificial Sequence
  Description of Artificial Sequence: Synthetic oligonucleotide
  Target: ATXN1; (+) strand; PAM type: NRG; PAM sequence: GAG
gtccagttagacctcaagaa

SEQ ID NO: 122648 - DNA, 20 bp, Artificial Sequence
  Description of Artificial Sequence: Synthetic oligonucleotide
  Target: ATXN1; (+) strand; PAM type: NRG; PAM sequence: TGG
agttagacctcaagaagagt

SEQ ID NO: 122649 - DNA, 20 bp, Artificial Sequence
  Description of Artificial Sequence: Synthetic oligonucleotide
  Target: ATXN1; (+) strand; PAM type: NRG; PAM sequence: GAG
ttagacctcaagaagagttg

SEQ ID NO: 122650 - DNA, 20 bp, Artificial Sequence
  Description of Artificial Sequence: Synthetic oligonucleotide
  Target: ATXN1; (+) strand; PAM type: NRG; PAM sequence: AGG
tagacctcaagaagagttgg

SEQ ID NO: 122651 - DNA, 20 bp, Artificial Sequence
  Description of Artificial Sequence: Synthetic oligonucleotide
  Target: ATXN1; (+) strand; PAM type: NRG; PAM sequence: GGG
agacctcaagaagagttgga

SEQ ID NO: 122652 - DNA, 20 bp, Artificial Sequence
  Description of Artificial Sequence: Synthetic oligonucleotide
  Target: ATXN1; (+) strand; PAM type: NRG; PAM sequence: GAG
acctcaagaagagttggagg

SEQ ID NO: 122653 - DNA, 20 bp, Artificial Sequence
  Description of Artificial Sequence: Synthetic oligonucleotide
  Target: ATXN1; (+) strand; PAM type: NRG; PAM sequence: AGG
cctcaagaagagttggaggg

SEQ ID NO: 122654 - DNA, 20 bp, Artificial Sequence
  Description of Artificial Sequence: Synthetic oligonucleotide
  Target: ATXN1; (+) strand; PAM type: NRG; PAM sequence: CAG
aagaagagttggagggaggt

SEQ ID NO: 122655 - DNA, 20 bp, Artificial Sequence
  Description of Artificial Sequence: Synthetic oligonucleotide
  Target: ATXN1; (+) strand; PAM type: NRG; PAM sequence: TGG
gagttggagggaggtcagcg

SEQ ID NO: 122656 - DNA, 20 bp, Artificial Sequence
  Description of Artificial Sequence: Synthetic oligonucleotide
  Target: ATXN1; (+) strand; PAM type: NRG; PAM sequence: GGG
agttggagggaggtcagcgt

SEQ ID NO: 122657 - DNA, 20 bp, Artificial Sequence
  Description of Artificial Sequence: Synthetic oligonucleotide
  Target: ATXN1; (+) strand; PAM type: NRG; PAM sequence: GAG
ttggagggaggtcagcgtgg

SEQ ID NO: 122658 - DNA, 20 bp, Artificial Sequence
  Description of Artificial Sequence: Synthetic oligonucleotide
  Target: ATXN1; (+) strand; PAM type: NRG; PAM sequence: AGG
tggagggaggtcagcgtggg

SEQ ID NO: 122659 - DNA, 20 bp, Artificial Sequence
  Description of Artificial Sequence: Synthetic oligonucleotide
  Target: ATXN1; (+) strand; PAM type: NRG; PAM sequence: TAG
agggaggtcagcgtgggagg

SEQ ID NO: 122660 - DNA, 20 bp, Artificial Sequence
  Description of Artificial Sequence: Synthetic oligonucleotide
  Target: ATXN1; (+) strand; PAM type: NRG; PAM sequence: AGG
gggaggtcagcgtgggaggt

SEQ ID NO: 122661 - DNA, 20 bp, Artificial Sequence
  Description of Artificial Sequence: Synthetic oligonucleotide
  Target: ATXN1; (+) strand; PAM type: NRG; PAM sequence: AAG
tgggaggtaggccaaaactc

SEQ ID NO: 122662 - DNA, 20 bp, Artificial Sequence
  Description of Artificial Sequence: Synthetic oligonucleotide
  Target: ATXN1; (+) strand; PAM type: NRG; PAM sequence: AGG
gggaggtaggccaaaactca

SEQ ID NO: 122663 - DNA, 20 bp, Artificial Sequence
  Description of Artificial Sequence: Synthetic oligonucleotide
  Target: ATXN1; (+) strand; PAM type: NRG; PAM sequence: AAG
ccaaaactcaaggtattctg

SEQ ID NO: 122664 - DNA, 20 bp, Artificial Sequence
  Description of Artificial Sequence: Synthetic oligonucleotide
  Target: ATXN1; (+) strand; PAM type: NRG; PAM sequence: CAG
aatatcatgcgttccctgtt

SEQ ID NO: 122665 - DNA, 20 bp, Artificial Sequence
  Description of Artificial Sequence: Synthetic oligonucleotide
  Target: ATXN1; (+) strand; PAM type: NRG; PAM sequence: TGG
agtcaacatttgatcattta

SEQ ID NO: 122666 - DNA, 20 bp, Artificial Sequence
  Description of Artificial Sequence: Synthetic oligonucleotide
  Target: ATXN1; (+) strand; PAM type: NRG; PAM sequence: GGG
gtcaacatttgatcatttat

SEQ ID NO: 122667 - DNA, 20 bp, Artificial Sequence
  Description of Artificial Sequence: Synthetic oligonucleotide
  Target: ATXN1; (+) strand; PAM type: NRG; PAM sequence: GAG
caacatttgatcatttatgg

SEQ ID NO: 122668 - DNA, 20 bp, Artificial Sequence
  Description of Artificial Sequence: Synthetic oligonucleotide
  Target: ATXN1; (+) strand; PAM type: NRG; PAM sequence: TGG
ttgtaaaatttcttacaaac

SEQ ID NO: 122669 - DNA, 20 bp, Artificial Sequence
  Description of Artificial Sequence: Synthetic oligonucleotide
  Target: ATXN1; (+) strand; PAM type: NRG; PAM sequence: CAG
taaaatttcttacaaactgg

SEQ ID NO: 122670 - DNA, 20 bp, Artificial Sequence
  Description of Artificial Sequence: Synthetic oligonucleotide
  Target: ATXN1; (+) strand; PAM type: NRG; PAM sequence: TGG
tcttacaaactggcagtcct

SEQ ID NO: 122671 - DNA, 20 bp, Artificial Sequence
  Description of Artificial Sequence: Synthetic oligonucleotide
  Target: ATXN1; (+) strand; PAM type: NRG; PAM sequence: TAG
actggcagtccttggatacc

SEQ ID NO: 122672 - DNA, 20 bp, Artificial Sequence
  Description of Artificial Sequence: Synthetic oligonucleotide
  Target: ATXN1; (+) strand; PAM type: NRG; PAM sequence: CAG
ttggatacctagcatgcact

SEQ ID NO: 122673 - DNA, 20 bp, Artificial Sequence
  Description of Artificial Sequence: Synthetic oligonucleotide
  Target: ATXN1; (+) strand; PAM type: NRG; PAM sequence: TGG
tattctctgtgtatattaac

SEQ ID NO: 122674 - DNA, 20 bp, Artificial Sequence
  Description of Artificial Sequence: Synthetic oligonucleotide
  Target: ATXN1; (+) strand; PAM type: NRG; PAM sequence: AAG
atattaactggtttgtgttc

SEQ ID NO: 122675 - DNA, 20 bp, Artificial Sequence
  Description of Artificial Sequence: Synthetic oligonucleotide
  Target: ATXN1; (+) strand; PAM type: NRG; PAM sequence: AGG
tattaactggtttgtgttca

SEQ ID NO: 122676 - DNA, 20 bp, Artificial Sequence
  Description of Artificial Sequence: Synthetic oligonucleotide
  Target: ATXN1; (+) strand; PAM type: NRG; PAM sequence: TAG
caaggaataaaatccaaaat

SEQ ID NO: 122677 - DNA, 20 bp, Artificial Sequence
  Description of Artificial Sequence: Synthetic oligonucleotide
  Target: ATXN1; (+) strand; PAM type: NRG; PAM sequence: CGG
ataaaatccaaaattagtac

SEQ ID NO: 122678 - DNA, 20 bp, Artificial Sequence
  Description of Artificial Sequence: Synthetic oligonucleotide
  Target: ATXN1; (+) strand; PAM type: NRG; PAM sequence: AAG
ccaaaattagtaccggccta

SEQ ID NO: 122679 - DNA, 20 bp, Artificial Sequence
  Description of Artificial Sequence: Synthetic oligonucleotide
  Target: ATXN1; (+) strand; PAM type: NRG; PAM sequence: CAG
cggcctaaagaacacattat

SEQ ID NO: 122680 - DNA, 20 bp, Artificial Sequence
  Description of Artificial Sequence: Synthetic oligonucleotide
  Target: ATXN1; (+) strand; PAM type: NRG; PAM sequence: GAG
gcctaaagaacacattatca

SEQ ID NO: 122681 - DNA, 20 bp, Artificial Sequence
  Description of Artificial Sequence: Synthetic oligonucleotide
  Target: ATXN1; (+) strand; PAM type: NRG; PAM sequence: TGG
attatcagagataaatatgc

SEQ ID NO: 122682 - DNA, 20 bp, Artificial Sequence
  Description of Artificial Sequence: Synthetic oligonucleotide
  Target: ATXN1; (+) strand; PAM type: NRG; PAM sequence: AAG
tggaaaaatgtctatcctca

SEQ ID NO: 122683 - DNA, 20 bp, Artificial Sequence
  Description of Artificial Sequence: Synthetic oligonucleotide
  Target: ATXN1; (+) strand; PAM type: NRG; PAM sequence: AGG
ggaaaaatgtctatcctcaa

SEQ ID NO: 122684 - DNA, 20 bp, Artificial Sequence
  Description of Artificial Sequence: Synthetic oligonucleotide
  Target: ATXN1; (+) strand; PAM type: NRG; PAM sequence: TAG
atgtcactgcttcttatcat

SEQ ID NO: 122685 - DNA, 20 bp, Artificial Sequence
  Description of Artificial Sequence: Synthetic oligonucleotide
  Target: ATXN1; (+) strand; PAM type: NRG; PAM sequence: TGG
actgcttcttatcattagca

SEQ ID NO: 122686 - DNA, 20 bp, Artificial Sequence
  Description of Artificial Sequence: Synthetic oligonucleotide
  Target: ATXN1; (+) strand; PAM type: NRG; PAM sequence: AAG
ttagcatggcttatcacata

SEQ ID NO: 122687 - DNA, 20 bp, Artificial Sequence
  Description of Artificial Sequence: Synthetic oligonucleotide
  Target: ATXN1; (+) strand; PAM type: NRG; PAM sequence: AGG
tagcatggcttatcacataa

SEQ ID NO: 122688 - DNA, 20 bp, Artificial Sequence
  Description of Artificial Sequence: Synthetic oligonucleotide
  Target: ATXN1; (+) strand; PAM type: NRG; PAM sequence: AAG
atggcttatcacataaaggt

SEQ ID NO: 122689 - DNA, 20 bp, Artificial Sequence
  Description of Artificial Sequence: Synthetic oligonucleotide
  Target: ATXN1; (+) strand; PAM type: NRG; PAM sequence: AGG
tggcttatcacataaaggta

SEQ ID NO: 122690 - DNA, 20 bp, Artificial Sequence
  Description of Artificial Sequence: Synthetic oligonucleotide
  Target: ATXN1; (+) strand; PAM type: NRG; PAM sequence: CAG
aaggtaaggatttattcata

SEQ ID NO: 122691 - DNA, 20 bp, Artificial Sequence
  Description of Artificial Sequence: Synthetic oligonucleotide
  Target: ATXN1; (+) strand; PAM type: NRG; PAM sequence: GAG
ggtaaggatttattcataca

SEQ ID NO: 122692 - DNA, 20 bp, Artificial Sequence
  Description of Artificial Sequence: Synthetic oligonucleotide
  Target: ATXN1; (+) strand; PAM type: NRG; PAM sequence: CAG
ctgctgtgtgtatttgtatg

SEQ ID NO: 122693 - DNA, 20 bp, Artificial Sequence
  Description of Artificial Sequence: Synthetic oligonucleotide
  Target: ATXN1; (+) strand; PAM type: NRG; PAM sequence: AGG
tgctgtgtgtatttgtatgc

SEQ ID NO: 122694 - DNA, 20 bp, Artificial Sequence
  Description of Artificial Sequence: Synthetic oligonucleotide
  Target: ATXN1; (+) strand; PAM type: NRG; PAM sequence: TGG
atgcaggttacatctcctta

SEQ ID NO: 122695 - DNA, 20 bp, Artificial Sequence
  Description of Artificial Sequence: Synthetic oligonucleotide
  Target: ATXN1; (+) strand; PAM type: NRG; PAM sequence: TAG
gttacatctccttatggacg

SEQ ID NO: 122696 - DNA, 20 bp, Artificial Sequence
  Description of Artificial Sequence: Synthetic oligonucleotide
  Target: ATXN1; (+) strand; PAM type: NRG; PAM sequence: AAG
ctccttatggacgtagtgca

SEQ ID NO: 122697 - DNA, 20 bp, Artificial Sequence
  Description of Artificial Sequence: Synthetic oligonucleotide
  Target: ATXN1; (+) strand; PAM type: NRG; PAM sequence: TGG
tatgaaatataattatacat

SEQ ID NO: 122698 - DNA, 20 bp, Artificial Sequence
  Description of Artificial Sequence: Synthetic oligonucleotide
  Target: ATXN1; (+) strand; PAM type: NRG; PAM sequence: GAG
tgaaatataattatacattg

SEQ ID NO: 122699 - DNA, 20 bp, Artificial Sequence
  Description of Artificial Sequence: Synthetic oligonucleotide
  Target: ATXN1; (+) strand; PAM type: NRG; PAM sequence: AAG
tataattatacattggagaa

SEQ ID NO: 122700 - DNA, 20 bp, Artificial Sequence
  Description of Artificial Sequence: Synthetic oligonucleotide
  Target: ATXN1; (+) strand; PAM type: NRG; PAM sequence: AAG
gaaaagtatgtctgcatatc

SEQ ID NO: 122701 - DNA, 20 bp, Artificial Sequence
  Description of Artificial Sequence: Synthetic oligonucleotide
  Target: ATXN1; (+) strand; PAM type: NRG; PAM sequence: AAG
ataaaatgaaaataaaatgt

SEQ ID NO: 122702 - DNA, 20 bp, Artificial Sequence
  Description of Artificial Sequence: Synthetic oligonucleotide
  Target: ATXN1; (+) strand; PAM type: NRG; PAM sequence: TAG
taaaatgtaagttgaacata

SEQ ID NO: 122703 - DNA, 20 bp, Artificial Sequence
  Description of Artificial Sequence: Synthetic oligonucleotide
  Target: ATXN1; (+) strand; PAM type: NRG; PAM sequence: GAG
ataaatacccaatctgtgct

SEQ ID NO: 122704 - DNA, 20 bp, Artificial Sequence
  Description of Artificial Sequence: Synthetic oligonucleotide
  Target: ATXN1; (+) strand; PAM type: NRG; PAM sequence: CAG
aatacccaatctgtgctgag

SEQ ID NO: 122705 - DNA, 20 bp, Artificial Sequence
  Description of Artificial Sequence: Synthetic oligonucleotide
  Target: ATXN1; (+) strand; PAM type: NRG; PAM sequence: TAG
caatctgtgctgagcagctg

SEQ ID NO: 122706 - DNA, 20 bp, Artificial Sequence
  Description of Artificial Sequence: Synthetic oligonucleotide
  Target: ATXN1; (+) strand; PAM type: NRG; PAM sequence: CAG
gcagctgtagaacgacgtct

SEQ ID NO: 122707 - DNA, 20 bp, Artificial Sequence
  Description of Artificial Sequence: Synthetic oligonucleotide
  Target: ATXN1; (+) strand; PAM type: NRG; PAM sequence: AGG
cagctgtagaacgacgtctc

SEQ ID NO: 122708 - DNA, 20 bp, Artificial Sequence
  Description of Artificial Sequence: Synthetic oligonucleotide
  Target: ATXN1; (+) strand; PAM type: NRG; PAM sequence: TAG
agaacgacgtctcaggaaat

SEQ ID NO: 122709 - DNA, 20 bp, Artificial Sequence
  Description of Artificial Sequence: Synthetic oligonucleotide
  Target: ATXN1; (+) strand; PAM type: NRG; PAM sequence: AAG
ctcaggaaattagtatttta

SEQ ID NO: 122710 - DNA, 20 bp, Artificial Sequence
  Description of Artificial Sequence: Synthetic oligonucleotide
  Target: ATXN1; (+) strand; PAM type: NRG; PAM sequence: AAG
gaaattagtattttaaagac

SEQ ID NO: 122711 - DNA, 20 bp, Artificial Sequence
  Description of Artificial Sequence: Synthetic oligonucleotide
  Target: ATXN1; (+) strand; PAM type: NRG; PAM sequence: TGG
tcctattgacaacttattcc

SEQ ID NO: 122712 - DNA, 20 bp, Artificial Sequence
  Description of Artificial Sequence: Synthetic oligonucleotide
  Target: ATXN1; (+) strand; PAM type: NRG; PAM sequence: CAG
ggccttatttgttcaacacg

SEQ ID NO: 122713 - DNA, 20 bp, Artificial Sequence
  Description of Artificial Sequence: Synthetic oligonucleotide
  Target: ATXN1; (+) strand; PAM type: NRG; PAM sequence: AGG
gccttatttgttcaacacgc

SEQ ID NO: 122714 - DNA, 20 bp, Artificial Sequence
  Description of Artificial Sequence: Synthetic oligonucleotide
  Target: ATXN1; (+) strand; PAM type: NRG; PAM sequence: CAG
tgttcaacacgcaggtcctt

SEQ ID NO: 122715 - DNA, 20 bp, Artificial Sequence
  Description of Artificial Sequence: Synthetic oligonucleotide
  Target: ATXN1; (+) strand; PAM type: NRG; PAM sequence: AGG
gttcaacacgcaggtccttc

SEQ ID NO: 122716 - DNA, 20 bp, Artificial Sequence
  Description of Artificial Sequence: Synthetic oligonucleotide
  Target: ATXN1; (+) strand; PAM type: NRG; PAM sequence: TAG
aggtccttcaggtattgctg

SEQ ID NO: 122717 - DNA, 20 bp, Artificial Sequence
  Description of Artificial Sequence: Synthetic oligonucleotide
  Target: ATXN1; (+) strand; PAM type: NRG; PAM sequence: CAG
caggtattgctgtagcacaa

SEQ ID NO: 122718 - DNA, 20 bp, Artificial Sequence
  Description of Artificial Sequence: Synthetic oligonucleotide
  Target: ATXN1; (+) strand; PAM type: NRG; PAM sequence: AAG
tattgctgtagcacaacaga

SEQ ID NO: 122719 - DNA, 20 bp, Artificial Sequence
  Description of Artificial Sequence: Synthetic oligonucleotide
  Target: ATXN1; (+) strand; PAM type: NRG; PAM sequence: CAG
ctgtagcacaacagaaagaa

SEQ ID NO: 122720 - DNA, 20 bp, Artificial Sequence
  Description of Artificial Sequence: Synthetic oligonucleotide
  Target: ATXN1; (+) strand; PAM type: NRG; PAM sequence: TGG
tagcacaacagaaagaacag

SEQ ID NO: 122721 - DNA, 20 bp, Artificial Sequence
  Description of Artificial Sequence: Synthetic oligonucleotide
  Target: ATXN1; (+) strand; PAM type: NRG; PAM sequence: GGG
agcacaacagaaagaacagt

SEQ ID NO: 122722 - DNA, 20 bp, Artificial Sequence
  Description of Artificial Sequence: Synthetic oligonucleotide
  Target: ATXN1; (+) strand; PAM type: NRG; PAM sequence: CAG
caacagaaagaacagtgggc

SEQ ID NO: 122723 - DNA, 20 bp, Artificial Sequence
  Description of Artificial Sequence: Synthetic oligonucleotide
  Target: ATXN1; (+) strand; PAM type: NRG; PAM sequence: AAG
cagaaagaacagtgggccag

SEQ ID NO: 122724 - DNA, 20 bp, Artificial Sequence
  Description of Artificial Sequence: Synthetic oligonucleotide
  Target: ATXN1; (+) strand; PAM type: NRG; PAM sequence: CAG
aagaacagtgggccagaaga

SEQ ID NO: 122725 - DNA, 20 bp, Artificial Sequence
  Description of Artificial Sequence: Synthetic oligonucleotide
  Target: ATXN1; (+) strand; PAM type: NRG; PAM sequence: AGG
agaacagtgggccagaagac

SEQ ID NO: 122726 - DNA, 20 bp, Artificial Sequence
  Description of Artificial Sequence: Synthetic oligonucleotide
  Target: ATXN1; (+) strand; PAM type: NRG; PAM sequence: GGG
gaacagtgggccagaagaca

SEQ ID NO: 122727 - DNA, 20 bp, Artificial Sequence
  Description of Artificial Sequence: Synthetic oligonucleotide
  Target: ATXN1; (+) strand; PAM type: NRG; PAM sequence: GAG
acagtgggccagaagacagg

SEQ ID NO: 122728 - DNA, 20 bp, Artificial Sequence
  Description of Artificial Sequence: Synthetic oligonucleotide
  Target: ATXN1; (+) strand; PAM type: NRG; PAM sequence: AGG
cagtgggccagaagacaggg

SEQ ID NO: 122729 - DNA, 20 bp, Artificial Sequence
  Description of Artificial Sequence: Synthetic oligonucleotide
  Target: ATXN1; (+) strand; PAM type: NRG; PAM sequence: TGG
ggccagaagacagggaggtc

SEQ ID NO: 122730 - DNA, 20 bp, Artificial Sequence
  Description of Artificial Sequence: Synthetic oligonucleotide
  Target: ATXN1; (+) strand; PAM type: NRG; PAM sequence: GGG
gccagaagacagggaggtct

SEQ ID NO: 122731 - DNA, 20 bp, Artificial Sequence
  Description of Artificial Sequence: Synthetic oligonucleotide
  Target: ATXN1; (+) strand; PAM type: NRG; PAM sequence: TAG
aagacagggaggtctgggtc

SEQ ID NO: 122732 - DNA, 20 bp, Artificial Sequence
  Description of Artificial Sequence: Synthetic oligonucleotide
  Target: ATXN1; (+) strand; PAM type: NRG; PAM sequence: AAG
acagggaggtctgggtctag

SEQ ID NO: 122733 - DNA, 20 bp, Artificial Sequence
  Description of Artificial Sequence: Synthetic oligonucleotide
  Target: ATXN1; (+) strand; PAM type: NRG; PAM sequence: CAG
gaggtctgggtctagaagcc

SEQ ID NO: 122734 - DNA, 20 bp, Artificial Sequence
  Description of Artificial Sequence: Synthetic oligonucleotide
  Target: ATXN1; (+) strand; PAM type: NRG; PAM sequence: GAG
ggtctgggtctagaagccca

SEQ ID NO: 122735 - DNA, 20 bp, Artificial Sequence
  Description of Artificial Sequence: Synthetic oligonucleotide
  Target: ATXN1; (+) strand; PAM type: NRG; PAM sequence: GAG
gcccagagactccacatccc

SEQ ID NO: 122736 - DNA, 20 bp, Artificial Sequence
  Description of Artificial Sequence: Synthetic oligonucleotide
  Target: ATXN1; (+) strand; PAM type: NRG; PAM sequence: TGG
cgagttacacatcccctttc

SEQ ID NO: 122737 - DNA, 20 bp, Artificial Sequence
  Description of Artificial Sequence: Synthetic oligonucleotide
  Target: ATXN1; (+) strand; PAM type: NRG; PAM sequence: GAG
atcccctttctggttgccat

SEQ ID NO: 122738 - DNA, 20 bp, Artificial Sequence
  Description of Artificial Sequence: Synthetic oligonucleotide
  Target: ATXN1; (+) strand; PAM type: NRG; PAM sequence: CAG
gtcatcacgcaccttctgcc

SEQ ID NO: 122739 - DNA, 20 bp, Artificial Sequence
  Description of Artificial Sequence: Synthetic oligonucleotide
  Target: ATXN1; (+) strand; PAM type: NRG; PAM sequence: GAG
catcacgcaccttctgccca

SEQ ID NO: 122740 - DNA, 20 bp, Artificial Sequence
  Description of Artificial Sequence: Synthetic oligonucleotide
  Target: ATXN1; (+) strand; PAM type: NRG; PAM sequence: AGG
atcacgcaccttctgcccag

SEQ ID NO: 122741 - DNA, 20 bp, Artificial Sequence
  Description of Artificial Sequence: Synthetic oligonucleotide
  Target: ATXN1; (+) strand; PAM type: NRG; PAM sequence: GAG
cacgcaccttctgcccagag

SEQ ID NO: 122742 - DNA, 20 bp, Artificial Sequence
  Description of Artificial Sequence: Synthetic oligonucleotide
  Target: ATXN1; (+) strand; PAM type: NRG; PAM sequence: GAG
cgcaccttctgcccagagga

SEQ ID NO: 122743 - DNA, 20 bp, Artificial Sequence
  Description of Artificial Sequence: Synthetic oligonucleotide
  Target: ATXN1; (+) strand; PAM type: NRG; PAM sequence: AAG
tttattcatgcctgcttgaa

SEQ ID NO: 122744 - DNA, 20 bp, Artificial Sequence
  Description of Artificial Sequence: Synthetic oligonucleotide
  Target: ATXN1; (+) strand; PAM type: NRG; PAM sequence: AGG
ttattcatgcctgcttgaaa

SEQ ID NO: 122745 - DNA, 20 bp, Artificial Sequence
  Description of Artificial Sequence: Synthetic oligonucleotide
  Target: ATXN1; (+) strand; PAM type: NRG; PAM sequence: CAG
tcatgcctgcttgaaaaggt

SEQ ID NO: 122746 - DNA, 20 bp, Artificial Sequence
  Description of Artificial Sequence: Synthetic oligonucleotide
  Target: ATXN1; (+) strand; PAM type: NRG; PAM sequence: TAG
tgcttgaaaaggtcagtgtt

SEQ ID NO: 122747 - DNA, 20 bp, Artificial Sequence
  Description of Artificial Sequence: Synthetic oligonucleotide
  Target: ATXN1; (+) strand; PAM type: NRG; PAM sequence: AGG
gcttgaaaaggtcagtgttt

SEQ ID NO: 122748 - DNA, 20 bp, Artificial Sequence
  Description of Artificial Sequence: Synthetic oligonucleotide
  Target: ATXN1; (+) strand; PAM type: NRG; PAM sequence: CAG
aggtcagtgtttaggtgttg

SEQ ID NO: 122749 - DNA, 20 bp, Artificial Sequence
  Description of Artificial Sequence: Synthetic oligonucleotide
  Target: ATXN1; (+) strand; PAM type: NRG; PAM sequence: AAG
tcagtgtttaggtgttgcag

SEQ ID NO: 122750 - DNA, 20 bp, Artificial Sequence
  Description of Artificial Sequence: Synthetic oligonucleotide
  Target: ATXN1; (+) strand; PAM type: NRG; PAM sequence: TGG
ttaggtgttgcagaagtgct

SEQ ID NO: 122751 - DNA, 20 bp, Artificial Sequence
  Description of Artificial Sequence: Synthetic oligonucleotide
  Target: ATXN1; (+) strand; PAM type: NRG; PAM sequence: TGG
gcagaagtgcttggtgaaaa

SEQ ID NO: 122752 - DNA, 20 bp, Artificial Sequence
  Description of Artificial Sequence: Synthetic oligonucleotide
  Target: ATXN1; (+) strand; PAM type: NRG; PAM sequence: GGG
cagaagtgcttggtgaaaat

SEQ ID NO: 122753 - DNA, 20 bp, Artificial Sequence
  Description of Artificial Sequence: Synthetic oligonucleotide
  Target: ATXN1; (+) strand; PAM type: NRG; PAM sequence: GGG
agaagtgcttggtgaaaatg

SEQ ID NO: 122754 - DNA, 20 bp, Artificial Sequence
  Description of Artificial Sequence: Synthetic oligonucleotide
  Target: ATXN1; (+) strand; PAM type: NRG; PAM sequence: AAG
agtgcttggtgaaaatgggg

SEQ ID NO: 122755 - DNA, 20 bp, Artificial Sequence
  Description of Artificial Sequence: Synthetic oligonucleotide
  Target: ATXN1; (+) strand; PAM type: NRG; PAM sequence: AGG
gtgcttggtgaaaatgggga

SEQ ID NO: 122756 - DNA, 20 bp, Artificial Sequence
  Description of Artificial Sequence: Synthetic oligonucleotide
  Target: ATXN1; (+) strand; PAM type: NRG; PAM sequence: CAG
aaatggggaaggctgaaaca

SEQ ID NO: 122757 - DNA, 20 bp, Artificial Sequence
  Description of Artificial Sequence: Synthetic oligonucleotide
  Target: ATXN1; (+) strand; PAM type: NRG; PAM sequence: AAG
tcatgctttgataatttctg

SEQ ID NO: 122758 - DNA, 20 bp, Artificial Sequence
  Description of Artificial Sequence: Synthetic oligonucleotide
  Target: ATXN1; (+) strand; PAM type: NRG; PAM sequence: GAG
ctgaagcatttataaatcat

SEQ ID NO: 122759 - DNA, 20 bp, Artificial Sequence
  Description of Artificial Sequence: Synthetic oligonucleotide
  Target: ATXN1; (+) strand; PAM type: NRG; PAM sequence: CAG
aagcatttataaatcatgag

SEQ ID NO: 122760 - DNA, 20 bp, Artificial Sequence
  Description of Artificial Sequence: Synthetic oligonucleotide
  Target: ATXN1; (+) strand; PAM type: NRG; PAM sequence: AAG
tttataaatcatgagcagct

SEQ ID NO: 122761 - DNA, 20 bp, Artificial Sequence
  Description of Artificial Sequence: Synthetic oligonucleotide
  Target: ATXN1; (+) strand; PAM type: NRG; PAM sequence: AGG
ttataaatcatgagcagcta

SEQ ID NO: 122762 - DNA, 20 bp, Artificial Sequence
  Description of Artificial Sequence: Synthetic oligonucleotide
  Target: ATXN1; (+) strand; PAM type: NRG; PAM sequence: AAG
catgagcagctaaggtctgc

SEQ ID NO: 122763 - DNA, 20 bp, Artificial Sequence
  Description of Artificial Sequence: Synthetic oligonucleotide
  Target: ATXN1; (+) strand; PAM type: NRG; PAM sequence: CAG
ctgcaagatgctaatgtgtg

SEQ ID NO: 122764 - DNA, 20 bp, Artificial Sequence
  Description of Artificial Sequence: Synthetic oligonucleotide
  Target: ATXN1; (+) strand; PAM type: NRG; PAM sequence: CAG
agatgctaatgtgtgcagtc

SEQ ID NO: 122765 - DNA, 20 bp, Artificial Sequence
  Description of Artificial Sequence: Synthetic oligonucleotide
  Target: ATXN1; (+) strand; PAM type: NRG; PAM sequence: AAG
cagtccagtcctctgacttt

SEQ ID NO: 122766 - DNA, 20 bp, Artificial Sequence
  Description of Artificial Sequence: Synthetic oligonucleotide
  Target: ATXN1; (+) strand; PAM type: NRG; PAM sequence: CAG
ctctgactttaagtctgttt

SEQ ID NO: 122767 - DNA, 20 bp, Artificial Sequence
  Description of Artificial Sequence: Synthetic oligonucleotide
  Target: ATXN1; (+) strand; PAM type: NRG; PAM sequence: TAG
ctcctttttaataacacaat

SEQ ID NO: 122768 - DNA, 20 bp, Artificial Sequence
  Description of Artificial Sequence: Synthetic oligonucleotide
  Target: ATXN1; (+) strand; PAM type: NRG; PAM sequence: AAG
aattagtaaaaatcctaaaa

SEQ ID NO: 122769 - DNA, 20 bp, Artificial Sequence
  Description of Artificial Sequence: Synthetic oligonucleotide
  Target: ATXN1; (+) strand; PAM type: NRG; PAM sequence: TAG
taaaaatcctaaaaaagaaa

SEQ ID NO: 122770 - DNA, 20 bp, Artificial Sequence
  Description of Artificial Sequence: Synthetic oligonucleotide
  Target: ATXN1; (+) strand; PAM type: NRG; PAM sequence: GAG
tctctttttgccataatatt

SEQ ID NO: 122771 - DNA, 20 bp, Artificial Sequence
  Description of Artificial Sequence: Synthetic oligonucleotide
  Target: ATXN1; (+) strand; PAM type: NRG; PAM sequence: GAG
tctttttgccataatattga

SEQ ID NO: 122772 - DNA, 20 bp, Artificial Sequence
  Description of Artificial Sequence: Synthetic oligonucleotide
  Target: ATXN1; (+) strand; PAM type: NRG; PAM sequence: TAG
taatattgagagttatatga

SEQ ID NO: 122773 - DNA, 20 bp, Artificial Sequence
  Description of Artificial Sequence: Synthetic oligonucleotide
  Target: ATXN1; (+) strand; PAM type: NRG; PAM sequence: TGG
gtatcttcaactattttatt

SEQ ID NO: 122774 - DNA, 20 bp, Artificial Sequence
  Description of Artificial Sequence: Synthetic oligonucleotide
  Target: ATXN1; (+) strand; PAM type: NRG; PAM sequence: AAG
ttatttggcctgacttcaca

SEQ ID NO: 122775 - DNA, 20 bp, Artificial Sequence
  Description of Artificial Sequence: Synthetic oligonucleotide
  Target: ATXN1; (+) strand; PAM type: NRG; PAM sequence: CGG
tgacttcacaaagtaccaaa

SEQ ID NO: 122776 - DNA, 20 bp, Artificial Sequence
  Description of Artificial Sequence: Synthetic oligonucleotide
  Target: ATXN1; (+) strand; PAM type: NRG; PAM sequence: GGG
gacttcacaaagtaccaaac

SEQ ID NO: 122777 - DNA, 20 bp, Artificial Sequence
  Description of Artificial Sequence: Synthetic oligonucleotide
  Target: ATXN1; (+) strand; PAM type: NRG; PAM sequence: GGG
acttcacaaagtaccaaacg

SEQ ID NO: 122778 - DNA, 20 bp, Artificial Sequence
  Description of Artificial Sequence: Synthetic oligonucleotide
  Target: ATXN1; (+) strand; PAM type: NRG; PAM sequence: GAG
ttcacaaagtaccaaacggg

SEQ ID NO: 122779 - DNA, 20 bp, Artificial Sequence
  Description of Artificial Sequence: Synthetic oligonucleotide
  Target: ATXN1; (+) strand; PAM type: NRG; PAM sequence: AAG
aaagtaccaaacggggagtg

SEQ ID NO: 122780 - DNA, 20 bp, Artificial Sequence
  Description of Artificial Sequence: Synthetic oligonucleotide
  Target: ATXN1; (+) strand; PAM type: NRG; PAM sequence: AAG
cggggagtgaagataaaatg

SEQ ID NO: 122781 - DNA, 20 bp, Artificial Sequence
  Description of Artificial Sequence: Synthetic oligonucleotide
  Target: ATXN1; (+) strand; PAM type: NRG; PAM sequence: GAG
gggagtgaagataaaatgaa

SEQ ID NO: 122782 - DNA, 20 bp, Artificial Sequence
  Description of Artificial Sequence: Synthetic oligonucleotide
  Target: ATXN1; (+) strand; PAM type: NRG; PAM sequence: CAG
gtgaagataaaatgaagaga

SEQ ID NO: 122783 - DNA, 20 bp, Artificial Sequence
  Description of Artificial Sequence: Synthetic oligonucleotide
  Target: ATXN1; (+) strand; PAM type: NRG; PAM sequence: CAG
ccaacctctgtccttttgaa

SEQ ID NO: 122784 - DNA, 20 bp, Artificial Sequence
  Description of Artificial Sequence: Synthetic oligonucleotide
  Target: ATXN1; (+) strand; PAM type: NRG; PAM sequence: AAG
ctgtccttttgaacagacac

SEQ ID NO: 122785 - DNA, 20 bp, Artificial Sequence
  Description of Artificial Sequence: Synthetic oligonucleotide
  Target: ATXN1; (+) strand; PAM type: NRG; PAM sequence: CAG
ttttgaacagacacaagtaa

SEQ ID NO: 122786 - DNA, 20 bp, Artificial Sequence
  Description of Artificial Sequence: Synthetic oligonucleotide
  Target: ATXN1; (+) strand; PAM type: NRG; PAM sequence: AAG
caagtaacagaatttaccaa

SEQ ID NO: 122787 - DNA, 20 bp, Artificial Sequence
  Description of Artificial Sequence: Synthetic oligonucleotide
  Target: ATXN1; (+) strand; PAM type: NRG; PAM sequence: TGG
aagtattaaaaacacgacct

SEQ ID NO: 122788 - DNA, 20 bp, Artificial Sequence
  Description of Artificial Sequence: Synthetic oligonucleotide
  Target: ATXN1; (+) strand; PAM type: NRG; PAM sequence: AAG
tattaaaaacacgaccttgg

SEQ ID NO: 122789 - DNA, 20 bp, Artificial Sequence
  Description of Artificial Sequence: Synthetic oligonucleotide
  Target: ATXN1; (+) strand; PAM type: NRG; PAM sequence: AAG
accttggaagcatcctatca

SEQ ID NO: 122790 - DNA, 20 bp, Artificial Sequence
  Description of Artificial Sequence: Synthetic oligonucleotide
  Target: ATXN1; (+) strand; PAM type: NRG; PAM sequence: TGG
tactaccatgcaaaattgca

SEQ ID NO: 122791 - DNA, 20 bp, Artificial Sequence
  Description of Artificial Sequence: Synthetic oligonucleotide
  Target: ATXN1; (+) strand; PAM type: NRG; PAM sequence: CAG
catgcaaaattgcatggcta

SEQ ID NO: 122792 - DNA, 20 bp, Artificial Sequence
  Description of Artificial Sequence: Synthetic oligonucleotide
  Target: ATXN1; (+) strand; PAM type: NRG; PAM sequence: TGG
caaaattgcatggctacagc

SEQ ID NO: 122793 - DNA, 20 bp, Artificial Sequence
  Description of Artificial Sequence: Synthetic oligonucleotide
  Target: ATXN1; (+) strand; PAM type: NRG; PAM sequence: GGG
aaaattgcatggctacagct

SEQ ID NO: 122794 - DNA, 20 bp, Artificial Sequence
  Description of Artificial Sequence: Synthetic oligonucleotide
  Target: ATXN1; (+) strand; PAM type: NRG; PAM sequence: TAG
caaatcatgctttaaaaaat

SEQ ID NO: 122795 - DNA, 20 bp, Artificial Sequence
  Description of Artificial Sequence: Synthetic oligonucleotide
  Target: ATXN1; (+) strand; PAM type: NRG; PAM sequence: TGG
atgctttaaaaaattagtat

SEQ ID NO: 122796 - DNA, 20 bp, Artificial Sequence
  Description of Artificial Sequence: Synthetic oligonucleotide
  Target: ATXN1; (+) strand; PAM type: NRG; PAM sequence: GGG
tgctttaaaaaattagtatt

SEQ ID NO: 122797 - DNA, 20 bp, Artificial Sequence
  Description of Artificial Sequence: Synthetic oligonucleotide
  Target: ATXN1; (+) strand; PAM type: NRG; PAM sequence: GGG
gctttaaaaaattagtattg

SEQ ID NO: 122798 - DNA, 20 bp, Artificial Sequence
  Description of Artificial Sequence: Synthetic oligonucleotide
  Target: ATXN1; (+) strand; PAM type: NRG; PAM sequence: TAG
taaaaaattagtattggggc

SEQ ID NO: 122799 - DNA, 20 bp, Artificial Sequence
  Description of Artificial Sequence: Synthetic oligonucleotide
  Target: ATXN1; (+) strand; PAM type: NRG; PAM sequence: AGG
aaaaaattagtattggggct

SEQ ID NO: 122800 - DNA, 20 bp, Artificial Sequence
  Description of Artificial Sequence: Synthetic oligonucleotide
  Target: ATXN1; (+) strand; PAM type: NRG; PAM sequence: TGG
attagtattggggctaggcg

SEQ ID NO: 122801 - DNA, 20 bp, Artificial Sequence
  Description of Artificial Sequence: Synthetic oligonucleotide
  Target: ATXN1; (+) strand; PAM type: NRG; PAM sequence: TGG
agtattggggctaggcgtgg

SEQ ID NO: 122802 - DNA, 20 bp, Artificial Sequence
  Description of Artificial Sequence: Synthetic oligonucleotide
  Target: ATXN1; (+) strand; PAM type: NRG; PAM sequence: TGG
cgcctataatccctgtactt

SEQ ID NO: 122803 - DNA, 20 bp, Artificial Sequence
  Description of Artificial Sequence: Synthetic oligonucleotide
  Target: ATXN1; (+) strand; PAM type: NRG; PAM sequence: GGG
gcctataatccctgtacttt

SEQ ID NO: 122804 - DNA, 20 bp, Artificial Sequence
  Description of Artificial Sequence: Synthetic oligonucleotide
  Target: ATXN1; (+) strand; PAM type: NRG; PAM sequence: GAG
ctataatccctgtactttgg

SEQ ID NO: 122805 - DNA, 20 bp, Artificial Sequence
  Description of Artificial Sequence: Synthetic oligonucleotide
  Target: ATXN1; (+) strand; PAM type: NRG; PAM sequence: AGG
tataatccctgtactttggg

SEQ ID NO: 122806 - DNA, 20 bp, Artificial Sequence
  Description of Artificial Sequence: Synthetic oligonucleotide
  Target: ATXN1; (+) strand; PAM type: NRG; PAM sequence: AAG
tccctgtactttgggaggcc

SEQ ID NO: 122807 - DNA, 20 bp, Artificial Sequence
  Description of Artificial Sequence: Synthetic oligonucleotide
  Target: ATXN1; (+) strand; PAM type: NRG; PAM sequence: AGG
ccctgtactttgggaggcca

SEQ ID NO: 122808 - DNA, 20 bp, Artificial Sequence
  Description of Artificial Sequence: Synthetic oligonucleotide
  Target: ATXN1; (+) strand; PAM type: NRG; PAM sequence: CAG
tgtactttgggaggccaagg

SEQ ID NO: 122809 - DNA, 20 bp, Artificial Sequence
  Description of Artificial Sequence: Synthetic oligonucleotide
  Target: ATXN1; (+) strand; PAM type: NRG; PAM sequence: AGG
gtactttgggaggccaaggc

SEQ ID NO: 122810 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccaaggcagg

SEQ ID NO: 122811 - DNA, 20 bp, Artificial Sequence
  Description of Artificial Sequence: Synthetic oligonucleotide
  Target: ATXN1; (+) strand; PAM type: NRG; PAM sequence: GAG
ccaaggcaggtggatcattt

SEQ ID NO: 122812 - DNA, 20 bp, Artificial Sequence
  Description of Artificial Sequence: Synthetic oligonucleotide
  Target: ATXN1; (+) strand; PAM type: NRG; PAM sequence: AGG
caaggcaggtggatcatttg

SEQ ID NO: 122813 - DNA, 20 bp, Artificial Sequence
  Description of Artificial Sequence: Synthetic oligonucleotide
  Target: ATXN1; (+) strand; PAM type: NRG; PAM sequence: CAG
gcaggtggatcatttgaggt

SEQ ID NO: 122814 - DNA, 20 bp, Artificial Sequence
  Description of Artificial Sequence: Synthetic oligonucleotide
  Target: ATXN1; (+) strand; PAM type: NRG; PAM sequence: AGG
caggtggatcatttgaggtc

SEQ ID NO: 122815 - DNA, 20 bp, Artificial Sequence
  Description of Artificial Sequence: Synthetic oligonucleotide
  Target: ATXN1; (+) strand; PAM type: NRG; PAM sequence: GAG
ggtggatcatttgaggtcag

SEQ ID NO: 122816 - DNA, 20 bp, Artificial Sequence
  Description of Artificial Sequence: Synthetic oligonucleotide
  Target: ATXN1; (+) strand; PAM type: NRG; PAM sequence: AAG
tcatttgaggtcaggagttc

SEQ ID NO: 122817 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagttcaagac

SEQ ID NO: 122818 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcaagaccagcc

SEQ ID NO: 122819 - DNA, 20 bp, Artificial Sequence
  Description of Artificial Sequence: Synthetic oligonucleotide
  Target: ATXN1; (+) strand; PAM type: NRG; PAM sequence: TGG
caagaccagcctggccaaca

SEQ ID NO: 122820 - DNA, 20 bp, Artificial Sequence
  Description of Artificial Sequence: Synthetic oligonucleotide
  Target: ATXN1; (+) strand; PAM type: NRG; PAM sequence: GAG
tctactaaaaatacaaaaat

SEQ ID NO: 122821 - DNA, 20 bp, Artificial Sequence
  Description of Artificial Sequence: Synthetic oligonucleotide
  Target: ATXN1; (+) strand; PAM type: NRG; PAM sequence: CAG
ctaaaaatacaaaaatgagc

SEQ ID NO: 122822 - DNA, 20 bp, Artificial Sequence
  Description of Artificial Sequence: Synthetic oligonucleotide
  Target: ATXN1; (+) strand; PAM type: NRG; PAM sequence: AGG
taaaaatacaaaaatgagcc

SEQ ID NO: 122823 - DNA, 20 bp, Artificial Sequence
  Description of Artificial Sequence: Synthetic oligonucleotide
  Target: ATXN1; (+) strand; PAM type: NRG; PAM sequence: TGG
atacaaaaatgagccaggta

SEQ ID NO: 122824 - DNA, 20 bp, Artificial Sequence
  Description of Artificial Sequence: Synthetic oligonucleotide
  Target: ATXN1; (+) strand; PAM type: NRG; PAM sequence: TGG
caaaaatgagccaggtatgg

SEQ ID NO: 122825 - DNA, 20 bp, Artificial Sequence
  Description of Artificial Sequence: Synthetic oligonucleotide
  Target: ATXN1; (+) strand; PAM type: NRG; PAM sequence: CAG
aaatgagccaggtatggtgg

SEQ ID NO: 122826 - DNA, 20 bp, Artificial Sequence
  Description of Artificial Sequence: Synthetic oligonucleotide
  Target: ATXN1; (+) strand; PAM type: NRG; PAM sequence: AGG
aatgagccaggtatggtggc

SEQ ID NO: 122827 - DNA, 20 bp, Artificial Sequence
  Description of Artificial Sequence: Synthetic oligonucleotide
  Target: ATXN1; (+) strand; PAM type: NRG; PAM sequence: TAG
ggtatggtggcaggcgcctg

SEQ ID NO: 122828 - DNA, 20 bp, Artificial Sequence
  Description of Artificial Sequence: Synthetic oligonucleotide
  Target: ATXN1; (+) strand; PAM type: NRG; PAM sequence: CAG
gtggcaggcgcctgtagtcc

SEQ ID NO: 122829 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagctactcac

SEQ ID NO: 122830 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagctactcacg

SEQ ID NO: 122831 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcacgaggct

SEQ ID NO: 122832 - DNA, 20 bp, Artificial Sequence
  Description of Artificial Sequence: Synthetic oligonucleotide
  Target: ATXN1; (+) strand; PAM type: NRG; PAM sequence: AGG
cccagctactcacgaggctg

SEQ ID NO: 122833 - DNA, 20 bp, Artificial Sequence
  Description of Artificial Sequence: Synthetic oligonucleotide
  Target: ATXN1; (+) strand; PAM type: NRG; PAM sequence: CAG
agctactcacgaggctgagg

SEQ ID NO: 122834 - DNA, 20 bp, Artificial Sequence
  Description of Artificial Sequence: Synthetic oligonucleotide
  Target: ATXN1; (+) strand; PAM type: NRG; PAM sequence: AGG
gctactcacgaggctgaggc

SEQ ID NO: 122835 - DNA, 20 bp, Artificial Sequence
  Description of Artificial Sequence: Synthetic oligonucleotide
  Target: ATXN1; (+) strand; PAM type: NRG; PAM sequence: GAG
tactcacgaggctgaggcag

SEQ ID NO: 122836 - DNA, 20 bp, Artificial Sequence
  Description of Artificial Sequence: Synthetic oligonucleotide
  Target: ATXN1; (+) strand; PAM type: NRG; PAM sequence: CAG
gcaggagaatcacttgaacc

SEQ ID NO: 122837 - DNA, 20 bp, Artificial Sequence
  Description of Artificial Sequence: Synthetic oligonucleotide
  Target: ATXN1; (+) strand; PAM type: NRG; PAM sequence: AGG
caggagaatcacttgaaccc

SEQ ID NO: 122838 - DNA, 20 bp, Artificial Sequence
  Description of Artificial Sequence: Synthetic oligonucleotide
  Target: ATXN1; (+) strand; PAM type: NRG; PAM sequence: AAG
gagaatcacttgaacccagg

SEQ ID NO: 122839 - DNA, 20 bp, Artificial Sequence
  Description of Artificial Sequence: Synthetic oligonucleotide
  Target: ATXN1; (+) strand; PAM type: NRG; PAM sequence: CGG
aatcacttgaacccaggaag

SEQ ID NO: 122840 - DNA, 20 bp, Artificial Sequence
  Description of Artificial Sequence: Synthetic oligonucleotide
  Target: ATXN1; (+) strand; PAM type: NRG; PAM sequence: GAG
tcacttgaacccaggaagcg

SEQ ID NO: 122841 - DNA, 20 bp, Artificial Sequence
  Description of Artificial Sequence: Synthetic oligonucleotide
  Target: ATXN1; (+) strand; PAM type: NRG; PAM sequence: AGG
cacttgaacccaggaagcgg

SEQ ID NO: 122842 - DNA, 20 bp, Artificial Sequence
  Description of Artificial Sequence: Synthetic oligonucleotide
  Target: ATXN1; (+) strand; PAM type: NRG; PAM sequence: CAG
aacccaggaagcggaggttg

SEQ ID NO: 122843 - DNA, 20 bp, Artificial Sequence
  Description of Artificial Sequence: Synthetic oligonucleotide
  Target: ATXN1; (+) strand; PAM type: NRG; PAM sequence: GAG
caggaagcggaggttgcagt

SEQ ID NO: 122844 - DNA, 20 bp, Artificial Sequence
  Description of Artificial Sequence: Synthetic oligonucleotide
  Target: ATXN1; (+) strand; PAM type: NRG; PAM sequence: GAG
agcggaggttgcagtgagcc

SEQ ID NO: 122845 - DNA, 20 bp, Artificial Sequence
  Description of Artificial Sequence: Synthetic oligonucleotide
  Target: ATXN1; (+) strand; PAM type: NRG; PAM sequence: TAG
gagatcatgccactgcactc

SEQ ID NO: 122846 - DNA, 20 bp, Artificial Sequence
  Description of Artificial Sequence: Synthetic oligonucleotide
  Target: ATXN1; (+) strand; PAM type: NRG; PAM sequence: TGG
catgccactgcactctagcc

SEQ ID NO: 122847 - DNA, 20 bp, Artificial Sequence
  Description of Artificial Sequence: Synthetic oligonucleotide
  Target: ATXN1; (+) strand; PAM type: NRG; PAM sequence: GGG
atgccactgcactctagcct

SEQ ID NO: 122848 - DNA, 20 bp, Artificial Sequence
  Description of Artificial Sequence: Synthetic oligonucleotide
  Target: ATXN1; (+) strand; PAM type: NRG; PAM sequence: CAG
ctgcactctagcctgggtga

SEQ ID NO: 122849 - DNA, 20 bp, Artificial Sequence
  Description of Artificial Sequence: Synthetic oligonucleotide
  Target: ATXN1; (+) strand; PAM type: NRG; PAM sequence: GAG
gcactctagcctgggtgaca

SEQ ID NO: 122850 - DNA, 20 bp, Artificial Sequence
  Description of Artificial Sequence: Synthetic oligonucleotide
  Target: ATXN1; (+) strand; PAM type: NRG; PAM sequence: GAG
tctagcctgggtgacagagt

SEQ ID NO: 122851 - DNA, 20 bp, Artificial Sequence
  Description of Artificial Sequence: Synthetic oligonucleotide
  Target: ATXN1; (+) strand; PAM type: NRG; PAM sequence: AAG
ctctctcaaaaaaaaaaaaa

SEQ ID NO: 122852 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaaaaaagttattat

SEQ ID NO: 122853 - DNA, 20 bp, Artificial Sequence
  Description of Artificial Sequence: Synthetic oligonucleotide
  Target: ATXN1; (+) strand; PAM type: NRG; PAM sequence: TAG
aaaagttattattggtatat

SEQ ID NO: 122854 - DNA, 20 bp, Artificial Sequence
  Description of Artificial Sequence: Synthetic oligonucleotide
  Target: ATXN1; (+) strand; PAM type: NRG; PAM sequence: AAG
tattattggtatattagtaa

SEQ ID NO: 122855 - DNA, 20 bp, Artificial Sequence
  Description of Artificial Sequence: Synthetic oligonucleotide
  Target: ATXN1; (+) strand; PAM type: NRG; PAM sequence: AAG
atattagtaaaagccattca

SEQ ID NO: 122856 - DNA, 20 bp, Artificial Sequence
  Description of Artificial Sequence: Synthetic oligonucleotide
  Target: ATXN1; (+) strand; PAM type: NRG; PAM sequence: CAG
cattcaaagctcaaaaacaa

SEQ ID NO: 122857 - DNA, 20 bp, Artificial Sequence
  Description of Artificial Sequence: Synthetic oligonucleotide
  Target: ATXN1; (+) strand; PAM type: NRG; PAM sequence: CAG
tattttctgaaattcaaaat

SEQ ID NO: 122858 - DNA, 20 bp, Artificial Sequence
  Description of Artificial Sequence: Synthetic oligonucleotide
  Target: ATXN1; (+) strand; PAM type: NRG; PAM sequence: CAG
ctgaaattcaaaatcagtgc

SEQ ID NO: 122859 - DNA, 20 bp, Artificial Sequence
  Description of Artificial Sequence: Synthetic oligonucleotide
  Target: ATXN1; (+) strand; PAM type: NRG; PAM sequence: CAG
ttgcataatgtttgccccca

SEQ ID NO: 122860 - DNA, 20 bp, Artificial Sequence
  Description of Artificial Sequence: Synthetic oligonucleotide
  Target: ATXN1; (+) strand; PAM type: NRG; PAM sequence: CAG
ccataataatattacgtcaa

SEQ ID NO: 122861 - DNA, 20 bp, Artificial Sequence
  Description of Artificial Sequence: Synthetic oligonucleotide
  Target: ATXN1; (+) strand; PAM type: NRG; PAM sequence: TGG
aacagcactcattttctttt

SEQ ID NO: 122862 - DNA, 20 bp, Artificial Sequence
  Description of Artificial Sequence: Synthetic oligonucleotide
  Target: ATXN1; (+) strand; PAM type: NRG; PAM sequence: AAG
tacttgttttactaaattaa

SEQ ID NO: 122863 - DNA, 20 bp, Artificial Sequence
  Description of Artificial Sequence: Synthetic oligonucleotide
  Target: ATXN1; (+) strand; PAM type: NRG; PAM sequence: CAG
tttactaaattaaaagccaa

SEQ ID NO: 122864 - DNA, 20 bp, Artificial Sequence
  Description of Artificial Sequence: Synthetic oligonucleotide
  Target: ATXN1; (+) strand; PAM type: NRG; PAM sequence: GAG
tccttttttaatactattcc

SEQ ID NO: 122865 - DNA, 20 bp, Artificial Sequence
  Description of Artificial Sequence: Synthetic oligonucleotide
  Target: ATXN1; (+) strand; PAM type: NRG; PAM sequence: CAG
ttacaattttctgactcaat

SEQ ID NO: 122866 - DNA, 20 bp, Artificial Sequence
  Description of Artificial Sequence: Synthetic oligonucleotide
  Target: ATXN1; (+) strand; PAM type: NRG; PAM sequence: AAG
tttctgactcaatcagaaca

SEQ ID NO: 122867 - DNA, 20 bp, Artificial Sequence
  Description of Artificial Sequence: Synthetic oligonucleotide
  Target: ATXN1; (+) strand; PAM type: NRG; PAM sequence: AAG
caatcagaacaaagtattgc

SEQ ID NO: 122868 - DNA, 20 bp, Artificial Sequence
  Description of Artificial Sequence: Synthetic oligonucleotide
  Target: ATXN1; (+) strand; PAM type: NRG; PAM sequence: AAG
gaacaaagtattgcaagaca

SEQ ID NO: 122869 - DNA, 20 bp, Artificial Sequence
  Description of Artificial Sequence: Synthetic oligonucleotide
  Target: ATXN1; (+) strand; PAM type: NRG; PAM sequence: AGG
aacaaagtattgcaagacaa

SEQ ID NO: 122870 - DNA, 20 bp, Artificial Sequence
  Description of Artificial Sequence: Synthetic oligonucleotide
  Target: ATXN1; (+) strand; PAM type: NRG; PAM sequence: TGG
attgaaaacttctctttttt

SEQ ID NO: 122871 - DNA, 20 bp, Artificial Sequence
  Description of Artificial Sequence: Synthetic oligonucleotide
  Target: ATXN1; (+) strand; PAM type: NRG; PAM sequence: GAG
tgaaaacttctctttttttg

SEQ ID NO: 122872 - DNA, 20 bp, Artificial Sequence
  Description of Artificial Sequence: Synthetic oligonucleotide
  Target: ATXN1; (+) strand; PAM type: NRG; PAM sequence: AGG
gaaaacttctctttttttgg

SEQ ID NO: 122873 - DNA, 20 bp, Artificial Sequence
  Description of Artificial Sequence: Synthetic oligonucleotide
  Target: ATXN1; (+) strand; PAM type: NRG; PAM sequence: GAG
aaacttctctttttttggag

SEQ ID NO: 122874 - DNA, 20 bp, Artificial Sequence
  Description of Artificial Sequence: Synthetic oligonucleotide
  Target: ATXN1; (+) strand; PAM type: NRG; PAM sequence: AGG
aacttctctttttttggagg

SEQ ID NO: 122875 - DNA, 20 bp, Artificial Sequence
  Description of Artificial Sequence: Synthetic oligonucleotide
  Target: ATXN1; (+) strand; PAM type: NRG; PAM sequence: AAG
ttttggaggaggcttcataa

SEQ ID NO: 122876 - DNA, 20 bp, Artificial Sequence
  Description of Artificial Sequence: Synthetic oligonucleotide
  Target: ATXN1; (+) strand; PAM type: NRG; PAM sequence: TAG
gaggcttcataaaagcattc

SEQ ID NO: 122877 - DNA, 20 bp, Artificial Sequence
  Description of Artificial Sequence: Synthetic oligonucleotide
  Target: ATXN1; (+) strand; PAM type: NRG; PAM sequence: TGG
aaagcattctagcttaaaac

SEQ ID NO: 122878 - DNA, 20 bp, Artificial Sequence
  Description of Artificial Sequence: Synthetic oligonucleotide
  Target: ATXN1; (+) strand; PAM type: NRG; PAM sequence: GGG
aagcattctagcttaaaact

SEQ ID NO: 122879 - DNA, 20 bp, Artificial Sequence
  Description of Artificial Sequence: Synthetic oligonucleotide
  Target: ATXN1; (+) strand; PAM type: NRG; PAM sequence: TGG
gcttaaaactgggatttcaa

SEQ ID NO: 122880 - DNA, 20 bp, Artificial Sequence
  Description of Artificial Sequence: Synthetic oligonucleotide
  Target: ATXN1; (+) strand; PAM type: NRG; PAM sequence: TAG
tcttaactgtgaataccatg

SEQ ID NO: 122881 - DNA, 20 bp, Artificial Sequence
  Description of Artificial Sequence: Synthetic oligonucleotide
  Target: ATXN1; (+) strand; PAM type: NRG; PAM sequence: CAG
taactgtgaataccatgtag

SEQ ID NO: 122882 - DNA, 20 bp, Artificial Sequence
  Description of Artificial Sequence: Synthetic oligonucleotide
  Target: ATXN1; (+) strand; PAM type: NRG; PAM sequence: TGG
catgtagcagaaatgccact

SEQ ID NO: 122883 - DNA, 20 bp, Artificial Sequence
  Description of Artificial Sequence: Synthetic oligonucleotide
  Target: ATXN1; (+) strand; PAM type: NRG; PAM sequence: TAG
atgccacttggcattatatc

SEQ ID NO: 122884 - DNA, 20 bp, Artificial Sequence
  Description of Artificial Sequence: Synthetic oligonucleotide
  Target: ATXN1; (+) strand; PAM type: NRG; PAM sequence: AGG
tgccacttggcattatatct

SEQ ID NO: 122885 - DNA, 20 bp, Artificial Sequence
  Description of Artificial Sequence: Synthetic oligonucleotide
  Target: ATXN1; (+) strand; PAM type: NRG; PAM sequence: GGG
gccacttggcattatatcta

SEQ ID NO: 122886 - DNA, 20 bp, Artificial Sequence
  Description of Artificial Sequence: Synthetic oligonucleotide
  Target: ATXN1; (+) strand; PAM type: NRG; PAM sequence: AAG
gattacctgttgaaacacca

SEQ ID NO: 122887 - DNA, 20 bp, Artificial Sequence
  Description of Artificial Sequence: Synthetic oligonucleotide
  Target: ATXN1; (+) strand; PAM type: NRG; PAM sequence: CAG
acctgttgaaacaccaaaga

SEQ ID NO: 122888 - DNA, 20 bp, Artificial Sequence
  Description of Artificial Sequence: Synthetic oligonucleotide
  Target: ATXN1; (+) strand; PAM type: NRG; PAM sequence: AGG
cctgttgaaacaccaaagac

SEQ ID NO: 122889 - DNA, 20 bp, Artificial Sequence
  Description of Artificial Sequence: Synthetic oligonucleotide
  Target: ATXN1; (+) strand; PAM type: NRG; PAM sequence: TGG
aagacaggtatactttgatg

SEQ ID NO: 122890 - DNA, 20 bp, Artificial Sequence
  Description of Artificial Sequence: Synthetic oligonucleotide
  Target: ATXN1; (+) strand; PAM type: NRG; PAM sequence: GGG
agacaggtatactttgatgt

SEQ ID NO: 122891 - DNA, 20 bp, Artificial Sequence
  Description of Artificial Sequence: Synthetic oligonucleotide
  Target: ATXN1; (+) strand; PAM type: NRG; PAM sequence: CAG
atactttgatgtgggttacg

SEQ ID NO: 122892 - DNA, 20 bp, Artificial Sequence
  Description of Artificial Sequence: Synthetic oligonucleotide
  Target: ATXN1; (+) strand; PAM type: NRG; PAM sequence: AGG
tactttgatgtgggttacgc

SEQ ID NO: 122893 - DNA, 20 bp, Artificial Sequence
  Description of Artificial Sequence: Synthetic oligonucleotide
  Target: ATXN1; (+) strand; PAM type: NRG; PAM sequence: GGG
actttgatgtgggttacgca

SEQ ID NO: 122894 - DNA, 20 bp, Artificial Sequence
  Description of Artificial Sequence: Synthetic oligonucleotide
  Target: ATXN1; (+) strand; PAM type: NRG; PAM sequence: CGG
tgatgtgggttacgcagggc

SEQ ID NO: 122895 - DNA, 20 bp, Artificial Sequence
  Description of Artificial Sequence: Synthetic oligonucleotide
  Target: ATXN1; (+) strand; PAM type: NRG; PAM sequence: GGG
gatgtgggttacgcagggcc

SEQ ID NO: 122896 - DNA, 20 bp, Artificial Sequence
  Description of Artificial Sequence: Synthetic oligonucleotide
  Target: ATXN1; (+) strand; PAM type: NRG; PAM sequence: AAG
tgggttacgcagggccgggt

SEQ ID NO: 122897 - DNA, 20 bp, Artificial Sequence
  Description of Artificial Sequence: Synthetic oligonucleotide
  Target: ATXN1; (+) strand; PAM type: NRG; PAM sequence: AAG
cgcagggccgggtaagtaac

SEQ ID NO: 122898 - DNA, 20 bp, Artificial Sequence
  Description of Artificial Sequence: Synthetic oligonucleotide
  Target: ATXN1; (+) strand; PAM type: NRG; PAM sequence: TGG
attctttctttctatgaatg

SEQ ID NO: 122899 - DNA, 20 bp, Artificial Sequence
  Description of Artificial Sequence: Synthetic oligonucleotide
  Target: ATXN1; (+) strand; PAM type: NRG; PAM sequence: AAG
tttctatgaatgtggcgctg

SEQ ID NO: 122900 - DNA, 20 bp, Artificial Sequence
  Description of Artificial Sequence: Synthetic oligonucleotide
  Target: ATXN1; (+) strand; PAM type: NRG; PAM sequence: TGG
tgaagatttgataccatatt

SEQ ID NO: 122901 - DNA, 20 bp, Artificial Sequence
  Description of Artificial Sequence: Synthetic oligonucleotide
  Target: ATXN1; (+) strand; PAM type: NRG; PAM sequence: GAG
aagatttgataccatatttg

SEQ ID NO: 122902 - DNA, 20 bp, Artificial Sequence
  Description of Artificial Sequence: Synthetic oligonucleotide
  Target: ATXN1; (+) strand; PAM type: NRG; PAM sequence: CAG
ttgataccatatttggagca

SEQ ID NO: 122903 - DNA, 20 bp, Artificial Sequence
  Description of Artificial Sequence: Synthetic oligonucleotide
  Target: ATXN1; (+) strand; PAM type: NRG; PAM sequence: TGG
tggagcacagatccatcgtg

SEQ ID NO: 122904 - DNA, 20 bp, Artificial Sequence
  Description of Artificial Sequence: Synthetic oligonucleotide
  Target: ATXN1; (+) strand; PAM type: NRG; PAM sequence: GAG
gagcacagatccatcgtgtg

SEQ ID NO: 122905 - DNA, 20 bp, Artificial Sequence
  Description of Artificial Sequence: Synthetic oligonucleotide
  Target: ATXN1; (+) strand; PAM type: NRG; PAM sequence: AGG
agcacagatccatcgtgtgg

SEQ ID NO: 122906 - DNA, 20 bp, Artificial Sequence
  Description of Artificial Sequence: Synthetic oligonucleotide
  Target: ATXN1; (+) strand; PAM type: NRG; PAM sequence: GGG
gcacagatccatcgtgtgga

SEQ ID NO: 122907 - DNA, 20 bp, Artificial Sequence
  Description of Artificial Sequence: Synthetic oligonucleotide
  Target: ATXN1; (+) strand; PAM type: NRG; PAM sequence: TGG
agatccatcgtgtggaggga

SEQ ID NO: 122908 - DNA, 20 bp, Artificial Sequence
  Description of Artificial Sequence: Synthetic oligonucleotide
  Target: ATXN1; (+) strand; PAM type: NRG; PAM sequence: GGG
gatccatcgtgtggagggat

SEQ ID NO: 122909 - DNA, 20 bp, Artificial Sequence
  Description of Artificial Sequence: Synthetic oligonucleotide
  Target: ATXN1; (+) strand; PAM type: NRG; PAM sequence: GGG
atccatcgtgtggagggatg

SEQ ID NO: 122910 - DNA, 20 bp, Artificial Sequence
  Description of Artificial Sequence: Synthetic oligonucleotide
  Target: ATXN1; (+) strand; PAM type: NRG; PAM sequence: CAG
tgtggagggatggggaaaca

SEQ ID NO: 122911 - DNA, 20 bp, Artificial Sequence
  Description of Artificial Sequence: Synthetic oligonucleotide
  Target: ATXN1; (+) strand; PAM type: NRG; PAM sequence: AGG
gtggagggatggggaaacac

SEQ ID NO: 122912 - DNA, 20 bp, Artificial Sequence
  Description of Artificial Sequence: Synthetic oligonucleotide
  Target: ATXN1; (+) strand; PAM type: NRG; PAM sequence: GAG
ggagggatggggaaacacag

SEQ ID NO: 122913 - DNA, 20 bp, Artificial Sequence
  Description of Artificial Sequence: Synthetic oligonucleotide
  Target: ATXN1; (+) strand; PAM type: NRG; PAM sequence: GAG
agggatggggaaacacagga

SEQ ID NO: 122914 - DNA, 20 bp, Artificial Sequence
  Description of Artificial Sequence: Synthetic oligonucleotide
  Target: ATXN1; (+) strand; PAM type: NRG; PAM sequence: AGG
gggatggggaaacacaggag

SEQ ID NO: 122915 - DNA, 20 bp, Artificial Sequence
  Description of Artificial Sequence: Synthetic oligonucleotide
  Target: ATXN1; (+) strand; PAM type: NRG; PAM sequence: GGG
ggatggggaaacacaggaga

SEQ ID NO: 122916 - DNA, 20 bp, Artificial Sequence
  Description of Artificial Sequence: Synthetic oligonucleotide
  Target: ATXN1; (+) strand; PAM type: NRG; PAM sequence: GGG
gatggggaaacacaggagag

SEQ ID NO: 122917 - DNA, 20 bp, Artificial Sequence
  Description of Artificial Sequence: Synthetic oligonucleotide
  Target: ATXN1; (+) strand; PAM type: NRG; PAM sequence: GAG
aaacacaggagaggggtgct

SEQ ID NO: 122918 - DNA, 20 bp, Artificial Sequence
  Description of Artificial Sequence: Synthetic oligonucleotide
  Target: ATXN1; (+) strand; PAM type: NRG; PAM sequence: CAG
tgagtgtgaccacatgtcca

SEQ ID NO: 122919 - DNA, 20 bp, Artificial Sequence
  Description of Artificial Sequence: Synthetic oligonucleotide
  Target: ATXN1; (+) strand; PAM type: NRG; PAM sequence: AGG
gagtgtgaccacatgtccac

SEQ ID NO: 122920 - DNA, 20 bp, Artificial Sequence
  Description of Artificial Sequence: Synthetic oligonucleotide
  Target: ATXN1; (+) strand; PAM type: NRG; PAM sequence: GAG
acatgtccacaggcctgtct

SEQ ID NO: 122921 - DNA, 20 bp, Artificial Sequence
  Description of Artificial Sequence: Synthetic oligonucleotide
  Target: ATXN1; (+) strand; PAM type: NRG; PAM sequence: CAG
aggcctgtctgagctcgcta

SEQ ID NO: 122922 - DNA, 20 bp, Artificial Sequence
  Description of Artificial Sequence: Synthetic oligonucleotide
  Target: ATXN1; (+) strand; PAM type: NRG; PAM sequence: AGG
ggcctgtctgagctcgctac

SEQ ID NO: 122923 - DNA, 20 bp, Artificial Sequence
  Description of Artificial Sequence: Synthetic oligonucleotide
  Target: ATXN1; (+) strand; PAM type: NRG; PAM sequence: AAG
acaggtcacactgcatcatg

SEQ ID NO: 122924 - DNA, 20 bp, Artificial Sequence
  Description of Artificial Sequence: Synthetic oligonucleotide
  Target: ATXN1; (+) strand; PAM type: NRG; PAM sequence: AGG
caggtcacactgcatcatga

SEQ ID NO: 122925 - DNA, 20 bp, Artificial Sequence
  Description of Artificial Sequence: Synthetic oligonucleotide
  Target: ATXN1; (+) strand; PAM type: NRG; PAM sequence: AAG
ctgcaatttcaatgcaaata

SEQ ID NO: 122926 - DNA, 20 bp, Artificial Sequence
  Description of Artificial Sequence: Synthetic oligonucleotide
  Target: ATXN1; (+) strand; PAM type: NRG; PAM sequence: GAG
aatatcaactactattttat

SEQ ID NO: 122927 - DNA, 20 bp, Artificial Sequence
  Description of Artificial Sequence: Synthetic oligonucleotide
  Target: ATXN1; (+) strand; PAM type: NRG; PAM sequence: AAG
caactactattttatgagta

SEQ ID NO: 122928 - DNA, 20 bp, Artificial Sequence
  Description of Artificial Sequence: Synthetic oligonucleotide
  Target: ATXN1; (+) strand; PAM type: NRG; PAM sequence: AGG
aactactattttatgagtaa

SEQ ID NO: 122929 - DNA, 20 bp, Artificial Sequence
  Description of Artificial Sequence: Synthetic oligonucleotide
  Target: ATXN1; (+) strand; PAM type: NRG; PAM sequence: TGG
attttatgagtaaaggacgc

SEQ ID NO: 122930 - DNA, 20 bp, Artificial Sequence
  Description of Artificial Sequence: Synthetic oligonucleotide
  Target: ATXN1; (+) strand; PAM type: NRG; PAM sequence: AAG
tatgagtaaaggacgctggc

SEQ ID NO: 122931 - DNA, 20 bp, Artificial Sequence
  Description of Artificial Sequence: Synthetic oligonucleotide
  Target: ATXN1; (+) strand; PAM type: NRG; PAM sequence: CAG
taaaggacgctggcaagatg

SEQ ID NO: 122932 - DNA, 20 bp, Artificial Sequence
  Description of Artificial Sequence: Synthetic oligonucleotide
  Target: ATXN1; (+) strand; PAM type: NRG; PAM sequence: TGG
acgctggcaagatgcagccg

SEQ ID NO: 122933 - DNA, 20 bp, Artificial Sequence
  Description of Artificial Sequence: Synthetic oligonucleotide
  Target: ATXN1; (+) strand; PAM type: NRG; PAM sequence: AAG
atgcagccgtggtttgtctt

SEQ ID NO: 122934 - DNA, 20 bp, Artificial Sequence
  Description of Artificial Sequence: Synthetic oligonucleotide
  Target: ATXN1; (+) strand; PAM type: NRG; PAM sequence: GAG
gcagccgtggtttgtcttaa

SEQ ID NO: 122935 - DNA, 20 bp, Artificial Sequence
  Description of Artificial Sequence: Synthetic oligonucleotide
  Target: ATXN1; (+) strand; PAM type: NRG; PAM sequence: CAG
gtcttaagagtcctgaaact

SEQ ID NO: 122936 - DNA, 20 bp, Artificial Sequence
  Description of Artificial Sequence: Synthetic oligonucleotide
  Target: ATXN1; (+) strand; PAM type: NRG; PAM sequence: AAG
cgcgtttcattaaaaacccc

SEQ ID NO: 122937 - DNA, 20 bp, Artificial Sequence
  Description of Artificial Sequence: Synthetic oligonucleotide
  Target: ATXN1; (+) strand; PAM type: NRG; PAM sequence: AGG
gcgtttcattaaaaacccca

SEQ ID NO: 122938 - DNA, 20 bp, Artificial Sequence
  Description of Artificial Sequence: Synthetic oligonucleotide
  Target: ATXN1; (+) strand; PAM type: NRG; PAM sequence: GAG
aaggaatttctttacaccat

SEQ ID NO: 122939 - DNA, 20 bp, Artificial Sequence
  Description of Artificial Sequence: Synthetic oligonucleotide
  Target: ATXN1; (+) strand; PAM type: NRG; PAM sequence: AAG
ttacaccatgagcattctac

SEQ ID NO: 122940 - DNA, 20 bp, Artificial Sequence
  Description of Artificial Sequence: Synthetic oligonucleotide
  Target: ATXN1; (+) strand; PAM type: NRG; PAM sequence: AAG
caagtttcctacctctcttt

SEQ ID NO: 122941 - DNA, 20 bp, Artificial Sequence
  Description of Artificial Sequence: Synthetic oligonucleotide
  Target: ATXN1; (+) strand; PAM type: NRG; PAM sequence: TAG
actaaatatttaaaactctt

SEQ ID NO: 122942 - DNA, 20 bp, Artificial Sequence
  Description of Artificial Sequence: Synthetic oligonucleotide
  Target: ATXN1; (+) strand; PAM type: NRG; PAM sequence: TAG
tatttaaaactctttagaat

SEQ ID NO: 122943 - DNA, 20 bp, Artificial Sequence
  Description of Artificial Sequence: Synthetic oligonucleotide
  Target: ATXN1; (+) strand; PAM type: NRG; PAM sequence: TGG
agcatcatctatgtgtcact

SEQ ID NO: 122944 - DNA, 20 bp, Artificial Sequence
  Description of Artificial Sequence: Synthetic oligonucleotide
  Target: ATXN1; (+) strand; PAM type: NRG; PAM sequence: TAG
atctatgtgtcacttggctc

SEQ ID NO: 122945 - DNA, 20 bp, Artificial Sequence
  Description of Artificial Sequence: Synthetic oligonucleotide
  Target: ATXN1; (+) strand; PAM type: NRG; PAM sequence: AGG
tctatgtgtcacttggctct

SEQ ID NO: 122946 - DNA, 20 bp, Artificial Sequence
  Description of Artificial Sequence: Synthetic oligonucleotide
  Target: ATXN1; (+) strand; PAM type: NRG; PAM sequence: CGG
ggctctaggacacatattct

SEQ ID NO: 122947 - DNA, 20 bp, Artificial Sequence
  Description of Artificial Sequence: Synthetic oligonucleotide
  Target: ATXN1; (+) strand; PAM type: NRG; PAM sequence: GGG
gctctaggacacatattctc

SEQ ID NO: 122948 - DNA, 20 bp, Artificial Sequence
  Description of Artificial Sequence: Synthetic oligonucleotide
  Target: ATXN1; (+) strand; PAM type: NRG; PAM sequence: GGG
ctctaggacacatattctcg

SEQ ID NO: 122949 - DNA, 20 bp, Artificial Sequence
  Description of Artificial Sequence: Synthetic oligonucleotide
  Target: ATXN1; (+) strand; PAM type: NRG; PAM sequence: AAG
taggacacatattctcgggg

SEQ ID NO: 122950 - DNA, 20 bp, Artificial Sequence
  Description of Artificial Sequence: Synthetic oligonucleotide
  Target: ATXN1; (+) strand; PAM type: NRG; PAM sequence: GAG
ggacacatattctcggggaa

SEQ ID NO: 122951 - DNA, 20 bp, Artificial Sequence
  Description of Artificial Sequence: Synthetic oligonucleotide
  Target: ATXN1; (+) strand; PAM type: NRG; PAM sequence: TAG
gagcatatccccatttctat

SEQ ID NO: 122952 - DNA, 20 bp, Artificial Sequence
  Description of Artificial Sequence: Synthetic oligonucleotide
  Target: ATXN1; (+) strand; PAM type: NRG; PAM sequence: AGG
agcatatccccatttctatt

SEQ ID NO: 122953 - DNA, 20 bp, Artificial Sequence
  Description of Artificial Sequence: Synthetic oligonucleotide
  Target: ATXN1; (+) strand; PAM type: NRG; PAM sequence: GAG
catatccccatttctattag

SEQ ID NO: 122954 - DNA, 20 bp, Artificial Sequence
  Description of Artificial Sequence: Synthetic oligonucleotide
  Target: ATXN1; (+) strand; PAM type: NRG; PAM sequence: AAG
tccccatttctattaggaga

SEQ ID NO: 122955 - DNA, 20 bp, Artificial Sequence
  Description of Artificial Sequence: Synthetic oligonucleotide
  Target: ATXN1; (+) strand; PAM type: NRG; PAM sequence: CAG
tctattaggagaaagaataa

SEQ ID NO: 122956 - DNA, 20 bp, Artificial Sequence
  Description of Artificial Sequence: Synthetic oligonucleotide
  Target: ATXN1; (+) strand; PAM type: NRG; PAM sequence: AGG
ctattaggagaaagaataac

SEQ ID NO: 122957 - DNA, 20 bp, Artificial Sequence
  Description of Artificial Sequence: Synthetic oligonucleotide
  Target: ATXN1; (+) strand; PAM type: NRG; PAM sequence: CAG
tcccctcctccttcatcttg

SEQ ID NO: 122958 - DNA, 20 bp, Artificial Sequence
  Description of Artificial Sequence: Synthetic oligonucleotide
  Target: ATXN1; (+) strand; PAM type: NRG; PAM sequence: TAG
cctccttcatcttgcagatt

SEQ ID NO: 122959 - DNA, 20 bp, Artificial Sequence
  Description of Artificial Sequence: Synthetic oligonucleotide
  Target: ATXN1; (+) strand; PAM type: NRG; PAM sequence: AGG
ctccttcatcttgcagattt

SEQ ID NO: 122960 - DNA, 20 bp, Artificial Sequence
  Description of Artificial Sequence: Synthetic oligonucleotide
  Target: ATXN1; (+) strand; PAM type: NRG; PAM sequence: GGG
tccttcatcttgcagattta

SEQ ID NO: 122961 - DNA, 20 bp, Artificial Sequence
  Description of Artificial Sequence: Synthetic oligonucleotide
  Target: ATXN1; (+) strand; PAM type: NRG; PAM sequence: GGG
ccttcatcttgcagatttag

SEQ ID NO: 122962 - DNA, 20 bp, Artificial Sequence
  Description of Artificial Sequence: Synthetic oligonucleotide
  Target: ATXN1; (+) strand; PAM type: NRG; PAM sequence: TAG
gcagatttaggggtttatcc

SEQ ID NO: 122963 - DNA, 20 bp, Artificial Sequence
  Description of Artificial Sequence: Synthetic oligonucleotide
  Target: ATXN1; (+) strand; PAM type: NRG; PAM sequence: TGG
aggggtttatcctagtatca

SEQ ID NO: 122964 - DNA, 20 bp, Artificial Sequence
  Description of Artificial Sequence: Synthetic oligonucleotide
  Target: ATXN1; (+) strand; PAM type: NRG; PAM sequence: CAG
tttatcctagtatcatggct

SEQ ID NO: 122965 - DNA, 20 bp, Artificial Sequence
  Description of Artificial Sequence: Synthetic oligonucleotide
  Target: ATXN1; (+) strand; PAM type: NRG; PAM sequence: AGG
ttatcctagtatcatggctc

SEQ ID NO: 122966 - DNA, 20 bp, Artificial Sequence
  Description of Artificial Sequence: Synthetic oligonucleotide
  Target: ATXN1; (+) strand; PAM type: NRG; PAM sequence: GGG
tatcctagtatcatggctca

SEQ ID NO: 122967 - DNA, 20 bp, Artificial Sequence
  Description of Artificial Sequence: Synthetic oligonucleotide
  Target: ATXN1; (+) strand; PAM type: NRG; PAM sequence: GGG
atcctagtatcatggctcag

SEQ ID NO: 122968 - DNA, 20 bp, Artificial Sequence
  Description of Artificial Sequence: Synthetic oligonucleotide
  Target: ATXN1; (+) strand; PAM type: NRG; PAM sequence: AAG
caactcctaatatatcaaaa

SEQ ID NO: 122969 - DNA, 20 bp, Artificial Sequence
  Description of Artificial Sequence: Synthetic oligonucleotide
  Target: ATXN1; (+) strand; PAM type: NRG; PAM sequence: AGG
aactcctaatatatcaaaaa

SEQ ID NO: 122970 - DNA, 20 bp, Artificial Sequence
  Description of Artificial Sequence: Synthetic oligonucleotide
  Target: ATXN1; (+) strand; PAM type: NRG; PAM sequence: GAG
ctcctaatatatcaaaaaag

SEQ ID NO: 122971 - DNA, 20 bp, Artificial Sequence
  Description of Artificial Sequence: Synthetic oligonucleotide
  Target: ATXN1; (+) strand; PAM type: NRG; PAM sequence: AAG
gcttaattgttttgtcgaat

SEQ ID NO: 122972 - DNA, 20 bp, Artificial Sequence
  Description of Artificial Sequence: Synthetic oligonucleotide
  Target: ATXN1; (+) strand; PAM type: NRG; PAM sequence: AAG
tttgtcgaataagctctcaa

SEQ ID NO: 122973 - DNA, 20 bp, Artificial Sequence
  Description of Artificial Sequence: Synthetic oligonucleotide
  Target: ATXN1; (+) strand; PAM type: NRG; PAM sequence: CAG
ttcatttttgttaccttttt

SEQ ID NO: 122974 - DNA, 20 bp, Artificial Sequence
  Description of Artificial Sequence: Synthetic oligonucleotide
  Target: ATXN1; (+) strand; PAM type: NRG; PAM sequence: AGG
tcatttttgttacctttttc

SEQ ID NO: 122975 - DNA, 20 bp, Artificial Sequence
  Description of Artificial Sequence: Synthetic oligonucleotide
  Target: ATXN1; (+) strand; PAM type: NRG; PAM sequence: AAG
ttacctttttcaggcaaaat

SEQ ID NO: 122976 - DNA, 20 bp, Artificial Sequence
  Description of Artificial Sequence: Synthetic oligonucleotide
  Target: ATXN1; (+) strand; PAM type: NRG; PAM sequence: GAG
acctttttcaggcaaaataa

SEQ ID NO: 122977 - DNA, 20 bp, Artificial Sequence
  Description of Artificial Sequence: Synthetic oligonucleotide
  Target: ATXN1; (+) strand; PAM type: NRG; PAM sequence: AGG
cctttttcaggcaaaataag

SEQ ID NO: 122978 - DNA, 20 bp, Artificial Sequence
  Description of Artificial Sequence: Synthetic oligonucleotide
  Target: ATXN1; (+) strand; PAM type: NRG; PAM sequence: TGG
aaattctattgctaaaacaa

SEQ ID NO: 122979 - DNA, 20 bp, Artificial Sequence
  Description of Artificial Sequence: Synthetic oligonucleotide
  Target: ATXN1; (+) strand; PAM type: NRG; PAM sequence: CGG
ctaaaacaatggaattctcc

SEQ ID NO: 122980 - DNA, 20 bp, Artificial Sequence
  Description of Artificial Sequence: Synthetic oligonucleotide
  Target: ATXN1; (+) strand; PAM type: NRG; PAM sequence: GGG
taaaacaatggaattctccc

SEQ ID NO: 122981 - DNA, 20 bp, Artificial Sequence
  Description of Artificial Sequence: Synthetic oligonucleotide
  Target: ATXN1; (+) strand; PAM type: NRG; PAM sequence: TGG
tcccgggaatgacttcgtta

SEQ ID NO: 122982 - DNA, 20 bp, Artificial Sequence
  Description of Artificial Sequence: Synthetic oligonucleotide
  Target: ATXN1; (+) strand; PAM type: NRG; PAM sequence: AAG
atgacttcgttatggaaatg

SEQ ID NO: 122983 - DNA, 20 bp, Artificial Sequence
  Description of Artificial Sequence: Synthetic oligonucleotide
  Target: ATXN1; (+) strand; PAM type: NRG; PAM sequence: CAG
tcgttatggaaatgaagtga

SEQ ID NO: 122984 - DNA, 20 bp, Artificial Sequence
  Description of Artificial Sequence: Synthetic oligonucleotide
  Target: ATXN1; (+) strand; PAM type: NRG; PAM sequence: TAG
aagtgacagcttcttttatc

SEQ ID NO: 122985 - DNA, 20 bp, Artificial Sequence
  Description of Artificial Sequence: Synthetic oligonucleotide
  Target: ATXN1; (+) strand; PAM type: NRG; PAM sequence: CAG
gacagcttcttttatctagc

SEQ ID NO: 122986 - DNA, 20 bp, Artificial Sequence
  Description of Artificial Sequence: Synthetic oligonucleotide
  Target: ATXN1; (+) strand; PAM type: NRG; PAM sequence: AGG
acagcttcttttatctagcc

SEQ ID NO: 122987 - DNA, 20 bp, Artificial Sequence
  Description of Artificial Sequence: Synthetic oligonucleotide
  Target: ATXN1; (+) strand; PAM type: NRG; PAM sequence: CAG
gcttcttttatctagccagg

SEQ ID NO: 122988 - DNA, 20 bp, Artificial Sequence
  Description of Artificial Sequence: Synthetic oligonucleotide
  Target: ATXN1; (+) strand; PAM type: NRG; PAM sequence: AAG
cttttatctagccaggcaga

SEQ ID NO: 122989 - DNA, 20 bp, Artificial Sequence
  Description of Artificial Sequence: Synthetic oligonucleotide
  Target: ATXN1; (+) strand; PAM type: NRG; PAM sequence: AAG
cagaaagtctgcatttataa

SEQ ID NO: 122990 - DNA, 20 bp, Artificial Sequence
  Description of Artificial Sequence: Synthetic oligonucleotide
  Target: ATXN1; (+) strand; PAM type: NRG; PAM sequence: AGG
agaaagtctgcatttataaa

SEQ ID NO: 122991 - DNA, 20 bp, Artificial Sequence
  Description of Artificial Sequence: Synthetic oligonucleotide
  Target: ATXN1; (+) strand; PAM type: NRG; PAM sequence: CAG
ctgcatttataaaaggcatt

SEQ ID NO: 122992 - DNA, 20 bp, Artificial Sequence
  Description of Artificial Sequence: Synthetic oligonucleotide
  Target: ATXN1; (+) strand; PAM type: NRG; PAM sequence: GAG
gcatttataaaaggcattca

SEQ ID NO: 122993 - DNA, 20 bp, Artificial Sequence
  Description of Artificial Sequence: Synthetic oligonucleotide
  Target: ATXN1; (+) strand; PAM type: NRG; PAM sequence: AAG
aaaaggcattcagagcactc

SEQ ID NO: 122994 - DNA, 20 bp, Artificial Sequence
  Description of Artificial Sequence: Synthetic oligonucleotide
  Target: ATXN1; (+) strand; PAM type: NRG; PAM sequence: TGG
gagcactcaagtgttgtgtg

SEQ ID NO: 122995 - DNA, 20 bp, Artificial Sequence
  Description of Artificial Sequence: Synthetic oligonucleotide
  Target: ATXN1; (+) strand; PAM type: NRG; PAM sequence: GGG
agcactcaagtgttgtgtgt

SEQ ID NO: 122996 - DNA, 20 bp, Artificial Sequence
  Description of Artificial Sequence: Synthetic oligonucleotide
  Target: ATXN1; (+) strand; PAM type: NRG; PAM sequence: GAG
cactcaagtgttgtgtgtgg

SEQ ID NO: 122997 - DNA, 20 bp, Artificial Sequence
  Description of Artificial Sequence: Synthetic oligonucleotide
  Target: ATXN1; (+) strand; PAM type: NRG; PAM sequence: AGG
actcaagtgttgtgtgtggg

SEQ ID NO: 122998 - DNA, 20 bp, Artificial Sequence
  Description of Artificial Sequence: Synthetic oligonucleotide
  Target: ATXN1; (+) strand; PAM type: NRG; PAM sequence: CAG
aagtgttgtgtgtgggagga

SEQ ID NO: 122999 - DNA, 20 bp, Artificial Sequence
  Description of Artificial Sequence: Synthetic oligonucleotide
  Target: ATXN1; (+) strand; PAM type: NRG; PAM sequence: CAG
agaaaatgctatttttaatt

SEQ ID NO: 123000 - DNA, 20 bp, Artificial Sequence
  Description of Artificial Sequence: Synthetic oligonucleotide
  Target: ATXN1; (+) strand; PAM type: NRG; PAM sequence: CAG
gctatttttaattcagattg

SEQ ID NO: 123001 - DNA, 20 bp, Artificial Sequence
  Description of Artificial Sequence: Synthetic oligonucleotide
  Target: ATXN1; (+) strand; PAM type: NRG; PAM sequence: CAG
attgcagcattcctcccatc

SEQ ID NO: 123002 - DNA, 20 bp, Artificial Sequence
  Description of Artificial Sequence: Synthetic oligonucleotide
  Target: ATXN1; (+) strand; PAM type: NRG; PAM sequence: AGG
ttgcagcattcctcccatcc

SEQ ID NO: 123003 - DNA, 20 bp, Artificial Sequence
  Description of Artificial Sequence: Synthetic oligonucleotide
  Target: ATXN1; (+) strand; PAM type: NRG; PAM sequence: CAG
ttcctcccatccaggtcttt

SEQ ID NO: 123004 - DNA, 20 bp, Artificial Sequence
  Description of Artificial Sequence: Synthetic oligonucleotide
  Target: ATXN1; (+) strand; PAM type: NRG; PAM sequence: AAG
agtataatcataatcataat

SEQ ID NO: 123005 - DNA, 20 bp, Artificial Sequence
  Description of Artificial Sequence: Synthetic oligonucleotide
  Target: ATXN1; (+) strand; PAM type: NRG; PAM sequence: AAG
cataataagactgatgtaaa

SEQ ID NO: 123006 - DNA, 20 bp, Artificial Sequence
  Description of Artificial Sequence: Synthetic oligonucleotide
  Target: ATXN1; (+) strand; PAM type: NRG; PAM sequence: AAG
atgtaaaaagaaaaaaaaaa

SEQ ID NO: 123007 - DNA, 20 bp, Artificial Sequence
  Description of Artificial Sequence: Synthetic oligonucleotide
  Target: ATXN1; (+) strand; PAM type: NRG; PAM sequence: CAG
attcccattcctgctgaccc

SEQ ID NO: 123008 - DNA, 20 bp, Artificial Sequence
  Description of Artificial Sequence: Synthetic oligonucleotide
  Target: ATXN1; (+) strand; PAM type: NRG; PAM sequence: CAG
cccattcctgctgaccccag

SEQ ID NO: 123009 - DNA, 20 bp, Artificial Sequence
  Description of Artificial Sequence: Synthetic oligonucleotide
  Target: ATXN1; (+) strand; PAM type: NRG; PAM sequence: AAG
cctgctgaccccagcagaaa

SEQ ID NO: 123010 - DNA, 20 bp, Artificial Sequence
  Description of Artificial Sequence: Synthetic oligonucleotide
  Target: ATXN1; (+) strand; PAM type: NRG; PAM sequence: GAG
tgctgaccccagcagaaaaa

SEQ ID NO: 123011 - DNA, 20 bp, Artificial Sequence
  Description of Artificial Sequence: Synthetic oligonucleotide
  Target: ATXN1; (+) strand; PAM type: NRG; PAM sequence: GAG
ctgaccccagcagaaaaaga

SEQ ID NO: 123012 - DNA, 20 bp, Artificial Sequence
  Description of Artificial Sequence: Synthetic oligonucleotide
  Target: ATXN1; (+) strand; PAM type: NRG; PAM sequence: AAG
ccccagcagaaaaagagaga

SEQ ID NO: 123013 - DNA, 20 bp, Artificial Sequence
  Description of Artificial Sequence: Synthetic oligonucleotide
  Target: ATXN1; (+) strand; PAM type: NRG; PAM sequence: AAG
agcagaaaaagagagaaaga

SEQ ID NO: 123014 - DNA, 20 bp, Artificial Sequence
  Description of Artificial Sequence: Synthetic oligonucleotide
  Target: ATXN1; (+) strand; PAM type: NRG; PAM sequence: CAG
aattaaataaatgattaata

SEQ ID NO: 123015 - DNA, 20 bp, Artificial Sequence
  Description of Artificial Sequence: Synthetic oligonucleotide
  Target: ATXN1; (+) strand; PAM type: NRG; PAM sequence: TAG
atacagcttccttccacttt

SEQ ID NO: 123016 - DNA, 20 bp, Artificial Sequence
  Description of Artificial Sequence: Synthetic oligonucleotide
  Target: ATXN1; (+) strand; PAM type: NRG; PAM sequence: TGG
tccacttttagaccgttctg

SEQ ID NO: 123017 - DNA, 20 bp, Artificial Sequence
  Description of Artificial Sequence: Synthetic oligonucleotide
  Target: ATXN1; (+) strand; PAM type: NRG; PAM sequence: GGG
ccacttttagaccgttctgt

SEQ ID NO: 123018 - DNA, 20 bp, Artificial Sequence
  Description of Artificial Sequence: Synthetic oligonucleotide
  Target: ATXN1; (+) strand; PAM type: NRG; PAM sequence: TGG
tttagaccgttctgtgggct

SEQ ID NO: 123019 - DNA, 20 bp, Artificial Sequence
  Description of Artificial Sequence: Synthetic oligonucleotide
  Target: ATXN1; (+) strand; PAM type: NRG; PAM sequence: GAG
tagaccgttctgtgggcttg

SEQ ID NO: 123020 - DNA, 20 bp, Artificial Sequence
  Description of Artificial Sequence: Synthetic oligonucleotide
  Target: ATXN1; (+) strand; PAM type: NRG; PAM sequence: GAG
gggcttggagatccaccttc

SEQ ID NO: 123021 - DNA, 20 bp, Artificial Sequence
  Description of Artificial Sequence: Synthetic oligonucleotide
  Target: ATXN1; (+) strand; PAM type: NRG; PAM sequence: AGG
ggcttggagatccaccttcg

SEQ ID NO: 123022 - DNA, 20 bp, Artificial Sequence
  Description of Artificial Sequence: Synthetic oligonucleotide
  Target: ATXN1; (+) strand; PAM type: NRG; PAM sequence: CAG
agatccaccttcgaggcaat

SEQ ID NO: 123023 - DNA, 20 bp, Artificial Sequence
  Description of Artificial Sequence: Synthetic oligonucleotide
  Target: ATXN1; (+) strand; PAM type: NRG; PAM sequence: GAG
atccaccttcgaggcaatca

SEQ ID NO: 123024 - DNA, 20 bp, Artificial Sequence
  Description of Artificial Sequence: Synthetic oligonucleotide
  Target: ATXN1; (+) strand; PAM type: NRG; PAM sequence: CAG
caccttcgaggcaatcagag

SEQ ID NO: 123025 - DNA, 20 bp, Artificial Sequence
  Description of Artificial Sequence: Synthetic oligonucleotide
  Target: ATXN1; (+) strand; PAM type: NRG; PAM sequence: AAG
agcagactatccattatcca

SEQ ID NO: 123026 - DNA, 20 bp, Artificial Sequence
  Description of Artificial Sequence: Synthetic oligonucleotide
  Target: ATXN1; (+) strand; PAM type: NRG; PAM sequence: AAG
tatccattatccaaagttaa

SEQ ID NO: 123027 - DNA, 20 bp, Artificial Sequence
  Description of Artificial Sequence: Synthetic oligonucleotide
  Target: ATXN1; (+) strand; PAM type: NRG; PAM sequence: TAG
taaaagcactttaactctgc

SEQ ID NO: 123028 - DNA, 20 bp, Artificial Sequence
  Description of Artificial Sequence: Synthetic oligonucleotide
  Target: ATXN1; (+) strand; PAM type: NRG; PAM sequence: CAG
cactttaactctgctagtaa

SEQ ID NO: 123029 - DNA, 20 bp, Artificial Sequence
  Description of Artificial Sequence: Synthetic oligonucleotide
  Target: ATXN1; (+) strand; PAM type: NRG; PAM sequence: AAG
cgtgtgactttcactctcct

SEQ ID NO: 123030 - DNA, 20 bp, Artificial Sequence
  Description of Artificial Sequence: Synthetic oligonucleotide
  Target: ATXN1; (+) strand; PAM type: NRG; PAM sequence: CAG
ctttcactctcctaagtttg

SEQ ID NO: 123031 - DNA, 20 bp, Artificial Sequence
  Description of Artificial Sequence: Synthetic oligonucleotide
  Target: ATXN1; (+) strand; PAM type: NRG; PAM sequence: AGG
tttcactctcctaagtttgc

SEQ ID NO: 123032 - DNA, 20 bp, Artificial Sequence
  Description of Artificial Sequence: Synthetic oligonucleotide
  Target: ATXN1; (+) strand; PAM type: NRG; PAM sequence: TGG
caggaatcgcctgtgcctgc

SEQ ID NO: 123033 - DNA, 20 bp, Artificial Sequence
  Description of Artificial Sequence: Synthetic oligonucleotide
  Target: ATXN1; (+) strand; PAM type: NRG; PAM sequence: GGG
aggaatcgcctgtgcctgct

SEQ ID NO: 123034 - DNA, 20 bp, Artificial Sequence
  Description of Artificial Sequence: Synthetic oligonucleotide
  Target: ATXN1; (+) strand; PAM type: NRG; PAM sequence: AAG
cctgctgggaaacgccgtgc

SEQ ID NO: 123035 - DNA, 20 bp, Artificial Sequence
  Description of Artificial Sequence: Synthetic oligonucleotide
  Target: ATXN1; (+) strand; PAM type: NRG; PAM sequence: AAG
aagttcctccatctgtttcc

SEQ ID NO: 123036 - DNA, 20 bp, Artificial Sequence
  Description of Artificial Sequence: Synthetic oligonucleotide
  Target: ATXN1; (+) strand; PAM type: NRG; PAM sequence: TGG
ttccaagacttaacattcct

SEQ ID NO: 123037 - DNA, 20 bp, Artificial Sequence
  Description of Artificial Sequence: Synthetic oligonucleotide
  Target: ATXN1; (+) strand; PAM type: NRG; PAM sequence: CAG
gacttaacattccttggtga

SEQ ID NO: 123038 - DNA, 20 bp, Artificial Sequence
  Description of Artificial Sequence: Synthetic oligonucleotide
  Target: ATXN1; (+) strand; PAM type: NRG; PAM sequence: TGG
attccttggtgacagtgcaa

SEQ ID NO: 123039 - DNA, 20 bp, Artificial Sequence
  Description of Artificial Sequence: Synthetic oligonucleotide
  Target: ATXN1; (+) strand; PAM type: NRG; PAM sequence: GAG
ttggtgacagtgcaatggac

SEQ ID NO: 123040 - DNA, 20 bp, Artificial Sequence
  Description of Artificial Sequence: Synthetic oligonucleotide
  Target: ATXN1; (+) strand; PAM type: NRG; PAM sequence: CAG
gacagtgcaatggacgagtc

SEQ ID NO: 123041 - DNA, 20 bp, Artificial Sequence
  Description of Artificial Sequence: Synthetic oligonucleotide
  Target: ATXN1; (+) strand; PAM type: NRG; PAM sequence: TGG
tgcaatggacgagtccagcc

SEQ ID NO: 123042 - DNA, 20 bp, Artificial Sequence
  Description of Artificial Sequence: Synthetic oligonucleotide
  Target: ATXN1; (+) strand; PAM type: NRG; PAM sequence: TGG
aatggacgagtccagcctgg

SEQ ID NO: 123043 - DNA, 20 bp, Artificial Sequence
  Description of Artificial Sequence: Synthetic oligonucleotide
  Target: ATXN1; (+) strand; PAM type: NRG; PAM sequence: CAG
ggacgagtccagcctggtgg

SEQ ID NO: 123044 - DNA, 20 bp, Artificial Sequence
  Description of Artificial Sequence: Synthetic oligonucleotide
  Target: ATXN1; (+) strand; PAM type: NRG; PAM sequence: AGG
gacgagtccagcctggtggc

SEQ ID NO: 123045 - DNA, 20 bp, Artificial Sequence
  Description of Artificial Sequence: Synthetic oligonucleotide
  Target: ATXN1; (+) strand; PAM type: NRG; PAM sequence: GGG
acgagtccagcctggtggca

SEQ ID NO: 123046 - DNA, 20 bp, Artificial Sequence
  Description of Artificial Sequence: Synthetic oligonucleotide
  Target: ATXN1; (+) strand; PAM type: NRG; PAM sequence: TGG
gcctggtggcagggccatgc

SEQ ID NO: 123047 - DNA, 20 bp, Artificial Sequence
  Description of Artificial Sequence: Synthetic oligonucleotide
  Target: ATXN1; (+) strand; PAM type: NRG; PAM sequence: GGG
cctggtggcagggccatgct

SEQ ID NO: 123048 - DNA, 20 bp, Artificial Sequence
  Description of Artificial Sequence: Synthetic oligonucleotide
  Target: ATXN1; (+) strand; PAM type: NRG; PAM sequence: TGG
tgatttctaatgtcaatcac

SEQ ID NO: 123049 - DNA, 20 bp, Artificial Sequence
  Description of Artificial Sequence: Synthetic oligonucleotide
  Target: ATXN1; (+) strand; PAM type: NRG; PAM sequence: TAG
caatcactggaatgcccttc

SEQ ID NO: 123050 - DNA, 20 bp, Artificial Sequence
  Description of Artificial Sequence: Synthetic oligonucleotide
  Target: ATXN1; (+) strand; PAM type: NRG; PAM sequence: AAG
cactggaatgcccttctagt

SEQ ID NO: 123051 - DNA, 20 bp, Artificial Sequence
  Description of Artificial Sequence: Synthetic oligonucleotide
  Target: ATXN1; (+) strand; PAM type: NRG; PAM sequence: AGG
actggaatgcccttctagta

SEQ ID NO: 123052 - DNA, 20 bp, Artificial Sequence
  Description of Artificial Sequence: Synthetic oligonucleotide
  Target: ATXN1; (+) strand; PAM type: NRG; PAM sequence: AAG
ggaatgcccttctagtaagg

SEQ ID NO: 123053 - DNA, 20 bp, Artificial Sequence
  Description of Artificial Sequence: Synthetic oligonucleotide
  Target: ATXN1; (+) strand; PAM type: NRG; PAM sequence: GAG
aatgcccttctagtaaggaa

SEQ ID NO: 123054 - DNA, 20 bp, Artificial Sequence
  Description of Artificial Sequence: Synthetic oligonucleotide
  Target: ATXN1; (+) strand; PAM type: NRG; PAM sequence: AGG
atgcccttctagtaaggaag

SEQ ID NO: 123055 - DNA, 20 bp, Artificial Sequence
  Description of Artificial Sequence: Synthetic oligonucleotide
  Target: ATXN1; (+) strand; PAM type: NRG; PAM sequence: AAG
ctagtaaggaagaggtgccc

SEQ ID NO: 123056 - DNA, 20 bp, Artificial Sequence
  Description of Artificial Sequence: Synthetic oligonucleotide
  Target: ATXN1; (+) strand; PAM type: NRG; PAM sequence: GAG
aggtgcccaagcttctgttt

SEQ ID NO: 123057 - DNA, 20 bp, Artificial Sequence
  Description of Artificial Sequence: Synthetic oligonucleotide
  Target: ATXN1; (+) strand; PAM type: NRG; PAM sequence: CAG
agcttctgtttgagttaaca

SEQ ID NO: 123058 - DNA, 20 bp, Artificial Sequence
  Description of Artificial Sequence: Synthetic oligonucleotide
  Target: ATXN1; (+) strand; PAM type: NRG; PAM sequence: CAG
tgagttaacacagacctttc

SEQ ID NO: 123059 - DNA, 20 bp, Artificial Sequence
  Description of Artificial Sequence: Synthetic oligonucleotide
  Target: ATXN1; (+) strand; PAM type: NRG; PAM sequence: AGG
gagttaacacagacctttcc

SEQ ID NO: 123060 - DNA, 20 bp, Artificial Sequence
  Description of Artificial Sequence: Synthetic oligonucleotide
  Target: ATXN1; (+) strand; PAM type: NRG; PAM sequence: CAG
taacacagacctttccaggt

SEQ ID NO: 123061 - DNA, 20 bp, Artificial Sequence
  Description of Artificial Sequence: Synthetic oligonucleotide
  Target: ATXN1; (+) strand; PAM type: NRG; PAM sequence: AGG
aacacagacctttccaggtc

SEQ ID NO: 123062 - DNA, 20 bp, Artificial Sequence
  Description of Artificial Sequence: Synthetic oligonucleotide
  Target: ATXN1; (+) strand; PAM type: NRG; PAM sequence: TAG
agacctttccaggtcaggtg

SEQ ID NO: 123063 - DNA, 20 bp, Artificial Sequence
  Description of Artificial Sequence: Synthetic oligonucleotide
  Target: ATXN1; (+) strand; PAM type: NRG; PAM sequence: TGG
tccaggtcaggtgtagaatc

SEQ ID NO: 123064 - DNA, 20 bp, Artificial Sequence
  Description of Artificial Sequence: Synthetic oligonucleotide
  Target: ATXN1; (+) strand; PAM type: NRG; PAM sequence: GAG
caggtcaggtgtagaatctg

SEQ ID NO: 123065 - DNA, 20 bp, Artificial Sequence
  Description of Artificial Sequence: Synthetic oligonucleotide
  Target: ATXN1; (+) strand; PAM type: NRG; PAM sequence: TGG
gtagaatctggagtgatgaa

SEQ ID NO: 123066 - DNA, 20 bp, Artificial Sequence
  Description of Artificial Sequence: Synthetic oligonucleotide
  Target: ATXN1; (+) strand; PAM type: NRG; PAM sequence: AAG
gaatctggagtgatgaatgg

SEQ ID NO: 123067 - DNA, 20 bp, Artificial Sequence
  Description of Artificial Sequence: Synthetic oligonucleotide
  Target: ATXN1; (+) strand; PAM type: NRG; PAM sequence: AGG
aatctggagtgatgaatgga

SEQ ID NO: 123068 - DNA, 20 bp, Artificial Sequence
  Description of Artificial Sequence: Synthetic oligonucleotide
  Target: ATXN1; (+) strand; PAM type: NRG; PAM sequence: GGG
atctggagtgatgaatggaa

SEQ ID NO: 123069 - DNA, 20 bp, Artificial Sequence
  Description of Artificial Sequence: Synthetic oligonucleotide
  Target: ATXN1; (+) strand; PAM type: NRG; PAM sequence: TGG
ggagtgatgaatggaagggc

SEQ ID NO: 123070 - DNA, 20 bp, Artificial Sequence
  Description of Artificial Sequence: Synthetic oligonucleotide
  Target: ATXN1; (+) strand; PAM type: NRG; PAM sequence: AAG
tgatgaatggaagggctgga

SEQ ID NO: 123071 - DNA, 20 bp, Artificial Sequence
  Description of Artificial Sequence: Synthetic oligonucleotide
  Target: ATXN1; (+) strand; PAM type: NRG; PAM sequence: AGG
gatgaatggaagggctggaa

SEQ ID NO: 123072 - DNA, 20 bp, Artificial Sequence
  Description of Artificial Sequence: Synthetic oligonucleotide
  Target: ATXN1; (+) strand; PAM type: NRG; PAM sequence: AAG
gaagggctggaaaggaaatg

SEQ ID NO: 123073 - DNA, 20 bp, Artificial Sequence
  Description of Artificial Sequence: Synthetic oligonucleotide
  Target: ATXN1; (+) strand; PAM type: NRG; PAM sequence: CAG
gctggaaaggaaatgaagac

SEQ ID NO: 123074 - DNA, 20 bp, Artificial Sequence
  Description of Artificial Sequence: Synthetic oligonucleotide
  Target: ATXN1; (+) strand; PAM type: NRG; PAM sequence: TAG
aaaggaaatgaagaccagtg

SEQ ID NO: 123075 - DNA, 20 bp, Artificial Sequence
  Description of Artificial Sequence: Synthetic oligonucleotide
  Target: ATXN1; (+) strand; PAM type: NRG; PAM sequence: CAG
ccagtgtagatgtctctttg

SEQ ID NO: 123076 - DNA, 20 bp, Artificial Sequence
  Description of Artificial Sequence: Synthetic oligonucleotide
  Target: ATXN1; (+) strand; PAM type: NRG; PAM sequence: AAG
gtgtagatgtctctttgcag

SEQ ID NO: 123077 - DNA, 20 bp, Artificial Sequence
  Description of Artificial Sequence: Synthetic oligonucleotide
  Target: ATXN1; (+) strand; PAM type: NRG; PAM sequence: TAG
tctttgcagaagttgaacat

SEQ ID NO: 123078 - DNA, 20 bp, Artificial Sequence
  Description of Artificial Sequence: Synthetic oligonucleotide
  Target: ATXN1; (+) strand; PAM type: NRG; PAM sequence: GAG
tttgcagaagttgaacatta

SEQ ID NO: 123079 - DNA, 20 bp, Artificial Sequence
  Description of Artificial Sequence: Synthetic oligonucleotide
  Target: ATXN1; (+) strand; PAM type: NRG; PAM sequence: AGG
ttgcagaagttgaacattag

SEQ ID NO: 123080 - DNA, 20 bp, Artificial Sequence
  Description of Artificial Sequence: Synthetic oligonucleotide
  Target: ATXN1; (+) strand; PAM type: NRG; PAM sequence: CAG
ttgaacattagaggaaaaaa

SEQ ID NO: 123081 - DNA, 20 bp, Artificial Sequence
  Description of Artificial Sequence: Synthetic oligonucleotide
  Target: ATXN1; (+) strand; PAM type: NRG; PAM sequence: AAG
attagaggaaaaaacagaat

SEQ ID NO: 123082 - DNA, 20 bp, Artificial Sequence
  Description of Artificial Sequence: Synthetic oligonucleotide
  Target: ATXN1; (+) strand; PAM type: NRG; PAM sequence: TGG
aaaacagaataagatgaaaa

SEQ ID NO: 123083 - DNA, 20 bp, Artificial Sequence
  Description of Artificial Sequence: Synthetic oligonucleotide
  Target: ATXN1; (+) strand; PAM type: NRG; PAM sequence: AAG
aagatgaaaatggaatcaca

SEQ ID NO: 123084 - DNA, 20 bp, Artificial Sequence
  Description of Artificial Sequence: Synthetic oligonucleotide
  Target: ATXN1; (+) strand; PAM type: NRG; PAM sequence: AGG
agatgaaaatggaatcacaa

SEQ ID NO: 123085 - DNA, 20 bp, Artificial Sequence
  Description of Artificial Sequence: Synthetic oligonucleotide
  Target: ATXN1; (+) strand; PAM type: NRG; PAM sequence: GGG
gatgaaaatggaatcacaaa

SEQ ID NO: 123086 - DNA, 20 bp, Artificial Sequence
  Description of Artificial Sequence: Synthetic oligonucleotide
  Target: ATXN1; (+) strand; PAM type: NRG; PAM sequence: TGG
atcacaaagggtaaaatgac

SEQ ID NO: 123087 - DNA, 20 bp, Artificial Sequence
  Description of Artificial Sequence: Synthetic oligonucleotide
  Target: ATXN1; (+) strand; PAM type: NRG; PAM sequence: AAG
aagggtaaaatgactggttt

SEQ ID NO: 123088 - DNA, 20 bp, Artificial Sequence
  Description of Artificial Sequence: Synthetic oligonucleotide
  Target: ATXN1; (+) strand; PAM type: NRG; PAM sequence: AGG
agggtaaaatgactggttta

SEQ ID NO: 123089 - DNA, 20 bp, Artificial Sequence
  Description of Artificial Sequence: Synthetic oligonucleotide
  Target: ATXN1; (+) strand; PAM type: NRG; PAM sequence: CAG
ctggtttaaggctatatgtg

SEQ ID NO: 123090 - DNA, 20 bp, Artificial Sequence
  Description of Artificial Sequence: Synthetic oligonucleotide
  Target: ATXN1; (+) strand; PAM type: NRG; PAM sequence: AGG
tggtttaaggctatatgtgc

SEQ ID NO: 123091 - DNA, 20 bp, Artificial Sequence
  Description of Artificial Sequence: Synthetic oligonucleotide
  Target: ATXN1; (+) strand; PAM type: NRG; PAM sequence: TAG
taaggctatatgtgcaggat

SEQ ID NO: 123092 - DNA, 20 bp, Artificial Sequence
  Description of Artificial Sequence: Synthetic oligonucleotide
  Target: ATXN1; (+) strand; PAM type: NRG; PAM sequence: GAG
aggctatatgtgcaggatta

SEQ ID NO: 123093 - DNA, 20 bp, Artificial Sequence
  Description of Artificial Sequence: Synthetic oligonucleotide
  Target: ATXN1; (+) strand; PAM type: NRG; PAM sequence: AAG
ctatatgtgcaggattagag

SEQ ID NO: 123094 - DNA, 20 bp, Artificial Sequence
  Description of Artificial Sequence: Synthetic oligonucleotide
  Target: ATXN1; (+) strand; PAM type: NRG; PAM sequence: GAG
atatgtgcaggattagagaa

SEQ ID NO: 123095 - DNA, 20 bp, Artificial Sequence
  Description of Artificial Sequence: Synthetic oligonucleotide
  Target: ATXN1; (+) strand; PAM type: NRG; PAM sequence: TGG
gtgcaggattagagaagaga

SEQ ID NO: 123096 - DNA, 20 bp, Artificial Sequence
  Description of Artificial Sequence: Synthetic oligonucleotide
  Target: ATXN1; (+) strand; PAM type: NRG; PAM sequence: GGG
tgcaggattagagaagagat

SEQ ID NO: 123097 - DNA, 20 bp, Artificial Sequence
  Description of Artificial Sequence: Synthetic oligonucleotide
  Target: ATXN1; (+) strand; PAM type: NRG; PAM sequence: GGG
gcaggattagagaagagatg

SEQ ID NO: 123098 - DNA, 20 bp, Artificial Sequence
  Description of Artificial Sequence: Synthetic oligonucleotide
  Target: ATXN1; (+) strand; PAM type: NRG; PAM sequence: AAG
ttagagaagagatggggtca

SEQ ID NO: 123099 - DNA, 20 bp, Artificial Sequence
  Description of Artificial Sequence: Synthetic oligonucleotide
  Target: ATXN1; (+) strand; PAM type: NRG; PAM sequence: AGG
tagagaagagatggggtcaa

SEQ ID NO: 123100 - DNA, 20 bp, Artificial Sequence
  Description of Artificial Sequence: Synthetic oligonucleotide
  Target: ATXN1; (+) strand; PAM type: NRG; PAM sequence: GGG
agagaagagatggggtcaaa

SEQ ID NO: 123101 - DNA, 20 bp, Artificial Sequence
  Description of Artificial Sequence: Synthetic oligonucleotide
  Target: ATXN1; (+) strand; PAM type: NRG; PAM sequence: GGG
gagaagagatggggtcaaag

SEQ ID NO: 123102 - DNA, 20 bp, Artificial Sequence
  Description of Artificial Sequence: Synthetic oligonucleotide
  Target: ATXN1; (+) strand; PAM type: NRG; PAM sequence: AAG
caaaggggtattttttaatg

SEQ ID NO: 123103 - DNA, 20 bp, Artificial Sequence
  Description of Artificial Sequence: Synthetic oligonucleotide
  Target: ATXN1; (+) strand; PAM type: NRG; PAM sequence: CAG
aattcacataaaacaaaatt

SEQ ID NO: 123104 - DNA, 20 bp, Artificial Sequence
  Description of Artificial Sequence: Synthetic oligonucleotide
  Target: ATXN1; (+) strand; PAM type: NRG; PAM sequence: AAG
cagcattttaactgttttta

SEQ ID NO: 123105 - DNA, 20 bp, Artificial Sequence
  Description of Artificial Sequence: Synthetic oligonucleotide
  Target: ATXN1; (+) strand; PAM type: NRG; PAM sequence: AAG
taactgtttttaaagtgtgt

SEQ ID NO: 123106 - DNA, 20 bp, Artificial Sequence
  Description of Artificial Sequence: Synthetic oligonucleotide
  Target: ATXN1; (+) strand; PAM type: NRG; PAM sequence: CAG
tgtttttaaagtgtgtaagt

SEQ ID NO: 123107 - DNA, 20 bp, Artificial Sequence
  Description of Artificial Sequence: Synthetic oligonucleotide
  Target: ATXN1; (+) strand; PAM type: NRG; PAM sequence: TGG
ttttaaagtgtgtaagtcag

SEQ ID NO: 123108 - DNA, 20 bp, Artificial Sequence
  Description of Artificial Sequence: Synthetic oligonucleotide
  Target: ATXN1; (+) strand; PAM type: NRG; PAM sequence: CAG
ccatcatcactatctaattc

SEQ ID NO: 123109 - DNA, 20 bp, Artificial Sequence
  Description of Artificial Sequence: Synthetic oligonucleotide
  Target: ATXN1; (+) strand; PAM type: NRG; PAM sequence: AAG
tcatcactatctaattccag

SEQ ID NO: 123110 - DNA, 20 bp, Artificial Sequence
  Description of Artificial Sequence: Synthetic oligonucleotide
  Target: ATXN1; (+) strand; PAM type: NRG; PAM sequence: CAG
catcccccttatccatgaaa

SEQ ID NO: 123111 - DNA, 20 bp, Artificial Sequence
  Description of Artificial Sequence: Synthetic oligonucleotide
  Target: ATXN1; (+) strand; PAM type: NRG; PAM sequence: CAG
tccctgtcccccactcctct

SEQ ID NO: 123112 - DNA, 20 bp, Artificial Sequence
  Description of Artificial Sequence: Synthetic oligonucleotide
  Target: ATXN1; (+) strand; PAM type: NRG; PAM sequence: TGG
cccccactcctctcagcccc

SEQ ID NO: 123113 - DNA, 20 bp, Artificial Sequence
  Description of Artificial Sequence: Synthetic oligonucleotide
  Target: ATXN1; (+) strand; PAM type: NRG; PAM sequence: AAG
actcctctcagcccctggca

SEQ ID NO: 123114 - DNA, 20 bp, Artificial Sequence
  Description of Artificial Sequence: Synthetic oligonucleotide
  Target: ATXN1; (+) strand; PAM type: NRG; PAM sequence: AAG
ctaatctactttctgactct

SEQ ID NO: 123115 - DNA, 20 bp, Artificial Sequence
  Description of Artificial Sequence: Synthetic oligonucleotide
  Target: ATXN1; (+) strand; PAM type: NRG; PAM sequence: AGG
taatctactttctgactcta

SEQ ID NO: 123116 - DNA, 20 bp, Artificial Sequence
  Description of Artificial Sequence: Synthetic oligonucleotide
  Target: ATXN1; (+) strand; PAM type: NRG; PAM sequence: GAG
atctactttctgactctaag

SEQ ID NO: 123117 - DNA, 20 bp, Artificial Sequence
  Description of Artificial Sequence: Synthetic oligonucleotide
  Target: ATXN1; (+) strand; PAM type: NRG; PAM sequence: TGG
ctctaaggagttgtctattc

SEQ ID NO: 123118 - DNA, 20 bp, Artificial Sequence
  Description of Artificial Sequence: Synthetic oligonucleotide
  Target: ATXN1; (+) strand; PAM type: NRG; PAM sequence: TGG
aaactgaatcatacaatatg

SEQ ID NO: 123119 - DNA, 20 bp, Artificial Sequence
  Description of Artificial Sequence: Synthetic oligonucleotide
  Target: ATXN1; (+) strand; PAM type: NRG; PAM sequence: TGG
aatatgtggccttttgtgtc

SEQ ID NO: 123120 - DNA, 20 bp, Artificial Sequence
  Description of Artificial Sequence: Synthetic oligonucleotide
  Target: ATXN1; (+) strand; PAM type: NRG; PAM sequence: TGG
tgtgtctggctgctttctct

SEQ ID NO: 123121 - DNA, 20 bp, Artificial Sequence
  Description of Artificial Sequence: Synthetic oligonucleotide
  Target: ATXN1; (+) strand; PAM type: NRG; PAM sequence: AAG
tctcttggcataatgttttc

SEQ ID NO: 123122 - DNA, 20 bp, Artificial Sequence
  Description of Artificial Sequence: Synthetic oligonucleotide
  Target: ATXN1; (+) strand; PAM type: NRG; PAM sequence: AGG
ctcttggcataatgttttca

SEQ ID NO: 123123 - DNA, 20 bp, Artificial Sequence
  Description of Artificial Sequence: Synthetic oligonucleotide
  Target: ATXN1; (+) strand; PAM type: NRG; PAM sequence: CAG
attcatattgtaacatgtac

SEQ ID NO: 123124 - DNA, 20 bp, Artificial Sequence
  Description of Artificial Sequence: Synthetic oligonucleotide
  Target: ATXN1; (+) strand; PAM type: NRG; PAM sequence: TGG
ccagtacttcattcttgttt

SEQ ID NO: 123125 - DNA, 20 bp, Artificial Sequence
  Description of Artificial Sequence: Synthetic oligonucleotide
  Target: ATXN1; (+) strand; PAM type: NRG; PAM sequence: TAG
ggttcaataatactctattg

SEQ ID NO: 123126 - DNA, 20 bp, Artificial Sequence
  Description of Artificial Sequence: Synthetic oligonucleotide
  Target: ATXN1; (+) strand; PAM type: NRG; PAM sequence: AGG
gttcaataatactctattgt

SEQ ID NO: 123127 - DNA, 20 bp, Artificial Sequence
  Description of Artificial Sequence: Synthetic oligonucleotide
  Target: ATXN1; (+) strand; PAM type: NRG; PAM sequence: CAG
acattttgttatttattcgt

SEQ ID NO: 123128 - DNA, 20 bp, Artificial Sequence
  Description of Artificial Sequence: Synthetic oligonucleotide
  Target: ATXN1; (+) strand; PAM type: NRG; PAM sequence: TGG
gttatttattcgtcagttga

SEQ ID NO: 123129 - DNA, 20 bp, Artificial Sequence
  Description of Artificial Sequence: Synthetic oligonucleotide
  Target: ATXN1; (+) strand; PAM type: NRG; PAM sequence: TGG
ttcgtcagttgatggacatt

SEQ ID NO: 123130 - DNA, 20 bp, Artificial Sequence
  Description of Artificial Sequence: Synthetic oligonucleotide
  Target: ATXN1; (+) strand; PAM type: NRG; PAM sequence: GGG
tcgtcagttgatggacattt

SEQ ID NO: 123131 - DNA, 20 bp, Artificial Sequence
  Description of Artificial Sequence: Synthetic oligonucleotide
  Target: ATXN1; (+) strand; PAM type: NRG; PAM sequence: TGG
atttgggatgattccatatt

SEQ ID NO: 123132 - DNA, 20 bp, Artificial Sequence
  Description of Artificial Sequence: Synthetic oligonucleotide
  Target: ATXN1; (+) strand; PAM type: NRG; PAM sequence: GGG
tttgggatgattccatattt

SEQ ID NO: 123133 - DNA, 20 bp, Artificial Sequence
  Description of Artificial Sequence: Synthetic oligonucleotide
  Target: ATXN1; (+) strand; PAM type: NRG; PAM sequence: CAG
tacctgtttgcaaatctctt

SEQ ID NO: 123134 - DNA, 20 bp, Artificial Sequence
  Description of Artificial Sequence: Synthetic oligonucleotide
  Target: ATXN1; (+) strand; PAM type: NRG; PAM sequence: AAG
aatctcttcagtgtatacct

SEQ ID NO: 123135 - DNA, 20 bp, Artificial Sequence
  Description of Artificial Sequence: Synthetic oligonucleotide
  Target: ATXN1; (+) strand; PAM type: NRG; PAM sequence: GAG
tctcttcagtgtatacctaa

SEQ ID NO: 123136 - DNA, 20 bp, Artificial Sequence
  Description of Artificial Sequence: Synthetic oligonucleotide
  Target: ATXN1; (+) strand; PAM type: NRG; PAM sequence: CAG
cttcagtgtatacctaagag

SEQ ID NO: 123137 - DNA, 20 bp, Artificial Sequence
  Description of Artificial Sequence: Synthetic oligonucleotide
  Target: ATXN1; (+) strand; PAM type: NRG; PAM sequence: GAG
tacctaagagcagaactact

SEQ ID NO: 123138 - DNA, 20 bp, Artificial Sequence
  Description of Artificial Sequence: Synthetic oligonucleotide
  Target: ATXN1; (+) strand; PAM type: NRG; PAM sequence: TAG
tcatatgttaattctgtatt

SEQ ID NO: 123139 - DNA, 20 bp, Artificial Sequence
  Description of Artificial Sequence: Synthetic oligonucleotide
  Target: ATXN1; (+) strand; PAM type: NRG; PAM sequence: GAG
aattctgtatttagctattt

SEQ ID NO: 123140 - DNA, 20 bp, Artificial Sequence
  Description of Artificial Sequence: Synthetic oligonucleotide
  Target: ATXN1; (+) strand; PAM type: NRG; PAM sequence: AGG
attctgtatttagctatttg

SEQ ID NO: 123141 - DNA, 20 bp, Artificial Sequence
  Description of Artificial Sequence: Synthetic oligonucleotide
  Target: ATXN1; (+) strand; PAM type: NRG; PAM sequence: TAG
acttgccaaattgttttcta

SEQ ID NO: 123142 - DNA, 20 bp, Artificial Sequence
  Description of Artificial Sequence: Synthetic oligonucleotide
  Target: ATXN1; (+) strand; PAM type: NRG; PAM sequence: CAG
gcaccatactacattcccac

SEQ ID NO: 123143 - DNA, 20 bp, Artificial Sequence
  Description of Artificial Sequence: Synthetic oligonucleotide
  Target: ATXN1; (+) strand; PAM type: NRG; PAM sequence: CAG
catactacattcccaccagc

SEQ ID NO: 123144 - DNA, 20 bp, Artificial Sequence
  Description of Artificial Sequence: Synthetic oligonucleotide
  Target: ATXN1; (+) strand; PAM type: NRG; PAM sequence: AGG
atactacattcccaccagcc

SEQ ID NO: 123145 - DNA, 20 bp, Artificial Sequence
  Description of Artificial Sequence: Synthetic oligonucleotide
  Target: ATXN1; (+) strand; PAM type: NRG; PAM sequence: TAG
ctacattcccaccagccagg

SEQ ID NO: 123146 - DNA, 20 bp, Artificial Sequence
  Description of Artificial Sequence: Synthetic oligonucleotide
  Target: ATXN1; (+) strand; PAM type: NRG; PAM sequence: AGG
tacattcccaccagccaggt

SEQ ID NO: 123147 - DNA, 20 bp, Artificial Sequence
  Description of Artificial Sequence: Synthetic oligonucleotide
  Target: ATXN1; (+) strand; PAM type: NRG; PAM sequence: AAG
attcccaccagccaggtagg

SEQ ID NO: 123148 - DNA, 20 bp, Artificial Sequence
  Description of Artificial Sequence: Synthetic oligonucleotide
  Target: ATXN1; (+) strand; PAM type: NRG; PAM sequence: AAG
aagattaccattttttccac

SEQ ID NO: 123149 - DNA, 20 bp, Artificial Sequence
  Description of Artificial Sequence: Synthetic oligonucleotide
  Target: ATXN1; (+) strand; PAM type: NRG; PAM sequence: TGG
ttccttttttaaaaaaatta

SEQ ID NO: 123150 - DNA, 20 bp, Artificial Sequence
  Description of Artificial Sequence: Synthetic oligonucleotide
  Target: ATXN1; (+) strand; PAM type: NRG; PAM sequence: TGG
aaaaattatggccatcataa

SEQ ID NO: 123151 - DNA, 20 bp, Artificial Sequence
  Description of Artificial Sequence: Synthetic oligonucleotide
  Target: ATXN1; (+) strand; PAM type: NRG; PAM sequence: GGG
aaaattatggccatcataat

SEQ ID NO: 123152 - DNA, 20 bp, Artificial Sequence
  Description of Artificial Sequence: Synthetic oligonucleotide
  Target: ATXN1; (+) strand; PAM type: NRG; PAM sequence: AAG
cataatgggtgaccataata

SEQ ID NO: 123153 - DNA, 20 bp, Artificial Sequence
  Description of Artificial Sequence: Synthetic oligonucleotide
  Target: ATXN1; (+) strand; PAM type: NRG; PAM sequence: TGG
aatgggtgaccataataaag

SEQ ID NO: 123154 - DNA, 20 bp, Artificial Sequence
  Description of Artificial Sequence: Synthetic oligonucleotide
  Target: ATXN1; (+) strand; PAM type: NRG; PAM sequence: TGG
aataaagtggtatctcattg

SEQ ID NO: 123155 - DNA, 20 bp, Artificial Sequence
  Description of Artificial Sequence: Synthetic oligonucleotide
  Target: ATXN1; (+) strand; PAM type: NRG; PAM sequence: TGG
cccctaaacactaatgatgt

SEQ ID NO: 123156 - DNA, 20 bp, Artificial Sequence
  Description of Artificial Sequence: Synthetic oligonucleotide
  Target: ATXN1; (+) strand; PAM type: NRG; PAM sequence: AAG
gatgttggacatcttttcat

SEQ ID NO: 123157 - DNA, 20 bp, Artificial Sequence
  Description of Artificial Sequence: Synthetic oligonucleotide
  Target: ATXN1; (+) strand; PAM type: NRG; PAM sequence: TGG
acatcttttcataagcttat

SEQ ID NO: 123158 - DNA, 20 bp, Artificial Sequence
  Description of Artificial Sequence: Synthetic oligonucleotide
  Target: ATXN1; (+) strand; PAM type: NRG; PAM sequence: TGG
ggctatttatatatcttctt

SEQ ID NO: 123159 - DNA, 20 bp, Artificial Sequence
  Description of Artificial Sequence: Synthetic oligonucleotide
  Target: ATXN1; (+) strand; PAM type: NRG; PAM sequence: GAG
ctatttatatatcttctttg

SEQ ID NO: 123160 - DNA, 20 bp, Artificial Sequence
  Description of Artificial Sequence: Synthetic oligonucleotide
  Target: ATXN1; (+) strand; PAM type: NRG; PAM sequence: TGG
gcctttgtccatctttaaac

SEQ ID NO: 123161 - DNA, 20 bp, Artificial Sequence
  Description of Artificial Sequence: Synthetic oligonucleotide
  Target: ATXN1; (+) strand; PAM type: NRG; PAM sequence: GGG
cctttgtccatctttaaact

SEQ ID NO: 123162 - DNA, 20 bp, Artificial Sequence
  Description of Artificial Sequence: Synthetic oligonucleotide
  Target: ATXN1; (+) strand; PAM type: NRG; PAM sequence: TAG
ccatctttaaactgggttgt

SEQ ID NO: 123163 - DNA, 20 bp, Artificial Sequence
  Description of Artificial Sequence: Synthetic oligonucleotide
  Target: ATXN1; (+) strand; PAM type: NRG; PAM sequence: AAG
tctttttctctttgaattgt

SEQ ID NO: 123164 - DNA, 20 bp, Artificial Sequence
  Description of Artificial Sequence: Synthetic oligonucleotide
  Target: ATXN1; (+) strand; PAM type: NRG; PAM sequence: GAG
tttttctctttgaattgtaa

SEQ ID NO: 123165 - DNA, 20 bp, Artificial Sequence
  Description of Artificial Sequence: Synthetic oligonucleotide
  Target: ATXN1; (+) strand; PAM type: NRG; PAM sequence: CAG
taagagttctttatatattc

SEQ ID NO: 123166 - DNA, 20 bp, Artificial Sequence
  Description of Artificial Sequence: Synthetic oligonucleotide
  Target: ATXN1; (+) strand; PAM type: NRG; PAM sequence: TAG
tctttatatattccagaaac

SEQ ID NO: 123167 - DNA, 20 bp, Artificial Sequence
  Description of Artificial Sequence: Synthetic oligonucleotide
  Target: ATXN1; (+) strand; PAM type: NRG; PAM sequence: GAG
tccagaaactagacccttat

SEQ ID NO: 123168 - DNA, 20 bp, Artificial Sequence
  Description of Artificial Sequence: Synthetic oligonucleotide
  Target: ATXN1; (+) strand; PAM type: NRG; PAM sequence: TGG
aaatattttctcccattctg

SEQ ID NO: 123169 - DNA, 20 bp, Artificial Sequence
  Description of Artificial Sequence: Synthetic oligonucleotide
  Target: ATXN1; (+) strand; PAM type: NRG; PAM sequence: GGG
aatattttctcccattctgt

SEQ ID NO: 123170 - DNA, 20 bp, Artificial Sequence
  Description of Artificial Sequence: Synthetic oligonucleotide
  Target: ATXN1; (+) strand; PAM type: NRG; PAM sequence: CAG
ctgtcttttgactttcttga

SEQ ID NO: 123171 - DNA, 20 bp, Artificial Sequence
  Description of Artificial Sequence: Synthetic oligonucleotide
  Target: ATXN1; (+) strand; PAM type: NRG; PAM sequence: TGG
actttcttgacagtgccctt

SEQ ID NO: 123172 - DNA, 20 bp, Artificial Sequence
  Description of Artificial Sequence: Synthetic oligonucleotide
  Target: ATXN1; (+) strand; PAM type: NRG; PAM sequence: AAG
acagtgccctttggttcaca

SEQ ID NO: 123173 - DNA, 20 bp, Artificial Sequence
  Description of Artificial Sequence: Synthetic oligonucleotide
  Target: ATXN1; (+) strand; PAM type: NRG; PAM sequence: AGG
cagtgccctttggttcacaa

SEQ ID NO: 123174 - DNA, 20 bp, Artificial Sequence
  Description of Artificial Sequence: Synthetic oligonucleotide
  Target: ATXN1; (+) strand; PAM type: NRG; PAM sequence: AAG
caaaggctttgatactgatg

SEQ ID NO: 123175 - DNA, 20 bp, Artificial Sequence
  Description of Artificial Sequence: Synthetic oligonucleotide
  Target: ATXN1; (+) strand; PAM type: NRG; PAM sequence: TGG
tcttttgttgtttgtgcttt

SEQ ID NO: 123176 - DNA, 20 bp, Artificial Sequence
  Description of Artificial Sequence: Synthetic oligonucleotide
  Target: ATXN1; (+) strand; PAM type: NRG; PAM sequence: AAG
gtgcttttggtgtcacatct

SEQ ID NO: 123177 - DNA, 20 bp, Artificial Sequence
  Description of Artificial Sequence: Synthetic oligonucleotide
  Target: ATXN1; (+) strand; PAM type: NRG; PAM sequence: TGG
agaatctattgccaaatcca

SEQ ID NO: 123178 - DNA, 20 bp, Artificial Sequence
  Description of Artificial Sequence: Synthetic oligonucleotide
  Target: ATXN1; (+) strand; PAM type: NRG; PAM sequence: AAG
ttgccaaatccatggtcatg

SEQ ID NO: 123179 - DNA, 20 bp, Artificial Sequence
  Description of Artificial Sequence: Synthetic oligonucleotide
  Target: ATXN1; (+) strand; PAM type: NRG; PAM sequence: AAG
ttactcctgttttcatttaa

SEQ ID NO: 123180 - DNA, 20 bp, Artificial Sequence
  Description of Artificial Sequence: Synthetic oligonucleotide
  Target: ATXN1; (+) strand; PAM type: NRG; PAM sequence: TAG
gttttcatttaaaagtttta

SEQ ID NO: 123181 - DNA, 20 bp, Artificial Sequence
  Description of Artificial Sequence: Synthetic oligonucleotide
  Target: ATXN1; (+) strand; PAM type: NRG; PAM sequence: CAG
atttaaaagttttatagttt

SEQ ID NO: 123182 - DNA, 20 bp, Artificial Sequence
  Description of Artificial Sequence: Synthetic oligonucleotide
  Target: ATXN1; (+) strand; PAM type: NRG; PAM sequence: TAG
atagtttcagttcctacatt

SEQ ID NO: 123183 - DNA, 20 bp, Artificial Sequence
  Description of Artificial Sequence: Synthetic oligonucleotide
  Target: ATXN1; (+) strand; PAM type: NRG; PAM sequence: AGG
tagtttcagttcctacattt

SEQ ID NO: 123184 - DNA, 20 bp, Artificial Sequence
  Description of Artificial Sequence: Synthetic oligonucleotide
  Target: ATXN1; (+) strand; PAM type: NRG; PAM sequence: GGG
agtttcagttcctacattta

SEQ ID NO: 123185 - DNA, 20 bp, Artificial Sequence
  Description of Artificial Sequence: Synthetic oligonucleotide
  Target: ATXN1; (+) strand; PAM type: NRG; PAM sequence: TAG
ttagggtattgatccatttt

SEQ ID NO: 123186 - DNA, 20 bp, Artificial Sequence
  Description of Artificial Sequence: Synthetic oligonucleotide
  Target: ATXN1; (+) strand; PAM type: NRG; PAM sequence: TGG
ttttagttcatttttgtata

SEQ ID NO: 123187 - DNA, 20 bp, Artificial Sequence
  Description of Artificial Sequence: Synthetic oligonucleotide
  Target: ATXN1; (+) strand; PAM type: NRG; PAM sequence: GAG
ttcatttttgtatatggtgt

SEQ ID NO: 123188 - DNA, 20 bp, Artificial Sequence
  Description of Artificial Sequence: Synthetic oligonucleotide
  Target: ATXN1; (+) strand; PAM type: NRG; PAM sequence: AGG
tcatttttgtatatggtgtg

SEQ ID NO: 123189 - DNA, 20 bp, Artificial Sequence
  Description of Artificial Sequence: Synthetic oligonucleotide
  Target: ATXN1; (+) strand; PAM type: NRG; PAM sequence: AAG
ttttgtatatggtgtgaggt

SEQ ID NO: 123190 - DNA, 20 bp, Artificial Sequence
  Description of Artificial Sequence: Synthetic oligonucleotide
  Target: ATXN1; (+) strand; PAM type: NRG; PAM sequence: AGG
tttgtatatggtgtgaggta

SEQ ID NO: 123191 - DNA, 20 bp, Artificial Sequence
  Description of Artificial Sequence: Synthetic oligonucleotide
  Target: ATXN1; (+) strand; PAM type: NRG; PAM sequence: GGG
ttgtatatggtgtgaggtaa

SEQ ID NO: 123192 - DNA, 20 bp, Artificial Sequence
  Description of Artificial Sequence: Synthetic oligonucleotide
  Target: ATXN1; (+) strand; PAM type: NRG; PAM sequence: TGG
aagggttcaacttctttctc

SEQ ID NO: 123193 - DNA, 20 bp, Artificial Sequence
  Description of Artificial Sequence: Synthetic oligonucleotide
  Target: ATXN1; (+) strand; PAM type: NRG; PAM sequence: CAG
tctttctctggcatgtgtcc

SEQ ID NO: 123194 - DNA, 20 bp, Artificial Sequence
  Description of Artificial Sequence: Synthetic oligonucleotide
  Target: ATXN1; (+) strand; PAM type: NRG; PAM sequence: AGG
ctttctctggcatgtgtccc

SEQ ID NO: 123195 - DNA, 20 bp, Artificial Sequence
  Description of Artificial Sequence: Synthetic oligonucleotide
  Target: ATXN1; (+) strand; PAM type: NRG; PAM sequence: CAG
ggtgactttttccattgtct

SEQ ID NO: 123196 - DNA, 20 bp, Artificial Sequence
  Description of Artificial Sequence: Synthetic oligonucleotide
  Target: ATXN1; (+) strand; PAM type: NRG; PAM sequence: AAG
tctcagcaccaattgttgaa

SEQ ID NO: 123197 - DNA, 20 bp, Artificial Sequence
  Description of Artificial Sequence: Synthetic oligonucleotide
  Target: ATXN1; (+) strand; PAM type: NRG; PAM sequence: GAG
tcagcaccaattgttgaaaa

SEQ ID NO: 123198 - DNA, 20 bp, Artificial Sequence
  Description of Artificial Sequence: Synthetic oligonucleotide
  Target: ATXN1; (+) strand; PAM type: NRG; PAM sequence: AGG
cagcaccaattgttgaaaag

SEQ ID NO: 123199 - DNA, 20 bp, Artificial Sequence
  Description of Artificial Sequence: Synthetic oligonucleotide
  Target: ATXN1; (+) strand; PAM type: NRG; PAM sequence: AAG
accaattgttgaaaagaggt

SEQ ID NO: 123200 - DNA, 20 bp, Artificial Sequence
  Description of Artificial Sequence: Synthetic oligonucleotide
  Target: ATXN1; (+) strand; PAM type: NRG; PAM sequence: GAG
caattgttgaaaagaggtaa

SEQ ID NO: 123201 - DNA, 20 bp, Artificial Sequence
  Description of Artificial Sequence: Synthetic oligonucleotide
  Target: ATXN1; (+) strand; PAM type: NRG; PAM sequence: GAG
attgttgaaaagaggtaaga

SEQ ID NO: 123202 - DNA, 20 bp, Artificial Sequence
  Description of Artificial Sequence: Synthetic oligonucleotide
  Target: ATXN1; (+) strand; PAM type: NRG; PAM sequence: GAG
aaagaggtaagagagatttt

SEQ ID NO: 123203 - DNA, 20 bp, Artificial Sequence
  Description of Artificial Sequence: Synthetic oligonucleotide
  Target: ATXN1; (+) strand; PAM type: NRG; PAM sequence: AAG
taagagagattttgagtatg

SEQ ID NO: 123204 - DNA, 20 bp, Artificial Sequence
  Description of Artificial Sequence: Synthetic oligonucleotide
  Target: ATXN1; (+) strand; PAM type: NRG; PAM sequence: TAG
ttttgagtatgaagtgattt

SEQ ID NO: 123205 - DNA, 20 bp, Artificial Sequence
  Description of Artificial Sequence: Synthetic oligonucleotide
  Target: ATXN1; (+) strand; PAM type: NRG; PAM sequence: TGG
tattttaaaaattaattttc

SEQ ID NO: 123206 - DNA, 20 bp, Artificial Sequence
  Description of Artificial Sequence: Synthetic oligonucleotide
  Target: ATXN1; (+) strand; PAM type: NRG; PAM sequence: TGG
aaaattaattttctggcttt

SEQ ID NO: 123207 - DNA, 20 bp, Artificial Sequence
  Description of Artificial Sequence: Synthetic oligonucleotide
  Target: ATXN1; (+) strand; PAM type: NRG; PAM sequence: CAG
ggttacactatgactgtatt

SEQ ID NO: 123208 - DNA, 20 bp, Artificial Sequence
  Description of Artificial Sequence: Synthetic oligonucleotide
  Target: ATXN1; (+) strand; PAM type: NRG; PAM sequence: AAG
tttcctcatcccacatttta

SEQ ID NO: 123209 - DNA, 20 bp, Artificial Sequence
  Description of Artificial Sequence: Synthetic oligonucleotide
  Target: ATXN1; (+) strand; PAM type: NRG; PAM sequence: CAG
catcccacattttaaagatg

SEQ ID NO: 123210 - DNA, 20 bp, Artificial Sequence
  Description of Artificial Sequence: Synthetic oligonucleotide
  Target: ATXN1; (+) strand; PAM type: NRG; PAM sequence: AAG
ccacattttaaagatgcagc

SEQ ID NO: 123211 - DNA, 20 bp, Artificial Sequence
  Description of Artificial Sequence: Synthetic oligonucleotide
  Target: ATXN1; (+) strand; PAM type: NRG; PAM sequence: CAG
tttcatgaatgatgacccac

SEQ ID NO: 123212 - DNA, 20 bp, Artificial Sequence
  Description of Artificial Sequence: Synthetic oligonucleotide
  Target: ATXN1; (+) strand; PAM type: NRG; PAM sequence: GAG
tcatgaatgatgacccacca

SEQ ID NO: 123213 - DNA, 20 bp, Artificial Sequence
  Description of Artificial Sequence: Synthetic oligonucleotide
  Target: ATXN1; (+) strand; PAM type: NRG; PAM sequence: GAG
cccaccagagccatgatgct

SEQ ID NO: 123214 - DNA, 20 bp, Artificial Sequence
  Description of Artificial Sequence: Synthetic oligonucleotide
  Target: ATXN1; (+) strand; PAM type: NRG; PAM sequence: CAG
gagccatgatgctgagcttt

SEQ ID NO: 123215 - DNA, 20 bp, Artificial Sequence
  Description of Artificial Sequence: Synthetic oligonucleotide
  Target: ATXN1; (+) strand; PAM type: NRG; PAM sequence: AGG
agccatgatgctgagctttc

SEQ ID NO: 123216 - DNA, 20 bp, Artificial Sequence
  Description of Artificial Sequence: Synthetic oligonucleotide
  Target: ATXN1; (+) strand; PAM type: NRG; PAM sequence: GGG
gccatgatgctgagctttca

SEQ ID NO: 123217 - DNA, 20 bp, Artificial Sequence
  Description of Artificial Sequence: Synthetic oligonucleotide
  Target: ATXN1; (+) strand; PAM type: NRG; PAM sequence: AAG
atgatgctgagctttcaggg

SEQ ID NO: 123218 - DNA, 20 bp, Artificial Sequence
  Description of Artificial Sequence: Synthetic oligonucleotide
  Target: ATXN1; (+) strand; PAM type: NRG; PAM sequence: GAG
agggaagccaaccacctctt

SEQ ID NO: 123219 - DNA, 20 bp, Artificial Sequence
  Description of Artificial Sequence: Synthetic oligonucleotide
  Target: ATXN1; (+) strand; PAM type: NRG; PAM sequence: AGG
gggaagccaaccacctcttg

SEQ ID NO: 123220 - DNA, 20 bp, Artificial Sequence
  Description of Artificial Sequence: Synthetic oligonucleotide
  Target: ATXN1; (+) strand; PAM type: NRG; PAM sequence: TGG
aagccaaccacctcttgagg

SEQ ID NO: 123221 - DNA, 20 bp, Artificial Sequence
  Description of Artificial Sequence: Synthetic oligonucleotide
  Target: ATXN1; (+) strand; PAM type: NRG; PAM sequence: AAG
tcttgaggtggtgcttttgc

SEQ ID NO: 123222 - DNA, 20 bp, Artificial Sequence
  Description of Artificial Sequence: Synthetic oligonucleotide
  Target: ATXN1; (+) strand; PAM type: NRG; PAM sequence: AAG
ttgcaagaactaattttcaa

SEQ ID NO: 123223 - DNA, 20 bp, Artificial Sequence
  Description of Artificial Sequence: Synthetic oligonucleotide
  Target: ATXN1; (+) strand; PAM type: NRG; PAM sequence: CAG
gaactaattttcaaaagcaa

SEQ ID NO: 123224 - DNA, 20 bp, Artificial Sequence
  Description of Artificial Sequence: Synthetic oligonucleotide
  Target: ATXN1; (+) strand; PAM type: NRG; PAM sequence: TAG
ctaattttcaaaagcaacag

SEQ ID NO: 123225 - DNA, 20 bp, Artificial Sequence
  Description of Artificial Sequence: Synthetic oligonucleotide
  Target: ATXN1; (+) strand; PAM type: NRG; PAM sequence: TGG
tagcttgaaattgctgactt

SEQ ID NO: 123226 - DNA, 20 bp, Artificial Sequence
  Description of Artificial Sequence: Synthetic oligonucleotide
  Target: ATXN1; (+) strand; PAM type: NRG; PAM sequence: GGG
agcttgaaattgctgacttt

SEQ ID NO: 123227 - DNA, 20 bp, Artificial Sequence
  Description of Artificial Sequence: Synthetic oligonucleotide
  Target: ATXN1; (+) strand; PAM type: NRG; PAM sequence: TAG
cctctgtgtttgtgcccctc

SEQ ID NO: 123228 - DNA, 20 bp, Artificial Sequence
  Description of Artificial Sequence: Synthetic oligonucleotide
  Target: ATXN1; (+) strand; PAM type: NRG; PAM sequence: CAG
gtttgtgcccctctagtgaa

SEQ ID NO: 123229 - DNA, 20 bp, Artificial Sequence
  Description of Artificial Sequence: Synthetic oligonucleotide
  Target: ATXN1; (+) strand; PAM type: NRG; PAM sequence: CAG
tagtgaacagcccctgtctt

SEQ ID NO: 123230 - DNA, 20 bp, Artificial Sequence
  Description of Artificial Sequence: Synthetic oligonucleotide
  Target: ATXN1; (+) strand; PAM type: NRG; PAM sequence: CAG
cccctgtcttcagatatcca

SEQ ID NO: 123231 - DNA, 20 bp, Artificial Sequence
  Description of Artificial Sequence: Synthetic oligonucleotide
  Target: ATXN1; (+) strand; PAM type: NRG; PAM sequence: AAG
cagacctctgttctctttcc

SEQ ID NO: 123232 - DNA, 20 bp, Artificial Sequence
  Description of Artificial Sequence: Synthetic oligonucleotide
  Target: ATXN1; (+) strand; PAM type: NRG; PAM sequence: AAG
aagcccgacacccacccatt

SEQ ID NO: 123233 - DNA, 20 bp, Artificial Sequence
  Description of Artificial Sequence: Synthetic oligonucleotide
  Target: ATXN1; (+) strand; PAM type: NRG; PAM sequence: TGG
cgacacccacccattaagat

SEQ ID NO: 123234 - DNA, 20 bp, Artificial Sequence
  Description of Artificial Sequence: Synthetic oligonucleotide
  Target: ATXN1; (+) strand; PAM type: NRG; PAM sequence: TGG
acccattaagattggctctt

SEQ ID NO: 123235 - DNA, 20 bp, Artificial Sequence
  Description of Artificial Sequence: Synthetic oligonucleotide
  Target: ATXN1; (+) strand; PAM type: NRG; PAM sequence: GAG
ccattaagattggctctttg

SEQ ID NO: 123236 - DNA, 20 bp, Artificial Sequence
  Description of Artificial Sequence: Synthetic oligonucleotide
  Target: ATXN1; (+) strand; PAM type: NRG; PAM sequence: AAG
atgccaaatcgtgtataacc

SEQ ID NO: 123237 - DNA, 20 bp, Artificial Sequence
  Description of Artificial Sequence: Synthetic oligonucleotide
  Target: ATXN1; (+) strand; PAM type: NRG; PAM sequence: GAG
gccaaatcgtgtataaccaa

SEQ ID NO: 123238 - DNA, 20 bp, Artificial Sequence
  Description of Artificial Sequence: Synthetic oligonucleotide
  Target: ATXN1; (+) strand; PAM type: NRG; PAM sequence: TAG
tgtataaccaagagaaataa

SEQ ID NO: 123239 - DNA, 20 bp, Artificial Sequence
  Description of Artificial Sequence: Synthetic oligonucleotide
  Target: ATXN1; (+) strand; PAM type: NRG; PAM sequence: TGG
caagagaaataatagacttt

SEQ ID NO: 123240 - DNA, 20 bp, Artificial Sequence
  Description of Artificial Sequence: Synthetic oligonucleotide
  Target: ATXN1; (+) strand; PAM type: NRG; PAM sequence: AAG
agacttttggcatgatacct

SEQ ID NO: 123241 - DNA, 20 bp, Artificial Sequence
  Description of Artificial Sequence: Synthetic oligonucleotide
  Target: ATXN1; (+) strand; PAM type: NRG; PAM sequence: AAG
cctaagactctgtttatctt

SEQ ID NO: 123242 - DNA, 20 bp, Artificial Sequence
  Description of Artificial Sequence: Synthetic oligonucleotide
  Target: ATXN1; (+) strand; PAM type: NRG; PAM sequence: AAG
ctctgtttatcttaagcaaa

SEQ ID NO: 123243 - DNA, 20 bp, Artificial Sequence
  Description of Artificial Sequence: Synthetic oligonucleotide
  Target: ATXN1; (+) strand; PAM type: NRG; PAM sequence: CAG
tatcttaagcaaaaagaata

SEQ ID NO: 123244 - DNA, 20 bp, Artificial Sequence
  Description of Artificial Sequence: Synthetic oligonucleotide
  Target: ATXN1; (+) strand; PAM type: NRG; PAM sequence: TAG
taagcaaaaagaatacagtg

SEQ ID NO: 123245 - DNA, 20 bp, Artificial Sequence
  Description of Artificial Sequence: Synthetic oligonucleotide
  Target: ATXN1; (+) strand; PAM type: NRG; PAM sequence: AGG
aagcaaaaagaatacagtgt

SEQ ID NO: 123246 - DNA, 20 bp, Artificial Sequence
  Description of Artificial Sequence: Synthetic oligonucleotide
  Target: ATXN1; (+) strand; PAM type: NRG; PAM sequence: TAG
aaagaatacagtgtaggttg

SEQ ID NO: 123247 - DNA, 20 bp, Artificial Sequence
  Description of Artificial Sequence: Synthetic oligonucleotide
  Target: ATXN1; (+) strand; PAM type: NRG; PAM sequence: TGG
cagtgtaggttgtagaattc

SEQ ID NO: 123248 - DNA, 20 bp, Artificial Sequence
  Description of Artificial Sequence: Synthetic oligonucleotide
  Target: ATXN1; (+) strand; PAM type: NRG; PAM sequence: CAG
aattctggctatcatcaatt

SEQ ID NO: 123249 - DNA, 20 bp, Artificial Sequence
  Description of Artificial Sequence: Synthetic oligonucleotide
  Target: ATXN1; (+) strand; PAM type: NRG; PAM sequence: AAG
atcatcaattcagccaatgc

SEQ ID NO: 123250 - DNA, 20 bp, Artificial Sequence
  Description of Artificial Sequence: Synthetic oligonucleotide
  Target: ATXN1; (+) strand; PAM type: NRG; PAM sequence: AGG
tcatcaattcagccaatgca

SEQ ID NO: 123251 - DNA, 20 bp, Artificial Sequence
  Description of Artificial Sequence: Synthetic oligonucleotide
  Target: ATXN1; (+) strand; PAM type: NRG; PAM sequence: GAG
atcaattcagccaatgcaag

SEQ ID NO: 123252 - DNA, 20 bp, Artificial Sequence
  Description of Artificial Sequence: Synthetic oligonucleotide
  Target: ATXN1; (+) strand; PAM type: NRG; PAM sequence: AAG
ttcagccaatgcaaggagtg

SEQ ID NO: 123253 - DNA, 20 bp, Artificial Sequence
  Description of Artificial Sequence: Synthetic oligonucleotide
  Target: ATXN1; (+) strand; PAM type: NRG; PAM sequence: AAG
aagacttttaaatcccccta

SEQ ID NO: 123254 - DNA, 20 bp, Artificial Sequence
  Description of Artificial Sequence: Synthetic oligonucleotide
  Target: ATXN1; (+) strand; PAM type: NRG; PAM sequence: CAG
tttaaatccccctaaagcat

SEQ ID NO: 123255 - DNA, 20 bp, Artificial Sequence
  Description of Artificial Sequence: Synthetic oligonucleotide
  Target: ATXN1; (+) strand; PAM type: NRG; PAM sequence: TGG
aaagcatcagttctccaact

SEQ ID NO: 123256 - DNA, 20 bp, Artificial Sequence
  Description of Artificial Sequence: Synthetic oligonucleotide
  Target: ATXN1; (+) strand; PAM type: NRG; PAM sequence: CAG
ggctacacattgtgaccacc

SEQ ID NO: 123257 - DNA, 20 bp, Artificial Sequence
  Description of Artificial Sequence: Synthetic oligonucleotide
  Target: ATXN1; (+) strand; PAM type: NRG; PAM sequence: GAG
ctacacattgtgaccaccca

SEQ ID NO: 123258 - DNA, 20 bp, Artificial Sequence
  Description of Artificial Sequence: Synthetic oligonucleotide
  Target: ATXN1; (+) strand; PAM type: NRG; PAM sequence: GAG
acacattgtgaccacccaga

SEQ ID NO: 123259 - DNA, 20 bp, Artificial Sequence
  Description of Artificial Sequence: Synthetic oligonucleotide
  Target: ATXN1; (+) strand; PAM type: NRG; PAM sequence: TAG
tgtgaccacccagagagatt

SEQ ID NO: 123260 - DNA, 20 bp, Artificial Sequence
  Description of Artificial Sequence: Synthetic oligonucleotide
  Target: ATXN1; (+) strand; PAM type: NRG; PAM sequence: AAG
accacccagagagatttaga

SEQ ID NO: 123261 - DNA, 20 bp, Artificial Sequence
  Description of Artificial Sequence: Synthetic oligonucleotide
  Target: ATXN1; (+) strand; PAM type: NRG; PAM sequence: TGG
atttagaaagtactaatgtc

SEQ ID NO: 123262 - DNA, 20 bp, Artificial Sequence
  Description of Artificial Sequence: Synthetic oligonucleotide
  Target: ATXN1; (+) strand; PAM type: NRG; PAM sequence: GGG
tttagaaagtactaatgtct

SEQ ID NO: 123263 - DNA, 20 bp, Artificial Sequence
  Description of Artificial Sequence: Synthetic oligonucleotide
  Target: ATXN1; (+) strand; PAM type: NRG; PAM sequence: CAG
taatgtctgggttccaccca

SEQ ID NO: 123264 - DNA, 20 bp, Artificial Sequence
  Description of Artificial Sequence: Synthetic oligonucleotide
  Target: ATXN1; (+) strand; PAM type: NRG; PAM sequence: GAG
atgtctgggttccacccaca

SEQ ID NO: 123265 - DNA, 20 bp, Artificial Sequence
  Description of Artificial Sequence: Synthetic oligonucleotide
  Target: ATXN1; (+) strand; PAM type: NRG; PAM sequence: TGG
cacagagatccttacttaac

SEQ ID NO: 123266 - DNA, 20 bp, Artificial Sequence
  Description of Artificial Sequence: Synthetic oligonucleotide
  Target: ATXN1; (+) strand; PAM type: NRG; PAM sequence: TGG
agatccttacttaactggtc

SEQ ID NO: 123267 - DNA, 20 bp, Artificial Sequence
  Description of Artificial Sequence: Synthetic oligonucleotide
  Target: ATXN1; (+) strand; PAM type: NRG; PAM sequence: GGG
gatccttacttaactggtct

SEQ ID NO: 123268 - DNA, 20 bp, Artificial Sequence
  Description of Artificial Sequence: Synthetic oligonucleotide
  Target: ATXN1; (+) strand; PAM type: NRG; PAM sequence: GGG
atccttacttaactggtctg

SEQ ID NO: 123269 - DNA, 20 bp, Artificial Sequence
  Description of Artificial Sequence: Synthetic oligonucleotide
  Target: ATXN1; (+) strand; PAM type: NRG; PAM sequence: TGG
tacttaactggtctggggta

SEQ ID NO: 123270 - DNA, 20 bp, Artificial Sequence
  Description of Artificial Sequence: Synthetic oligonucleotide
  Target: ATXN1; (+) strand; PAM type: NRG; PAM sequence: CAG
aactggtctggggtatggct

SEQ ID NO: 123271 - DNA, 20 bp, Artificial Sequence
  Description of Artificial Sequence: Synthetic oligonucleotide
  Target: ATXN1; (+) strand; PAM type: NRG; PAM sequence: AGG
actggtctggggtatggctc

SEQ ID NO: 123272 - DNA, 20 bp, Artificial Sequence
  Description of Artificial Sequence: Synthetic oligonucleotide
  Target: ATXN1; (+) strand; PAM type: NRG; PAM sequence: TAG
ctggggtatggctcaggcaa

SEQ ID NO: 123273 - DNA, 20 bp, Artificial Sequence
  Description of Artificial Sequence: Synthetic oligonucleotide
  Target: ATXN1; (+) strand; PAM type: NRG; PAM sequence: TGG
tggctcaggcaatagaattt

SEQ ID NO: 123274 - DNA, 20 bp, Artificial Sequence
  Description of Artificial Sequence: Synthetic oligonucleotide
  Target: ATXN1; (+) strand; PAM type: NRG; PAM sequence: AAG
tcaggcaatagaattttgga

SEQ ID NO: 123275 - DNA, 20 bp, Artificial Sequence
  Description of Artificial Sequence: Synthetic oligonucleotide
  Target: ATXN1; (+) strand; PAM type: NRG; PAM sequence: AAG
agaattttggaaagctcccc

SEQ ID NO: 123276 - DNA, 20 bp, Artificial Sequence
  Description of Artificial Sequence: Synthetic oligonucleotide
  Target: ATXN1; (+) strand; PAM type: NRG; PAM sequence: CAG
ccccaagtgattctactatg

SEQ ID NO: 123277 - DNA, 20 bp, Artificial Sequence
  Description of Artificial Sequence: Synthetic oligonucleotide
  Target: ATXN1; (+) strand; PAM type: NRG; PAM sequence: AAG
agtgattctactatgcagcc

SEQ ID NO: 123278 - DNA, 20 bp, Artificial Sequence
  Description of Artificial Sequence: Synthetic oligonucleotide
  Target: ATXN1; (+) strand; PAM type: NRG; PAM sequence: AGG
gtgattctactatgcagcca

SEQ ID NO: 123279 - DNA, 20 bp, Artificial Sequence
  Description of Artificial Sequence: Synthetic oligonucleotide
  Target: ATXN1; (+) strand; PAM type: NRG; PAM sequence: TGG
attctactatgcagccaagg

SEQ ID NO: 123280 - DNA, 20 bp, Artificial Sequence
  Description of Artificial Sequence: Synthetic oligonucleotide
  Target: ATXN1; (+) strand; PAM type: NRG; PAM sequence: GAG
tctactatgcagccaaggtg

SEQ ID NO: 123281 - DNA, 20 bp, Artificial Sequence
  Description of Artificial Sequence: Synthetic oligonucleotide
  Target: ATXN1; (+) strand; PAM type: NRG; PAM sequence: GAG
tactatgcagccaaggtgga

SEQ ID NO: 123282 - DNA, 20 bp, Artificial Sequence
  Description of Artificial Sequence: Synthetic oligonucleotide
  Target: ATXN1; (+) strand; PAM type: NRG; PAM sequence: AAG
ggtggagagtcactgtcctg

SEQ ID NO: 123283 - DNA, 20 bp, Artificial Sequence
  Description of Artificial Sequence: Synthetic oligonucleotide
  Target: ATXN1; (+) strand; PAM type: NRG; PAM sequence: CAG
agtcactgtcctgaagtcat

SEQ ID NO: 123284 - DNA, 20 bp, Artificial Sequence
  Description of Artificial Sequence: Synthetic oligonucleotide
  Target: ATXN1; (+) strand; PAM type: NRG; PAM sequence: GAG
tcactgtcctgaagtcatca

SEQ ID NO: 123285 - DNA, 20 bp, Artificial Sequence
  Description of Artificial Sequence: Synthetic oligonucleotide
  Target: ATXN1; (+) strand; PAM type: NRG; PAM sequence: AGG
cactgtcctgaagtcatcag

SEQ ID NO: 123286 - DNA, 20 bp, Artificial Sequence
  Description of Artificial Sequence: Synthetic oligonucleotide
  Target: ATXN1; (+) strand; PAM type: NRG; PAM sequence: AAG
tgccacctactcctcccaca

SEQ ID NO: 123287 - DNA, 20 bp, Artificial Sequence
  Description of Artificial Sequence: Synthetic oligonucleotide
  Target: ATXN1; (+) strand; PAM type: NRG; PAM sequence: AGG
gccacctactcctcccacaa

SEQ ID NO: 123288 - DNA, 20 bp, Artificial Sequence
  Description of Artificial Sequence: Synthetic oligonucleotide
  Target: ATXN1; (+) strand; PAM type: NRG; PAM sequence: TGG
acctactcctcccacaaagg

SEQ ID NO: 123289 - DNA, 20 bp, Artificial Sequence
  Description of Artificial Sequence: Synthetic oligonucleotide
  Target: ATXN1; (+) strand; PAM type: NRG; PAM sequence: AAG
tgtcaccttgcaccacttgc

SEQ ID NO: 123290 - DNA, 20 bp, Artificial Sequence
  Description of Artificial Sequence: Synthetic oligonucleotide
  Target: ATXN1; (+) strand; PAM type: NRG; PAM sequence: TAG
ttgcaccacttgcaagcaat

SEQ ID NO: 123291 - DNA, 20 bp, Artificial Sequence
  Description of Artificial Sequence: Synthetic oligonucleotide
  Target: ATXN1; (+) strand; PAM type: NRG; PAM sequence: AGG
tgcaccacttgcaagcaatt

SEQ ID NO: 123292 - DNA, 20 bp, Artificial Sequence
  Description of Artificial Sequence: Synthetic oligonucleotide
  Target: ATXN1; (+) strand; PAM type: NRG; PAM sequence: GGG
gcaccacttgcaagcaatta

SEQ ID NO: 123293 - DNA, 20 bp, Artificial Sequence
  Description of Artificial Sequence: Synthetic oligonucleotide
  Target: ATXN1; (+) strand; PAM type: NRG; PAM sequence: AAG
gtacatttacatgattttaa

SEQ ID NO: 123294 - DNA, 20 bp, Artificial Sequence
  Description of Artificial Sequence: Synthetic oligonucleotide
  Target: ATXN1; (+) strand; PAM type: NRG; PAM sequence: CAG
aaaacttgaatttcttgtat

SEQ ID NO: 123295 - DNA, 20 bp, Artificial Sequence
  Description of Artificial Sequence: Synthetic oligonucleotide
  Target: ATXN1; (+) strand; PAM type: NRG; PAM sequence: AAG
tcttctcaacaaccgtgtga

SEQ ID NO: 123296 - DNA, 20 bp, Artificial Sequence
  Description of Artificial Sequence: Synthetic oligonucleotide
  Target: ATXN1; (+) strand; PAM type: NRG; PAM sequence: AAG
ctcaacaaccgtgtgaaagt

SEQ ID NO: 123297 - DNA, 20 bp, Artificial Sequence
  Description of Artificial Sequence: Synthetic oligonucleotide
  Target: ATXN1; (+) strand; PAM type: NRG; PAM sequence: GAG
attgttcccatatgacacac

SEQ ID NO: 123298 - DNA, 20 bp, Artificial Sequence
  Description of Artificial Sequence: Synthetic oligonucleotide
  Target: ATXN1; (+) strand; PAM type: NRG; PAM sequence: AGG
ttgttcccatatgacacacg

SEQ ID NO: 123299 - DNA, 20 bp, Artificial Sequence
  Description of Artificial Sequence: Synthetic oligonucleotide
  Target: ATXN1; (+) strand; PAM type: NRG; PAM sequence: GAG
cacacgaggaaacaaactct

SEQ ID NO: 123300 - DNA, 20 bp, Artificial Sequence
  Description of Artificial Sequence: Synthetic oligonucleotide
  Target: ATXN1; (+) strand; PAM type: NRG; PAM sequence: GAG
cacgaggaaacaaactctga

SEQ ID NO: 123301 - DNA, 20 bp, Artificial Sequence
  Description of Artificial Sequence: Synthetic oligonucleotide
  Target: ATXN1; (+) strand; PAM type: NRG; PAM sequence: AAG
caaactctgagagattaatt

SEQ ID NO: 123302 - DNA, 20 bp, Artificial Sequence
  Description of Artificial Sequence: Synthetic oligonucleotide
  Target: ATXN1; (+) strand; PAM type: NRG; PAM sequence: CAG
ctgagagattaattaagcga

SEQ ID NO: 123303 - DNA, 20 bp, Artificial Sequence
  Description of Artificial Sequence: Synthetic oligonucleotide
  Target: ATXN1; (+) strand; PAM type: NRG; PAM sequence: TAG
gattaattaagcgacagccc

SEQ ID NO: 123304 - DNA, 20 bp, Artificial Sequence
  Description of Artificial Sequence: Synthetic oligonucleotide
  Target: ATXN1; (+) strand; PAM type: NRG; PAM sequence: CAG
taagcgacagccctagatca

SEQ ID NO: 123305 - DNA, 20 bp, Artificial Sequence
  Description of Artificial Sequence: Synthetic oligonucleotide
  Target: ATXN1; (+) strand; PAM type: NRG; PAM sequence: TGG
cagccctagatcacagaact

SEQ ID NO: 123306 - DNA, 20 bp, Artificial Sequence
  Description of Artificial Sequence: Synthetic oligonucleotide
  Target: ATXN1; (+) strand; PAM type: NRG; PAM sequence: AAG
ccctagatcacagaacttgg

SEQ ID NO: 123307 - DNA, 20 bp, Artificial Sequence
  Description of Artificial Sequence: Synthetic oligonucleotide
  Target: ATXN1; (+) strand; PAM type: NRG; PAM sequence: TGG
tagatcacagaacttggaag

SEQ ID NO: 123308 - DNA, 20 bp, Artificial Sequence
  Description of Artificial Sequence: Synthetic oligonucleotide
  Target: ATXN1; (+) strand; PAM type: NRG; PAM sequence: CAG
atcacagaacttggaagtgg

SEQ ID NO: 123309 - DNA, 20 bp, Artificial Sequence
  Description of Artificial Sequence: Synthetic oligonucleotide
  Target: ATXN1; (+) strand; PAM type: NRG; PAM sequence: CAG
atacaattgtttcaacccca

SEQ ID NO: 123310 - DNA, 20 bp, Artificial Sequence
  Description of Artificial Sequence: Synthetic oligonucleotide
  Target: ATXN1; (+) strand; PAM type: NRG; PAM sequence: CAG
tctgtatcattataatctcc

SEQ ID NO: 123311 - DNA, 20 bp, Artificial Sequence
  Description of Artificial Sequence: Synthetic oligonucleotide
  Target: ATXN1; (+) strand; PAM type: NRG; PAM sequence: AAG
taatctcccagtaatttcaa

SEQ ID NO: 123312 - DNA, 20 bp, Artificial Sequence
  Description of Artificial Sequence: Synthetic oligonucleotide
  Target: ATXN1; (+) strand; PAM type: NRG; PAM sequence: AGG
aatctcccagtaatttcaaa

SEQ ID NO: 123313 - DNA, 20 bp, Artificial Sequence
  Description of Artificial Sequence: Synthetic oligonucleotide
  Target: ATXN1; (+) strand; PAM type: NRG; PAM sequence: GGG
atctcccagtaatttcaaaa

SEQ ID NO: 123314 - DNA, 20 bp, Artificial Sequence
  Description of Artificial Sequence: Synthetic oligonucleotide
  Target: ATXN1; (+) strand; PAM type: NRG; PAM sequence: GAG
tcaaaagggccaaccactgt

SEQ ID NO: 123315 - DNA, 20 bp, Artificial Sequence
  Description of Artificial Sequence: Synthetic oligonucleotide
  Target: ATXN1; (+) strand; PAM type: NRG; PAM sequence: TGG
agggccaaccactgtgagtg

SEQ ID NO: 123316 - DNA, 20 bp, Artificial Sequence
  Description of Artificial Sequence: Synthetic oligonucleotide
  Target: ATXN1; (+) strand; PAM type: NRG; PAM sequence: GGG
gggccaaccactgtgagtgt

SEQ ID NO: 123317 - DNA, 20 bp, Artificial Sequence
  Description of Artificial Sequence: Synthetic oligonucleotide
  Target: ATXN1; (+) strand; PAM type: NRG; PAM sequence: TGG
gtgagtgtgggcatgtaatt

SEQ ID NO: 123318 - DNA, 20 bp, Artificial Sequence
  Description of Artificial Sequence: Synthetic oligonucleotide
  Target: ATXN1; (+) strand; PAM type: NRG; PAM sequence: TGG
atttggttgcatcttcaatg

SEQ ID NO: 123319 - DNA, 20 bp, Artificial Sequence
  Description of Artificial Sequence: Synthetic oligonucleotide
  Target: ATXN1; (+) strand; PAM type: NRG; PAM sequence: TGG
tcaatgtggcacccatcttg

SEQ ID NO: 123320 - DNA, 20 bp, Artificial Sequence
  Description of Artificial Sequence: Synthetic oligonucleotide
  Target: ATXN1; (+) strand; PAM type: NRG; PAM sequence: TGG
gtggcacccatcttgtggaa

SEQ ID NO: 123321 - DNA, 20 bp, Artificial Sequence
  Description of Artificial Sequence: Synthetic oligonucleotide
  Target: ATXN1; (+) strand; PAM type: NRG; PAM sequence: GGG
tggcacccatcttgtggaat

SEQ ID NO: 123322 - DNA, 20 bp, Artificial Sequence
  Description of Artificial Sequence: Synthetic oligonucleotide
  Target: ATXN1; (+) strand; PAM type: NRG; PAM sequence: GAG
cccatcttgtggaatgggac

SEQ ID NO: 123323 - DNA, 20 bp, Artificial Sequence
  Description of Artificial Sequence: Synthetic oligonucleotide
  Target: ATXN1; (+) strand; PAM type: NRG; PAM sequence: AGG
ccatcttgtggaatgggacg

SEQ ID NO: 123324 - DNA, 20 bp, Artificial Sequence
  Description of Artificial Sequence: Synthetic oligonucleotide
  Target: ATXN1; (+) strand; PAM type: NRG; PAM sequence: GGG
catcttgtggaatgggacga

SEQ ID NO: 123325 - DNA, 20 bp, Artificial Sequence
  Description of Artificial Sequence: Synthetic oligonucleotide
  Target: ATXN1; (+) strand; PAM type: NRG; PAM sequence: GGG
atcttgtggaatgggacgag

SEQ ID NO: 123326 - DNA, 20 bp, Artificial Sequence
  Description of Artificial Sequence: Synthetic oligonucleotide
  Target: ATXN1; (+) strand; PAM type: NRG; PAM sequence: AAG
gaggggataacaactcgctg

SEQ ID NO: 123327 - DNA, 20 bp, Artificial Sequence
  Description of Artificial Sequence: Synthetic oligonucleotide
  Target: ATXN1; (+) strand; PAM type: NRG; PAM sequence: GAG
ggggataacaactcgctgaa

SEQ ID NO: 123328 - DNA, 20 bp, Artificial Sequence
  Description of Artificial Sequence: Synthetic oligonucleotide
  Target: ATXN1; (+) strand; PAM type: NRG; PAM sequence: TAG
taacaactcgctgaagagaa

SEQ ID NO: 123329 - DNA, 20 bp, Artificial Sequence
  Description of Artificial Sequence: Synthetic oligonucleotide
  Target: ATXN1; (+) strand; PAM type: NRG; PAM sequence: CAG
caactcgctgaagagaatag

SEQ ID NO: 123330 - DNA, 20 bp, Artificial Sequence
  Description of Artificial Sequence: Synthetic oligonucleotide
  Target: ATXN1; (+) strand; PAM type: NRG; PAM sequence: AGG
aactcgctgaagagaatagc

SEQ ID NO: 123331 - DNA, 20 bp, Artificial Sequence
  Description of Artificial Sequence: Synthetic oligonucleotide
  Target: ATXN1; (+) strand; PAM type: NRG; PAM sequence: CGG
atagcaggcactacctctgt

SEQ ID NO: 123332 - DNA, 20 bp, Artificial Sequence
  Description of Artificial Sequence: Synthetic oligonucleotide
  Target: ATXN1; (+) strand; PAM type: NRG; PAM sequence: TGG
ttctctatattgtatgcatg

SEQ ID NO: 123333 - DNA, 20 bp, Artificial Sequence
  Description of Artificial Sequence: Synthetic oligonucleotide
  Target: ATXN1; (+) strand; PAM type: NRG; PAM sequence: GGG
tctctatattgtatgcatgt

SEQ ID NO: 123334 - DNA, 20 bp, Artificial Sequence
  Description of Artificial Sequence: Synthetic oligonucleotide
  Target: ATXN1; (+) strand; PAM type: NRG; PAM sequence: GAG
ttgtatgcatgtgggtgtgt

SEQ ID NO: 123335 - DNA, 20 bp, Artificial Sequence
  Description of Artificial Sequence: Synthetic oligonucleotide
  Target: ATXN1; (+) strand; PAM type: NRG; PAM sequence: AAG
gtgggtgtgtgagtgtacat

SEQ ID NO: 123336 - DNA, 20 bp, Artificial Sequence
  Description of Artificial Sequence: Synthetic oligonucleotide
  Target: ATXN1; (+) strand; PAM type: NRG; PAM sequence: AAG
acataagtgtatgtccacct

SEQ ID NO: 123337 - DNA, 20 bp, Artificial Sequence
  Description of Artificial Sequence: Synthetic oligonucleotide
  Target: ATXN1; (+) strand; PAM type: NRG; PAM sequence: AGG
cataagtgtatgtccaccta

SEQ ID NO: 123338 - DNA, 20 bp, Artificial Sequence
  Description of Artificial Sequence: Synthetic oligonucleotide
  Target: ATXN1; (+) strand; PAM type: NRG; PAM sequence: AAG
agtgtatgtccacctaagga

SEQ ID NO: 123339 - DNA, 20 bp, Artificial Sequence
  Description of Artificial Sequence: Synthetic oligonucleotide
  Target: ATXN1; (+) strand; PAM type: NRG; PAM sequence: TGG
gtatgtccacctaaggaaag

SEQ ID NO: 123340 - DNA, 20 bp, Artificial Sequence
  Description of Artificial Sequence: Synthetic oligonucleotide
  Target: ATXN1; (+) strand; PAM type: NRG; PAM sequence: AAG
acctaaggaaagtggacctc

SEQ ID NO: 123341 - DNA, 20 bp, Artificial Sequence
  Description of Artificial Sequence: Synthetic oligonucleotide
  Target: ATXN1; (+) strand; PAM type: NRG; PAM sequence: AGG
cctaaggaaagtggacctca

SEQ ID NO: 123342 - DNA, 20 bp, Artificial Sequence
  Description of Artificial Sequence: Synthetic oligonucleotide
  Target: ATXN1; (+) strand; PAM type: NRG; PAM sequence: GGG
ctaaggaaagtggacctcaa

SEQ ID NO: 123343 - DNA, 20 bp, Artificial Sequence
  Description of Artificial Sequence: Synthetic oligonucleotide
  Target: ATXN1; (+) strand; PAM type: NRG; PAM sequence: GAG
ctcaagggtatatctgaatt

SEQ ID NO: 123344 - DNA, 20 bp, Artificial Sequence
  Description of Artificial Sequence: Synthetic oligonucleotide
  Target: ATXN1; (+) strand; PAM type: NRG; PAM sequence: TGG
tatctgaattgagaaacata

SEQ ID NO: 123345 - DNA, 20 bp, Artificial Sequence
  Description of Artificial Sequence: Synthetic oligonucleotide
  Target: ATXN1; (+) strand; PAM type: NRG; PAM sequence: AAG
gaaacatatggcccaactac

SEQ ID NO: 123346 - DNA, 20 bp, Artificial Sequence
  Description of Artificial Sequence: Synthetic oligonucleotide
  Target: ATXN1; (+) strand; PAM type: NRG; PAM sequence: AAG
acatatggcccaactacaag

SEQ ID NO: 123347 - DNA, 20 bp, Artificial Sequence
  Description of Artificial Sequence: Synthetic oligonucleotide
  Target: ATXN1; (+) strand; PAM type: NRG; PAM sequence: AGG
catatggcccaactacaaga

SEQ ID NO: 123348 - DNA, 20 bp, Artificial Sequence
  Description of Artificial Sequence: Synthetic oligonucleotide
  Target: ATXN1; (+) strand; PAM type: NRG; PAM sequence: TGG
cccaactacaagaaggtacc

SEQ ID NO: 123349 - DNA, 20 bp, Artificial Sequence
  Description of Artificial Sequence: Synthetic oligonucleotide
  Target: ATXN1; (+) strand; PAM type: NRG; PAM sequence: GGG
ccaactacaagaaggtacct

SEQ ID NO: 123350 - DNA, 20 bp, Artificial Sequence
  Description of Artificial Sequence: Synthetic oligonucleotide
  Target: ATXN1; (+) strand; PAM type: NRG; PAM sequence: TAG
actacaagaaggtacctggg

SEQ ID NO: 123351 - DNA, 20 bp, Artificial Sequence
  Description of Artificial Sequence: Synthetic oligonucleotide
  Target: ATXN1; (+) strand; PAM type: NRG; PAM sequence: AGG
ctacaagaaggtacctgggt

SEQ ID NO: 123352 - DNA, 20 bp, Artificial Sequence
  Description of Artificial Sequence: Synthetic oligonucleotide
  Target: ATXN1; (+) strand; PAM type: NRG; PAM sequence: GGG
tacaagaaggtacctgggta

SEQ ID NO: 123353 - DNA, 20 bp, Artificial Sequence
  Description of Artificial Sequence: Synthetic oligonucleotide
  Target: ATXN1; (+) strand; PAM type: NRG; PAM sequence: CAG
aggtacctgggtagggtttt

SEQ ID NO: 123354 - DNA, 20 bp, Artificial Sequence
  Description of Artificial Sequence: Synthetic oligonucleotide
  Target: ATXN1; (+) strand; PAM type: NRG; PAM sequence: GAG
gtacctgggtagggttttca

SEQ ID NO: 123355 - DNA, 20 bp, Artificial Sequence
  Description of Artificial Sequence: Synthetic oligonucleotide
  Target: ATXN1; (+) strand; PAM type: NRG; PAM sequence: TAG
gggtagggttttcagagatg

SEQ ID NO: 123356 - DNA, 20 bp, Artificial Sequence
  Description of Artificial Sequence: Synthetic oligonucleotide
  Target: ATXN1; (+) strand; PAM type: NRG; PAM sequence: AAG
gagatgtagtaattctttcc

SEQ ID NO: 123357 - DNA, 20 bp, Artificial Sequence
  Description of Artificial Sequence: Synthetic oligonucleotide
  Target: ATXN1; (+) strand; PAM type: NRG; PAM sequence: AAG
aattctttccaagatgtgat

SEQ ID NO: 123358 - DNA, 20 bp, Artificial Sequence
  Description of Artificial Sequence: Synthetic oligonucleotide
  Target: ATXN1; (+) strand; PAM type: NRG; PAM sequence: TGG
tttccaagatgtgataagac

SEQ ID NO: 123359 - DNA, 20 bp, Artificial Sequence
  Description of Artificial Sequence: Synthetic oligonucleotide
  Target: ATXN1; (+) strand; PAM type: NRG; PAM sequence: AAG
agatgtgataagactggtaa

SEQ ID NO: 123360 - DNA, 20 bp, Artificial Sequence
  Description of Artificial Sequence: Synthetic oligonucleotide
  Target: ATXN1; (+) strand; PAM type: NRG; PAM sequence: AGG
gatgtgataagactggtaaa

SEQ ID NO: 123361 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaaaaaaacatt

SEQ ID NO: 123362 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaaaaaaaacattg

SEQ ID NO: 123363 - DNA, 20 bp, Artificial Sequence
  Description of Artificial Sequence: Synthetic oligonucleotide
  Target: ATXN1; (+) strand; PAM type: NRG; PAM sequence: TGG
actaccaattcattcattta

SEQ ID NO: 123364 - DNA, 20 bp, Artificial Sequence
  Description of Artificial Sequence: Synthetic oligonucleotide
  Target: ATXN1; (+) strand; PAM type: NRG; PAM sequence: TAG
attcatctaatgcccatata

SEQ ID NO: 123365 - DNA, 20 bp, Artificial Sequence
  Description of Artificial Sequence: Synthetic oligonucleotide
  Target: ATXN1; (+) strand; PAM type: NRG; PAM sequence: AAG
atgcccatatatagattaca

SEQ ID NO: 123366 - DNA, 20 bp, Artificial Sequence
  Description of Artificial Sequence: Synthetic oligonucleotide
  Target: ATXN1; (+) strand; PAM type: NRG; PAM sequence: CAG
tatagattacaaagcttaat

SEQ ID NO: 123367 - DNA, 20 bp, Artificial Sequence
  Description of Artificial Sequence: Synthetic oligonucleotide
  Target: ATXN1; (+) strand; PAM type: NRG; PAM sequence: TAG
agattacaaagcttaatcag

SEQ ID NO: 123368 - DNA, 20 bp, Artificial Sequence
  Description of Artificial Sequence: Synthetic oligonucleotide
  Target: ATXN1; (+) strand; PAM type: NRG; PAM sequence: GAG
tacaaagcttaatcagtagt

SEQ ID NO: 123369 - DNA, 20 bp, Artificial Sequence
  Description of Artificial Sequence: Synthetic oligonucleotide
  Target: ATXN1; (+) strand; PAM type: NRG; PAM sequence: AAG
cttaatcagtagtgagtgac

SEQ ID NO: 123370 - DNA, 20 bp, Artificial Sequence
  Description of Artificial Sequence: Synthetic oligonucleotide
  Target: ATXN1; (+) strand; PAM type: NRG; PAM sequence: AAG
agtagtgagtgacaagactg

SEQ ID NO: 123371 - DNA, 20 bp, Artificial Sequence
  Description of Artificial Sequence: Synthetic oligonucleotide
  Target: ATXN1; (+) strand; PAM type: NRG; PAM sequence: CAG
gtgacaagactgaagaatat

SEQ ID NO: 123372 - DNA, 20 bp, Artificial Sequence
  Description of Artificial Sequence: Synthetic oligonucleotide
  Target: ATXN1; (+) strand; PAM type: NRG; PAM sequence: AGG
tgacaagactgaagaatatc

SEQ ID NO: 123373 - DNA, 20 bp, Artificial Sequence
  Description of Artificial Sequence: Synthetic oligonucleotide
  Target: ATXN1; (+) strand; PAM type: NRG; PAM sequence: CAG
atctcccatacttaaatatt

SEQ ID NO: 123374 - DNA, 20 bp, Artificial Sequence
  Description of Artificial Sequence: Synthetic oligonucleotide
  Target: ATXN1; (+) strand; PAM type: NRG; PAM sequence: AGG
tctcccatacttaaatattc

SEQ ID NO: 123375 - DNA, 20 bp, Artificial Sequence
  Description of Artificial Sequence: Synthetic oligonucleotide
  Target: ATXN1; (+) strand; PAM type: NRG; PAM sequence: TAG
aaatattcaggttcttataa

SEQ ID NO: 123376 - DNA, 20 bp, Artificial Sequence
  Description of Artificial Sequence: Synthetic oligonucleotide
  Target: ATXN1; (+) strand; PAM type: NRG; PAM sequence: AAG
ttcaggttcttataatagac

SEQ ID NO: 123377 - DNA, 20 bp, Artificial Sequence
  Description of Artificial Sequence: Synthetic oligonucleotide
  Target: ATXN1; (+) strand; PAM type: NRG; PAM sequence: TGG
tcatcttgtctgccaatgca

SEQ ID NO: 123378 - DNA, 20 bp, Artificial Sequence
  Description of Artificial Sequence: Synthetic oligonucleotide
  Target: ATXN1; (+) strand; PAM type: NRG; PAM sequence: GGG
catcttgtctgccaatgcat

SEQ ID NO: 123379 - DNA, 20 bp, Artificial Sequence
  Description of Artificial Sequence: Synthetic oligonucleotide
  Target: ATXN1; (+) strand; PAM type: NRG; PAM sequence: GGG
atcttgtctgccaatgcatg

SEQ ID NO: 123380 - DNA, 20 bp, Artificial Sequence
  Description of Artificial Sequence: Synthetic oligonucleotide
  Target: ATXN1; (+) strand; PAM type: NRG; PAM sequence: TAG
aatgcatggggcacattaac

SEQ ID NO: 123381 - DNA, 20 bp, Artificial Sequence
  Description of Artificial Sequence: Synthetic oligonucleotide
  Target: ATXN1; (+) strand; PAM type: NRG; PAM sequence: TAG
attaactagccttgacacaa

SEQ ID NO: 123382 - DNA, 20 bp, Artificial Sequence
  Description of Artificial Sequence: Synthetic oligonucleotide
  Target: ATXN1; (+) strand; PAM type: NRG; PAM sequence: TAG
aactagccttgacacaatag

SEQ ID NO: 123383 - DNA, 20 bp, Artificial Sequence
  Description of Artificial Sequence: Synthetic oligonucleotide
  Target: ATXN1; (+) strand; PAM type: NRG; PAM sequence: CAG
gacacaatagtagaacaaat

SEQ ID NO: 123384 - DNA, 20 bp, Artificial Sequence
  Description of Artificial Sequence: Synthetic oligonucleotide
  Target: ATXN1; (+) strand; PAM type: NRG; PAM sequence: TGG
atagtagaacaaatcagaat

SEQ ID NO: 123385 - DNA, 20 bp, Artificial Sequence
  Description of Artificial Sequence: Synthetic oligonucleotide
  Target: ATXN1; (+) strand; PAM type: NRG; PAM sequence: TGG
gtaaaatgtattattaatga

SEQ ID NO: 123386 - DNA, 20 bp, Artificial Sequence
  Description of Artificial Sequence: Synthetic oligonucleotide
  Target: ATXN1; (+) strand; PAM type: NRG; PAM sequence: TAG
aaatgtattattaatgatgg

SEQ ID NO: 123387 - DNA, 20 bp, Artificial Sequence
  Description of Artificial Sequence: Synthetic oligonucleotide
  Target: ATXN1; (+) strand; PAM type: NRG; PAM sequence: TGG
ttattaatgatggtagaaat

SEQ ID NO: 123388 - DNA, 20 bp, Artificial Sequence
  Description of Artificial Sequence: Synthetic oligonucleotide
  Target: ATXN1; (+) strand; PAM type: NRG; PAM sequence: GGG
tattaatgatggtagaaatt

SEQ ID NO: 123389 - DNA, 20 bp, Artificial Sequence
  Description of Artificial Sequence: Synthetic oligonucleotide
  Target: ATXN1; (+) strand; PAM type: NRG; PAM sequence: AAG
taatgatggtagaaattggg

SEQ ID NO: 123390 - DNA, 20 bp, Artificial Sequence
  Description of Artificial Sequence: Synthetic oligonucleotide
  Target: ATXN1; (+) strand; PAM type: NRG; PAM sequence: GAG
gatggtagaaattgggaagt

SEQ ID NO: 123391 - DNA, 20 bp, Artificial Sequence
  Description of Artificial Sequence: Synthetic oligonucleotide
  Target: ATXN1; (+) strand; PAM type: NRG; PAM sequence: TGG
ttttttctcttattttaaac

SEQ ID NO: 123392 - DNA, 20 bp, Artificial Sequence
  Description of Artificial Sequence: Synthetic oligonucleotide
  Target: ATXN1; (+) strand; PAM type: NRG; PAM sequence: TAG
aactggtgcactcaaatgtg

SEQ ID NO: 123393 - DNA, 20 bp, Artificial Sequence
  Description of Artificial Sequence: Synthetic oligonucleotide
  Target: ATXN1; (+) strand; PAM type: NRG; PAM sequence: AGG
actggtgcactcaaatgtgt

SEQ ID NO: 123394 - DNA, 20 bp, Artificial Sequence
  Description of Artificial Sequence: Synthetic oligonucleotide
  Target: ATXN1; (+) strand; PAM type: NRG; PAM sequence: GAG
gtaggtttgtgcatgtgcgt

SEQ ID NO: 123395 - DNA, 20 bp, Artificial Sequence
  Description of Artificial Sequence: Synthetic oligonucleotide
  Target: ATXN1; (+) strand; PAM type: NRG; PAM sequence: AAG
gcatacacacaatcacacac

SEQ ID NO: 123396 - DNA, 20 bp, Artificial Sequence
  Description of Artificial Sequence: Synthetic oligonucleotide
  Target: ATXN1; (+) strand; PAM type: NRG; PAM sequence: AGG
catacacacaatcacacaca

SEQ ID NO: 123397 - DNA, 20 bp, Artificial Sequence
  Description of Artificial Sequence: Synthetic oligonucleotide
  Target: ATXN1; (+) strand; PAM type: NRG; PAM sequence: GAG
cacaatcacacacaaggctt

SEQ ID NO: 123398 - DNA, 20 bp, Artificial Sequence
  Description of Artificial Sequence: Synthetic oligonucleotide
  Target: ATXN1; (+) strand; PAM type: NRG; PAM sequence: AAG
tcacacacaaggcttgagtg

SEQ ID NO: 123399 - DNA, 20 bp, Artificial Sequence
  Description of Artificial Sequence: Synthetic oligonucleotide
  Target: ATXN1; (+) strand; PAM type: NRG; PAM sequence: CAG
cttgagtgaagactccattt

SEQ ID NO: 123400 - DNA, 20 bp, Artificial Sequence
  Description of Artificial Sequence: Synthetic oligonucleotide
  Target: ATXN1; (+) strand; PAM type: NRG; PAM sequence: CAG
ttcagttctgccattgttca

SEQ ID NO: 123401 - DNA, 20 bp, Artificial Sequence
  Description of Artificial Sequence: Synthetic oligonucleotide
  Target: ATXN1; (+) strand; PAM type: NRG; PAM sequence: AGG
tcagttctgccattgttcac

SEQ ID NO: 123402 - DNA, 20 bp, Artificial Sequence
  Description of Artificial Sequence: Synthetic oligonucleotide
  Target: ATXN1; (+) strand; PAM type: NRG; PAM sequence: AAG
aacttacttttccttaaaac

SEQ ID NO: 123403 - DNA, 20 bp, Artificial Sequence
  Description of Artificial Sequence: Synthetic oligonucleotide
  Target: ATXN1; (+) strand; PAM type: NRG; PAM sequence: AGG
acttacttttccttaaaaca

SEQ ID NO: 123404 - DNA, 20 bp, Artificial Sequence
  Description of Artificial Sequence: Synthetic oligonucleotide
  Target: ATXN1; (+) strand; PAM type: NRG; PAM sequence: AAG
acttttccttaaaacaagga

SEQ ID NO: 123405 - DNA, 20 bp, Artificial Sequence
  Description of Artificial Sequence: Synthetic oligonucleotide
  Target: ATXN1; (+) strand; PAM type: NRG; PAM sequence: AGG
cttttccttaaaacaaggaa

SEQ ID NO: 123406 - DNA, 20 bp, Artificial Sequence
  Description of Artificial Sequence: Synthetic oligonucleotide
  Target: ATXN1; (+) strand; PAM type: NRG; PAM sequence: GAG
tttccttaaaacaaggaaag

SEQ ID NO: 123407 - DNA, 20 bp, Artificial Sequence
  Description of Artificial Sequence: Synthetic oligonucleotide
  Target: ATXN1; (+) strand; PAM type: NRG; PAM sequence: AGG
ttccttaaaacaaggaaagg

SEQ ID NO: 123408 - DNA, 20 bp, Artificial Sequence
  Description of Artificial Sequence: Synthetic oligonucleotide
  Target: ATXN1; (+) strand; PAM type: NRG; PAM sequence: GGG
tccttaaaacaaggaaagga

SEQ ID NO: 123409 - DNA, 20 bp, Artificial Sequence
  Description of Artificial Sequence: Synthetic oligonucleotide
  Target: ATXN1; (+) strand; PAM type: NRG; PAM sequence: AAG
tgtttccattattatgccat

SEQ ID NO: 123410 - DNA, 20 bp, Artificial Sequence
  Description of Artificial Sequence: Synthetic oligonucleotide
  Target: ATXN1; (+) strand; PAM type: NRG; PAM sequence: AGG
gtttccattattatgccata

SEQ ID NO: 123411 - DNA, 20 bp, Artificial Sequence
  Description of Artificial Sequence: Synthetic oligonucleotide
  Target: ATXN1; (+) strand; PAM type: NRG; PAM sequence: TGG
ttattatgccataaggaaac

SEQ ID NO: 123412 - DNA, 20 bp, Artificial Sequence
  Description of Artificial Sequence: Synthetic oligonucleotide
  Target: ATXN1; (+) strand; PAM type: NRG; PAM sequence: AAG
ttatgccataaggaaactgg

SEQ ID NO: 123413 - DNA, 20 bp, Artificial Sequence
  Description of Artificial Sequence: Synthetic oligonucleotide
  Target: ATXN1; (+) strand; PAM type: NRG; PAM sequence: AAG
atatttttaaattttacttt

SEQ ID NO: 123414 - DNA, 20 bp, Artificial Sequence
  Description of Artificial Sequence: Synthetic oligonucleotide
  Target: ATXN1; (+) strand; PAM type: NRG; PAM sequence: TGG
ttaaattttactttaagttc

SEQ ID NO: 123415 - DNA, 20 bp, Artificial Sequence
  Description of Artificial Sequence: Synthetic oligonucleotide
  Target: ATXN1; (+) strand; PAM type: NRG; PAM sequence: GGG
taaattttactttaagttct

SEQ ID NO: 123416 - DNA, 20 bp, Artificial Sequence
  Description of Artificial Sequence: Synthetic oligonucleotide
  Target: ATXN1; (+) strand; PAM type: NRG; PAM sequence: CAG
taagttctgggatacatgtg

SEQ ID NO: 123417 - DNA, 20 bp, Artificial Sequence
  Description of Artificial Sequence: Synthetic oligonucleotide
  Target: ATXN1; (+) strand; PAM type: NRG; PAM sequence: CAG
ggatacatgtgcagaacatg

SEQ ID NO: 123418 - DNA, 20 bp, Artificial Sequence
  Description of Artificial Sequence: Synthetic oligonucleotide
  Target: ATXN1; (+) strand; PAM type: NRG; PAM sequence: AGG
gatacatgtgcagaacatgc

SEQ ID NO: 123419 - DNA, 20 bp, Artificial Sequence
  Description of Artificial Sequence: Synthetic oligonucleotide
  Target: ATXN1; (+) strand; PAM type: NRG; PAM sequence: TAG
gaacatgcaggtttgttaca

SEQ ID NO: 123420 - DNA, 20 bp, Artificial Sequence
  Description of Artificial Sequence: Synthetic oligonucleotide
  Target: ATXN1; (+) strand; PAM type: NRG; PAM sequence: AGG
aacatgcaggtttgttacat

SEQ ID NO: 123421 - DNA, 20 bp, Artificial Sequence
  Description of Artificial Sequence: Synthetic oligonucleotide
  Target: ATXN1; (+) strand; PAM type: NRG; PAM sequence: TGG
acataggtatacatgtgcca

SEQ ID NO: 123422 - DNA, 20 bp, Artificial Sequence
  Description of Artificial Sequence: Synthetic oligonucleotide
  Target: ATXN1; (+) strand; PAM type: NRG; PAM sequence: TGG
taggtatacatgtgccatgg

SEQ ID NO: 123423 - DNA, 20 bp, Artificial Sequence
  Description of Artificial Sequence: Synthetic oligonucleotide
  Target: ATXN1; (+) strand; PAM type: NRG; PAM sequence: TAG
gcacctatcaacccatcatc

SEQ ID NO: 123424 - DNA, 20 bp, Artificial Sequence
  Description of Artificial Sequence: Synthetic oligonucleotide
  Target: ATXN1; (+) strand; PAM type: NRG; PAM sequence: AGG
cacctatcaacccatcatct

SEQ ID NO: 123425 - DNA, 20 bp, Artificial Sequence
  Description of Artificial Sequence: Synthetic oligonucleotide
  Target: ATXN1; (+) strand; PAM type: NRG; PAM sequence: AAG
caacccatcatctaggtttt

SEQ ID NO: 123426 - DNA, 20 bp, Artificial Sequence
  Description of Artificial Sequence: Synthetic oligonucleotide
  Target: ATXN1; (+) strand; PAM type: NRG; PAM sequence: TAG
gttttaagcccctcatgcat

SEQ ID NO: 123427 - DNA, 20 bp, Artificial Sequence
  Description of Artificial Sequence: Synthetic oligonucleotide
  Target: ATXN1; (+) strand; PAM type: NRG; PAM sequence: AGG
ttttaagcccctcatgcatt

SEQ ID NO: 123428 - DNA, 20 bp, Artificial Sequence
  Description of Artificial Sequence: Synthetic oligonucleotide
  Target: ATXN1; (+) strand; PAM type: NRG; PAM sequence: TAG
ccttgccccccactcaccga

SEQ ID NO: 123429 - DNA, 20 bp, Artificial Sequence
  Description of Artificial Sequence: Synthetic oligonucleotide
  Target: ATXN1; (+) strand; PAM type: NRG; PAM sequence: AGG
cttgccccccactcaccgat

SEQ ID NO: 123430 - DNA, 20 bp, Artificial Sequence
  Description of Artificial Sequence: Synthetic oligonucleotide
  Target: ATXN1; (+) strand; PAM type: NRG; PAM sequence: TGG
ccccactcaccgataggccc

SEQ ID NO: 123431 - DNA, 20 bp, Artificial Sequence
  Description of Artificial Sequence: Synthetic oligonucleotide
  Target: ATXN1; (+) strand; PAM type: NRG; PAM sequence: GAG
cattattcaactcctactat

SEQ ID NO: 123432 - DNA, 20 bp, Artificial Sequence
  Description of Artificial Sequence: Synthetic oligonucleotide
  Target: ATXN1; (+) strand; PAM type: NRG; PAM sequence: GAG
attcaactcctactatgagt

SEQ ID NO: 123433 - DNA, 20 bp, Artificial Sequence
  Description of Artificial Sequence: Synthetic oligonucleotide
  Target: ATXN1; (+) strand; PAM type: NRG; PAM sequence: CGG
ctactatgagtgagaacatg

SEQ ID NO: 123434 - DNA, 20 bp, Artificial Sequence
  Description of Artificial Sequence: Synthetic oligonucleotide
  Target: ATXN1; (+) strand; PAM type: NRG; PAM sequence: TGG
gagtgagaacatgcggtgtt

SEQ ID NO: 123435 - DNA, 20 bp, Artificial Sequence
  Description of Artificial Sequence: Synthetic oligonucleotide
  Target: ATXN1; (+) strand; PAM type: NRG; PAM sequence: TAG
ttggttttctgttcctgtgt

SEQ ID NO: 123436 - DNA, 20 bp, Artificial Sequence
  Description of Artificial Sequence: Synthetic oligonucleotide
  Target: ATXN1; (+) strand; PAM type: NRG; PAM sequence: GAG
tgttcctgtgttagtttgct

SEQ ID NO: 123437 - DNA, 20 bp, Artificial Sequence
  Description of Artificial Sequence: Synthetic oligonucleotide
  Target: ATXN1; (+) strand; PAM type: NRG; PAM sequence: GAG
tgtgttagtttgctgagaat

SEQ ID NO: 123438 - DNA, 20 bp, Artificial Sequence
  Description of Artificial Sequence: Synthetic oligonucleotide
  Target: ATXN1; (+) strand; PAM type: NRG; PAM sequence: AGG
gtgttagtttgctgagaatg

SEQ ID NO: 123439 - DNA, 20 bp, Artificial Sequence
  Description of Artificial Sequence: Synthetic oligonucleotide
  Target: ATXN1; (+) strand; PAM type: NRG; PAM sequence: CAG
tttgctgagaatgaggcttc

SEQ ID NO: 123440 - DNA, 20 bp, Artificial Sequence
  Description of Artificial Sequence: Synthetic oligonucleotide
  Target: ATXN1; (+) strand; PAM type: NRG; PAM sequence: AAG
gcttcatccatgtccctgta

SEQ ID NO: 123441 - DNA, 20 bp, Artificial Sequence
  Description of Artificial Sequence: Synthetic oligonucleotide
  Target: ATXN1; (+) strand; PAM type: NRG; PAM sequence: AGG
cttcatccatgtccctgtaa

SEQ ID NO: 123442 - DNA, 20 bp, Artificial Sequence
  Description of Artificial Sequence: Synthetic oligonucleotide
  Target: ATXN1; (+) strand; PAM type: NRG; PAM sequence: GAG
catgtccctgtaaaggacat

SEQ ID NO: 123443 - DNA, 20 bp, Artificial Sequence
  Description of Artificial Sequence: Synthetic oligonucleotide
  Target: ATXN1; (+) strand; PAM type: NRG; PAM sequence: TGG
catgagctcattctttttta

SEQ ID NO: 123444 - DNA, 20 bp, Artificial Sequence
  Description of Artificial Sequence: Synthetic oligonucleotide
  Target: ATXN1; (+) strand; PAM type: NRG; PAM sequence: TAG
cattcttttttatggctgca

SEQ ID NO: 123445 - DNA, 20 bp, Artificial Sequence
  Description of Artificial Sequence: Synthetic oligonucleotide
  Target: ATXN1; (+) strand; PAM type: NRG; PAM sequence: TGG
tatggctgcatagtattcca

SEQ ID NO: 123446 - DNA, 20 bp, Artificial Sequence
  Description of Artificial Sequence: Synthetic oligonucleotide
  Target: ATXN1; (+) strand; PAM type: NRG; PAM sequence: CAG
tttaccacattttctttatc

SEQ ID NO: 123447 - DNA, 20 bp, Artificial Sequence
  Description of Artificial Sequence: Synthetic oligonucleotide
  Target: ATXN1; (+) strand; PAM type: NRG; PAM sequence: TGG
tttatccagtctatcattga

SEQ ID NO: 123448 - DNA, 20 bp, Artificial Sequence
  Description of Artificial Sequence: Synthetic oligonucleotide
  Target: ATXN1; (+) strand; PAM type: NRG; PAM sequence: GGG
ttatccagtctatcattgat

SEQ ID NO: 123449 - DNA, 20 bp, Artificial Sequence
  Description of Artificial Sequence: Synthetic oligonucleotide
  Target: ATXN1; (+) strand; PAM type: NRG; PAM sequence: TGG
gtctatcattgatgggcatt

SEQ ID NO: 123450 - DNA, 20 bp, Artificial Sequence
  Description of Artificial Sequence: Synthetic oligonucleotide
  Target: ATXN1; (+) strand; PAM type: NRG; PAM sequence: GGG
tctatcattgatgggcattt

SEQ ID NO: 123451 - DNA, 20 bp, Artificial Sequence
  Description of Artificial Sequence: Synthetic oligonucleotide
  Target: ATXN1; (+) strand; PAM type: NRG; PAM sequence: TGG
tcattgatgggcatttgggt

SEQ ID NO: 123452 - DNA, 20 bp, Artificial Sequence
  Description of Artificial Sequence: Synthetic oligonucleotide
  Target: ATXN1; (+) strand; PAM type: NRG; PAM sequence: CAG
tgggcatttgggttggtttc

SEQ ID NO: 123453 - DNA, 20 bp, Artificial Sequence
  Description of Artificial Sequence: Synthetic oligonucleotide
  Target: ATXN1; (+) strand; PAM type: NRG; PAM sequence: CAG
tactattgtaaatactgctg

SEQ ID NO: 123454 - DNA, 20 bp, Artificial Sequence
  Description of Artificial Sequence: Synthetic oligonucleotide
  Target: ATXN1; (+) strand; PAM type: NRG; PAM sequence: CAG
gtgtgcatgtgtctttataa

SEQ ID NO: 123455 - DNA, 20 bp, Artificial Sequence
  Description of Artificial Sequence: Synthetic oligonucleotide
  Target: ATXN1; (+) strand; PAM type: NRG; PAM sequence: TGG
cagaatgatttataatcctt

SEQ ID NO: 123456 - DNA, 20 bp, Artificial Sequence
  Description of Artificial Sequence: Synthetic oligonucleotide
  Target: ATXN1; (+) strand; PAM type: NRG; PAM sequence: GGG
agaatgatttataatccttt

SEQ ID NO: 123457 - DNA, 20 bp, Artificial Sequence
  Description of Artificial Sequence: Synthetic oligonucleotide
  Target: ATXN1; (+) strand; PAM type: NRG; PAM sequence: CAG
taatcctttgggtatataac

SEQ ID NO: 123458 - DNA, 20 bp, Artificial Sequence
  Description of Artificial Sequence: Synthetic oligonucleotide
  Target: ATXN1; (+) strand; PAM type: NRG; PAM sequence: CGG
tttgggtatataaccagtaa

SEQ ID NO: 123459 - DNA, 20 bp, Artificial Sequence
  Description of Artificial Sequence: Synthetic oligonucleotide
  Target: ATXN1; (+) strand; PAM type: NRG; PAM sequence: GGG
ttgggtatataaccagtaac

SEQ ID NO: 123460 - DNA, 20 bp, Artificial Sequence
  Description of Artificial Sequence: Synthetic oligonucleotide
  Target: ATXN1; (+) strand; PAM type: NRG; PAM sequence: TGG
ataaccagtaacgggattgc

SEQ ID NO: 123461 - DNA, 20 bp, Artificial Sequence
  Description of Artificial Sequence: Synthetic oligonucleotide
  Target: ATXN1; (+) strand; PAM type: NRG; PAM sequence: GGG
taaccagtaacgggattgct

SEQ ID NO: 123462 - DNA, 20 bp, Artificial Sequence
  Description of Artificial Sequence: Synthetic oligonucleotide
  Target: ATXN1; (+) strand; PAM type: NRG; PAM sequence: TGG
aacgggattgctgggtcaaa

SEQ ID NO: 123463 - DNA, 20 bp, Artificial Sequence
  Description of Artificial Sequence: Synthetic oligonucleotide
  Target: ATXN1; (+) strand; PAM type: NRG; PAM sequence: TGG
gctgggtcaaatggtatttc

SEQ ID NO: 123464 - DNA, 20 bp, Artificial Sequence
  Description of Artificial Sequence: Synthetic oligonucleotide
  Target: ATXN1; (+) strand; PAM type: NRG; PAM sequence: TAG
tcaaatggtatttctggttc

SEQ ID NO: 123465 - DNA, 20 bp, Artificial Sequence
  Description of Artificial Sequence: Synthetic oligonucleotide
  Target: ATXN1; (+) strand; PAM type: NRG; PAM sequence: GAG
atttctggttctagatcctt

SEQ ID NO: 123466 - DNA, 20 bp, Artificial Sequence
  Description of Artificial Sequence: Synthetic oligonucleotide
  Target: ATXN1; (+) strand; PAM type: NRG; PAM sequence: AGG
tttctggttctagatccttg

SEQ ID NO: 123467 - DNA, 20 bp, Artificial Sequence
  Description of Artificial Sequence: Synthetic oligonucleotide
  Target: ATXN1; (+) strand; PAM type: NRG; PAM sequence: TGG
cgccacactgtcttccacaa

SEQ ID NO: 123468 - DNA, 20 bp, Artificial Sequence
  Description of Artificial Sequence: Synthetic oligonucleotide
  Target: ATXN1; (+) strand; PAM type: NRG; PAM sequence: CAG
acaatggttgaactaattta

SEQ ID NO: 123469 - DNA, 20 bp, Artificial Sequence
  Description of Artificial Sequence: Synthetic oligonucleotide
  Target: ATXN1; (+) strand; PAM type: NRG; PAM sequence: CAG
actaatttacagtcccccaa

SEQ ID NO: 123470 - DNA, 20 bp, Artificial Sequence
  Description of Artificial Sequence: Synthetic oligonucleotide
  Target: ATXN1; (+) strand; PAM type: NRG; PAM sequence: AAG
acagtcccccaacagcataa

SEQ ID NO: 123471 - DNA, 20 bp, Artificial Sequence
  Description of Artificial Sequence: Synthetic oligonucleotide
  Target: ATXN1; (+) strand; PAM type: NRG; PAM sequence: CAG
aaagcattcctatttctcca

SEQ ID NO: 123472 - DNA, 20 bp, Artificial Sequence
  Description of Artificial Sequence: Synthetic oligonucleotide
  Target: ATXN1; (+) strand; PAM type: NRG; PAM sequence: CAG
ctatttctccacagcctcgc

SEQ ID NO: 123473 - DNA, 20 bp, Artificial Sequence
  Description of Artificial Sequence: Synthetic oligonucleotide
  Target: ATXN1; (+) strand; PAM type: NRG; PAM sequence: TAG
acagcctcgccagcatctat

SEQ ID NO: 123474 - DNA, 20 bp, Artificial Sequence
  Description of Artificial Sequence: Synthetic oligonucleotide
  Target: ATXN1; (+) strand; PAM type: NRG; PAM sequence: AGG
cagcctcgccagcatctatt

SEQ ID NO: 123475 - DNA, 20 bp, Artificial Sequence
  Description of Artificial Sequence: Synthetic oligonucleotide
  Target: ATXN1; (+) strand; PAM type: NRG; PAM sequence: TGG
gccagcatctattaggaaac

SEQ ID NO: 123476 - DNA, 20 bp, Artificial Sequence
  Description of Artificial Sequence: Synthetic oligonucleotide
  Target: ATXN1; (+) strand; PAM type: NRG; PAM sequence: AAG
agcatctattaggaaactgg

SEQ ID NO: 123477 - DNA, 20 bp, Artificial Sequence
  Description of Artificial Sequence: Synthetic oligonucleotide
  Target: ATXN1; (+) strand; PAM type: NRG; PAM sequence: TAG
actggaagaattctatacaa

SEQ ID NO: 123478 - DNA, 20 bp, Artificial Sequence
  Description of Artificial Sequence: Synthetic oligonucleotide
  Target: ATXN1; (+) strand; PAM type: NRG; PAM sequence: TAG
agaattctatacaatagatt

SEQ ID NO: 123479 - DNA, 20 bp, Artificial Sequence
  Description of Artificial Sequence: Synthetic oligonucleotide
  Target: ATXN1; (+) strand; PAM type: NRG; PAM sequence: AGG
gaattctatacaatagattt

SEQ ID NO: 123480 - DNA, 20 bp, Artificial Sequence
  Description of Artificial Sequence: Synthetic oligonucleotide
  Target: ATXN1; (+) strand; PAM type: NRG; PAM sequence: GAG
attctatacaatagatttag

SEQ ID NO: 123481 - DNA, 20 bp, Artificial Sequence
  Description of Artificial Sequence: Synthetic oligonucleotide
  Target: ATXN1; (+) strand; PAM type: NRG; PAM sequence: AAG
caatagatttaggagctgca

SEQ ID NO: 123482 - DNA, 20 bp, Artificial Sequence
  Description of Artificial Sequence: Synthetic oligonucleotide
  Target: ATXN1; (+) strand; PAM type: NRG; PAM sequence: AGG
aatagatttaggagctgcaa

SEQ ID NO: 123483 - DNA, 20 bp, Artificial Sequence
  Description of Artificial Sequence: Synthetic oligonucleotide
  Target: ATXN1; (+) strand; PAM type: NRG; PAM sequence: GAG
tagatttaggagctgcaaag

SEQ ID NO: 123484 - DNA, 20 bp, Artificial Sequence
  Description of Artificial Sequence: Synthetic oligonucleotide
  Target: ATXN1; (+) strand; PAM type: NRG; PAM sequence: AAG
tttaggagctgcaaaggagt

SEQ ID NO: 123485 - DNA, 20 bp, Artificial Sequence
  Description of Artificial Sequence: Synthetic oligonucleotide
  Target: ATXN1; (+) strand; PAM type: NRG; PAM sequence: AGG
ttaggagctgcaaaggagta

SEQ ID NO: 123486 - DNA, 20 bp, Artificial Sequence
  Description of Artificial Sequence: Synthetic oligonucleotide
  Target: ATXN1; (+) strand; PAM type: NRG; PAM sequence: AAG
aaaggagtaaggatttgctg

SEQ ID NO: 123487 - DNA, 20 bp, Artificial Sequence
  Description of Artificial Sequence: Synthetic oligonucleotide
  Target: ATXN1; (+) strand; PAM type: NRG; PAM sequence: TAG
ggatttgctgaagattttct

SEQ ID NO: 123488 - DNA, 20 bp, Artificial Sequence
  Description of Artificial Sequence: Synthetic oligonucleotide
  Target: ATXN1; (+) strand; PAM type: NRG; PAM sequence: AGG
gatttgctgaagattttctt

SEQ ID NO: 123489 - DNA, 20 bp, Artificial Sequence
  Description of Artificial Sequence: Synthetic oligonucleotide
  Target: ATXN1; (+) strand; PAM type: NRG; PAM sequence: AAG
tgctgaagattttcttaggc

SEQ ID NO: 123490 - DNA, 20 bp, Artificial Sequence
  Description of Artificial Sequence: Synthetic oligonucleotide
  Target: ATXN1; (+) strand; PAM type: NRG; PAM sequence: TAG
agattttcttaggcaagtat

SEQ ID NO: 123491 - DNA, 20 bp, Artificial Sequence
  Description of Artificial Sequence: Synthetic oligonucleotide
  Target: ATXN1; (+) strand; PAM type: NRG; PAM sequence: AAG
ttttcttaggcaagtattag

SEQ ID NO: 123492 - DNA, 20 bp, Artificial Sequence
  Description of Artificial Sequence: Synthetic oligonucleotide
  Target: ATXN1; (+) strand; PAM type: NRG; PAM sequence: TGG
cttaggcaagtattagaagt

SEQ ID NO: 123493 - DNA, 20 bp, Artificial Sequence
  Description of Artificial Sequence: Synthetic oligonucleotide
  Target: ATXN1; (+) strand; PAM type: NRG; PAM sequence: TAG
ggcaagtattagaagttggt

SEQ ID NO: 123494 - DNA, 20 bp, Artificial Sequence
  Description of Artificial Sequence: Synthetic oligonucleotide
  Target: ATXN1; (+) strand; PAM type: NRG; PAM sequence: GAG
gtattagaagttggttagat

SEQ ID NO: 123495 - DNA, 20 bp, Artificial Sequence
  Description of Artificial Sequence: Synthetic oligonucleotide
  Target: ATXN1; (+) strand; PAM type: NRG; PAM sequence: AAG
agaagttggttagatgagaa

SEQ ID NO: 123496 - DNA, 20 bp, Artificial Sequence
  Description of Artificial Sequence: Synthetic oligonucleotide
  Target: ATXN1; (+) strand; PAM type: NRG; PAM sequence: AAG
tagatgagaaaagttttcac

SEQ ID NO: 123497 - DNA, 20 bp, Artificial Sequence
  Description of Artificial Sequence: Synthetic oligonucleotide
  Target: ATXN1; (+) strand; PAM type: NRG; PAM sequence: TGG
atgagaaaagttttcacaag

SEQ ID NO: 123498 - DNA, 20 bp, Artificial Sequence
  Description of Artificial Sequence: Synthetic oligonucleotide
  Target: ATXN1; (+) strand; PAM type: NRG; PAM sequence: GGG
tgagaaaagttttcacaagt

SEQ ID NO: 123499 - DNA, 20 bp, Artificial Sequence
  Description of Artificial Sequence: Synthetic oligonucleotide
  Target: ATXN1; (+) strand; PAM type: NRG; PAM sequence: GAG
agaaaagttttcacaagtgg

SEQ ID NO: 123500 - DNA, 20 bp, Artificial Sequence
  Description of Artificial Sequence: Synthetic oligonucleotide
  Target: ATXN1; (+) strand; PAM type: NRG; PAM sequence: TAG
acctccttgtctcctaattg

SEQ ID NO: 123501 - DNA, 20 bp, Artificial Sequence
  Description of Artificial Sequence: Synthetic oligonucleotide
  Target: ATXN1; (+) strand; PAM type: NRG; PAM sequence: CAG
gaatctgtcaactttctttt

SEQ ID NO: 123502 - DNA, 20 bp, Artificial Sequence
  Description of Artificial Sequence: Synthetic oligonucleotide
  Target: ATXN1; (+) strand; PAM type: NRG; PAM sequence: AAG
aactttcttttcagtgtatc

SEQ ID NO: 123503 - DNA, 20 bp, Artificial Sequence
  Description of Artificial Sequence: Synthetic oligonucleotide
  Target: ATXN1; (+) strand; PAM type: NRG; PAM sequence: CAG
ttactcttcaaaatcattct

SEQ ID NO: 123504 - DNA, 20 bp, Artificial Sequence
  Description of Artificial Sequence: Synthetic oligonucleotide
  Target: ATXN1; (+) strand; PAM type: NRG; PAM sequence: AAG
ctctgaattgctatactttt

SEQ ID NO: 123505 - DNA, 20 bp, Artificial Sequence
  Description of Artificial Sequence: Synthetic oligonucleotide
  Target: ATXN1; (+) strand; PAM type: NRG; PAM sequence: AAG
tttaagttaactacttctca

SEQ ID NO: 123506 - DNA, 20 bp, Artificial Sequence
  Description of Artificial Sequence: Synthetic oligonucleotide
  Target: ATXN1; (+) strand; PAM type: NRG; PAM sequence: CAG
tgacatcttcaaccacattt

SEQ ID NO: 123507 - DNA, 20 bp, Artificial Sequence
  Description of Artificial Sequence: Synthetic oligonucleotide
  Target: ATXN1; (+) strand; PAM type: NRG; PAM sequence: AGG
gacatcttcaaccacatttc

SEQ ID NO: 123508 - DNA, 20 bp, Artificial Sequence
  Description of Artificial Sequence: Synthetic oligonucleotide
  Target: ATXN1; (+) strand; PAM type: NRG; PAM sequence: TAG
cttcaaccacatttcaggct

SEQ ID NO: 123509 - DNA, 20 bp, Artificial Sequence
  Description of Artificial Sequence: Synthetic oligonucleotide
  Target: ATXN1; (+) strand; PAM type: NRG; PAM sequence: AAG
agaatctatctaaatttgca

SEQ ID NO: 123510 - DNA, 20 bp, Artificial Sequence
  Description of Artificial Sequence: Synthetic oligonucleotide
  Target: ATXN1; (+) strand; PAM type: NRG; PAM sequence: TGG
ctaaatttgcaaagtttcat

SEQ ID NO: 123511 - DNA, 20 bp, Artificial Sequence
  Description of Artificial Sequence: Synthetic oligonucleotide
  Target: ATXN1; (+) strand; PAM type: NRG; PAM sequence: AAG
agtttcattggttcttatga

SEQ ID NO: 123512 - DNA, 20 bp, Artificial Sequence
  Description of Artificial Sequence: Synthetic oligonucleotide
  Target: ATXN1; (+) strand; PAM type: NRG; PAM sequence: CAG
acttaaaaaaatacacttga

SEQ ID NO: 123513 - DNA, 20 bp, Artificial Sequence
  Description of Artificial Sequence: Synthetic oligonucleotide
  Target: ATXN1; (+) strand; PAM type: NRG; PAM sequence: CAG
tctcttgaaaatgatttgtg

SEQ ID NO: 123514 - DNA, 20 bp, Artificial Sequence
  Description of Artificial Sequence: Synthetic oligonucleotide
  Target: ATXN1; (+) strand; PAM type: NRG; PAM sequence: AAG
tgttcaaattactttatatc

SEQ ID NO: 123515 - DNA, 20 bp, Artificial Sequence
  Description of Artificial Sequence: Synthetic oligonucleotide
  Target: ATXN1; (+) strand; PAM type: NRG; PAM sequence: AAG
tactttatatcaagacattt

SEQ ID NO: 123516 - DNA, 20 bp, Artificial Sequence
  Description of Artificial Sequence: Synthetic oligonucleotide
  Target: ATXN1; (+) strand; PAM type: NRG; PAM sequence: GAG
ctttatatcaagacatttaa

SEQ ID NO: 123517 - DNA, 20 bp, Artificial Sequence
  Description of Artificial Sequence: Synthetic oligonucleotide
  Target: ATXN1; (+) strand; PAM type: NRG; PAM sequence: TGG
aagacatttaagagaaaatg

SEQ ID NO: 123518 - DNA, 20 bp, Artificial Sequence
  Description of Artificial Sequence: Synthetic oligonucleotide
  Target: ATXN1; (+) strand; PAM type: NRG; PAM sequence: TAG
aaatgtggttttctttgtaa

SEQ ID NO: 123519 - DNA, 20 bp, Artificial Sequence
  Description of Artificial Sequence: Synthetic oligonucleotide
  Target: ATXN1; (+) strand; PAM type: NRG; PAM sequence: AGG
aatgtggttttctttgtaat

SEQ ID NO: 123520 - DNA, 20 bp, Artificial Sequence
  Description of Artificial Sequence: Synthetic oligonucleotide
  Target: ATXN1; (+) strand; PAM type: NRG; PAM sequence: AAG
aacatgtacatatgctgtat

SEQ ID NO: 123521 - DNA, 20 bp, Artificial Sequence
  Description of Artificial Sequence: Synthetic oligonucleotide
  Target: ATXN1; (+) strand; PAM type: NRG; PAM sequence: CAG
catttaaacaaattgaaaaa

SEQ ID NO: 123522 - DNA, 20 bp, Artificial Sequence
  Description of Artificial Sequence: Synthetic oligonucleotide
  Target: ATXN1; (+) strand; PAM type: NRG; PAM sequence: TAG
ttaaacaaattgaaaaacag

SEQ ID NO: 123523 - DNA, 20 bp, Artificial Sequence
  Description of Artificial Sequence: Synthetic oligonucleotide
  Target: ATXN1; (+) strand; PAM type: NRG; PAM sequence: AGG
taaacaaattgaaaaacagt

SEQ ID NO: 123524 - DNA, 20 bp, Artificial Sequence
  Description of Artificial Sequence: Synthetic oligonucleotide
  Target: ATXN1; (+) strand; PAM type: NRG; PAM sequence: TGG
attgaaaaacagtaggattc

SEQ ID NO: 123525 - DNA, 20 bp, Artificial Sequence
  Description of Artificial Sequence: Synthetic oligonucleotide
  Target: ATXN1; (+) strand; PAM type: NRG; PAM sequence: TAG
aaacagtaggattctggcta

SEQ ID NO: 123526 - DNA, 20 bp, Artificial Sequence
  Description of Artificial Sequence: Synthetic oligonucleotide
  Target: ATXN1; (+) strand; PAM type: NRG; PAM sequence: AAG
gattctggctatagaccgta

SEQ ID NO: 123527 - DNA, 20 bp, Artificial Sequence
  Description of Artificial Sequence: Synthetic oligonucleotide
  Target: ATXN1; (+) strand; PAM type: NRG; PAM sequence: CAG
gtaaagaaacaaaacttgcc

SEQ ID NO: 123528 - DNA, 20 bp, Artificial Sequence
  Description of Artificial Sequence: Synthetic oligonucleotide
  Target: ATXN1; (+) strand; PAM type: NRG; PAM sequence: AAG
cttgcccagaatatcatttt

SEQ ID NO: 123529 - DNA, 20 bp, Artificial Sequence
  Description of Artificial Sequence: Synthetic oligonucleotide
  Target: ATXN1; (+) strand; PAM type: NRG; PAM sequence: AAG
attaactgctatttcccaca

SEQ ID NO: 123530 - DNA, 20 bp, Artificial Sequence
  Description of Artificial Sequence: Synthetic oligonucleotide
  Target: ATXN1; (+) strand; PAM type: NRG; PAM sequence: CAG
acaaagttcaatcctacata

SEQ ID NO: 123531 - DNA, 20 bp, Artificial Sequence
  Description of Artificial Sequence: Synthetic oligonucleotide
  Target: ATXN1; (+) strand; PAM type: NRG; PAM sequence: CGG
ttcaatcctacatacagaat

SEQ ID NO: 123532 - DNA, 20 bp, Artificial Sequence
  Description of Artificial Sequence: Synthetic oligonucleotide
  Target: ATXN1; (+) strand; PAM type: NRG; PAM sequence: CAG
acagaatcggaattgtcaac

SEQ ID NO: 123533 - DNA, 20 bp, Artificial Sequence
  Description of Artificial Sequence: Synthetic oligonucleotide
  Target: ATXN1; (+) strand; PAM type: NRG; PAM sequence: AGG
cagaatcggaattgtcaacc

SEQ ID NO: 123534 - DNA, 20 bp, Artificial Sequence
  Description of Artificial Sequence: Synthetic oligonucleotide
  Target: ATXN1; (+) strand; PAM type: NRG; PAM sequence: AAG
ggaattgtcaaccaggtcca

SEQ ID NO: 123535 - DNA, 20 bp, Artificial Sequence
  Description of Artificial Sequence: Synthetic oligonucleotide
  Target: ATXN1; (+) strand; PAM type: NRG; PAM sequence: CAG
aattataaaacctgatgtct

SEQ ID NO: 123536 - DNA, 20 bp, Artificial Sequence
  Description of Artificial Sequence: Synthetic oligonucleotide
  Target: ATXN1; (+) strand; PAM type: NRG; PAM sequence: TAG
aaaacctgatgtctcagaaa

SEQ ID NO: 123537 - DNA, 20 bp, Artificial Sequence
  Description of Artificial Sequence: Synthetic oligonucleotide
  Target: ATXN1; (+) strand; PAM type: NRG; PAM sequence: AAG
ctgatgtctcagaaatagac

SEQ ID NO: 123538 - DNA, 20 bp, Artificial Sequence
  Description of Artificial Sequence: Synthetic oligonucleotide
  Target: ATXN1; (+) strand; PAM type: NRG; PAM sequence: CAG
cagaaatagacaagaaaact

SEQ ID NO: 123539 - DNA, 20 bp, Artificial Sequence
  Description of Artificial Sequence: Synthetic oligonucleotide
  Target: ATXN1; (+) strand; PAM type: NRG; PAM sequence: CAG
ctcagaaaaaataattatta

SEQ ID NO: 123540 - DNA, 20 bp, Artificial Sequence
  Description of Artificial Sequence: Synthetic oligonucleotide
  Target: ATXN1; (+) strand; PAM type: NRG; PAM sequence: AAG
ttacagtccaatcgcacaca

SEQ ID NO: 123541 - DNA, 20 bp, Artificial Sequence
  Description of Artificial Sequence: Synthetic oligonucleotide
  Target: ATXN1; (+) strand; PAM type: NRG; PAM sequence: AAG
gtccaatcgcacacaaagaa

SEQ ID NO: 123542 - DNA, 20 bp, Artificial Sequence
  Description of Artificial Sequence: Synthetic oligonucleotide
  Target: ATXN1; (+) strand; PAM type: NRG; PAM sequence: GAG
aatcgcacacaaagaaaagt

SEQ ID NO: 123543 - DNA, 20 bp, Artificial Sequence
  Description of Artificial Sequence: Synthetic oligonucleotide
  Target: ATXN1; (+) strand; PAM type: NRG; PAM sequence: AAG
acaaagaaaagtgagaataa

SEQ ID NO: 123544 - DNA, 20 bp, Artificial Sequence
  Description of Artificial Sequence: Synthetic oligonucleotide
  Target: ATXN1; (+) strand; PAM type: NRG; PAM sequence: AGG
caaagaaaagtgagaataaa

SEQ ID NO: 123545 - DNA, 20 bp, Artificial Sequence
  Description of Artificial Sequence: Synthetic oligonucleotide
  Target: ATXN1; (+) strand; PAM type: NRG; PAM sequence: AAG
gaaaagtgagaataaaaggc

SEQ ID NO: 123546 - DNA, 20 bp, Artificial Sequence
  Description of Artificial Sequence: Synthetic oligonucleotide
  Target: ATXN1; (+) strand; PAM type: NRG; PAM sequence: TAG
agaataaaaggcaagttata

SEQ ID NO: 123547 - DNA, 20 bp, Artificial Sequence
  Description of Artificial Sequence: Synthetic oligonucleotide
  Target: ATXN1; (+) strand; PAM type: NRG; PAM sequence: GAG
tatttctacaaattcctttt

SEQ ID NO: 123548 - DNA, 20 bp, Artificial Sequence
  Description of Artificial Sequence: Synthetic oligonucleotide
  Target: ATXN1; (+) strand; PAM type: NRG; PAM sequence: TGG
acaaattccttttgagttac

SEQ ID NO: 123549 - DNA, 20 bp, Artificial Sequence
  Description of Artificial Sequence: Synthetic oligonucleotide
  Target: ATXN1; (+) strand; PAM type: NRG; PAM sequence: GGG
caaattccttttgagttact

SEQ ID NO: 123550 - DNA, 20 bp, Artificial Sequence
  Description of Artificial Sequence: Synthetic oligonucleotide
  Target: ATXN1; (+) strand; PAM type: NRG; PAM sequence: AAG
tactgggcaacattctattt

SEQ ID NO: 123551 - DNA, 20 bp, Artificial Sequence
  Description of Artificial Sequence: Synthetic oligonucleotide
  Target: ATXN1; (+) strand; PAM type: NRG; PAM sequence: TGG
tgggcaacattctatttaag

SEQ ID NO: 123552 - DNA, 20 bp, Artificial Sequence
  Description of Artificial Sequence: Synthetic oligonucleotide
  Target: ATXN1; (+) strand; PAM type: NRG; PAM sequence: CAG
atttaagtggacccttatga

SEQ ID NO: 123553 - DNA, 20 bp, Artificial Sequence
  Description of Artificial Sequence: Synthetic oligonucleotide
  Target: ATXN1; (+) strand; PAM type: NRG; PAM sequence: TAG
taagtggacccttatgacag

SEQ ID NO: 123554 - DNA, 20 bp, Artificial Sequence
  Description of Artificial Sequence: Synthetic oligonucleotide
  Target: ATXN1; (+) strand; PAM type: NRG; PAM sequence: AAG
agtataatgaaaatatccct

SEQ ID NO: 123555 - DNA, 20 bp, Artificial Sequence
  Description of Artificial Sequence: Synthetic oligonucleotide
  Target: ATXN1; (+) strand; PAM type: NRG; PAM sequence: TAG
atgaaaatatccctaagtca

SEQ ID NO: 123556 - DNA, 20 bp, Artificial Sequence
  Description of Artificial Sequence: Synthetic oligonucleotide
  Target: ATXN1; (+) strand; PAM type: NRG; PAM sequence: TAG
tgaacatttcattgaatgct

SEQ ID NO: 123557 - DNA, 20 bp, Artificial Sequence
  Description of Artificial Sequence: Synthetic oligonucleotide
  Target: ATXN1; (+) strand; PAM type: NRG; PAM sequence: AAG
ttgaatgcttagtatgtgca

SEQ ID NO: 123558 - DNA, 20 bp, Artificial Sequence
  Description of Artificial Sequence: Synthetic oligonucleotide
  Target: ATXN1; (+) strand; PAM type: NRG; PAM sequence: GAG
tagtatgtgcaaagtactgt

SEQ ID NO: 123559 - DNA, 20 bp, Artificial Sequence
  Description of Artificial Sequence: Synthetic oligonucleotide
  Target: ATXN1; (+) strand; PAM type: NRG; PAM sequence: AGG
agtatgtgcaaagtactgtg

SEQ ID NO: 123560 - DNA, 20 bp, Artificial Sequence
  Description of Artificial Sequence: Synthetic oligonucleotide
  Target: ATXN1; (+) strand; PAM type: NRG; PAM sequence: GAG
tgtgcaaagtactgtgaggt

SEQ ID NO: 123561 - DNA, 20 bp, Artificial Sequence
  Description of Artificial Sequence: Synthetic oligonucleotide
  Target: ATXN1; (+) strand; PAM type: NRG; PAM sequence: AGG
gtgcaaagtactgtgaggtg

SEQ ID NO: 123562 - DNA, 20 bp, Artificial Sequence
  Description of Artificial Sequence: Synthetic oligonucleotide
  Target: ATXN1; (+) strand; PAM type: NRG; PAM sequence: CAG
aagtactgtgaggtgaggtt

SEQ ID NO: 123563 - DNA, 20 bp, Artificial Sequence
  Description of Artificial Sequence: Synthetic oligonucleotide
  Target: ATXN1; (+) strand; PAM type: NRG; PAM sequence: TGG
tgtgaggtgaggttcagaaa

SEQ ID NO: 123564 - DNA, 20 bp, Artificial Sequence
  Description of Artificial Sequence: Synthetic oligonucleotide
  Target: ATXN1; (+) strand; PAM type: NRG; PAM sequence: GAG
tgaggtgaggttcagaaatg

SEQ ID NO: 123565 - DNA, 20 bp, Artificial Sequence
  Description of Artificial Sequence: Synthetic oligonucleotide
  Target: ATXN1; (+) strand; PAM type: NRG; PAM sequence: AAG
gtgaggttcagaaatggaga

SEQ ID NO: 123566 - DNA, 20 bp, Artificial Sequence
  Description of Artificial Sequence: Synthetic oligonucleotide
  Target: ATXN1; (+) strand; PAM type: NRG; PAM sequence: AAG
aggttcagaaatggagaaag

SEQ ID NO: 123567 - DNA, 20 bp, Artificial Sequence
  Description of Artificial Sequence: Synthetic oligonucleotide
  Target: ATXN1; (+) strand; PAM type: NRG; PAM sequence: AGG
ggttcagaaatggagaaaga

SEQ ID NO: 123568 - DNA, 20 bp, Artificial Sequence
  Description of Artificial Sequence: Synthetic oligonucleotide
  Target: ATXN1; (+) strand; PAM type: NRG; PAM sequence: CAG
aaggtttattgctttgaatg

SEQ ID NO: 123569 - DNA, 20 bp, Artificial Sequence
  Description of Artificial Sequence: Synthetic oligonucleotide
  Target: ATXN1; (+) strand; PAM type: NRG; PAM sequence: AAG
atattgatttttaaaacact

SEQ ID NO: 123570 - DNA, 20 bp, Artificial Sequence
  Description of Artificial Sequence: Synthetic oligonucleotide
  Target: ATXN1; (+) strand; PAM type: NRG; PAM sequence: CAG
ttatgattcctcattgccaa

SEQ ID NO: 123571 - DNA, 20 bp, Artificial Sequence
  Description of Artificial Sequence: Synthetic oligonucleotide
  Target: ATXN1; (+) strand; PAM type: NRG; PAM sequence: AAG
ttttcaaatgtgttttttaa

SEQ ID NO: 123572 - DNA, 20 bp, Artificial Sequence
  Description of Artificial Sequence: Synthetic oligonucleotide
  Target: ATXN1; (+) strand; PAM type: NRG; PAM sequence: CAG
caaatgtgttttttaaaagc

SEQ ID NO: 123573 - DNA, 20 bp, Artificial Sequence
  Description of Artificial Sequence: Synthetic oligonucleotide
  Target: ATXN1; (+) strand; PAM type: NRG; PAM sequence: TAG
ccttcaaacaaaatcttata

SEQ ID NO: 123574 - DNA, 20 bp, Artificial Sequence
  Description of Artificial Sequence: Synthetic oligonucleotide
  Target: ATXN1; (+) strand; PAM type: NRG; PAM sequence: AAG
tatatagaaatctaatacac

SEQ ID NO: 123575 - DNA, 20 bp, Artificial Sequence
  Description of Artificial Sequence: Synthetic oligonucleotide
  Target: ATXN1; (+) strand; PAM type: NRG; PAM sequence: GAG
tacacaagataaataaaatt

SEQ ID NO: 123576 - DNA, 20 bp, Artificial Sequence
  Description of Artificial Sequence: Synthetic oligonucleotide
  Target: ATXN1; (+) strand; PAM type: NRG; PAM sequence: AGG
acacaagataaataaaattg

SEQ ID NO: 123577 - DNA, 20 bp, Artificial Sequence
  Description of Artificial Sequence: Synthetic oligonucleotide
  Target: ATXN1; (+) strand; PAM type: NRG; PAM sequence: TAG
ttgaggctacttacactatc

SEQ ID NO: 123578 - DNA, 20 bp, Artificial Sequence
  Description of Artificial Sequence: Synthetic oligonucleotide
  Target: ATXN1; (+) strand; PAM type: NRG; PAM sequence: CGG
cttacactatctagttttat

SEQ ID NO: 123579 - DNA, 20 bp, Artificial Sequence
  Description of Artificial Sequence: Synthetic oligonucleotide
  Target: ATXN1; (+) strand; PAM type: NRG; PAM sequence: AAG
actcctcatccatcaccacc

SEQ ID NO: 123580 - DNA, 20 bp, Artificial Sequence
  Description of Artificial Sequence: Synthetic oligonucleotide
  Target: ATXN1; (+) strand; PAM type: NRG; PAM sequence: AAG
atcaccaccaagtacttctg

SEQ ID NO: 123581 - DNA, 20 bp, Artificial Sequence
  Description of Artificial Sequence: Synthetic oligonucleotide
  Target: ATXN1; (+) strand; PAM type: NRG; PAM sequence: AGG
tcaccaccaagtacttctga

SEQ ID NO: 123582 - DNA, 20 bp, Artificial Sequence
  Description of Artificial Sequence: Synthetic oligonucleotide
  Target: ATXN1; (+) strand; PAM type: NRG; PAM sequence: CAG
ccaccaagtacttctgaagg

SEQ ID NO: 123583 - DNA, 20 bp, Artificial Sequence
  Description of Artificial Sequence: Synthetic oligonucleotide
  Target: ATXN1; (+) strand; PAM type: NRG; PAM sequence: CAG
tacttctgaaggcagcccca

SEQ ID NO: 123584 - DNA, 20 bp, Artificial Sequence
  Description of Artificial Sequence: Synthetic oligonucleotide
  Target: ATXN1; (+) strand; PAM type: NRG; PAM sequence: GAG
cttctgaaggcagccccaca

SEQ ID NO: 123585 - DNA, 20 bp, Artificial Sequence
  Description of Artificial Sequence: Synthetic oligonucleotide
  Target: ATXN1; (+) strand; PAM type: NRG; PAM sequence: AGG
ttctgaaggcagccccacag

SEQ ID NO: 123586 - DNA, 20 bp, Artificial Sequence
  Description of Artificial Sequence: Synthetic oligonucleotide
  Target: ATXN1; (+) strand; PAM type: NRG; PAM sequence: CAG
ggcagccccacagaggttca

SEQ ID NO: 123587 - DNA, 20 bp, Artificial Sequence
  Description of Artificial Sequence: Synthetic oligonucleotide
  Target: ATXN1; (+) strand; PAM type: NRG; PAM sequence: AGG
gcagccccacagaggttcac

SEQ ID NO: 123588 - DNA, 20 bp, Artificial Sequence
  Description of Artificial Sequence: Synthetic oligonucleotide
  Target: ATXN1; (+) strand; PAM type: NRG; PAM sequence: GGG
cagccccacagaggttcaca

SEQ ID NO: 123589 - DNA, 20 bp, Artificial Sequence
  Description of Artificial Sequence: Synthetic oligonucleotide
  Target: ATXN1; (+) strand; PAM type: NRG; PAM sequence: CAG
ccccacagaggttcacaggg

SEQ ID NO: 123590 - DNA, 20 bp, Artificial Sequence
  Description of Artificial Sequence: Synthetic oligonucleotide
  Target: ATXN1; (+) strand; PAM type: NRG; PAM sequence: GAG
ccacagaggttcacagggca

SEQ ID NO: 123591 - DNA, 20 bp, Artificial Sequence
  Description of Artificial Sequence: Synthetic oligonucleotide
  Target: ATXN1; (+) strand; PAM type: NRG; PAM sequence: AGG
cacagaggttcacagggcag

SEQ ID NO: 123592 - DNA, 20 bp, Artificial Sequence
  Description of Artificial Sequence: Synthetic oligonucleotide
  Target: ATXN1; (+) strand; PAM type: NRG; PAM sequence: TGG
gaggttcacagggcagaggt

SEQ ID NO: 123593 - DNA, 20 bp, Artificial Sequence
  Description of Artificial Sequence: Synthetic oligonucleotide
  Target: ATXN1; (+) strand; PAM type: NRG; PAM sequence: GGG
aggttcacagggcagaggtt

SEQ ID NO: 123594 - DNA, 20 bp, Artificial Sequence
  Description of Artificial Sequence: Synthetic oligonucleotide
  Target: ATXN1; (+) strand; PAM type: NRG; PAM sequence: GAG
gttcacagggcagaggttgg

SEQ ID NO: 123595 - DNA, 20 bp, Artificial Sequence
  Description of Artificial Sequence: Synthetic oligonucleotide
  Target: ATXN1; (+) strand; PAM type: NRG; PAM sequence: GAG
agggcagaggttgggagact

SEQ ID NO: 123596 - DNA, 20 bp, Artificial Sequence
  Description of Artificial Sequence: Synthetic oligonucleotide
  Target: ATXN1; (+) strand; PAM type: NRG; PAM sequence: CAG
ttgggagactgagaaatcct

SEQ ID NO: 123597 - DNA, 20 bp, Artificial Sequence
  Description of Artificial Sequence: Synthetic oligonucleotide
  Target: ATXN1; (+) strand; PAM type: NRG; PAM sequence: AGG
tgggagactgagaaatcctc

SEQ ID NO: 123598 - DNA, 20 bp, Artificial Sequence
  Description of Artificial Sequence: Synthetic oligonucleotide
  Target: ATXN1; (+) strand; PAM type: NRG; PAM sequence: TGG
ctgagaaatcctcaggctac

SEQ ID NO: 123599 - DNA, 20 bp, Artificial Sequence
  Description of Artificial Sequence: Synthetic oligonucleotide
  Target: ATXN1; (+) strand; PAM type: NRG; PAM sequence: GAG
gagaaatcctcaggctactg

SEQ ID NO: 123600 - DNA, 20 bp, Artificial Sequence
  Description of Artificial Sequence: Synthetic oligonucleotide
  Target: ATXN1; (+) strand; PAM type: NRG; PAM sequence: TGG
cctcaggctactggagaatg

SEQ ID NO: 123601 - DNA, 20 bp, Artificial Sequence
  Description of Artificial Sequence: Synthetic oligonucleotide
  Target: ATXN1; (+) strand; PAM type: NRG; PAM sequence: GAG
aatgtggtctgacctccacc

SEQ ID NO: 123602 - DNA, 20 bp, Artificial Sequence
  Description of Artificial Sequence: Synthetic oligonucleotide
  Target: ATXN1; (+) strand; PAM type: NRG; PAM sequence: GAG
ggtctgacctccaccgagct

SEQ ID NO: 123603 - DNA, 20 bp, Artificial Sequence
  Description of Artificial Sequence: Synthetic oligonucleotide
  Target: ATXN1; (+) strand; PAM type: NRG; PAM sequence: AGG
gtctgacctccaccgagctg

SEQ ID NO: 123604 - DNA, 20 bp, Artificial Sequence
  Description of Artificial Sequence: Synthetic oligonucleotide
  Target: ATXN1; (+) strand; PAM type: NRG; PAM sequence: GAG
ctgacctccaccgagctgag

SEQ ID NO: 123605 - DNA, 20 bp, Artificial Sequence
  Description of Artificial Sequence: Synthetic oligonucleotide
  Target: ATXN1; (+) strand; PAM type: NRG; PAM sequence: TGG
ggagtctgtactccttaaca

SEQ ID NO: 123606 - DNA, 20 bp, Artificial Sequence
  Description of Artificial Sequence: Synthetic oligonucleotide
  Target: ATXN1; (+) strand; PAM type: NRG; PAM sequence: GAG
tactccttaacatggcctat

SEQ ID NO: 123607 - DNA, 20 bp, Artificial Sequence
  Description of Artificial Sequence: Synthetic oligonucleotide
  Target: ATXN1; (+) strand; PAM type: NRG; PAM sequence: TGG
atggcctatgagaccctcta

SEQ ID NO: 123608 - DNA, 20 bp, Artificial Sequence
  Description of Artificial Sequence: Synthetic oligonucleotide
  Target: ATXN1; (+) strand; PAM type: NRG; PAM sequence: TGG
gaccctctatggtttgctcc

SEQ ID NO: 123609 - DNA, 20 bp, Artificial Sequence
  Description of Artificial Sequence: Synthetic oligonucleotide
  Target: ATXN1; (+) strand; PAM type: NRG; PAM sequence: AAG
tttgctcctggcctcatgac

SEQ ID NO: 123610 - DNA, 20 bp, Artificial Sequence
  Description of Artificial Sequence: Synthetic oligonucleotide
  Target: ATXN1; (+) strand; PAM type: NRG; PAM sequence: TGG
tcatgacaagttaccaccaa

SEQ ID NO: 123611 - DNA, 20 bp, Artificial Sequence
  Description of Artificial Sequence: Synthetic oligonucleotide
  Target: ATXN1; (+) strand; PAM type: NRG; PAM sequence: GAG
atgacaagttaccaccaatg

SEQ ID NO: 123612 - DNA, 20 bp, Artificial Sequence
  Description of Artificial Sequence: Synthetic oligonucleotide
  Target: ATXN1; (+) strand; PAM type: NRG; PAM sequence: TGG
gctttgtccatgctgtccct

SEQ ID NO: 123613 - DNA, 20 bp, Artificial Sequence
  Description of Artificial Sequence: Synthetic oligonucleotide
  Target: ATXN1; (+) strand; PAM type: NRG; PAM sequence: CAG
ttgtccatgctgtcccttgg

SEQ ID NO: 123614 - DNA, 20 bp, Artificial Sequence
  Description of Artificial Sequence: Synthetic oligonucleotide
  Target: ATXN1; (+) strand; PAM type: NRG; PAM sequence: AGG
tgtccatgctgtcccttggc

SEQ ID NO: 123615 - DNA, 20 bp, Artificial Sequence
  Description of Artificial Sequence: Synthetic oligonucleotide
  Target: ATXN1; (+) strand; PAM type: NRG; PAM sequence: CAG
tatgtccatcttctctttga

SEQ ID NO: 123616 - DNA, 20 bp, Artificial Sequence
  Description of Artificial Sequence: Synthetic oligonucleotide
  Target: ATXN1; (+) strand; PAM type: NRG; PAM sequence: AAG
tcttctctttgacagatgcc

SEQ ID NO: 123617 - DNA, 20 bp, Artificial Sequence
  Description of Artificial Sequence: Synthetic oligonucleotide
  Target: ATXN1; (+) strand; PAM type: NRG; PAM sequence: CAG
agacaccccacaactctgca

SEQ ID NO: 123618 - DNA, 20 bp, Artificial Sequence
  Description of Artificial Sequence: Synthetic oligonucleotide
  Target: ATXN1; (+) strand; PAM type: NRG; PAM sequence: TGG
accccacaactctgcacagc

SEQ ID NO: 123619 - DNA, 20 bp, Artificial Sequence
  Description of Artificial Sequence: Synthetic oligonucleotide
  Target: ATXN1; (+) strand; PAM type: NRG; PAM sequence: CAG
caactctgcacagctggaca

SEQ ID NO: 123620 - DNA, 20 bp, Artificial Sequence
  Description of Artificial Sequence: Synthetic oligonucleotide
  Target: ATXN1; (+) strand; PAM type: NRG; PAM sequence: TGG
tccacatacacattcatttt

SEQ ID NO: 123621 - DNA, 20 bp, Artificial Sequence
  Description of Artificial Sequence: Synthetic oligonucleotide
  Target: ATXN1; (+) strand; PAM type: NRG; PAM sequence: TGG
tcatttttggctcaccacgc

SEQ ID NO: 123622 - DNA, 20 bp, Artificial Sequence
  Description of Artificial Sequence: Synthetic oligonucleotide
  Target: ATXN1; (+) strand; PAM type: NRG; PAM sequence: TGG
ttttggctcaccacgctggc

SEQ ID NO: 123623 - DNA, 20 bp, Artificial Sequence
  Description of Artificial Sequence: Synthetic oligonucleotide
  Target: ATXN1; (+) strand; PAM type: NRG; PAM sequence: TGG
gctggtaattattgttcata

SEQ ID NO: 123624 - DNA, 20 bp, Artificial Sequence
  Description of Artificial Sequence: Synthetic oligonucleotide
  Target: ATXN1; (+) strand; PAM type: NRG; PAM sequence: CAG
gctttcacttaaactaacct

SEQ ID NO: 123625 - DNA, 20 bp, Artificial Sequence
  Description of Artificial Sequence: Synthetic oligonucleotide
  Target: ATXN1; (+) strand; PAM type: NRG; PAM sequence: GAG
tttcacttaaactaacctca

SEQ ID NO: 123626 - DNA, 20 bp, Artificial Sequence
  Description of Artificial Sequence: Synthetic oligonucleotide
  Target: ATXN1; (+) strand; PAM type: NRG; PAM sequence: AAG
aactaacctcagagtaacac

SEQ ID NO: 123627 - DNA, 20 bp, Artificial Sequence
  Description of Artificial Sequence: Synthetic oligonucleotide
  Target: ATXN1; (+) strand; PAM type: NRG; PAM sequence: CAG
acctcagagtaacacaagca

SEQ ID NO: 123628 - DNA, 20 bp, Artificial Sequence
  Description of Artificial Sequence: Synthetic oligonucleotide
  Target: ATXN1; (+) strand; PAM type: NRG; PAM sequence: TAG
aagcacagaaaatgtattca

SEQ ID NO: 123629 - DNA, 20 bp, Artificial Sequence
  Description of Artificial Sequence: Synthetic oligonucleotide
  Target: ATXN1; (+) strand; PAM type: NRG; PAM sequence: CAG
atgtattcatagttatattc

SEQ ID NO: 123630 - DNA, 20 bp, Artificial Sequence
  Description of Artificial Sequence: Synthetic oligonucleotide
  Target: ATXN1; (+) strand; PAM type: NRG; PAM sequence: TGG
ttcatagttatattccagct

SEQ ID NO: 123631 - DNA, 20 bp, Artificial Sequence
  Description of Artificial Sequence: Synthetic oligonucleotide
  Target: ATXN1; (+) strand; PAM type: NRG; PAM sequence: CAG
ttatattccagcttggaaca

SEQ ID NO: 123632 - DNA, 20 bp, Artificial Sequence
  Description of Artificial Sequence: Synthetic oligonucleotide
  Target: ATXN1; (+) strand; PAM type: NRG; PAM sequence: CAG
gaacacagatgttgacctaa

SEQ ID NO: 123633 - DNA, 20 bp, Artificial Sequence
  Description of Artificial Sequence: Synthetic oligonucleotide
  Target: ATXN1; (+) strand; PAM type: NRG; PAM sequence: TGG
cacagatgttgacctaacag

SEQ ID NO: 123634 - DNA, 20 bp, Artificial Sequence
  Description of Artificial Sequence: Synthetic oligonucleotide
  Target: ATXN1; (+) strand; PAM type: NRG; PAM sequence: AAG
atttgttgaatgaatgaata

SEQ ID NO: 123635 - DNA, 20 bp, Artificial Sequence
  Description of Artificial Sequence: Synthetic oligonucleotide
  Target: ATXN1; (+) strand; PAM type: NRG; PAM sequence: TGG
gttgaatgaatgaataaaga

SEQ ID NO: 123636 - DNA, 20 bp, Artificial Sequence
  Description of Artificial Sequence: Synthetic oligonucleotide
  Target: ATXN1; (+) strand; PAM type: NRG; PAM sequence: TGG
aatgaatgaataaagatgga

SEQ ID NO: 123637 - DNA, 20 bp, Artificial Sequence
  Description of Artificial Sequence: Synthetic oligonucleotide
  Target: ATXN1; (+) strand; PAM type: NRG; PAM sequence: GGG
atgaatgaataaagatggat

SEQ ID NO: 123638 - DNA, 20 bp, Artificial Sequence
  Description of Artificial Sequence: Synthetic oligonucleotide
  Target: ATXN1; (+) strand; PAM type: NRG; PAM sequence: GAG
atgaataaagatggatgggt

SEQ ID NO: 123639 - DNA, 20 bp, Artificial Sequence
  Description of Artificial Sequence: Synthetic oligonucleotide
  Target: ATXN1; (+) strand; PAM type: NRG; PAM sequence: TGG
aataaagatggatgggtgag

SEQ ID NO: 123640 - DNA, 20 bp, Artificial Sequence
  Description of Artificial Sequence: Synthetic oligonucleotide
  Target: ATXN1; (+) strand; PAM type: NRG; PAM sequence: TAG
acaatatactttcatcaaac

SEQ ID NO: 123641 - DNA, 20 bp, Artificial Sequence
  Description of Artificial Sequence: Synthetic oligonucleotide
  Target: ATXN1; (+) strand; PAM type: NRG; PAM sequence: AGG
caatatactttcatcaaact

SEQ ID NO: 123642 - DNA, 20 bp, Artificial Sequence
  Description of Artificial Sequence: Synthetic oligonucleotide
  Target: ATXN1; (+) strand; PAM type: NRG; PAM sequence: GGG
aatatactttcatcaaacta

SEQ ID NO: 123643 - DNA, 20 bp, Artificial Sequence
  Description of Artificial Sequence: Synthetic oligonucleotide
  Target: ATXN1; (+) strand; PAM type: NRG; PAM sequence: TGG
atatatacttctaaaaattg

SEQ ID NO: 123644 - DNA, 20 bp, Artificial Sequence
  Description of Artificial Sequence: Synthetic oligonucleotide
  Target: ATXN1; (+) strand; PAM type: NRG; PAM sequence: CAG
cttaaacatttttaactata

SEQ ID NO: 123645 - DNA, 20 bp, Artificial Sequence
  Description of Artificial Sequence: Synthetic oligonucleotide
  Target: ATXN1; (+) strand; PAM type: NRG; PAM sequence: CAG
aacatttttaactatacagt

SEQ ID NO: 123646 - DNA, 20 bp, Artificial Sequence
  Description of Artificial Sequence: Synthetic oligonucleotide
  Target: ATXN1; (+) strand; PAM type: NRG; PAM sequence: TGG
atttttaactatacagtcag

SEQ ID NO: 123647 - DNA, 20 bp, Artificial Sequence
  Description of Artificial Sequence: Synthetic oligonucleotide
  Target: ATXN1; (+) strand; PAM type: NRG; PAM sequence: AAG
actatacagtcagtggcatt

SEQ ID NO: 123648 - DNA, 20 bp, Artificial Sequence
  Description of Artificial Sequence: Synthetic oligonucleotide
  Target: ATXN1; (+) strand; PAM type: NRG; PAM sequence: TAG
aaaaatgtaattgaatgatc

SEQ ID NO: 123649 - DNA, 20 bp, Artificial Sequence
  Description of Artificial Sequence: Synthetic oligonucleotide
  Target: ATXN1; (+) strand; PAM type: NRG; PAM sequence: AGG
aaaatgtaattgaatgatct

SEQ ID NO: 123650 - DNA, 20 bp, Artificial Sequence
  Description of Artificial Sequence: Synthetic oligonucleotide
  Target: ATXN1; (+) strand; PAM type: NRG; PAM sequence: GGG
aaatgtaattgaatgatcta

SEQ ID NO: 123651 - DNA, 20 bp, Artificial Sequence
  Description of Artificial Sequence: Synthetic oligonucleotide
  Target: ATXN1; (+) strand; PAM type: NRG; PAM sequence: TGG
taattgaatgatctagggtg

SEQ ID NO: 123652 - DNA, 20 bp, Artificial Sequence
  Description of Artificial Sequence: Synthetic oligonucleotide
  Target: ATXN1; (+) strand; PAM type: NRG; PAM sequence: GGG
aattgaatgatctagggtgt

SEQ ID NO: 123653 - DNA, 20 bp, Artificial Sequence
  Description of Artificial Sequence: Synthetic oligonucleotide
  Target: ATXN1; (+) strand; PAM type: NRG; PAM sequence: GGG
attgaatgatctagggtgtg

SEQ ID NO: 123654 - DNA, 20 bp, Artificial Sequence
  Description of Artificial Sequence: Synthetic oligonucleotide
  Target: ATXN1; (+) strand; PAM type: NRG; PAM sequence: CAG
gatctagggtgtggggtacc

SEQ ID NO: 123655 - DNA, 20 bp, Artificial Sequence
  Description of Artificial Sequence: Synthetic oligonucleotide
  Target: ATXN1; (+) strand; PAM type: NRG; PAM sequence: AGG
atctagggtgtggggtaccc

SEQ ID NO: 123656 - DNA, 20 bp, Artificial Sequence
  Description of Artificial Sequence: Synthetic oligonucleotide
  Target: ATXN1; (+) strand; PAM type: NRG; PAM sequence: CAG
gctatatatcttgtgccttt

SEQ ID NO: 123657 - DNA, 20 bp, Artificial Sequence
  Description of Artificial Sequence: Synthetic oligonucleotide
  Target: ATXN1; (+) strand; PAM type: NRG; PAM sequence: TAG
ttgtgcctttcagccccact

SEQ ID NO: 123658 - DNA, 20 bp, Artificial Sequence
  Description of Artificial Sequence: Synthetic oligonucleotide
  Target: ATXN1; (+) strand; PAM type: NRG; PAM sequence: AGG
tgtgcctttcagccccactt

SEQ ID NO: 123659 - DNA, 20 bp, Artificial Sequence
  Description of Artificial Sequence: Synthetic oligonucleotide
  Target: ATXN1; (+) strand; PAM type: NRG; PAM sequence: GGG
gtgcctttcagccccactta

SEQ ID NO: 123660 - DNA, 20 bp, Artificial Sequence
  Description of Artificial Sequence: Synthetic oligonucleotide
  Target: ATXN1; (+) strand; PAM type: NRG; PAM sequence: TAG
agccccacttagggcatctt

SEQ ID NO: 123661 - DNA, 20 bp, Artificial Sequence
  Description of Artificial Sequence: Synthetic oligonucleotide
  Target: ATXN1; (+) strand; PAM type: NRG; PAM sequence: AAG
ccacttagggcatctttagc

SEQ ID NO: 123662 - DNA, 20 bp, Artificial Sequence
  Description of Artificial Sequence: Synthetic oligonucleotide
  Target: ATXN1; (+) strand; PAM type: NRG; PAM sequence: TGG
ggcatctttagcaagaaatg

SEQ ID NO: 123663 - DNA, 20 bp, Artificial Sequence
  Description of Artificial Sequence: Synthetic oligonucleotide
  Target: ATXN1; (+) strand; PAM type: NRG; PAM sequence: TGG
agcaagaaatgtggtaaatg

SEQ ID NO: 123664 - DNA, 20 bp, Artificial Sequence
  Description of Artificial Sequence: Synthetic oligonucleotide
  Target: ATXN1; (+) strand; PAM type: NRG; PAM sequence: GAG
gaaatgtggtaaatgtggtt

SEQ ID NO: 123665 - DNA, 20 bp, Artificial Sequence
  Description of Artificial Sequence: Synthetic oligonucleotide
  Target: ATXN1; (+) strand; PAM type: NRG; PAM sequence: TGG
gtaaatgtggttgagacatg

SEQ ID NO: 123666 - DNA, 20 bp, Artificial Sequence
  Description of Artificial Sequence: Synthetic oligonucleotide
  Target: ATXN1; (+) strand; PAM type: NRG; PAM sequence: TAG
tcaatgaaactcctgcctac

SEQ ID NO: 123667 - DNA, 20 bp, Artificial Sequence
  Description of Artificial Sequence: Synthetic oligonucleotide
  Target: ATXN1; (+) strand; PAM type: NRG; PAM sequence: TAG
gaaactcctgcctactagct

SEQ ID NO: 123668 - DNA, 20 bp, Artificial Sequence
  Description of Artificial Sequence: Synthetic oligonucleotide
  Target: ATXN1; (+) strand; PAM type: NRG; PAM sequence: TAG
ctgcctactagcttagctac

SEQ ID NO: 123669 - DNA, 20 bp, Artificial Sequence
  Description of Artificial Sequence: Synthetic oligonucleotide
  Target: ATXN1; (+) strand; PAM type: NRG; PAM sequence: TAG
ctactagcttagctactagc

SEQ ID NO: 123670 - DNA, 20 bp, Artificial Sequence
  Description of Artificial Sequence: Synthetic oligonucleotide
  Target: ATXN1; (+) strand; PAM type: NRG; PAM sequence: CAG
ctagcttagctactagctag

SEQ ID NO: 123671 - DNA, 20 bp, Artificial Sequence
  Description of Artificial Sequence: Synthetic oligonucleotide
  Target: ATXN1; (+) strand; PAM type: NRG; PAM sequence: TGG
ttagctactagctagcagtt

SEQ ID NO: 123672 - DNA, 20 bp, Artificial Sequence
  Description of Artificial Sequence: Synthetic oligonucleotide
  Target: ATXN1; (+) strand; PAM type: NRG; PAM sequence: GGG
tagctactagctagcagttt

SEQ ID NO: 123673 - DNA, 20 bp, Artificial Sequence
  Description of Artificial Sequence: Synthetic oligonucleotide
  Target: ATXN1; (+) strand; PAM type: NRG; PAM sequence: TGG
gctgctcaaaatgaatttcc

SEQ ID NO: 123674 - DNA, 20 bp, Artificial Sequence
  Description of Artificial Sequence: Synthetic oligonucleotide
  Target: ATXN1; (+) strand; PAM type: NRG; PAM sequence: AAG
atttcctggataattttcct

SEQ ID NO: 123675 - DNA, 20 bp, Artificial Sequence
  Description of Artificial Sequence: Synthetic oligonucleotide
  Target: ATXN1; (+) strand; PAM type: NRG; PAM sequence: TAG
ctcctactcgcatgtattgc

SEQ ID NO: 123676 - DNA, 20 bp, Artificial Sequence
  Description of Artificial Sequence: Synthetic oligonucleotide
  Target: ATXN1; (+) strand; PAM type: NRG; PAM sequence: AGG
tcctactcgcatgtattgct

SEQ ID NO: 123677 - DNA, 20 bp, Artificial Sequence
  Description of Artificial Sequence: Synthetic oligonucleotide
  Target: ATXN1; (+) strand; PAM type: NRG; PAM sequence: GAG
ctactcgcatgtattgctag

SEQ ID NO: 123678 - DNA, 20 bp, Artificial Sequence
  Description of Artificial Sequence: Synthetic oligonucleotide
  Target: ATXN1; (+) strand; PAM type: NRG; PAM sequence: CAG
tcgcatgtattgctaggagc

SEQ ID NO: 123679 - DNA, 20 bp, Artificial Sequence
  Description of Artificial Sequence: Synthetic oligonucleotide
  Target: ATXN1; (+) strand; PAM type: NRG; PAM sequence: TGG
taggagccagctttcactcc

SEQ ID NO: 123680 - DNA, 20 bp, Artificial Sequence
  Description of Artificial Sequence: Synthetic oligonucleotide
  Target: ATXN1; (+) strand; PAM type: NRG; PAM sequence: GGG
aggagccagctttcactcct

SEQ ID NO: 123681 - DNA, 20 bp, Artificial Sequence
  Description of Artificial Sequence: Synthetic oligonucleotide
  Target: ATXN1; (+) strand; PAM type: NRG; PAM sequence: TGG
ccagctttcactcctgggac

SEQ ID NO: 123682 - DNA, 20 bp, Artificial Sequence
  Description of Artificial Sequence: Synthetic oligonucleotide
  Target: ATXN1; (+) strand; PAM type: NRG; PAM sequence: TGG
tttcactcctgggactggtt

SEQ ID NO: 123683 - DNA, 20 bp, Artificial Sequence
  Description of Artificial Sequence: Synthetic oligonucleotide
  Target: ATXN1; (+) strand; PAM type: NRG; PAM sequence: GGG
ttcactcctgggactggttt

SEQ ID NO: 123684 - DNA, 20 bp, Artificial Sequence
  Description of Artificial Sequence: Synthetic oligonucleotide
  Target: ATXN1; (+) strand; PAM type: NRG; PAM sequence: CAG
ctgggactggtttgggcttc

SEQ ID NO: 123685 - DNA, 20 bp, Artificial Sequence
  Description of Artificial Sequence: Synthetic oligonucleotide
  Target: ATXN1; (+) strand; PAM type: NRG; PAM sequence: AAG
gactggtttgggcttccaga

SEQ ID NO: 123686 - DNA, 20 bp, Artificial Sequence
  Description of Artificial Sequence: Synthetic oligonucleotide
  Target: ATXN1; (+) strand; PAM type: NRG; PAM sequence: AAG
tccagaaagcatgccttgta

SEQ ID NO: 123687 - DNA, 20 bp, Artificial Sequence
  Description of Artificial Sequence: Synthetic oligonucleotide
  Target: ATXN1; (+) strand; PAM type: NRG; PAM sequence: CAG
aaagcatgccttgtaaagaa

SEQ ID NO: 123688 - DNA, 20 bp, Artificial Sequence
  Description of Artificial Sequence: Synthetic oligonucleotide
  Target: ATXN1; (+) strand; PAM type: NRG; PAM sequence: AGG
aagcatgccttgtaaagaac

SEQ ID NO: 123689 - DNA, 20 bp, Artificial Sequence
  Description of Artificial Sequence: Synthetic oligonucleotide
  Target: ATXN1; (+) strand; PAM type: NRG; PAM sequence: GGG
agcatgccttgtaaagaaca

SEQ ID NO: 123690 - DNA, 20 bp, Artificial Sequence
  Description of Artificial Sequence: Synthetic oligonucleotide
  Target: ATXN1; (+) strand; PAM type: NRG; PAM sequence: CAG
aacagggcctgtgtgtcaaa

SEQ ID NO: 123691 - DNA, 20 bp, Artificial Sequence
  Description of Artificial Sequence: Synthetic oligonucleotide
  Target: ATXN1; (+) strand; PAM type: NRG; PAM sequence: TAG
cagcctgtatacaacacaca

SEQ ID NO: 123692 - DNA, 20 bp, Artificial Sequence
  Description of Artificial Sequence: Synthetic oligonucleotide
  Target: ATXN1; (+) strand; PAM type: NRG; PAM sequence: CAG
cattttaacatttctgaact

SEQ ID NO: 123693 - DNA, 20 bp, Artificial Sequence
  Description of Artificial Sequence: Synthetic oligonucleotide
  Target: ATXN1; (+) strand; PAM type: NRG; PAM sequence: AGG
attttaacatttctgaactc

SEQ ID NO: 123694 - DNA, 20 bp, Artificial Sequence
  Description of Artificial Sequence: Synthetic oligonucleotide
  Target: ATXN1; (+) strand; PAM type: NRG; PAM sequence: TGG
ggacttattttatatatgat

SEQ ID NO: 123695 - DNA, 20 bp, Artificial Sequence
  Description of Artificial Sequence: Synthetic oligonucleotide
  Target: ATXN1; (+) strand; PAM type: NRG; PAM sequence: AAG
tatatatgattggtacataa

SEQ ID NO: 123696 - DNA, 20 bp, Artificial Sequence
  Description of Artificial Sequence: Synthetic oligonucleotide
  Target: ATXN1; (+) strand; PAM type: NRG; PAM sequence: GAG
tatatgattggtacataaaa

SEQ ID NO: 123697 - DNA, 20 bp, Artificial Sequence
  Description of Artificial Sequence: Synthetic oligonucleotide
  Target: ATXN1; (+) strand; PAM type: NRG; PAM sequence: TGG
atgattggtacataaaagag

SEQ ID NO: 123698 - DNA, 20 bp, Artificial Sequence
  Description of Artificial Sequence: Synthetic oligonucleotide
  Target: ATXN1; (+) strand; PAM type: NRG; PAM sequence: TAG
attggtacataaaagagtgg

SEQ ID NO: 123699 - DNA, 20 bp, Artificial Sequence
  Description of Artificial Sequence: Synthetic oligonucleotide
  Target: ATXN1; (+) strand; PAM type: NRG; PAM sequence: CAG
agtggtagcacccccacccc

SEQ ID NO: 123700 - DNA, 20 bp, Artificial Sequence
  Description of Artificial Sequence: Synthetic oligonucleotide
  Target: ATXN1; (+) strand; PAM type: NRG; PAM sequence: CAG
gaaactaatcatttaatcta

SEQ ID NO: 123701 - DNA, 20 bp, Artificial Sequence
  Description of Artificial Sequence: Synthetic oligonucleotide
  Target: ATXN1; (+) strand; PAM type: NRG; PAM sequence: CAG
tctacagtgcatattatcat

SEQ ID NO: 123702 - DNA, 20 bp, Artificial Sequence
  Description of Artificial Sequence: Synthetic oligonucleotide
  Target: ATXN1; (+) strand; PAM type: NRG; PAM sequence: CAG
tattatcatcagtgacacta

SEQ ID NO: 123703 - DNA, 20 bp, Artificial Sequence
  Description of Artificial Sequence: Synthetic oligonucleotide
  Target: ATXN1; (+) strand; PAM type: NRG; PAM sequence: AAG
cagtgacactacagaaatca

SEQ ID NO: 123704 - DNA, 20 bp, Artificial Sequence
  Description of Artificial Sequence: Synthetic oligonucleotide
  Target: ATXN1; (+) strand; PAM type: NRG; PAM sequence: TGG
ctacagaaatcaaagaaaac

SEQ ID NO: 123705 - DNA, 20 bp, Artificial Sequence
  Description of Artificial Sequence: Synthetic oligonucleotide
  Target: ATXN1; (+) strand; PAM type: NRG; PAM sequence: CAG
gtatctatttcatatttgca

SEQ ID NO: 123706 - DNA, 20 bp, Artificial Sequence
  Description of Artificial Sequence: Synthetic oligonucleotide
  Target: ATXN1; (+) strand; PAM type: NRG; PAM sequence: TGG
cacattgccaatctcacact

SEQ ID NO: 123707 - DNA, 20 bp, Artificial Sequence
  Description of Artificial Sequence: Synthetic oligonucleotide
  Target: ATXN1; (+) strand; PAM type: NRG; PAM sequence: GAG
cattgccaatctcacacttg

SEQ ID NO: 123708 - DNA, 20 bp, Artificial Sequence
  Description of Artificial Sequence: Synthetic oligonucleotide
  Target: ATXN1; (+) strand; PAM type: NRG; PAM sequence: AAG
tgccaatctcacacttggag

SEQ ID NO: 123709 - DNA, 20 bp, Artificial Sequence
  Description of Artificial Sequence: Synthetic oligonucleotide
  Target: ATXN1; (+) strand; PAM type: NRG; PAM sequence: AAG
ctcacacttggagaagcaaa

SEQ ID NO: 123710 - DNA, 20 bp, Artificial Sequence
  Description of Artificial Sequence: Synthetic oligonucleotide
  Target: ATXN1; (+) strand; PAM type: NRG; PAM sequence: AAG
acttggagaagcaaaaagca

SEQ ID NO: 123711 - DNA, 20 bp, Artificial Sequence
  Description of Artificial Sequence: Synthetic oligonucleotide
  Target: ATXN1; (+) strand; PAM type: NRG; PAM sequence: AAG
tggagaagcaaaaagcaaag

SEQ ID NO: 123712 - DNA, 20 bp, Artificial Sequence
  Description of Artificial Sequence: Synthetic oligonucleotide
  Target: ATXN1; (+) strand; PAM type: NRG; PAM sequence: AGG
ggagaagcaaaaagcaaaga

SEQ ID NO: 123713 - DNA, 20 bp, Artificial Sequence
  Description of Artificial Sequence: Synthetic oligonucleotide
  Target: ATXN1; (+) strand; PAM type: NRG; PAM sequence: AAG
agcaaaaagcaaagaaggaa

SEQ ID NO: 123714 - DNA, 20 bp, Artificial Sequence
  Description of Artificial Sequence: Synthetic oligonucleotide
  Target: ATXN1; (+) strand; PAM type: NRG; PAM sequence: AGG
gcaaaaagcaaagaaggaaa

SEQ ID NO: 123715 - DNA, 20 bp, Artificial Sequence
  Description of Artificial Sequence: Synthetic oligonucleotide
  Target: ATXN1; (+) strand; PAM type: NRG; PAM sequence: AAG
aagaaggaaaaggacttgaa

SEQ ID NO: 123716 - DNA, 20 bp, Artificial Sequence
  Description of Artificial Sequence: Synthetic oligonucleotide
  Target: ATXN1; (+) strand; PAM type: NRG; PAM sequence: AGG
agaaggaaaaggacttgaaa

SEQ ID NO: 123717 - DNA, 20 bp, Artificial Sequence
  Description of Artificial Sequence: Synthetic oligonucleotide
  Target: ATXN1; (+) strand; PAM type: NRG; PAM sequence: GGG
gaaggaaaaggacttgaaaa

SEQ ID NO: 123718 - DNA, 20 bp, Artificial Sequence
  Description of Artificial Sequence: Synthetic oligonucleotide
  Target: ATXN1; (+) strand; PAM type: NRG; PAM sequence: AAG
aaggacttgaaaagggtgac

SEQ ID NO: 123719 - DNA, 20 bp, Artificial Sequence
  Description of Artificial Sequence: Synthetic oligonucleotide
  Target: ATXN1; (+) strand; PAM type: NRG; PAM sequence: CAG
gaaaagggtgacaagtcact

SEQ ID NO: 123720 - DNA, 20 bp, Artificial Sequence
  Description of Artificial Sequence: Synthetic oligonucleotide
  Target: ATXN1; (+) strand; PAM type: NRG; PAM sequence: AGG
aaaagggtgacaagtcactc

SEQ ID NO: 123721 - DNA, 20 bp, Artificial Sequence
  Description of Artificial Sequence: Synthetic oligonucleotide
  Target: ATXN1; (+) strand; PAM type: NRG; PAM sequence: TGG
tgacaagtcactcaggtgaa

SEQ ID NO: 123722 - DNA, 20 bp, Artificial Sequence
  Description of Artificial Sequence: Synthetic oligonucleotide
  Target: ATXN1; (+) strand; PAM type: NRG; PAM sequence: GGG
gacaagtcactcaggtgaat

SEQ ID NO: 123723 - DNA, 20 bp, Artificial Sequence
  Description of Artificial Sequence: Synthetic oligonucleotide
  Target: ATXN1; (+) strand; PAM type: NRG; PAM sequence: GAG
gtcactcaggtgaatgggat

SEQ ID NO: 123724 - DNA, 20 bp, Artificial Sequence
  Description of Artificial Sequence: Synthetic oligonucleotide
  Target: ATXN1; (+) strand; PAM type: NRG; PAM sequence: AGG
tcactcaggtgaatgggatg

SEQ ID NO: 123725 - DNA, 20 bp, Artificial Sequence
  Description of Artificial Sequence: Synthetic oligonucleotide
  Target: ATXN1; (+) strand; PAM type: NRG; PAM sequence: CAG
tcaggtgaatgggatgaggc

SEQ ID NO: 123726 - DNA, 20 bp, Artificial Sequence
  Description of Artificial Sequence: Synthetic oligonucleotide
  Target: ATXN1; (+) strand; PAM type: NRG; PAM sequence: AGG
caggtgaatgggatgaggcc

SEQ ID NO: 123727 - DNA, 20 bp, Artificial Sequence
  Description of Artificial Sequence: Synthetic oligonucleotide
  Target: ATXN1; (+) strand; PAM type: NRG; PAM sequence: GAG
ggtgaatgggatgaggccag

SEQ ID NO: 123728 - DNA, 20 bp, Artificial Sequence
  Description of Artificial Sequence: Synthetic oligonucleotide
  Target: ATXN1; (+) strand; PAM type: NRG; PAM sequence: AGG
gtgaatgggatgaggccagg

SEQ ID NO: 123729 - DNA, 20 bp, Artificial Sequence
  Description of Artificial Sequence: Synthetic oligonucleotide
  Target: ATXN1; (+) strand; PAM type: NRG; PAM sequence: CAG
ggatgaggccaggaggtgac

SEQ ID NO: 123730 - DNA, 20 bp, Artificial Sequence
  Description of Artificial Sequence: Synthetic oligonucleotide
  Target: ATXN1; (+) strand; PAM type: NRG; PAM sequence: AGG
gatgaggccaggaggtgacc

SEQ ID NO: 123731 - DNA, 20 bp, Artificial Sequence
  Description of Artificial Sequence: Synthetic oligonucleotide
  Target: ATXN1; (+) strand; PAM type: NRG; PAM sequence: TGG
ggccaggaggtgaccaggcc

SEQ ID NO: 123732 - DNA, 20 bp, Artificial Sequence
  Description of Artificial Sequence: Synthetic oligonucleotide
  Target: ATXN1; (+) strand; PAM type: NRG; PAM sequence: AAG
gacgtgaactgctccccaca

SEQ ID NO: 123733 - DNA, 20 bp, Artificial Sequence
  Description of Artificial Sequence: Synthetic oligonucleotide
  Target: ATXN1; (+) strand; PAM type: NRG; PAM sequence: CGG
tccccacaaagacctctcca

SEQ ID NO: 123734 - DNA, 20 bp, Artificial Sequence
  Description of Artificial Sequence: Synthetic oligonucleotide
  Target: ATXN1; (+) strand; PAM type: NRG; PAM sequence: CAG
aaagacctctccacggcgct

SEQ ID NO: 123735 - DNA, 20 bp, Artificial Sequence
  Description of Artificial Sequence: Synthetic oligonucleotide
  Target: ATXN1; (+) strand; PAM type: NRG; PAM sequence: CAG
ctctccacggcgctcagcct

SEQ ID NO: 123736 - DNA, 20 bp, Artificial Sequence
  Description of Artificial Sequence: Synthetic oligonucleotide
  Target: ATXN1; (+) strand; PAM type: NRG; PAM sequence: CAG
ccctcatgtgtaaaataaca

SEQ ID NO: 123737 - DNA, 20 bp, Artificial Sequence
  Description of Artificial Sequence: Synthetic oligonucleotide
  Target: ATXN1; (+) strand; PAM type: NRG; PAM sequence: AGG
cctcatgtgtaaaataacac

SEQ ID NO: 123738 - DNA, 20 bp, Artificial Sequence
  Description of Artificial Sequence: Synthetic oligonucleotide
  Target: ATXN1; (+) strand; PAM type: NRG; PAM sequence: GGG
ctcatgtgtaaaataacaca

SEQ ID NO: 123739 - DNA, 20 bp, Artificial Sequence
  Description of Artificial Sequence: Synthetic oligonucleotide
  Target: ATXN1; (+) strand; PAM type: NRG; PAM sequence: GGG
tcatgtgtaaaataacacag

SEQ ID NO: 123740 - DNA, 20 bp, Artificial Sequence
  Description of Artificial Sequence: Synthetic oligonucleotide
  Target: ATXN1; (+) strand; PAM type: NRG; PAM sequence: CAG
aggggaaatgaaaattaaac

SEQ ID NO: 123741 - DNA, 20 bp, Artificial Sequence
  Description of Artificial Sequence: Synthetic oligonucleotide
  Target: ATXN1; (+) strand; PAM type: NRG; PAM sequence: AAG
atgaaaattaaaccagtgtt

SEQ ID NO: 123742 - DNA, 20 bp, Artificial Sequence
  Description of Artificial Sequence: Synthetic oligonucleotide
  Target: ATXN1; (+) strand; PAM type: NRG; PAM sequence: CAG
ttcctgcaccaacattcaac

SEQ ID NO: 123743 - DNA, 20 bp, Artificial Sequence
  Description of Artificial Sequence: Synthetic oligonucleotide
  Target: ATXN1; (+) strand; PAM type: NRG; PAM sequence: GAG
cagctctctgaccttcttac

SEQ ID NO: 123744 - DNA, 20 bp, Artificial Sequence
  Description of Artificial Sequence: Synthetic oligonucleotide
  Target: ATXN1; (+) strand; PAM type: NRG; PAM sequence: AGG
agctctctgaccttcttacg

SEQ ID NO: 123745 - DNA, 20 bp, Artificial Sequence
  Description of Artificial Sequence: Synthetic oligonucleotide
  Target: ATXN1; (+) strand; PAM type: NRG; PAM sequence: CAG
tctgaccttcttacgaggct

SEQ ID NO: 123746 - DNA, 20 bp, Artificial Sequence
  Description of Artificial Sequence: Synthetic oligonucleotide
  Target: ATXN1; (+) strand; PAM type: NRG; PAM sequence: AGG
ctgaccttcttacgaggctc

SEQ ID NO: 123747 - DNA, 20 bp, Artificial Sequence
  Description of Artificial Sequence: Synthetic oligonucleotide
  Target: ATXN1; (+) strand; PAM type: NRG; PAM sequence: GAG
gaccttcttacgaggctcag

SEQ ID NO: 123748 - DNA, 20 bp, Artificial Sequence
  Description of Artificial Sequence: Synthetic oligonucleotide
  Target: ATXN1; (+) strand; PAM type: NRG; PAM sequence: TGG
acgaggctcaggagtcctcc

SEQ ID NO: 123749 - DNA, 20 bp, Artificial Sequence
  Description of Artificial Sequence: Synthetic oligonucleotide
  Target: ATXN1; (+) strand; PAM type: NRG; PAM sequence: GGG
cgaggctcaggagtcctcct

SEQ ID NO: 123750 - DNA, 20 bp, Artificial Sequence
  Description of Artificial Sequence: Synthetic oligonucleotide
  Target: ATXN1; (+) strand; PAM type: NRG; PAM sequence: GGG
gaggctcaggagtcctcctg

SEQ ID NO: 123751 - DNA, 20 bp, Artificial Sequence
  Description of Artificial Sequence: Synthetic oligonucleotide
  Target: ATXN1; (+) strand; PAM type: NRG; PAM sequence: GGG
aggctcaggagtcctcctgg

SEQ ID NO: 123752 - DNA, 20 bp, Artificial Sequence
  Description of Artificial Sequence: Synthetic oligonucleotide
  Target: ATXN1; (+) strand; PAM type: NRG; PAM sequence: AAG
tcaggagtcctcctggggga

SEQ ID NO: 123753 - DNA, 20 bp, Artificial Sequence
  Description of Artificial Sequence: Synthetic oligonucleotide
  Target: ATXN1; (+) strand; PAM type: NRG; PAM sequence: GAG
aggagtcctcctgggggaaa

SEQ ID NO: 123754 - DNA, 20 bp, Artificial Sequence
  Description of Artificial Sequence: Synthetic oligonucleotide
  Target: ATXN1; (+) strand; PAM type: NRG; PAM sequence: TGG
acctgctattctactttgca

SEQ ID NO: 123755 - DNA, 20 bp, Artificial Sequence
  Description of Artificial Sequence: Synthetic oligonucleotide
  Target: ATXN1; (+) strand; PAM type: NRG; PAM sequence: TGG
gctattctactttgcatggt

SEQ ID NO: 123756 - DNA, 20 bp, Artificial Sequence
  Description of Artificial Sequence: Synthetic oligonucleotide
  Target: ATXN1; (+) strand; PAM type: NRG; PAM sequence: CAG
tctactttgcatggttggtt

SEQ ID NO: 123757 - DNA, 20 bp, Artificial Sequence
  Description of Artificial Sequence: Synthetic oligonucleotide
  Target: ATXN1; (+) strand; PAM type: NRG; PAM sequence: AGG
ctactttgcatggttggttc

SEQ ID NO: 123758 - DNA, 20 bp, Artificial Sequence
  Description of Artificial Sequence: Synthetic oligonucleotide
  Target: ATXN1; (+) strand; PAM type: NRG; PAM sequence: TAG
tgcatggttggttcaggctc

SEQ ID NO: 123759 - DNA, 20 bp, Artificial Sequence
  Description of Artificial Sequence: Synthetic oligonucleotide
  Target: ATXN1; (+) strand; PAM type: NRG; PAM sequence: TAG
ttggttcaggctctagaaaa

SEQ ID NO: 123760 - DNA, 20 bp, Artificial Sequence
  Description of Artificial Sequence: Synthetic oligonucleotide
  Target: ATXN1; (+) strand; PAM type: NRG; PAM sequence: AAG
ttcaggctctagaaaatagc

SEQ ID NO: 123761 - DNA, 20 bp, Artificial Sequence
  Description of Artificial Sequence: Synthetic oligonucleotide
  Target: ATXN1; (+) strand; PAM type: NRG; PAM sequence: GAG
caggctctagaaaatagcaa

SEQ ID NO: 123762 - DNA, 20 bp, Artificial Sequence
  Description of Artificial Sequence: Synthetic oligonucleotide
  Target: ATXN1; (+) strand; PAM type: NRG; PAM sequence: CAG
cctcctcctcctcctgcaat

SEQ ID NO: 123763 - DNA, 20 bp, Artificial Sequence
  Description of Artificial Sequence: Synthetic oligonucleotide
  Target: ATXN1; (+) strand; PAM type: NRG; PAM sequence: TAG
ttcctttttttttttttttt

SEQ ID NO: 123764 - DNA, 20 bp, Artificial Sequence
  Description of Artificial Sequence: Synthetic oligonucleotide
  Target: ATXN1; (+) strand; PAM type: NRG; PAM sequence: TAG
tttttttttttttttagctt

SEQ ID NO: 123765 - DNA, 20 bp, Artificial Sequence
  Description of Artificial Sequence: Synthetic oligonucleotide
  Target: ATXN1; (+) strand; PAM type: NRG; PAM sequence: TGG
ctctacttctattttccaac

SEQ ID NO: 123766 - DNA, 20 bp, Artificial Sequence
  Description of Artificial Sequence: Synthetic oligonucleotide
  Target: ATXN1; (+) strand; PAM type: NRG; PAM sequence: GGG
tctacttctattttccaact

SEQ ID NO: 123767 - DNA, 20 bp, Artificial Sequence
  Description of Artificial Sequence: Synthetic oligonucleotide
  Target: ATXN1; (+) strand; PAM type: NRG; PAM sequence: TGG
ctattttccaactgggatca

SEQ ID NO: 123768 - DNA, 20 bp, Artificial Sequence
  Description of Artificial Sequence: Synthetic oligonucleotide
  Target: ATXN1; (+) strand; PAM type: NRG; PAM sequence: CAG
ggctactgccttctactact

SEQ ID NO: 123769 - DNA, 20 bp, Artificial Sequence
  Description of Artificial Sequence: Synthetic oligonucleotide
  Target: ATXN1; (+) strand; PAM type: NRG; PAM sequence: CAG
tactgccttctactactcag

SEQ ID NO: 123770 - DNA, 20 bp, Artificial Sequence
  Description of Artificial Sequence: Synthetic oligonucleotide
  Target: ATXN1; (+) strand; PAM type: NRG; PAM sequence: GAG
gctaattacacacaccctcc

SEQ ID NO: 123771 - DNA, 20 bp, Artificial Sequence
  Description of Artificial Sequence: Synthetic oligonucleotide
  Target: ATXN1; (+) strand; PAM type: NRG; PAM sequence: AGG
ctaattacacacaccctccg

SEQ ID NO: 123772 - DNA, 20 bp, Artificial Sequence
  Description of Artificial Sequence: Synthetic oligonucleotide
  Target: ATXN1; (+) strand; PAM type: NRG; PAM sequence: TAG
cacacaccctccgaggaacg

SEQ ID NO: 123773 - DNA, 20 bp, Artificial Sequence
  Description of Artificial Sequence: Synthetic oligonucleotide
  Target: ATXN1; (+) strand; PAM type: NRG; PAM sequence: AGG
acacaccctccgaggaacgt

SEQ ID NO: 123774 - DNA, 20 bp, Artificial Sequence
  Description of Artificial Sequence: Synthetic oligonucleotide
  Target: ATXN1; (+) strand; PAM type: NRG; PAM sequence: GAG
tccgaggaacgtaggccact

SEQ ID NO: 123775 - DNA, 20 bp, Artificial Sequence
  Description of Artificial Sequence: Synthetic oligonucleotide
  Target: ATXN1; (+) strand; PAM type: NRG; PAM sequence: GAG
aggaacgtaggccactgagt

SEQ ID NO: 123776 - DNA, 20 bp, Artificial Sequence
  Description of Artificial Sequence: Synthetic oligonucleotide
  Target: ATXN1; (+) strand; PAM type: NRG; PAM sequence: AGG
ggaacgtaggccactgagtg

SEQ ID NO: 123777 - DNA, 20 bp, Artificial Sequence
  Description of Artificial Sequence: Synthetic oligonucleotide
  Target: ATXN1; (+) strand; PAM type: NRG; PAM sequence: GGG
gaacgtaggccactgagtga

SEQ ID NO: 123778 - DNA, 20 bp, Artificial Sequence
  Description of Artificial Sequence: Synthetic oligonucleotide
  Target: ATXN1; (+) strand; PAM type: NRG; PAM sequence: GGG
aacgtaggccactgagtgag

SEQ ID NO: 123779 - DNA, 20 bp, Artificial Sequence
  Description of Artificial Sequence: Synthetic oligonucleotide
  Target: ATXN1; (+) strand; PAM type: NRG; PAM sequence: CAG
ctgagtgaggggcccaaact

SEQ ID NO: 123780 - DNA, 20 bp, Artificial Sequence
  Description of Artificial Sequence: Synthetic oligonucleotide
  Target: ATXN1; (+) strand; PAM type: NRG; PAM sequence: TGG
gtgaggggcccaaactcagc

SEQ ID NO: 123781 - DNA, 20 bp, Artificial Sequence
  Description of Artificial Sequence: Synthetic oligonucleotide
  Target: ATXN1; (+) strand; PAM type: NRG; PAM sequence: CAG
caatccctgcttatccctct

SEQ ID NO: 123782 - DNA, 20 bp, Artificial Sequence
  Description of Artificial Sequence: Synthetic oligonucleotide
  Target: ATXN1; (+) strand; PAM type: NRG; PAM sequence: TGG
ctgcttatccctctcagctg

SEQ ID NO: 123783 - DNA, 20 bp, Artificial Sequence
  Description of Artificial Sequence: Synthetic oligonucleotide
  Target: ATXN1; (+) strand; PAM type: NRG; PAM sequence: CAG
ttatccctctcagctgtggt

SEQ ID NO: 123784 - DNA, 20 bp, Artificial Sequence
  Description of Artificial Sequence: Synthetic oligonucleotide
  Target: ATXN1; (+) strand; PAM type: NRG; PAM sequence: TGG
ccctctcagctgtggtcagc

SEQ ID NO: 123785 - DNA, 20 bp, Artificial Sequence
  Description of Artificial Sequence: Synthetic oligonucleotide
  Target: ATXN1; (+) strand; PAM type: NRG; PAM sequence: TAG
gctgtggtcagctggacacc

SEQ ID NO: 123786 - DNA, 20 bp, Artificial Sequence
  Description of Artificial Sequence: Synthetic oligonucleotide
  Target: ATXN1; (+) strand; PAM type: NRG; PAM sequence: AGG
ctgtggtcagctggacacct

SEQ ID NO: 123787 - DNA, 20 bp, Artificial Sequence
  Description of Artificial Sequence: Synthetic oligonucleotide
  Target: ATXN1; (+) strand; PAM type: NRG; PAM sequence: TGG
gctggacacctaggcacaca

SEQ ID NO: 123788 - DNA, 20 bp, Artificial Sequence
  Description of Artificial Sequence: Synthetic oligonucleotide
  Target: ATXN1; (+) strand; PAM type: NRG; PAM sequence: GGG
ctggacacctaggcacacat

SEQ ID NO: 123789 - DNA, 20 bp, Artificial Sequence
  Description of Artificial Sequence: Synthetic oligonucleotide
  Target: ATXN1; (+) strand; PAM type: NRG; PAM sequence: GGG
tggacacctaggcacacatg

SEQ ID NO: 123790 - DNA, 20 bp, Artificial Sequence
  Description of Artificial Sequence: Synthetic oligonucleotide
  Target: ATXN1; (+) strand; PAM type: NRG; PAM sequence: AAG
acacctaggcacacatgggg

SEQ ID NO: 123791 - DNA, 20 bp, Artificial Sequence
  Description of Artificial Sequence: Synthetic oligonucleotide
  Target: ATXN1; (+) strand; PAM type: NRG; PAM sequence: CAG
gcacacatggggaagccact

SEQ ID NO: 123792 - DNA, 20 bp, Artificial Sequence
  Description of Artificial Sequence: Synthetic oligonucleotide
  Target: ATXN1; (+) strand; PAM type: NRG; PAM sequence: AAG
gccactcagtccttgcctga

SEQ ID NO: 123793 - DNA, 20 bp, Artificial Sequence
  Description of Artificial Sequence: Synthetic oligonucleotide
  Target: ATXN1; (+) strand; PAM type: NRG; PAM sequence: AAG
actcagtccttgcctgaaag

SEQ ID NO: 123794 - DNA, 20 bp, Artificial Sequence
  Description of Artificial Sequence: Synthetic oligonucleotide
  Target: ATXN1; (+) strand; PAM type: NRG; PAM sequence: CGG
cctgaaagaagaaaacatac

SEQ ID NO: 123795 - DNA, 20 bp, Artificial Sequence
  Description of Artificial Sequence: Synthetic oligonucleotide
  Target: ATXN1; (+) strand; PAM type: NRG; PAM sequence: CAG
gaaagaagaaaacataccgg

SEQ ID NO: 123796 - DNA, 20 bp, Artificial Sequence
  Description of Artificial Sequence: Synthetic oligonucleotide
  Target: ATXN1; (+) strand; PAM type: NRG; PAM sequence: CAG
atctcaaccttcttcactaa

SEQ ID NO: 123797 - DNA, 20 bp, Artificial Sequence
  Description of Artificial Sequence: Synthetic oligonucleotide
  Target: ATXN1; (+) strand; PAM type: NRG; PAM sequence: AGG
tctcaaccttcttcactaac

SEQ ID NO: 123798 - DNA, 20 bp, Artificial Sequence
  Description of Artificial Sequence: Synthetic oligonucleotide
  Target: ATXN1; (+) strand; PAM type: NRG; PAM sequence: AAG
aaccttcttcactaacaggc

SEQ ID NO: 123799 - DNA, 20 bp, Artificial Sequence
  Description of Artificial Sequence: Synthetic oligonucleotide
  Target: ATXN1; (+) strand; PAM type: NRG; PAM sequence: CAG
taccatgtgttgaatttaac

SEQ ID NO: 123800 - DNA, 20 bp, Artificial Sequence
  Description of Artificial Sequence: Synthetic oligonucleotide
  Target: ATXN1; (+) strand; PAM type: NRG; PAM sequence: CAG
atgtgttgaatttaaccagc

SEQ ID NO: 123801 - DNA, 20 bp, Artificial Sequence
  Description of Artificial Sequence: Synthetic oligonucleotide
  Target: ATXN1; (+) strand; PAM type: NRG; PAM sequence: CAG
accagccagcaccaaaccat

SEQ ID NO: 123802 - DNA, 20 bp, Artificial Sequence
  Description of Artificial Sequence: Synthetic oligonucleotide
  Target: ATXN1; (+) strand; PAM type: NRG; PAM sequence: CAG
ccatcagactttctgttact

SEQ ID NO: 123803 - DNA, 20 bp, Artificial Sequence
  Description of Artificial Sequence: Synthetic oligonucleotide
  Target: ATXN1; (+) strand; PAM type: NRG; PAM sequence: AAG
actttctgttactcagaaat

SEQ ID NO: 123804 - DNA, 20 bp, Artificial Sequence
  Description of Artificial Sequence: Synthetic oligonucleotide
  Target: ATXN1; (+) strand; PAM type: NRG; PAM sequence: CAG
gttactcagaaataagtaaa

SEQ ID NO: 123805 - DNA, 20 bp, Artificial Sequence
  Description of Artificial Sequence: Synthetic oligonucleotide
  Target: ATXN1; (+) strand; PAM type: NRG; PAM sequence: AAG
aataagtaaacagtatgaaa

SEQ ID NO: 123806 - DNA, 20 bp, Artificial Sequence
  Description of Artificial Sequence: Synthetic oligonucleotide
  Target: ATXN1; (+) strand; PAM type: NRG; PAM sequence: AGG
ataagtaaacagtatgaaaa

SEQ ID NO: 123807 - DNA, 20 bp, Artificial Sequence
  Description of Artificial Sequence: Synthetic oligonucleotide
  Target: ATXN1; (+) strand; PAM type: NRG; PAM sequence: TAG
gtatgaaaaaggtcccttat

SEQ ID NO: 123808 - DNA, 20 bp, Artificial Sequence
  Description of Artificial Sequence: Synthetic oligonucleotide
  Target: ATXN1; (+) strand; PAM type: NRG; PAM sequence: AGG
tatgaaaaaggtcccttatt

SEQ ID NO: 123809 - DNA, 20 bp, Artificial Sequence
  Description of Artificial Sequence: Synthetic oligonucleotide
  Target: ATXN1; (+) strand; PAM type: NRG; PAM sequence: TGG
gaaaaaggtcccttattagg

SEQ ID NO: 123810 - DNA, 20 bp, Artificial Sequence
  Description of Artificial Sequence: Synthetic oligonucleotide
  Target: ATXN1; (+) strand; PAM type: NRG; PAM sequence: GGG
aaaaaggtcccttattaggt

SEQ ID NO: 123811 - DNA, 20 bp, Artificial Sequence
  Description of Artificial Sequence: Synthetic oligonucleotide
  Target: ATXN1; (+) strand; PAM type: NRG; PAM sequence: CAG
ggtcccttattaggtgggct

SEQ ID NO: 123812 - DNA, 20 bp, Artificial Sequence
  Description of Artificial Sequence: Synthetic oligonucleotide
  Target: ATXN1; (+) strand; PAM type: NRG; PAM sequence: AGG
gtcccttattaggtgggctc

SEQ ID NO: 123813 - DNA, 20 bp, Artificial Sequence
  Description of Artificial Sequence: Synthetic oligonucleotide
  Target: ATXN1; (+) strand; PAM type: NRG; PAM sequence: GGG
tcccttattaggtgggctca

SEQ ID NO: 123814 - DNA, 20 bp, Artificial Sequence
  Description of Artificial Sequence: Synthetic oligonucleotide
  Target: ATXN1; (+) strand; PAM type: NRG; PAM sequence: TGG
attaggtgggctcagggtgc

SEQ ID NO: 123815 - DNA, 20 bp, Artificial Sequence
  Description of Artificial Sequence: Synthetic oligonucleotide
  Target: ATXN1; (+) strand; PAM type: NRG; PAM sequence: CAG
tgggctcagggtgctggtat

SEQ ID NO: 123816 - DNA, 20 bp, Artificial Sequence
  Description of Artificial Sequence: Synthetic oligonucleotide
  Target: ATXN1; (+) strand; PAM type: NRG; PAM sequence: AGG
gggctcagggtgctggtatc

SEQ ID NO: 123817 - DNA, 20 bp, Artificial Sequence
  Description of Artificial Sequence: Synthetic oligonucleotide
  Target: ATXN1; (+) strand; PAM type: NRG; PAM sequence: TAG
atttttgcatattctatcat

SEQ ID NO: 123818 - DNA, 20 bp, Artificial Sequence
  Description of Artificial Sequence: Synthetic oligonucleotide
  Target: ATXN1; (+) strand; PAM type: NRG; PAM sequence: AGG
tttttgcatattctatcatt

SEQ ID NO: 123819 - DNA, 20 bp, Artificial Sequence
  Description of Artificial Sequence: Synthetic oligonucleotide
  Target: ATXN1; (+) strand; PAM type: NRG; PAM sequence: CAG
tgcatattctatcattaggt

SEQ ID NO: 123820 - DNA, 20 bp, Artificial Sequence
  Description of Artificial Sequence: Synthetic oligonucleotide
  Target: ATXN1; (+) strand; PAM type: NRG; PAM sequence: AGG
gcatattctatcattaggtc

SEQ ID NO: 123821 - DNA, 20 bp, Artificial Sequence
  Description of Artificial Sequence: Synthetic oligonucleotide
  Target: ATXN1; (+) strand; PAM type: NRG; PAM sequence: AAG
ctgacatcccaaaccttaaa

SEQ ID NO: 123822 - DNA, 20 bp, Artificial Sequence
  Description of Artificial Sequence: Synthetic oligonucleotide
  Target: ATXN1; (+) strand; PAM type: NRG; PAM sequence: AAG
ccaaaccttaaaaagttaat

SEQ ID NO: 123823 - DNA, 20 bp, Artificial Sequence
  Description of Artificial Sequence: Synthetic oligonucleotide
  Target: ATXN1; (+) strand; PAM type: NRG; PAM sequence: AGG
caaaccttaaaaagttaata

SEQ ID NO: 123824 - DNA, 20 bp, Artificial Sequence
  Description of Artificial Sequence: Synthetic oligonucleotide
  Target: ATXN1; (+) strand; PAM type: NRG; PAM sequence: GGG
aaaccttaaaaagttaataa

SEQ ID NO: 123825 - DNA, 20 bp, Artificial Sequence
  Description of Artificial Sequence: Synthetic oligonucleotide
  Target: ATXN1; (+) strand; PAM type: NRG; PAM sequence: AAG
cttaaaaagttaataaggga

SEQ ID NO: 123826 - DNA, 20 bp, Artificial Sequence
  Description of Artificial Sequence: Synthetic oligonucleotide
  Target: ATXN1; (+) strand; PAM type: NRG; PAM sequence: AAG
aagaacgcataaacgcatat

SEQ ID NO: 123827 - DNA, 20 bp, Artificial Sequence
  Description of Artificial Sequence: Synthetic oligonucleotide
  Target: ATXN1; (+) strand; PAM type: NRG; PAM sequence: TGG
aaacgcatataagctttata

SEQ ID NO: 123828 - DNA, 20 bp, Artificial Sequence
  Description of Artificial Sequence: Synthetic oligonucleotide
  Target: ATXN1; (+) strand; PAM type: NRG; PAM sequence: AAG
cgcatataagctttatatgg

SEQ ID NO: 123829 - DNA, 20 bp, Artificial Sequence
  Description of Artificial Sequence: Synthetic oligonucleotide
  Target: ATXN1; (+) strand; PAM type: NRG; PAM sequence: AGG
gcatataagctttatatgga

SEQ ID NO: 123830 - DNA, 20 bp, Artificial Sequence
  Description of Artificial Sequence: Synthetic oligonucleotide
  Target: ATXN1; (+) strand; PAM type: NRG; PAM sequence: AAG
taagctttatatggaaggtt

SEQ ID NO: 123831 - DNA, 20 bp, Artificial Sequence
  Description of Artificial Sequence: Synthetic oligonucleotide
  Target: ATXN1; (+) strand; PAM type: NRG; PAM sequence: TGG
atatggaaggttaagtgcac

SEQ ID NO: 123832 - DNA, 20 bp, Artificial Sequence
  Description of Artificial Sequence: Synthetic oligonucleotide
  Target: ATXN1; (+) strand; PAM type: NRG; PAM sequence: CAG
tggaaggttaagtgcactgg

SEQ ID NO: 123833 - DNA, 20 bp, Artificial Sequence
  Description of Artificial Sequence: Synthetic oligonucleotide
  Target: ATXN1; (+) strand; PAM type: NRG; PAM sequence: TAG
gcactggcagcctactaaaa

SEQ ID NO: 123834 - DNA, 20 bp, Artificial Sequence
  Description of Artificial Sequence: Synthetic oligonucleotide
  Target: ATXN1; (+) strand; PAM type: NRG; PAM sequence: AAG
tggcagcctactaaaataga

SEQ ID NO: 123835 - DNA, 20 bp, Artificial Sequence
  Description of Artificial Sequence: Synthetic oligonucleotide
  Target: ATXN1; (+) strand; PAM type: NRG; PAM sequence: CAG
ctaaaatagaaagttaaata

SEQ ID NO: 123836 - DNA, 20 bp, Artificial Sequence
  Description of Artificial Sequence: Synthetic oligonucleotide
  Target: ATXN1; (+) strand; PAM type: NRG; PAM sequence: GAG
agaaagttaaatacagcaat

SEQ ID NO: 123837 - DNA, 20 bp, Artificial Sequence
  Description of Artificial Sequence: Synthetic oligonucleotide
  Target: ATXN1; (+) strand; PAM type: NRG; PAM sequence: AAG
aatttccccttgcaataaaa

SEQ ID NO: 123838 - DNA, 20 bp, Artificial Sequence
  Description of Artificial Sequence: Synthetic oligonucleotide
  Target: ATXN1; (+) strand; PAM type: NRG; PAM sequence: AAG
ttccccttgcaataaaaaag

SEQ ID NO: 123839 - DNA, 20 bp, Artificial Sequence
  Description of Artificial Sequence: Synthetic oligonucleotide
  Target: ATXN1; (+) strand; PAM type: NRG; PAM sequence: AGG
tccccttgcaataaaaaaga

SEQ ID NO: 123840 - DNA, 20 bp, Artificial Sequence
  Description of Artificial Sequence: Synthetic oligonucleotide
  Target: ATXN1; (+) strand; PAM type: NRG; PAM sequence: GGG
ccccttgcaataaaaaagaa

SEQ ID NO: 123841 - DNA, 20 bp, Artificial Sequence
  Description of Artificial Sequence: Synthetic oligonucleotide
  Target: ATXN1; (+) strand; PAM type: NRG; PAM sequence: GGG
cccttgcaataaaaaagaag

SEQ ID NO: 123842 - DNA, 20 bp, Artificial Sequence
  Description of Artificial Sequence: Synthetic oligonucleotide
  Target: ATXN1; (+) strand; PAM type: NRG; PAM sequence: TAG
taaaaaagaaggggccttaa

SEQ ID NO: 123843 - DNA, 20 bp, Artificial Sequence
  Description of Artificial Sequence: Synthetic oligonucleotide
  Target: ATXN1; (+) strand; PAM type: NRG; PAM sequence: AGG
aaaaaagaaggggccttaat

SEQ ID NO: 123844 - DNA, 20 bp, Artificial Sequence
  Description of Artificial Sequence: Synthetic oligonucleotide
  Target: ATXN1; (+) strand; PAM type: NRG; PAM sequence: AAG
aggggccttaataggaacac

SEQ ID NO: 123845 - DNA, 20 bp, Artificial Sequence
  Description of Artificial Sequence: Synthetic oligonucleotide
  Target: ATXN1; (+) strand; PAM type: NRG; PAM sequence: CAG
gccttaataggaacacaagc

SEQ ID NO: 123846 - DNA, 20 bp, Artificial Sequence
  Description of Artificial Sequence: Synthetic oligonucleotide
  Target: ATXN1; (+) strand; PAM type: NRG; PAM sequence: AGG
ccttaataggaacacaagcc

SEQ ID NO: 123847 - DNA, 20 bp, Artificial Sequence
  Description of Artificial Sequence: Synthetic oligonucleotide
  Target: ATXN1; (+) strand; PAM type: NRG; PAM sequence: TGG
ggaacacaagccaggcttgc

SEQ ID NO: 123848 - DNA, 20 bp, Artificial Sequence
  Description of Artificial Sequence: Synthetic oligonucleotide
  Target: ATXN1; (+) strand; PAM type: NRG; PAM sequence: AAG
acaagccaggcttgctggaa

SEQ ID NO: 123849 - DNA, 20 bp, Artificial Sequence
  Description of Artificial Sequence: Synthetic oligonucleotide
  Target: ATXN1; (+) strand; PAM type: NRG; PAM sequence: CAG
agccaggcttgctggaaaag

SEQ ID NO: 123850 - DNA, 20 bp, Artificial Sequence
  Description of Artificial Sequence: Synthetic oligonucleotide
  Target: ATXN1; (+) strand; PAM type: NRG; PAM sequence: TGG
aacctgcaattgactactta

SEQ ID NO: 123851 - DNA, 20 bp, Artificial Sequence
  Description of Artificial Sequence: Synthetic oligonucleotide
  Target: ATXN1; (+) strand; PAM type: NRG; PAM sequence: GAG
cctgcaattgactacttatg

SEQ ID NO: 123852 - DNA, 20 bp, Artificial Sequence
  Description of Artificial Sequence: Synthetic oligonucleotide
  Target: ATXN1; (+) strand; PAM type: NRG; PAM sequence: AGG
ctgcaattgactacttatgg

SEQ ID NO: 123853 - DNA, 20 bp, Artificial Sequence
  Description of Artificial Sequence: Synthetic oligonucleotide
  Target: ATXN1; (+) strand; PAM type: NRG; PAM sequence: CGG
ttatggaggacttaaatttc

SEQ ID NO: 123854 - DNA, 20 bp, Artificial Sequence
  Description of Artificial Sequence: Synthetic oligonucleotide
  Target: ATXN1; (+) strand; PAM type: NRG; PAM sequence: CGG
ccatcactgacccgtgtaca

SEQ ID NO: 123855 - DNA, 20 bp, Artificial Sequence
  Description of Artificial Sequence: Synthetic oligonucleotide
  Target: ATXN1; (+) strand; PAM type: NRG; PAM sequence: GAG
tgacccgtgtacacggttat

SEQ ID NO: 123856 - DNA, 20 bp, Artificial Sequence
  Description of Artificial Sequence: Synthetic oligonucleotide
  Target: ATXN1; (+) strand; PAM type: NRG; PAM sequence: AGG
gacccgtgtacacggttatg

SEQ ID NO: 123857 - DNA, 20 bp, Artificial Sequence
  Description of Artificial Sequence: Synthetic oligonucleotide
  Target: ATXN1; (+) strand; PAM type: NRG; PAM sequence: TAG
ttatgaggctccgataacaa

SEQ ID NO: 123858 - DNA, 20 bp, Artificial Sequence
  Description of Artificial Sequence: Synthetic oligonucleotide
  Target: ATXN1; (+) strand; PAM type: NRG; PAM sequence: CAG
tccgataacaatagcactct

SEQ ID NO: 123859 - DNA, 20 bp, Artificial Sequence
  Description of Artificial Sequence: Synthetic oligonucleotide
  Target: ATXN1; (+) strand; PAM type: NRG; PAM sequence: AGG
ccgataacaatagcactctc

SEQ ID NO: 123860 - DNA, 20 bp, Artificial Sequence
  Description of Artificial Sequence: Synthetic oligonucleotide
  Target: ATXN1; (+) strand; PAM type: NRG; PAM sequence: GGG
cgataacaatagcactctca

SEQ ID NO: 123861 - DNA, 20 bp, Artificial Sequence
  Description of Artificial Sequence: Synthetic oligonucleotide
  Target: ATXN1; (+) strand; PAM type: NRG; PAM sequence: GAG
ataacaatagcactctcagg

SEQ ID NO: 123862 - DNA, 20 bp, Artificial Sequence
  Description of Artificial Sequence: Synthetic oligonucleotide
  Target: ATXN1; (+) strand; PAM type: NRG; PAM sequence: CAG
gcactctcagggagaaccga

SEQ ID NO: 123863 - DNA, 20 bp, Artificial Sequence
  Description of Artificial Sequence: Synthetic oligonucleotide
  Target: ATXN1; (+) strand; PAM type: NRG; PAM sequence: AAG
gagaaccgacagtttaacga

SEQ ID NO: 123864 - DNA, 20 bp, Artificial Sequence
  Description of Artificial Sequence: Synthetic oligonucleotide
  Target: ATXN1; (+) strand; PAM type: NRG; PAM sequence: TAG
acagtttaacgaaagcaaat

SEQ ID NO: 123865 - DNA, 20 bp, Artificial Sequence
  Description of Artificial Sequence: Synthetic oligonucleotide
  Target: ATXN1; (+) strand; PAM type: NRG; PAM sequence: AGG
cagtttaacgaaagcaaatt

SEQ ID NO: 123866 - DNA, 20 bp, Artificial Sequence
  Description of Artificial Sequence: Synthetic oligonucleotide
  Target: ATXN1; (+) strand; PAM type: NRG; PAM sequence: GGG
agtttaacgaaagcaaatta

SEQ ID NO: 123867 - DNA, 20 bp, Artificial Sequence
  Description of Artificial Sequence: Synthetic oligonucleotide
  Target: ATXN1; (+) strand; PAM type: NRG; PAM sequence: CAG
acgaaagcaaattagggtct

SEQ ID NO: 123868 - DNA, 20 bp, Artificial Sequence
  Description of Artificial Sequence: Synthetic oligonucleotide
  Target: ATXN1; (+) strand; PAM type: NRG; PAM sequence: AAG
caaattagggtctcagtaat

SEQ ID NO: 123869 - DNA, 20 bp, Artificial Sequence
  Description of Artificial Sequence: Synthetic oligonucleotide
  Target: ATXN1; (+) strand; PAM type: NRG; PAM sequence: GAG
gtctcagtaataagatgact

SEQ ID NO: 123870 - DNA, 20 bp, Artificial Sequence
  Description of Artificial Sequence: Synthetic oligonucleotide
  Target: ATXN1; (+) strand; PAM type: NRG; PAM sequence: AAG
cgtctatcttttaaacactt

SEQ ID NO: 123871 - DNA, 20 bp, Artificial Sequence
  Description of Artificial Sequence: Synthetic oligonucleotide
  Target: ATXN1; (+) strand; PAM type: NRG; PAM sequence: TAG
tttaaacacttaagtaattt

SEQ ID NO: 123872 - DNA, 20 bp, Artificial Sequence
  Description of Artificial Sequence: Synthetic oligonucleotide
  Target: ATXN1; (+) strand; PAM type: NRG; PAM sequence: CAG
tttagtgttgcttcacttgc

SEQ ID NO: 123873 - DNA, 20 bp, Artificial Sequence
  Description of Artificial Sequence: Synthetic oligonucleotide
  Target: ATXN1; (+) strand; PAM type: NRG; PAM sequence: GAG
tagtgttgcttcacttgcca

SEQ ID NO: 123874 - DNA, 20 bp, Artificial Sequence
  Description of Artificial Sequence: Synthetic oligonucleotide
  Target: ATXN1; (+) strand; PAM type: NRG; PAM sequence: GAG
cttcacttgccagagtaaat

SEQ ID NO: 123875 - DNA, 20 bp, Artificial Sequence
  Description of Artificial Sequence: Synthetic oligonucleotide
  Target: ATXN1; (+) strand; PAM type: NRG; PAM sequence: AAG
aaacctctgctttctcataa

SEQ ID NO: 123876 - DNA, 20 bp, Artificial Sequence
  Description of Artificial Sequence: Synthetic oligonucleotide
  Target: ATXN1; (+) strand; PAM type: NRG; PAM sequence: TGG
gcctccatatacccaacgaa

SEQ ID NO: 123877 - DNA, 20 bp, Artificial Sequence
  Description of Artificial Sequence: Synthetic oligonucleotide
  Target: ATXN1; (+) strand; PAM type: NRG; PAM sequence: AAG
atggcgaatgatgttacaat

SEQ ID NO: 123878 - DNA, 20 bp, Artificial Sequence
  Description of Artificial Sequence: Synthetic oligonucleotide
  Target: ATXN1; (+) strand; PAM type: NRG; PAM sequence: CAG
gcgaatgatgttacaataag

SEQ ID NO: 123879 - DNA, 20 bp, Artificial Sequence
  Description of Artificial Sequence: Synthetic oligonucleotide
  Target: ATXN1; (+) strand; PAM type: NRG; PAM sequence: AAG
cgtgtcccatttcctcccat

SEQ ID NO: 123880 - DNA, 20 bp, Artificial Sequence
  Description of Artificial Sequence: Synthetic oligonucleotide
  Target: ATXN1; (+) strand; PAM type: NRG; PAM sequence: AGG
gtgtcccatttcctcccata

SEQ ID NO: 123881 - DNA, 20 bp, Artificial Sequence
  Description of Artificial Sequence: Synthetic oligonucleotide
  Target: ATXN1; (+) strand; PAM type: NRG; PAM sequence: TGG
attctccttttcacttcatc

SEQ ID NO: 123882 - DNA, 20 bp, Artificial Sequence
  Description of Artificial Sequence: Synthetic oligonucleotide
  Target: ATXN1; (+) strand; PAM type: NRG; PAM sequence: GAG
tctccttttcacttcatctg

SEQ ID NO: 123883 - DNA, 20 bp, Artificial Sequence
  Description of Artificial Sequence: Synthetic oligonucleotide
  Target: ATXN1; (+) strand; PAM type: NRG; PAM sequence: AGG
ctccttttcacttcatctgg

SEQ ID NO: 123884 - DNA, 20 bp, Artificial Sequence
  Description of Artificial Sequence: Synthetic oligonucleotide
  Target: ATXN1; (+) strand; PAM type: NRG; PAM sequence: GGG
tccttttcacttcatctgga

SEQ ID NO: 123885 - DNA, 20 bp, Artificial Sequence
  Description of Artificial Sequence: Synthetic oligonucleotide
  Target: ATXN1; (+) strand; PAM type: NRG; PAM sequence: CAG
ttttcacttcatctggaggg

SEQ ID NO: 123886 - DNA, 20 bp, Artificial Sequence
  Description of Artificial Sequence: Synthetic oligonucleotide
  Target: ATXN1; (+) strand; PAM type: NRG; PAM sequence: TAG
gagggcagtgtcttccctcc

SEQ ID NO: 123887 - DNA, 20 bp, Artificial Sequence
  Description of Artificial Sequence: Synthetic oligonucleotide
  Target: ATXN1; (+) strand; PAM type: NRG; PAM sequence: AAG
ggcagtgtcttccctcctag

SEQ ID NO: 123888 - DNA, 20 bp, Artificial Sequence
  Description of Artificial Sequence: Synthetic oligonucleotide
  Target: ATXN1; (+) strand; PAM type: NRG; PAM sequence: GAG
cagtgtcttccctcctagaa

SEQ ID NO: 123889 - DNA, 20 bp, Artificial Sequence
  Description of Artificial Sequence: Synthetic oligonucleotide
  Target: ATXN1; (+) strand; PAM type: NRG; PAM sequence: GAG
gtgtcttccctcctagaaga

SEQ ID NO: 123890 - DNA, 20 bp, Artificial Sequence
  Description of Artificial Sequence: Synthetic oligonucleotide
  Target: ATXN1; (+) strand; PAM type: NRG; PAM sequence: AGG
tgtcttccctcctagaagag

SEQ ID NO: 123891 - DNA, 20 bp, Artificial Sequence
  Description of Artificial Sequence: Synthetic oligonucleotide
  Target: ATXN1; (+) strand; PAM type: NRG; PAM sequence: CAG
tccctcctagaagagaggcc

SEQ ID NO: 123892 - DNA, 20 bp, Artificial Sequence
  Description of Artificial Sequence: Synthetic oligonucleotide
  Target: ATXN1; (+) strand; PAM type: NRG; PAM sequence: AGG
ccctcctagaagagaggccc

SEQ ID NO: 123893 - DNA, 20 bp, Artificial Sequence
  Description of Artificial Sequence: Synthetic oligonucleotide
  Target: ATXN1; (+) strand; PAM type: NRG; PAM sequence: GAG
ctagaagagaggcccaggct

SEQ ID NO: 123894 - DNA, 20 bp, Artificial Sequence
  Description of Artificial Sequence: Synthetic oligonucleotide
  Target: ATXN1; (+) strand; PAM type: NRG; PAM sequence: GAG
agaagagaggcccaggctga

SEQ ID NO: 123895 - DNA, 20 bp, Artificial Sequence
  Description of Artificial Sequence: Synthetic oligonucleotide
  Target: ATXN1; (+) strand; PAM type: NRG; PAM sequence: TGG
ggcccaggctgagagcatca

SEQ ID NO: 123896 - DNA, 20 bp, Artificial Sequence
  Description of Artificial Sequence: Synthetic oligonucleotide
  Target: ATXN1; (+) strand; PAM type: NRG; PAM sequence: TGG
ggctgagagcatcatggttt

SEQ ID NO: 123897 - DNA, 20 bp, Artificial Sequence
  Description of Artificial Sequence: Synthetic oligonucleotide
  Target: ATXN1; (+) strand; PAM type: NRG; PAM sequence: CAG
tgagagcatcatggttttgg

SEQ ID NO: 123898 - DNA, 20 bp, Artificial Sequence
  Description of Artificial Sequence: Synthetic oligonucleotide
  Target: ATXN1; (+) strand; PAM type: NRG; PAM sequence: AGG
gagagcatcatggttttggc

SEQ ID NO: 123899 - DNA, 20 bp, Artificial Sequence
  Description of Artificial Sequence: Synthetic oligonucleotide
  Target: ATXN1; (+) strand; PAM type: NRG; PAM sequence: GGG
agagcatcatggttttggca

SEQ ID NO: 123900 - DNA, 20 bp, Artificial Sequence
  Description of Artificial Sequence: Synthetic oligonucleotide
  Target: ATXN1; (+) strand; PAM type: NRG; PAM sequence: CAG
catggttttggcagggaact

SEQ ID NO: 123901 - DNA, 20 bp, Artificial Sequence
  Description of Artificial Sequence: Synthetic oligonucleotide
  Target: ATXN1; (+) strand; PAM type: NRG; PAM sequence: TGG
gcagggaactcagaaaatct

SEQ ID NO: 123902 - DNA, 20 bp, Artificial Sequence
  Description of Artificial Sequence: Synthetic oligonucleotide
  Target: ATXN1; (+) strand; PAM type: NRG; PAM sequence: CAG
aactcagaaaatcttggcat

SEQ ID NO: 123903 - DNA, 20 bp, Artificial Sequence
  Description of Artificial Sequence: Synthetic oligonucleotide
  Target: ATXN1; (+) strand; PAM type: NRG; PAM sequence: AGG
actcagaaaatcttggcatc

SEQ ID NO: 123904 - DNA, 20 bp, Artificial Sequence
  Description of Artificial Sequence: Synthetic oligonucleotide
  Target: ATXN1; (+) strand; PAM type: NRG; PAM sequence: GGG
ctcagaaaatcttggcatca

SEQ ID NO: 123905 - DNA, 20 bp, Artificial Sequence
  Description of Artificial Sequence: Synthetic oligonucleotide
  Target: ATXN1; (+) strand; PAM type: NRG; PAM sequence: AAG
ttggcatcagggcttactat

SEQ ID NO: 123906 - DNA, 20 bp, Artificial Sequence
  Description of Artificial Sequence: Synthetic oligonucleotide
  Target: ATXN1; (+) strand; PAM type: NRG; PAM sequence: GAG
atcagggcttactataagct

SEQ ID NO: 123907 - DNA, 20 bp, Artificial Sequence
  Description of Artificial Sequence: Synthetic oligonucleotide
  Target: ATXN1; (+) strand; PAM type: NRG; PAM sequence: CAG
ttactataagctgagttaaa

SEQ ID NO: 123908 - DNA, 20 bp, Artificial Sequence
  Description of Artificial Sequence: Synthetic oligonucleotide
  Target: ATXN1; (+) strand; PAM type: NRG; PAM sequence: AGG
tactataagctgagttaaac

SEQ ID NO: 123909 - DNA, 20 bp, Artificial Sequence
  Description of Artificial Sequence: Synthetic oligonucleotide
  Target: ATXN1; (+) strand; PAM type: NRG; PAM sequence: TGG
taagctgagttaaacaggaa

SEQ ID NO: 123910 - DNA, 20 bp, Artificial Sequence
  Description of Artificial Sequence: Synthetic oligonucleotide
  Target: ATXN1; (+) strand; PAM type: NRG; PAM sequence: AAG
gctgagttaaacaggaatgg

SEQ ID NO: 123911 - DNA, 20 bp, Artificial Sequence
  Description of Artificial Sequence: Synthetic oligonucleotide
  Target: ATXN1; (+) strand; PAM type: NRG; PAM sequence: TGG
aaacaggaatggaagatcat

SEQ ID NO: 123912 - DNA, 20 bp, Artificial Sequence
  Description of Artificial Sequence: Synthetic oligonucleotide
  Target: ATXN1; (+) strand; PAM type: NRG; PAM sequence: AAG
caggaatggaagatcattgg

SEQ ID NO: 123913 - DNA, 20 bp, Artificial Sequence
  Description of Artificial Sequence: Synthetic oligonucleotide
  Target: ATXN1; (+) strand; PAM type: NRG; PAM sequence: TGG
tggaagatcattggaagccc

SEQ ID NO: 123914 - DNA, 20 bp, Artificial Sequence
  Description of Artificial Sequence: Synthetic oligonucleotide
  Target: ATXN1; (+) strand; PAM type: NRG; PAM sequence: TAG
cattggaagccctggaaaaa

SEQ ID NO: 123915 - DNA, 20 bp, Artificial Sequence
  Description of Artificial Sequence: Synthetic oligonucleotide
  Target: ATXN1; (+) strand; PAM type: NRG; PAM sequence: TAG
ggaaaaatagaaaatatttc

SEQ ID NO: 123916 - DNA, 20 bp, Artificial Sequence
  Description of Artificial Sequence: Synthetic oligonucleotide
  Target: ATXN1; (+) strand; PAM type: NRG; PAM sequence: AGG
gaaaaatagaaaatatttct

SEQ ID NO: 123917 - DNA, 20 bp, Artificial Sequence
  Description of Artificial Sequence: Synthetic oligonucleotide
  Target: ATXN1; (+) strand; PAM type: NRG; PAM sequence: GGG
aaaaatagaaaatatttcta

SEQ ID NO: 123918 - DNA, 20 bp, Artificial Sequence
  Description of Artificial Sequence: Synthetic oligonucleotide
  Target: ATXN1; (+) strand; PAM type: NRG; PAM sequence: TAG
aatagaaaatatttctaggg

SEQ ID NO: 123919 - DNA, 20 bp, Artificial Sequence
  Description of Artificial Sequence: Synthetic oligonucleotide
  Target: ATXN1; (+) strand; PAM type: NRG; PAM sequence: CAG
aaaatatttctagggtagca

SEQ ID NO: 123920 - DNA, 20 bp, Artificial Sequence
  Description of Artificial Sequence: Synthetic oligonucleotide
  Target: ATXN1; (+) strand; PAM type: NRG; PAM sequence: AAG
atatttctagggtagcacag

SEQ ID NO: 123921 - DNA, 20 bp, Artificial Sequence
  Description of Artificial Sequence: Synthetic oligonucleotide
  Target: ATXN1; (+) strand; PAM type: NRG; PAM sequence: TGG
tctagggtagcacagaagtt

SEQ ID NO: 123922 - DNA, 20 bp, Artificial Sequence
  Description of Artificial Sequence: Synthetic oligonucleotide
  Target: ATXN1; (+) strand; PAM type: NRG; PAM sequence: TGG
cagaagtttggccttttcgc

SEQ ID NO: 123923 - DNA, 20 bp, Artificial Sequence
  Description of Artificial Sequence: Synthetic oligonucleotide
  Target: ATXN1; (+) strand; PAM type: NRG; PAM sequence: TGG
acatgatgtgactcatcatt

SEQ ID NO: 123924 - DNA, 20 bp, Artificial Sequence
  Description of Artificial Sequence: Synthetic oligonucleotide
  Target: ATXN1; (+) strand; PAM type: NRG; PAM sequence: GGG
catgatgtgactcatcattt

SEQ ID NO: 123925 - DNA, 20 bp, Artificial Sequence
  Description of Artificial Sequence: Synthetic oligonucleotide
  Target: ATXN1; (+) strand; PAM type: NRG; PAM sequence: TGG
gactcatcatttgggtgaca

SEQ ID NO: 123926 - DNA, 20 bp, Artificial Sequence
  Description of Artificial Sequence: Synthetic oligonucleotide
  Target: ATXN1; (+) strand; PAM type: NRG; PAM sequence: GAG
ctcatcatttgggtgacatg

SEQ ID NO: 123927 - DNA, 20 bp, Artificial Sequence
  Description of Artificial Sequence: Synthetic oligonucleotide
  Target: ATXN1; (+) strand; PAM type: NRG; PAM sequence: CAG
atcatttgggtgacatggag

SEQ ID NO: 123928 - DNA, 20 bp, Artificial Sequence
  Description of Artificial Sequence: Synthetic oligonucleotide
  Target: ATXN1; (+) strand; PAM type: NRG; PAM sequence: AGG
tcatttgggtgacatggagc

SEQ ID NO: 123929 - DNA, 20 bp, Artificial Sequence
  Description of Artificial Sequence: Synthetic oligonucleotide
  Target: ATXN1; (+) strand; PAM type: NRG; PAM sequence: CAG
tttgggtgacatggagcagg

SEQ ID NO: 123930 - DNA, 20 bp, Artificial Sequence
  Description of Artificial Sequence: Synthetic oligonucleotide
  Target: ATXN1; (+) strand; PAM type: NRG; PAM sequence: AAG
ggagcaggcagcatcgtttc

SEQ ID NO: 123931 - DNA, 20 bp, Artificial Sequence
  Description of Artificial Sequence: Synthetic oligonucleotide
  Target: ATXN1; (+) strand; PAM type: NRG; PAM sequence: AAG
ttcaagttcatcattttatt

SEQ ID NO: 123932 - DNA, 20 bp, Artificial Sequence
  Description of Artificial Sequence: Synthetic oligonucleotide
  Target: ATXN1; (+) strand; PAM type: NRG; PAM sequence: GAG
tcatcattttattaagcaat

SEQ ID NO: 123933 - DNA, 20 bp, Artificial Sequence
  Description of Artificial Sequence: Synthetic oligonucleotide
  Target: ATXN1; (+) strand; PAM type: NRG; PAM sequence: AAG
attaagcaatgagtcaaatg

SEQ ID NO: 123934 - DNA, 20 bp, Artificial Sequence
  Description of Artificial Sequence: Synthetic oligonucleotide
  Target: ATXN1; (+) strand; PAM type: NRG; PAM sequence: AAG
agcaatgagtcaaatgaaga

SEQ ID NO: 123935 - DNA, 20 bp, Artificial Sequence
  Description of Artificial Sequence: Synthetic oligonucleotide
  Target: ATXN1; (+) strand; PAM type: NRG; PAM sequence: TGG
aatgagtcaaatgaagaaag

SEQ ID NO: 123936 - DNA, 20 bp, Artificial Sequence
  Description of Artificial Sequence: Synthetic oligonucleotide
  Target: ATXN1; (+) strand; PAM type: NRG; PAM sequence: AAG
tcaaatgaagaaagtggttt

SEQ ID NO: 123937 - DNA, 20 bp, Artificial Sequence
  Description of Artificial Sequence: Synthetic oligonucleotide
  Target: ATXN1; (+) strand; PAM type: NRG; PAM sequence: AGG
caaatgaagaaagtggttta

SEQ ID NO: 123938 - DNA, 20 bp, Artificial Sequence
  Description of Artificial Sequence: Synthetic oligonucleotide
  Target: ATXN1; (+) strand; PAM type: NRG; PAM sequence: GGG
aaatgaagaaagtggtttaa

SEQ ID NO: 123939 - DNA, 20 bp, Artificial Sequence
  Description of Artificial Sequence: Synthetic oligonucleotide
  Target: ATXN1; (+) strand; PAM type: NRG; PAM sequence: TGG
agaaagtggtttaagggaaa

SEQ ID NO: 123940 - DNA, 20 bp, Artificial Sequence
  Description of Artificial Sequence: Synthetic oligonucleotide
  Target: ATXN1; (+) strand; PAM type: NRG; PAM sequence: TAG
attttctaatgatttttctc

SEQ ID NO: 123941 - DNA, 20 bp, Artificial Sequence
  Description of Artificial Sequence: Synthetic oligonucleotide
  Target: ATXN1; (+) strand; PAM type: NRG; PAM sequence: TAG
tctagtatgattttatttaa

SEQ ID NO: 123942 - DNA, 20 bp, Artificial Sequence
  Description of Artificial Sequence: Synthetic oligonucleotide
  Target: ATXN1; (+) strand; PAM type: NRG; PAM sequence: AAG
tttatttaatagttttacat

SEQ ID NO: 123943 - DNA, 20 bp, Artificial Sequence
  Description of Artificial Sequence: Synthetic oligonucleotide
  Target: ATXN1; (+) strand; PAM type: NRG; PAM sequence: AAG
ttaatagttttacataagca

SEQ ID NO: 123944 - DNA, 20 bp, Artificial Sequence
  Description of Artificial Sequence: Synthetic oligonucleotide
  Target: ATXN1; (+) strand; PAM type: NRG; PAM sequence: CAG
cctcccccttttaaaatttc

SEQ ID NO: 123945 - DNA, 20 bp, Artificial Sequence
  Description of Artificial Sequence: Synthetic oligonucleotide
  Target: ATXN1; (+) strand; PAM type: NRG; PAM sequence: AAG
ttttaaaatttccagaaaat

SEQ ID NO: 123946 - DNA, 20 bp, Artificial Sequence
  Description of Artificial Sequence: Synthetic oligonucleotide
  Target: ATXN1; (+) strand; PAM type: NRG; PAM sequence: TGG
cagaaaataagacattctga

SEQ ID NO: 123947 - DNA, 20 bp, Artificial Sequence
  Description of Artificial Sequence: Synthetic oligonucleotide
  Target: ATXN1; (+) strand; PAM type: NRG; PAM sequence: GAG
gaaaataagacattctgatg

SEQ ID NO: 123948 - DNA, 20 bp, Artificial Sequence
  Description of Artificial Sequence: Synthetic oligonucleotide
  Target: ATXN1; (+) strand; PAM type: NRG; PAM sequence: CAG
taagacattctgatggagat

SEQ ID NO: 123949 - DNA, 20 bp, Artificial Sequence
  Description of Artificial Sequence: Synthetic oligonucleotide
  Target: ATXN1; (+) strand; PAM type: NRG; PAM sequence: AGG
aagacattctgatggagatc

SEQ ID NO: 123950 - DNA, 20 bp, Artificial Sequence
  Description of Artificial Sequence: Synthetic oligonucleotide
  Target: ATXN1; (+) strand; PAM type: NRG; PAM sequence: AAG
tctgatggagatcaggccac

SEQ ID NO: 123951 - DNA, 20 bp, Artificial Sequence
  Description of Artificial Sequence: Synthetic oligonucleotide
  Target: ATXN1; (+) strand; PAM type: NRG; PAM sequence: CAG
atggagatcaggccacaaga

SEQ ID NO: 123952 - DNA, 20 bp, Artificial Sequence
  Description of Artificial Sequence: Synthetic oligonucleotide
  Target: ATXN1; (+) strand; PAM type: NRG; PAM sequence: TAG
gagatcaggccacaagacag

SEQ ID NO: 123953 - DNA, 20 bp, Artificial Sequence
  Description of Artificial Sequence: Synthetic oligonucleotide
  Target: ATXN1; (+) strand; PAM type: NRG; PAM sequence: CAG
caggccacaagacagtagtt

SEQ ID NO: 123954 - DNA, 20 bp, Artificial Sequence
  Description of Artificial Sequence: Synthetic oligonucleotide
  Target: ATXN1; (+) strand; PAM type: NRG; PAM sequence: AAG
cacaagacagtagttcagaa

SEQ ID NO: 123955 - DNA, 20 bp, Artificial Sequence
  Description of Artificial Sequence: Synthetic oligonucleotide
  Target: ATXN1; (+) strand; PAM type: NRG; PAM sequence: AGG
acaagacagtagttcagaaa

SEQ ID NO: 123956 - DNA, 20 bp, Artificial Sequence
  Description of Artificial Sequence: Synthetic oligonucleotide
  Target: ATXN1; (+) strand; PAM type: NRG; PAM sequence: GGG
caagacagtagttcagaaaa

SEQ ID NO: 123957 - DNA, 20 bp, Artificial Sequence
  Description of Artificial Sequence: Synthetic oligonucleotide
  Target: ATXN1; (+) strand; PAM type: NRG; PAM sequence: TGG
ctcctcactccctatgtaat

SEQ ID NO: 123958 - DNA, 20 bp, Artificial Sequence
  Description of Artificial Sequence: Synthetic oligonucleotide
  Target: ATXN1; (+) strand; PAM type: NRG; PAM sequence: TGG
ctcactccctatgtaattgg

SEQ ID NO: 123959 - DNA, 20 bp, Artificial Sequence
  Description of Artificial Sequence: Synthetic oligonucleotide
  Target: ATXN1; (+) strand; PAM type: NRG; PAM sequence: CAG
ctccctatgtaattggtggc

SEQ ID NO: 123960 - DNA, 20 bp, Artificial Sequence
  Description of Artificial Sequence: Synthetic oligonucleotide
  Target: ATXN1; (+) strand; PAM type: NRG; PAM sequence: AGG
tccctatgtaattggtggcc

SEQ ID NO: 123961 - DNA, 20 bp, Artificial Sequence
  Description of Artificial Sequence: Synthetic oligonucleotide
  Target: ATXN1; (+) strand; PAM type: NRG; PAM sequence: TGG
gccaggatattgaaattctc

SEQ ID NO: 123962 - DNA, 20 bp, Artificial Sequence
  Description of Artificial Sequence: Synthetic oligonucleotide
  Target: ATXN1; (+) strand; PAM type: NRG; PAM sequence: CAG
ttgaaattctctggaaaaca

SEQ ID NO: 123963 - DNA, 20 bp, Artificial Sequence
  Description of Artificial Sequence: Synthetic oligonucleotide
  Target: ATXN1; (+) strand; PAM type: NRG; PAM sequence: CAG
atatattataatgtcttgtt

SEQ ID NO: 123964 - DNA, 20 bp, Artificial Sequence
  Description of Artificial Sequence: Synthetic oligonucleotide
  Target: ATXN1; (+) strand; PAM type: NRG; PAM sequence: AAG
tattataatgtcttgttcag

SEQ ID NO: 123965 - DNA, 20 bp, Artificial Sequence
  Description of Artificial Sequence: Synthetic oligonucleotide
  Target: ATXN1; (+) strand; PAM type: NRG; PAM sequence: TAG
aatgtcttgttcagaagtgt

SEQ ID NO: 123966 - DNA, 20 bp, Artificial Sequence
  Description of Artificial Sequence: Synthetic oligonucleotide
  Target: ATXN1; (+) strand; PAM type: NRG; PAM sequence: AGG
atgtcttgttcagaagtgtt

SEQ ID NO: 123967 - DNA, 20 bp, Artificial Sequence
  Description of Artificial Sequence: Synthetic oligonucleotide
  Target: ATXN1; (+) strand; PAM type: NRG; PAM sequence: GAG
gtcttgttcagaagtgttag

SEQ ID NO: 123968 - DNA, 20 bp, Artificial Sequence
  Description of Artificial Sequence: Synthetic oligonucleotide
  Target: ATXN1; (+) strand; PAM type: NRG; PAM sequence: GAG
gaagtgttaggagaattgat

SEQ ID NO: 123969 - DNA, 20 bp, Artificial Sequence
  Description of Artificial Sequence: Synthetic oligonucleotide
  Target: ATXN1; (+) strand; PAM type: NRG; PAM sequence: TGG
gagaattgatgagttaatgt

SEQ ID NO: 123970 - DNA, 20 bp, Artificial Sequence
  Description of Artificial Sequence: Synthetic oligonucleotide
  Target: ATXN1; (+) strand; PAM type: NRG; PAM sequence: CAG
gtaaatcactctgcaattcc

SEQ ID NO: 123971 - DNA, 20 bp, Artificial Sequence
  Description of Artificial Sequence: Synthetic oligonucleotide
  Target: ATXN1; (+) strand; PAM type: NRG; PAM sequence: AGG
taaatcactctgcaattccc

SEQ ID NO: 123972 - DNA, 20 bp, Artificial Sequence
  Description of Artificial Sequence: Synthetic oligonucleotide
  Target: ATXN1; (+) strand; PAM type: NRG; PAM sequence: AAG
actctgcaattcccaggtca

SEQ ID NO: 123973 - DNA, 20 bp, Artificial Sequence
  Description of Artificial Sequence: Synthetic oligonucleotide
  Target: ATXN1; (+) strand; PAM type: NRG; PAM sequence: CAG
aacattatcattatttgttt

SEQ ID NO: 123974 - DNA, 20 bp, Artificial Sequence
  Description of Artificial Sequence: Synthetic oligonucleotide
  Target: ATXN1; (+) strand; PAM type: NRG; PAM sequence: TGG
attatcattatttgtttcag

SEQ ID NO: 123975 - DNA, 20 bp, Artificial Sequence
  Description of Artificial Sequence: Synthetic oligonucleotide
  Target: ATXN1; (+) strand; PAM type: NRG; PAM sequence: GAG
tatcattatttgtttcagtg

SEQ ID NO: 123976 - DNA, 20 bp, Artificial Sequence
  Description of Artificial Sequence: Synthetic oligonucleotide
  Target: ATXN1; (+) strand; PAM type: NRG; PAM sequence: AGG
atcattatttgtttcagtgg

SEQ ID NO: 123977 - DNA, 20 bp, Artificial Sequence
  Description of Artificial Sequence: Synthetic oligonucleotide
  Target: ATXN1; (+) strand; PAM type: NRG; PAM sequence: TGG
ttgtttcagtggaggctcac

SEQ ID NO: 123978 - DNA, 20 bp, Artificial Sequence
  Description of Artificial Sequence: Synthetic oligonucleotide
  Target: ATXN1; (+) strand; PAM type: NRG; PAM sequence: TGG
ggaggctcactggcaaaatg

SEQ ID NO: 123979 - DNA, 20 bp, Artificial Sequence
  Description of Artificial Sequence: Synthetic oligonucleotide
  Target: ATXN1; (+) strand; PAM type: NRG; PAM sequence: TAG
ctcactggcaaaatgtggtc

SEQ ID NO: 123980 - DNA, 20 bp, Artificial Sequence
  Description of Artificial Sequence: Synthetic oligonucleotide
  Target: ATXN1; (+) strand; PAM type: NRG; PAM sequence: TGG
actggcaaaatgtggtctag

SEQ ID NO: 123981 - DNA, 20 bp, Artificial Sequence
  Description of Artificial Sequence: Synthetic oligonucleotide
  Target: ATXN1; (+) strand; PAM type: NRG; PAM sequence: GGG
ctggcaaaatgtggtctagt

SEQ ID NO: 123982 - DNA, 20 bp, Artificial Sequence
  Description of Artificial Sequence: Synthetic oligonucleotide
  Target: ATXN1; (+) strand; PAM type: NRG; PAM sequence: TAG
tgtggtctagtgggcctgat

SEQ ID NO: 123983 - DNA, 20 bp, Artificial Sequence
  Description of Artificial Sequence: Synthetic oligonucleotide
  Target: ATXN1; (+) strand; PAM type: NRG; PAM sequence: AGG
gtggtctagtgggcctgatt

SEQ ID NO: 123984 - DNA, 20 bp, Artificial Sequence
  Description of Artificial Sequence: Synthetic oligonucleotide
  Target: ATXN1; (+) strand; PAM type: NRG; PAM sequence: AAG
tgggcctgattaggaaacaa

SEQ ID NO: 123985 - DNA, 20 bp, Artificial Sequence
  Description of Artificial Sequence: Synthetic oligonucleotide
  Target: ATXN1; (+) strand; PAM type: NRG; PAM sequence: CAG
aacaaaagcttataactttg

SEQ ID NO: 123986 - DNA, 20 bp, Artificial Sequence
  Description of Artificial Sequence: Synthetic oligonucleotide
  Target: ATXN1; (+) strand; PAM type: NRG; PAM sequence: AAG
aaagcttataactttgcagc

SEQ ID NO: 123987 - DNA, 20 bp, Artificial Sequence
  Description of Artificial Sequence: Synthetic oligonucleotide
  Target: ATXN1; (+) strand; PAM type: NRG; PAM sequence: GAG
agcttataactttgcagcaa

SEQ ID NO: 123988 - DNA, 20 bp, Artificial Sequence
  Description of Artificial Sequence: Synthetic oligonucleotide
  Target: ATXN1; (+) strand; PAM type: NRG; PAM sequence: AGG
gcttataactttgcagcaag

SEQ ID NO: 123989 - DNA, 20 bp, Artificial Sequence
  Description of Artificial Sequence: Synthetic oligonucleotide
  Target: ATXN1; (+) strand; PAM type: NRG; PAM sequence: GGG
cttataactttgcagcaaga

SEQ ID NO: 123990 - DNA, 20 bp, Artificial Sequence
  Description of Artificial Sequence: Synthetic oligonucleotide
  Target: ATXN1; (+) strand; PAM type: NRG; PAM sequence: GGG
ttataactttgcagcaagag

SEQ ID NO: 123991 - DNA, 20 bp, Artificial Sequence
  Description of Artificial Sequence: Synthetic oligonucleotide
  Target: ATXN1; (+) strand; PAM type: NRG; PAM sequence: CAG
aagaggggaaaacatttttt

SEQ ID NO: 123992 - DNA, 20 bp, Artificial Sequence
  Description of Artificial Sequence: Synthetic oligonucleotide
  Target: ATXN1; (+) strand; PAM type: NRG; PAM sequence: AAG
acctaattctcttctaccct

SEQ ID NO: 123993 - DNA, 20 bp, Artificial Sequence
  Description of Artificial Sequence: Synthetic oligonucleotide
  Target: ATXN1; (+) strand; PAM type: NRG; PAM sequence: AGG
cctaattctcttctacccta

SEQ ID NO: 123994 - DNA, 20 bp, Artificial Sequence
  Description of Artificial Sequence: Synthetic oligonucleotide
  Target: ATXN1; (+) strand; PAM type: NRG; PAM sequence: GGG
ctaattctcttctaccctaa

SEQ ID NO: 123995 - DNA, 20 bp, Artificial Sequence
  Description of Artificial Sequence: Synthetic oligonucleotide
  Target: ATXN1; (+) strand; PAM type: NRG; PAM sequence: GAG
aattctcttctaccctaagg

SEQ ID NO: 123996 - DNA, 20 bp, Artificial Sequence
  Description of Artificial Sequence: Synthetic oligonucleotide
  Target: ATXN1; (+) strand; PAM type: NRG; PAM sequence: AAG
tcttctaccctaagggagta

SEQ ID NO: 123997 - DNA, 20 bp, Artificial Sequence
  Description of Artificial Sequence: Synthetic oligonucleotide
  Target: ATXN1; (+) strand; PAM type: NRG; PAM sequence: AGG
cttctaccctaagggagtaa

SEQ ID NO: 123998 - DNA, 20 bp, Artificial Sequence
  Description of Artificial Sequence: Synthetic oligonucleotide
  Target: ATXN1; (+) strand; PAM type: NRG; PAM sequence: GGG
ttctaccctaagggagtaaa

SEQ ID NO: 123999 - DNA, 20 bp, Artificial Sequence
  Description of Artificial Sequence: Synthetic oligonucleotide
  Target: ATXN1; (+) strand; PAM type: NRG; PAM sequence: GAG
atcattcaacgccatgtaat

SEQ ID NO: 124000 - DNA, 20 bp, Artificial Sequence
  Description of Artificial Sequence: Synthetic oligonucleotide
  Target: ATXN1; (+) strand; PAM type: NRG; PAM sequence: AAG
gacaccactgaaataaacca

SEQ ID NO: 124001 - DNA, 20 bp, Artificial Sequence
  Description of Artificial Sequence: Synthetic oligonucleotide
  Target: ATXN1; (+) strand; PAM type: NRG; PAM sequence: AGG
acaccactgaaataaaccaa

SEQ ID NO: 124002 - DNA, 20 bp, Artificial Sequence
  Description of Artificial Sequence: Synthetic oligonucleotide
  Target: ATXN1; (+) strand; PAM type: NRG; PAM sequence: TAG
ctgaaataaaccaaaggatg

SEQ ID NO: 124003 - DNA, 20 bp, Artificial Sequence
  Description of Artificial Sequence: Synthetic oligonucleotide
  Target: ATXN1; (+) strand; PAM type: NRG; PAM sequence: AGG
tgaaataaaccaaaggatgt

SEQ ID NO: 124004 - DNA, 20 bp, Artificial Sequence
  Description of Artificial Sequence: Synthetic oligonucleotide
  Target: ATXN1; (+) strand; PAM type: NRG; PAM sequence: GGG
gaaataaaccaaaggatgta

SEQ ID NO: 124005 - DNA, 20 bp, Artificial Sequence
  Description of Artificial Sequence: Synthetic oligonucleotide
  Target: ATXN1; (+) strand; PAM type: NRG; PAM sequence: CAG
aggatgtagggatgtatgta

SEQ ID NO: 124006 - DNA, 20 bp, Artificial Sequence
  Description of Artificial Sequence: Synthetic oligonucleotide
  Target: ATXN1; (+) strand; PAM type: NRG; PAM sequence: TGG
tgtagggatgtatgtacagc

SEQ ID NO: 124007 - DNA, 20 bp, Artificial Sequence
  Description of Artificial Sequence: Synthetic oligonucleotide
  Target: ATXN1; (+) strand; PAM type: NRG; PAM sequence: TGG
gggatgtatgtacagctgga

SEQ ID NO: 124008 - DNA, 20 bp, Artificial Sequence
  Description of Artificial Sequence: Synthetic oligonucleotide
  Target: ATXN1; (+) strand; PAM type: NRG; PAM sequence: TGG
tgtacagctggatggatgaa

SEQ ID NO: 124009 - DNA, 20 bp, Artificial Sequence
  Description of Artificial Sequence: Synthetic oligonucleotide
  Target: ATXN1; (+) strand; PAM type: NRG; PAM sequence: CAG
cagctggatggatgaatgga

SEQ ID NO: 124010 - DNA, 20 bp, Artificial Sequence
  Description of Artificial Sequence: Synthetic oligonucleotide
  Target: ATXN1; (+) strand; PAM type: NRG; PAM sequence: TGG
tggatggatgaatggacaga

SEQ ID NO: 124011 - DNA, 20 bp, Artificial Sequence
  Description of Artificial Sequence: Synthetic oligonucleotide
  Target: ATXN1; (+) strand; PAM type: NRG; PAM sequence: TGG
tggatgaatggacagatgga

SEQ ID NO: 124012 - DNA, 20 bp, Artificial Sequence
  Description of Artificial Sequence: Synthetic oligonucleotide
  Target: ATXN1; (+) strand; PAM type: NRG; PAM sequence: TGG
tgaatggacagatggatgga

SEQ ID NO: 124013 - DNA, 20 bp, Artificial Sequence
  Description of Artificial Sequence: Synthetic oligonucleotide
  Target: ATXN1; (+) strand; PAM type: NRG; PAM sequence: CAG
tggacagatggatggatgga

SEQ ID NO: 124014 - DNA, 20 bp, Artificial Sequence
  Description of Artificial Sequence: Synthetic oligonucleotide
  Target: ATXN1; (+) strand; PAM type: NRG; PAM sequence: TGG
tggatggatggacagacaaa

SEQ ID NO: 124015 - DNA, 20 bp, Artificial Sequence
  Description of Artificial Sequence: Synthetic oligonucleotide
  Target: ATXN1; (+) strand; PAM type: NRG; PAM sequence: CGG
tggatggacagacaaatggc

SEQ ID NO: 124016 - DNA, 20 bp, Artificial Sequence
  Description of Artificial Sequence: Synthetic oligonucleotide
  Target: ATXN1; (+) strand; PAM type: NRG; PAM sequence: AAG
actcctccgtgttatatatt

SEQ ID NO: 124017 - DNA, 20 bp, Artificial Sequence
  Description of Artificial Sequence: Synthetic oligonucleotide
  Target: ATXN1; (+) strand; PAM type: NRG; PAM sequence: AGG
ctcctccgtgttatatatta

SEQ ID NO: 124018 - DNA, 20 bp, Artificial Sequence
  Description of Artificial Sequence: Synthetic oligonucleotide
  Target: ATXN1; (+) strand; PAM type: NRG; PAM sequence: TAG
atatattaaggctgcttttt

SEQ ID NO: 124019 - DNA, 20 bp, Artificial Sequence
  Description of Artificial Sequence: Synthetic oligonucleotide
  Target: ATXN1; (+) strand; PAM type: NRG; PAM sequence: TAG
tcttacccaaattatcactg

SEQ ID NO: 124020 - DNA, 20 bp, Artificial Sequence
  Description of Artificial Sequence: Synthetic oligonucleotide
  Target: ATXN1; (+) strand; PAM type: NRG; PAM sequence: AAG
tacccaaattatcactgtag

SEQ ID NO: 124021 - DNA, 20 bp, Artificial Sequence
  Description of Artificial Sequence: Synthetic oligonucleotide
  Target: ATXN1; (+) strand; PAM type: NRG; PAM sequence: CAG
ccaaattatcactgtagaag

SEQ ID NO: 124022 - DNA, 20 bp, Artificial Sequence
  Description of Artificial Sequence: Synthetic oligonucleotide
  Target: ATXN1; (+) strand; PAM type: NRG; PAM sequence: AAG
gaagcagatcatcatgcttt

SEQ ID NO: 124023 - DNA, 20 bp, Artificial Sequence
  Description of Artificial Sequence: Synthetic oligonucleotide
  Target: ATXN1; (+) strand; PAM type: NRG; PAM sequence: TAG
gatcatcatgctttaagcct

SEQ ID NO: 124024 - DNA, 20 bp, Artificial Sequence
  Description of Artificial Sequence: Synthetic oligonucleotide
  Target: ATXN1; (+) strand; PAM type: NRG; PAM sequence: TGG
ctttaagccttagaatatga

SEQ ID NO: 124025 - DNA, 20 bp, Artificial Sequence
  Description of Artificial Sequence: Synthetic oligonucleotide
  Target: ATXN1; (+) strand; PAM type: NRG; PAM sequence: GAG
aattactgcatcatatctgt

SEQ ID NO: 124026 - DNA, 20 bp, Artificial Sequence
  Description of Artificial Sequence: Synthetic oligonucleotide
  Target: ATXN1; (+) strand; PAM type: NRG; PAM sequence: TGG
catcatatctgtgagatttt

SEQ ID NO: 124027 - DNA, 20 bp, Artificial Sequence
  Description of Artificial Sequence: Synthetic oligonucleotide
  Target: ATXN1; (+) strand; PAM type: NRG; PAM sequence: TAG
atatctgtgagatttttggt

SEQ ID NO: 124028 - DNA, 20 bp, Artificial Sequence
  Description of Artificial Sequence: Synthetic oligonucleotide
  Target: ATXN1; (+) strand; PAM type: NRG; PAM sequence: AGG
tatctgtgagatttttggtt

SEQ ID NO: 124029 - DNA, 20 bp, Artificial Sequence
  Description of Artificial Sequence: Synthetic oligonucleotide
  Target: ATXN1; (+) strand; PAM type: NRG; PAM sequence: CAG
atgaatttgtccaatttttt

SEQ ID NO: 124030 - DNA, 20 bp, Artificial Sequence
  Description of Artificial Sequence: Synthetic oligonucleotide
  Target: ATXN1; (+) strand; PAM type: NRG; PAM sequence: TGG
ttcagtaatgcaaaactttt

SEQ ID NO: 124031 - DNA, 20 bp, Artificial Sequence
  Description of Artificial Sequence: Synthetic oligonucleotide
  Target: ATXN1; (+) strand; PAM type: NRG; PAM sequence: CAG
gttgttattcctacccttgt

SEQ ID NO: 124032 - DNA, 20 bp, Artificial Sequence
  Description of Artificial Sequence: Synthetic oligonucleotide
  Target: ATXN1; (+) strand; PAM type: NRG; PAM sequence: AAG
tcagccaaactcataaaata

SEQ ID NO: 124033 - DNA, 20 bp, Artificial Sequence
  Description of Artificial Sequence: Synthetic oligonucleotide
  Target: ATXN1; (+) strand; PAM type: NRG; PAM sequence: TGG
aataaagattttctaatata

SEQ ID NO: 124034 - DNA, 20 bp, Artificial Sequence
  Description of Artificial Sequence: Synthetic oligonucleotide
  Target: ATXN1; (+) strand; PAM type: NRG; PAM sequence: TAG
attttctaatatatggtatt

SEQ ID NO: 124035 - DNA, 20 bp, Artificial Sequence
  Description of Artificial Sequence: Synthetic oligonucleotide
  Target: ATXN1; (+) strand; PAM type: NRG; PAM sequence: TAG
tttagaaattctctgcacta

SEQ ID NO: 124036 - DNA, 20 bp, Artificial Sequence
  Description of Artificial Sequence: Synthetic oligonucleotide
  Target: ATXN1; (+) strand; PAM type: NRG; PAM sequence: AAG
agaaattctctgcactatag

SEQ ID NO: 124037 - DNA, 20 bp, Artificial Sequence
  Description of Artificial Sequence: Synthetic oligonucleotide
  Target: ATXN1; (+) strand; PAM type: NRG; PAM sequence: AGG
gaaattctctgcactataga

SEQ ID NO: 124038 - DNA, 20 bp, Artificial Sequence
  Description of Artificial Sequence: Synthetic oligonucleotide
  Target: ATXN1; (+) strand; PAM type: NRG; PAM sequence: AAG
tgcactatagaaggtgtttg

SEQ ID NO: 124039 - DNA, 20 bp, Artificial Sequence
  Description of Artificial Sequence: Synthetic oligonucleotide
  Target: ATXN1; (+) strand; PAM type: NRG; PAM sequence: TGG
gaagttaatgaataaataaa

SEQ ID NO: 124040 - DNA, 20 bp, Artificial Sequence
  Description of Artificial Sequence: Synthetic oligonucleotide
  Target: ATXN1; (+) strand; PAM type: NRG; PAM sequence: TAG
tgaataaataaatggataaa

SEQ ID NO: 124041 - DNA, 20 bp, Artificial Sequence
  Description of Artificial Sequence: Synthetic oligonucleotide
  Target: ATXN1; (+) strand; PAM type: NRG; PAM sequence: TGG
taaataaatggataaataga

SEQ ID NO: 124042 - DNA, 20 bp, Artificial Sequence
  Description of Artificial Sequence: Synthetic oligonucleotide
  Target: ATXN1; (+) strand; PAM type: NRG; PAM sequence: GGG
aaataaatggataaatagat

SEQ ID NO: 124043 - DNA, 20 bp, Artificial Sequence
  Description of Artificial Sequence: Synthetic oligonucleotide
  Target: ATXN1; (+) strand; PAM type: NRG; PAM sequence: AAG
aaatggataaatagatgggt

SEQ ID NO: 124044 - DNA, 20 bp, Artificial Sequence
  Description of Artificial Sequence: Synthetic oligonucleotide
  Target: ATXN1; (+) strand; PAM type: NRG; PAM sequence: TGG
tggataaatagatgggtaag

SEQ ID NO: 124045 - DNA, 20 bp, Artificial Sequence
  Description of Artificial Sequence: Synthetic oligonucleotide
  Target: ATXN1; (+) strand; PAM type: NRG; PAM sequence: CAG
gatgggtaagtggcatcatc

SEQ ID NO: 124046 - DNA, 20 bp, Artificial Sequence
  Description of Artificial Sequence: Synthetic oligonucleotide
  Target: ATXN1; (+) strand; PAM type: NRG; PAM sequence: CAG
taagtggcatcatccagcca

SEQ ID NO: 124047 - DNA, 20 bp, Artificial Sequence
  Description of Artificial Sequence: Synthetic oligonucleotide
  Target: ATXN1; (+) strand; PAM type: NRG; PAM sequence: AAG
ccacagcactgcaatgtccg

SEQ ID NO: 124048 - DNA, 20 bp, Artificial Sequence
  Description of Artificial Sequence: Synthetic oligonucleotide
  Target: ATXN1; (+) strand; PAM type: NRG; PAM sequence: AGG
cacagcactgcaatgtccga

SEQ ID NO: 124049 - DNA, 20 bp, Artificial Sequence
  Description of Artificial Sequence: Synthetic oligonucleotide
  Target: ATXN1; (+) strand; PAM type: NRG; PAM sequence: TAG
tgaaacgttcctcatgcctc

SEQ ID NO: 124050 - DNA, 20 bp, Artificial Sequence
  Description of Artificial Sequence: Synthetic oligonucleotide
  Target: ATXN1; (+) strand; PAM type: NRG; PAM sequence: AGG
gaaacgttcctcatgcctct

SEQ ID NO: 124051 - DNA, 20 bp, Artificial Sequence
  Description of Artificial Sequence: Synthetic oligonucleotide
  Target: ATXN1; (+) strand; PAM type: NRG; PAM sequence: AAG
cgttcctcatgcctctagga

SEQ ID NO: 124052 - DNA, 20 bp, Artificial Sequence
  Description of Artificial Sequence: Synthetic oligonucleotide
  Target: ATXN1; (+) strand; PAM type: NRG; PAM sequence: CAG
agactgacctttgaatacgc

SEQ ID NO: 124053 - DNA, 20 bp, Artificial Sequence
  Description of Artificial Sequence: Synthetic oligonucleotide
  Target: ATXN1; (+) strand; PAM type: NRG; PAM sequence: AAG
gacctttgaatacgccagac

SEQ ID NO: 124054 - DNA, 20 bp, Artificial Sequence
  Description of Artificial Sequence: Synthetic oligonucleotide
  Target: ATXN1; (+) strand; PAM type: NRG; PAM sequence: TAG
cgccagacaagtatttttct

SEQ ID NO: 124055 - DNA, 20 bp, Artificial Sequence
  Description of Artificial Sequence: Synthetic oligonucleotide
  Target: ATXN1; (+) strand; PAM type: NRG; PAM sequence: GAG
ttttcttagcaaacatttat

SEQ ID NO: 124056 - DNA, 20 bp, Artificial Sequence
  Description of Artificial Sequence: Synthetic oligonucleotide
  Target: ATXN1; (+) strand; PAM type: NRG; PAM sequence: TGG
tagcaaacatttatgagcaa

SEQ ID NO: 124057 - DNA, 20 bp, Artificial Sequence
  Description of Artificial Sequence: Synthetic oligonucleotide
  Target: ATXN1; (+) strand; PAM type: NRG; PAM sequence: GGG
agcaaacatttatgagcaat

SEQ ID NO: 124058 - DNA, 20 bp, Artificial Sequence
  Description of Artificial Sequence: Synthetic oligonucleotide
  Target: ATXN1; (+) strand; PAM type: NRG; PAM sequence: TAG
aatgggctcaatcactatat

SEQ ID NO: 124059 - DNA, 20 bp, Artificial Sequence
  Description of Artificial Sequence: Synthetic oligonucleotide
  Target: ATXN1; (+) strand; PAM type: NRG; PAM sequence: AAG
caatcactatattagtgttt

SEQ ID NO: 124060 - DNA, 20 bp, Artificial Sequence
  Description of Artificial Sequence: Synthetic oligonucleotide
  Target: ATXN1; (+) strand; PAM type: NRG; PAM sequence: AGG
aatcactatattagtgttta

SEQ ID NO: 124061 - DNA, 20 bp, Artificial Sequence
  Description of Artificial Sequence: Synthetic oligonucleotide
  Target: ATXN1; (+) strand; PAM type: NRG; PAM sequence: GGG
atcactatattagtgtttaa

SEQ ID NO: 124062 - DNA, 20 bp, Artificial Sequence
  Description of Artificial Sequence: Synthetic oligonucleotide
  Target: ATXN1; (+) strand; PAM type: NRG; PAM sequence: TAG
gtttaagggcttttcctgta

SEQ ID NO: 124063 - DNA, 20 bp, Artificial Sequence
  Description of Artificial Sequence: Synthetic oligonucleotide
  Target: ATXN1; (+) strand; PAM type: NRG; PAM sequence: AAG
taagggcttttcctgtatag

SEQ ID NO: 124064 - DNA, 20 bp, Artificial Sequence
  Description of Artificial Sequence: Synthetic oligonucleotide
  Target: ATXN1; (+) strand; PAM type: NRG; PAM sequence: AAG
agaagctctttctttgactg

SEQ ID NO: 124065 - DNA, 20 bp, Artificial Sequence
  Description of Artificial Sequence: Synthetic oligonucleotide
  Target: ATXN1; (+) strand; PAM type: NRG; PAM sequence: AAG
ttctttgactgaagtctcca

SEQ ID NO: 124066 - DNA, 20 bp, Artificial Sequence
  Description of Artificial Sequence: Synthetic oligonucleotide
  Target: ATXN1; (+) strand; PAM type: NRG; PAM sequence: AAG
tattatgtatgcctgaataa

SEQ ID NO: 124067 - DNA, 20 bp, Artificial Sequence
  Description of Artificial Sequence: Synthetic oligonucleotide
  Target: ATXN1; (+) strand; PAM type: NRG; PAM sequence: AGG
attatgtatgcctgaataaa

SEQ ID NO: 124068 - DNA, 20 bp, Artificial Sequence
  Description of Artificial Sequence: Synthetic oligonucleotide
  Target: ATXN1; (+) strand; PAM type: NRG; PAM sequence: AAG
aataaaaggtaatataatat

SEQ ID NO: 124069 - DNA, 20 bp, Artificial Sequence
  Description of Artificial Sequence: Synthetic oligonucleotide
  Target: ATXN1; (+) strand; PAM type: NRG; PAM sequence: AGG
ataaaaggtaatataatata

SEQ ID NO: 124070 - DNA, 20 bp, Artificial Sequence
  Description of Artificial Sequence: Synthetic oligonucleotide
  Target: ATXN1; (+) strand; PAM type: NRG; PAM sequence: AAG
tataaggtaatttttctcca

SEQ ID NO: 124071 - DNA, 20 bp, Artificial Sequence
  Description of Artificial Sequence: Synthetic oligonucleotide
  Target: ATXN1; (+) strand; PAM type: NRG; PAM sequence: AAG
aggtaatttttctccaaaga

SEQ ID NO: 124072 - DNA, 20 bp, Artificial Sequence
  Description of Artificial Sequence: Synthetic oligonucleotide
  Target: ATXN1; (+) strand; PAM type: NRG; PAM sequence: CAG
ttttctccaaagaaagccct

SEQ ID NO: 124073 - DNA, 20 bp, Artificial Sequence
  Description of Artificial Sequence: Synthetic oligonucleotide
  Target: ATXN1; (+) strand; PAM type: NRG; PAM sequence: AAG
tccaaagaaagccctcagaa

SEQ ID NO: 124074 - DNA, 20 bp, Artificial Sequence
  Description of Artificial Sequence: Synthetic oligonucleotide
  Target: ATXN1; (+) strand; PAM type: NRG; PAM sequence: AAG
gaaagccctcagaaaagcct

SEQ ID NO: 124075 - DNA, 20 bp, Artificial Sequence
  Description of Artificial Sequence: Synthetic oligonucleotide
  Target: ATXN1; (+) strand; PAM type: NRG; PAM sequence: GAG
cctaagtacccttaattttt

SEQ ID NO: 124076 - DNA, 20 bp, Artificial Sequence
  Description of Artificial Sequence: Synthetic oligonucleotide
  Target: ATXN1; (+) strand; PAM type: NRG; PAM sequence: AAG
ttaatttttgagttcttaca

SEQ ID NO: 124077 - DNA, 20 bp, Artificial Sequence
  Description of Artificial Sequence: Synthetic oligonucleotide
  Target: ATXN1; (+) strand; PAM type: NRG; PAM sequence: TGG
acaaagtttattgtatctat

SEQ ID NO: 124078 - DNA, 20 bp, Artificial Sequence
  Description of Artificial Sequence: Synthetic oligonucleotide
  Target: ATXN1; (+) strand; PAM type: NRG; PAM sequence: AAG
atctattggtctcttaaata

SEQ ID NO: 124079 - DNA, 20 bp, Artificial Sequence
  Description of Artificial Sequence: Synthetic oligonucleotide
  Target: ATXN1; (+) strand; PAM type: NRG; PAM sequence: TAG
tattggtctcttaaataaag

SEQ ID NO: 124080 - DNA, 20 bp, Artificial Sequence
  Description of Artificial Sequence: Synthetic oligonucleotide
  Target: ATXN1; (+) strand; PAM type: NRG; PAM sequence: TGG
cttaaataaagtagtcttta

SEQ ID NO: 124081 - DNA, 20 bp, Artificial Sequence
  Description of Artificial Sequence: Synthetic oligonucleotide
  Target: ATXN1; (+) strand; PAM type: NRG; PAM sequence: AAG
aaataaagtagtctttatgg

SEQ ID NO: 124082 - DNA, 20 bp, Artificial Sequence
  Description of Artificial Sequence: Synthetic oligonucleotide
  Target: ATXN1; (+) strand; PAM type: NRG; PAM sequence: TAG
aaaactaccttgataaatgc

SEQ ID NO: 124083 - DNA, 20 bp, Artificial Sequence
  Description of Artificial Sequence: Synthetic oligonucleotide
  Target: ATXN1; (+) strand; PAM type: NRG; PAM sequence: TGG
taccttgataaatgctagtt

SEQ ID NO: 124084 - DNA, 20 bp, Artificial Sequence
  Description of Artificial Sequence: Synthetic oligonucleotide
  Target: ATXN1; (+) strand; PAM type: NRG; PAM sequence: CAG
agtttggcatgtttatataa

SEQ ID NO: 124085 - DNA, 20 bp, Artificial Sequence
  Description of Artificial Sequence: Synthetic oligonucleotide
  Target: ATXN1; (+) strand; PAM type: NRG; PAM sequence: CAG
tttatataacagccacctaa

SEQ ID NO: 124086 - DNA, 20 bp, Artificial Sequence
  Description of Artificial Sequence: Synthetic oligonucleotide
  Target: ATXN1; (+) strand; PAM type: NRG; PAM sequence: TGG
tttttccttttgttttttaa

SEQ ID NO: 124087 - DNA, 20 bp, Artificial Sequence
  Description of Artificial Sequence: Synthetic oligonucleotide
  Target: ATXN1; (+) strand; PAM type: NRG; PAM sequence: AAG
ttccttttgttttttaatgg

SEQ ID NO: 124088 - DNA, 20 bp, Artificial Sequence
  Description of Artificial Sequence: Synthetic oligonucleotide
  Target: ATXN1; (+) strand; PAM type: NRG; PAM sequence: TAG
tggaagaaaacaaatttgac

SEQ ID NO: 124089 - DNA, 20 bp, Artificial Sequence
  Description of Artificial Sequence: Synthetic oligonucleotide
  Target: ATXN1; (+) strand; PAM type: NRG; PAM sequence: TGG
atttgactagtaattattct

SEQ ID NO: 124090 - DNA, 20 bp, Artificial Sequence
  Description of Artificial Sequence: Synthetic oligonucleotide
  Target: ATXN1; (+) strand; PAM type: NRG; PAM sequence: AAG
tgactagtaattattcttgg

SEQ ID NO: 124091 - DNA, 20 bp, Artificial Sequence
  Description of Artificial Sequence: Synthetic oligonucleotide
  Target: ATXN1; (+) strand; PAM type: NRG; PAM sequence: TAG
tcttggaagtatgactttcc

SEQ ID NO: 124092 - DNA, 20 bp, Artificial Sequence
  Description of Artificial Sequence: Synthetic oligonucleotide
  Target: ATXN1; (+) strand; PAM type: NRG; PAM sequence: AAG
agtatgactttcctagttgc

SEQ ID NO: 124093 - DNA, 20 bp, Artificial Sequence
  Description of Artificial Sequence: Synthetic oligonucleotide
  Target: ATXN1; (+) strand; PAM type: NRG; PAM sequence: TGG
actttcctagttgcaagcac

SEQ ID NO: 124094 - DNA, 20 bp, Artificial Sequence
  Description of Artificial Sequence: Synthetic oligonucleotide
  Target: ATXN1; (+) strand; PAM type: NRG; PAM sequence: AAG
ggatgtcactataaataaaa

SEQ ID NO: 124095 - DNA, 20 bp, Artificial Sequence
  Description of Artificial Sequence: Synthetic oligonucleotide
  Target: ATXN1; (+) strand; PAM type: NRG; PAM sequence: AAG
ataaataaaaaagcatttta

SEQ ID NO: 124096 - DNA, 20 bp, Artificial Sequence
  Description of Artificial Sequence: Synthetic oligonucleotide
  Target: ATXN1; (+) strand; PAM type: NRG; PAM sequence: AAG
attttaaagattacttttaa

SEQ ID NO: 124097 - DNA, 20 bp, Artificial Sequence
  Description of Artificial Sequence: Synthetic oligonucleotide
  Target: ATXN1; (+) strand; PAM type: NRG; PAM sequence: CAG
gattacttttaaaagcaaca

SEQ ID NO: 124098 - DNA, 20 bp, Artificial Sequence
  Description of Artificial Sequence: Synthetic oligonucleotide
  Target: ATXN1; (+) strand; PAM type: NRG; PAM sequence: AAG
acttttaaaagcaacacagt

SEQ ID NO: 124099 - DNA, 20 bp, Artificial Sequence
  Description of Artificial Sequence: Synthetic oligonucleotide
  Target: ATXN1; (+) strand; PAM type: NRG; PAM sequence: TGG
tttaaaagcaacacagtaag

SEQ ID NO: 124100 - DNA, 20 bp, Artificial Sequence
  Description of Artificial Sequence: Synthetic oligonucleotide
  Target: ATXN1; (+) strand; PAM type: NRG; PAM sequence: AAG
aagcaacacagtaagtggtt

SEQ ID NO: 124101 - DNA, 20 bp, Artificial Sequence
  Description of Artificial Sequence: Synthetic oligonucleotide
  Target: ATXN1; (+) strand; PAM type: NRG; PAM sequence: CAG
cacagtaagtggttaagttg

SEQ ID NO: 124102 - DNA, 20 bp, Artificial Sequence
  Description of Artificial Sequence: Synthetic oligonucleotide
  Target: ATXN1; (+) strand; PAM type: NRG; PAM sequence: GAG
cagtaagtggttaagttgca

SEQ ID NO: 124103 - DNA, 20 bp, Artificial Sequence
  Description of Artificial Sequence: Synthetic oligonucleotide
  Target: ATXN1; (+) strand; PAM type: NRG; PAM sequence: CAG
agttcatcaaaatacactca

SEQ ID NO: 124104 - DNA, 20 bp, Artificial Sequence
  Description of Artificial Sequence: Synthetic oligonucleotide
  Target: ATXN1; (+) strand; PAM type: NRG; PAM sequence: AGG
gttcatcaaaatacactcac

SEQ ID NO: 124105 - DNA, 20 bp, Artificial Sequence
  Description of Artificial Sequence: Synthetic oligonucleotide
  Target: ATXN1; (+) strand; PAM type: NRG; PAM sequence: AAG
catcaaaatacactcacagg

SEQ ID NO: 124106 - DNA, 20 bp, Artificial Sequence
  Description of Artificial Sequence: Synthetic oligonucleotide
  Target: ATXN1; (+) strand; PAM type: NRG; PAM sequence: AAG
atacactcacaggaagaatg

SEQ ID NO: 124107 - DNA, 20 bp, Artificial Sequence
  Description of Artificial Sequence: Synthetic oligonucleotide
  Target: ATXN1; (+) strand; PAM type: NRG; PAM sequence: TGG
aaaaacatctcttaataata

SEQ ID NO: 124108 - DNA, 20 bp, Artificial Sequence
  Description of Artificial Sequence: Synthetic oligonucleotide
  Target: ATXN1; (+) strand; PAM type: NRG; PAM sequence: TAG
catctcttaataatatggtt

SEQ ID NO: 124109 - DNA, 20 bp, Artificial Sequence
  Description of Artificial Sequence: Synthetic oligonucleotide
  Target: ATXN1; (+) strand; PAM type: NRG; PAM sequence: AGG
atctcttaataatatggttt

SEQ ID NO: 124110 - DNA, 20 bp, Artificial Sequence
  Description of Artificial Sequence: Synthetic oligonucleotide
  Target: ATXN1; (+) strand; PAM type: NRG; PAM sequence: TGG
ttaggatattgtgacaataa

SEQ ID NO: 124111 - DNA, 20 bp, Artificial Sequence
  Description of Artificial Sequence: Synthetic oligonucleotide
  Target: ATXN1; (+) strand; PAM type: NRG; PAM sequence: TAG
gacaataatggtccccaatg

SEQ ID NO: 124112 - DNA, 20 bp, Artificial Sequence
  Description of Artificial Sequence: Synthetic oligonucleotide
  Target: ATXN1; (+) strand; PAM type: NRG; PAM sequence: AGG
acaataatggtccccaatgt

SEQ ID NO: 124113 - DNA, 20 bp, Artificial Sequence
  Description of Artificial Sequence: Synthetic oligonucleotide
  Target: ATXN1; (+) strand; PAM type: NRG; PAM sequence: TAG
caatgtaggatgcctcccta

SEQ ID NO: 124114 - DNA, 20 bp, Artificial Sequence
  Description of Artificial Sequence: Synthetic oligonucleotide
  Target: ATXN1; (+) strand; PAM type: NRG; PAM sequence: TGG
agccatgctcacattaactg

SEQ ID NO: 124115 - DNA, 20 bp, Artificial Sequence
  Description of Artificial Sequence: Synthetic oligonucleotide
  Target: ATXN1; (+) strand; PAM type: NRG; PAM sequence: GGG
gccatgctcacattaactgt

SEQ ID NO: 124116 - DNA, 20 bp, Artificial Sequence
  Description of Artificial Sequence: Synthetic oligonucleotide
  Target: ATXN1; (+) strand; PAM type: NRG; PAM sequence: TGG
gctcacattaactgtgggct

SEQ ID NO: 124117 - DNA, 20 bp, Artificial Sequence
  Description of Artificial Sequence: Synthetic oligonucleotide
  Target: ATXN1; (+) strand; PAM type: NRG; PAM sequence: TGG
cttggctatatgtctttttt

SEQ ID NO: 124118 - DNA, 20 bp, Artificial Sequence
  Description of Artificial Sequence: Synthetic oligonucleotide
  Target: ATXN1; (+) strand; PAM type: NRG; PAM sequence: TGG
atatgtctttttttggccaa

SEQ ID NO: 124119 - DNA, 20 bp, Artificial Sequence
  Description of Artificial Sequence: Synthetic oligonucleotide
  Target: ATXN1; (+) strand; PAM type: NRG; PAM sequence: GGG
tatgtctttttttggccaat

SEQ ID NO: 124120 - DNA, 20 bp, Artificial Sequence
  Description of Artificial Sequence: Synthetic oligonucleotide
  Target: ATXN1; (+) strand; PAM type: NRG; PAM sequence: GGG
atgtctttttttggccaatg

SEQ ID NO: 124121 - DNA, 20 bp, Artificial Sequence
  Description of Artificial Sequence: Synthetic oligonucleotide
  Target: ATXN1; (+) strand; PAM type: NRG; PAM sequence: TAG
acaaatgtaaccaacgaata

SEQ ID NO: 124122 - DNA, 20 bp, Artificial Sequence
  Description of Artificial Sequence: Synthetic oligonucleotide
  Target: ATXN1; (+) strand; PAM type: NRG; PAM sequence: AGG
caaatgtaaccaacgaatat

SEQ ID NO: 124123 - DNA, 20 bp, Artificial Sequence
  Description of Artificial Sequence: Synthetic oligonucleotide
  Target: ATXN1; (+) strand; PAM type: NRG; PAM sequence: TGG
gtaaccaacgaatataggaa

SEQ ID NO: 124124 - DNA, 20 bp, Artificial Sequence
  Description of Artificial Sequence: Synthetic oligonucleotide
  Target: ATXN1; (+) strand; PAM type: NRG; PAM sequence: GGG
taaccaacgaatataggaat

SEQ ID NO: 124125 - DNA, 20 bp, Artificial Sequence
  Description of Artificial Sequence: Synthetic oligonucleotide
  Target: ATXN1; (+) strand; PAM type: NRG; PAM sequence: CGG
aatataggaatgggcacttg

SEQ ID NO: 124126 - DNA, 20 bp, Artificial Sequence
  Description of Artificial Sequence: Synthetic oligonucleotide
  Target: ATXN1; (+) strand; PAM type: NRG; PAM sequence: TAG
aggaatgggcacttgcggct

SEQ ID NO: 124127 - DNA, 20 bp, Artificial Sequence
  Description of Artificial Sequence: Synthetic oligonucleotide
  Target: ATXN1; (+) strand; PAM type: NRG; PAM sequence: AGG
ggaatgggcacttgcggctt

SEQ ID NO: 124128 - DNA, 20 bp, Artificial Sequence
  Description of Artificial Sequence: Synthetic oligonucleotide
  Target: ATXN1; (+) strand; PAM type: NRG; PAM sequence: TGG
gcggcttaggatgaaatttc

SEQ ID NO: 124129 - DNA, 20 bp, Artificial Sequence
  Description of Artificial Sequence: Synthetic oligonucleotide
  Target: ATXN1; (+) strand; PAM type: NRG; PAM sequence: TAG
taggatgaaatttctggtaa

SEQ ID NO: 124130 - DNA, 20 bp, Artificial Sequence
  Description of Artificial Sequence: Synthetic oligonucleotide
  Target: ATXN1; (+) strand; PAM type: NRG; PAM sequence: CAG
tctggtaatagcatcaaaca

SEQ ID NO: 124131 - DNA, 20 bp, Artificial Sequence
  Description of Artificial Sequence: Synthetic oligonucleotide
  Target: ATXN1; (+) strand; PAM type: NRG; PAM sequence: GAG
tggtaatagcatcaaacaca

SEQ ID NO: 124132 - DNA, 20 bp, Artificial Sequence
  Description of Artificial Sequence: Synthetic oligonucleotide
  Target: ATXN1; (+) strand; PAM type: NRG; PAM sequence: TAG
taatagcatcaaacacagag

SEQ ID NO: 124133 - DNA, 20 bp, Artificial Sequence
  Description of Artificial Sequence: Synthetic oligonucleotide
  Target: ATXN1; (+) strand; PAM type: NRG; PAM sequence: AAG
acacagagtagatgaacgtc

SEQ ID NO: 124134 - DNA, 20 bp, Artificial Sequence
  Description of Artificial Sequence: Synthetic oligonucleotide
  Target: ATXN1; (+) strand; PAM type: NRG; PAM sequence: TGG
aacgtcaagatgatgtgctt

SEQ ID NO: 124135 - DNA, 20 bp, Artificial Sequence
  Description of Artificial Sequence: Synthetic oligonucleotide
  Target: ATXN1; (+) strand; PAM type: NRG; PAM sequence: TAG
atactacatgacctgccatg

SEQ ID NO: 124136 - DNA, 20 bp, Artificial Sequence
  Description of Artificial Sequence: Synthetic oligonucleotide
  Target: ATXN1; (+) strand; PAM type: NRG; PAM sequence: GAG
tgccatgtagttcaaaacgt

SEQ ID NO: 124137 - DNA, 20 bp, Artificial Sequence
  Description of Artificial Sequence: Synthetic oligonucleotide
  Target: ATXN1; (+) strand; PAM type: NRG; PAM sequence: AGG
gccatgtagttcaaaacgtg

SEQ ID NO: 124138 - DNA, 20 bp, Artificial Sequence
  Description of Artificial Sequence: Synthetic oligonucleotide
  Target: ATXN1; (+) strand; PAM type: NRG; PAM sequence: AAG
atgtagttcaaaacgtgagg

SEQ ID NO: 124139 - DNA, 20 bp, Artificial Sequence
  Description of Artificial Sequence: Synthetic oligonucleotide
  Target: ATXN1; (+) strand; PAM type: NRG; PAM sequence: TAG
acgtgaggaagatactgata

SEQ ID NO: 124140 - DNA, 20 bp, Artificial Sequence
  Description of Artificial Sequence: Synthetic oligonucleotide
  Target: ATXN1; (+) strand; PAM type: NRG; PAM sequence: TAG
tgaggaagatactgatatag

SEQ ID NO: 124141 - DNA, 20 bp, Artificial Sequence
  Description of Artificial Sequence: Synthetic oligonucleotide
  Target: ATXN1; (+) strand; PAM type: NRG; PAM sequence: AAG
gatactgatatagtagataa

SEQ ID NO: 124142 - DNA, 20 bp, Artificial Sequence
  Description of Artificial Sequence: Synthetic oligonucleotide
  Target: ATXN1; (+) strand; PAM type: NRG; PAM sequence: AAG
atatagtagataaaagttgt

SEQ ID NO: 124143 - DNA, 20 bp, Artificial Sequence
  Description of Artificial Sequence: Synthetic oligonucleotide
  Target: ATXN1; (+) strand; PAM type: NRG; PAM sequence: AAG
aattatttcatataatatga

SEQ ID NO: 124144 - DNA, 20 bp, Artificial Sequence
  Description of Artificial Sequence: Synthetic oligonucleotide
  Target: ATXN1; (+) strand; PAM type: NRG; PAM sequence: TGG
tatttcatataatatgaaag

SEQ ID NO: 124145 - DNA, 20 bp, Artificial Sequence
  Description of Artificial Sequence: Synthetic oligonucleotide
  Target: ATXN1; (+) strand; PAM type: NRG; PAM sequence: AAG
ttcatataatatgaaagtgg

SEQ ID NO: 124146 - DNA, 20 bp, Artificial Sequence
  Description of Artificial Sequence: Synthetic oligonucleotide
  Target: ATXN1; (+) strand; PAM type: NRG; PAM sequence: AAG
tataatatgaaagtggaaga

SEQ ID NO: 124147 - DNA, 20 bp, Artificial Sequence
  Description of Artificial Sequence: Synthetic oligonucleotide
  Target: ATXN1; (+) strand; PAM type: NRG; PAM sequence: CAG
aatatgaaagtggaagaaag

SEQ ID NO: 124148 - DNA, 20 bp, Artificial Sequence
  Description of Artificial Sequence: Synthetic oligonucleotide
  Target: ATXN1; (+) strand; PAM type: NRG; PAM sequence: GAG
atattatttaaaatgtcttt

SEQ ID NO: 124149 - DNA, 20 bp, Artificial Sequence
  Description of Artificial Sequence: Synthetic oligonucleotide
  Target: ATXN1; (+) strand; PAM type: NRG; PAM sequence: AAG
tctttgagattaaataattt

SEQ ID NO: 124150 - DNA, 20 bp, Artificial Sequence
  Description of Artificial Sequence: Synthetic oligonucleotide
  Target: ATXN1; (+) strand; PAM type: NRG; PAM sequence: TGG
taatttaagcacaaatctga

SEQ ID NO: 124151 - DNA, 20 bp, Artificial Sequence
  Description of Artificial Sequence: Synthetic oligonucleotide
  Target: ATXN1; (+) strand; PAM type: NRG; PAM sequence: TAG
gcacaaatctgatggtttaa

SEQ ID NO: 124152 - DNA, 20 bp, Artificial Sequence
  Description of Artificial Sequence: Synthetic oligonucleotide
  Target: ATXN1; (+) strand; PAM type: NRG; PAM sequence: TAG
tctaaatccttaaatgctta

SEQ ID NO: 124153 - DNA, 20 bp, Artificial Sequence
  Description of Artificial Sequence: Synthetic oligonucleotide
  Target: ATXN1; (+) strand; PAM type: NRG; PAM sequence: TGG
ttaaatgcttatagacaaac

SEQ ID NO: 124154 - DNA, 20 bp, Artificial Sequence
  Description of Artificial Sequence: Synthetic oligonucleotide
  Target: ATXN1; (+) strand; PAM type: NRG; PAM sequence: AAG
ctggccaaaaaattcattga

SEQ ID NO: 124155 - DNA, 20 bp, Artificial Sequence
  Description of Artificial Sequence: Synthetic oligonucleotide
  Target: ATXN1; (+) strand; PAM type: NRG; PAM sequence: AGG
tggccaaaaaattcattgaa

SEQ ID NO: 124156 - DNA, 20 bp, Artificial Sequence
  Description of Artificial Sequence: Synthetic oligonucleotide
  Target: ATXN1; (+) strand; PAM type: NRG; PAM sequence: AAG
aaaaattcattgaaaggata

SEQ ID NO: 124157 - DNA, 20 bp, Artificial Sequence
  Description of Artificial Sequence: Synthetic oligonucleotide
  Target: ATXN1; (+) strand; PAM type: NRG; PAM sequence: AGG
aaaattcattgaaaggataa

SEQ ID NO: 124158 - DNA, 20 bp, Artificial Sequence
  Description of Artificial Sequence: Synthetic oligonucleotide
  Target: ATXN1; (+) strand; PAM type: NRG; PAM sequence: TGG
ttcattgaaaggataaagga

SEQ ID NO: 124159 - DNA, 20 bp, Artificial Sequence
  Description of Artificial Sequence: Synthetic oligonucleotide
  Target: ATXN1; (+) strand; PAM type: NRG; PAM sequence: TGG
ggcataaatatgaacttcta

SEQ ID NO: 124160 - DNA, 20 bp, Artificial Sequence
  Description of Artificial Sequence: Synthetic oligonucleotide
  Target: ATXN1; (+) strand; PAM type: NRG; PAM sequence: CAG
tgaacttctatggtataatg

SEQ ID NO: 124161 - DNA, 20 bp, Artificial Sequence
  Description of Artificial Sequence: Synthetic oligonucleotide
  Target: ATXN1; (+) strand; PAM type: NRG; PAM sequence: AGG
gaacttctatggtataatgc

SEQ ID NO: 124162 - DNA, 20 bp, Artificial Sequence
  Description of Artificial Sequence: Synthetic oligonucleotide
  Target: ATXN1; (+) strand; PAM type: NRG; PAM sequence: CAG
tctatggtataatgcaggcc

SEQ ID NO: 124163 - DNA, 20 bp, Artificial Sequence
  Description of Artificial Sequence: Synthetic oligonucleotide
  Target: ATXN1; (+) strand; PAM type: NRG; PAM sequence: GAG
aatgcaggcccagacttctt

SEQ ID NO: 124164 - DNA, 20 bp, Artificial Sequence
  Description of Artificial Sequence: Synthetic oligonucleotide
  Target: ATXN1; (+) strand; PAM type: NRG; PAM sequence: CAG
ggcccagacttcttgagctg

SEQ ID NO: 124165 - DNA, 20 bp, Artificial Sequence
  Description of Artificial Sequence: Synthetic oligonucleotide
  Target: ATXN1; (+) strand; PAM type: NRG; PAM sequence: AGG
gcccagacttcttgagctgc

SEQ ID NO: 124166 - DNA, 20 bp, Artificial Sequence
  Description of Artificial Sequence: Synthetic oligonucleotide
  Target: ATXN1; (+) strand; PAM type: NRG; PAM sequence: AAG
cttcttgagctgcaggcctg

SEQ ID NO: 124167 - DNA, 20 bp, Artificial Sequence
  Description of Artificial Sequence: Synthetic oligonucleotide
  Target: ATXN1; (+) strand; PAM type: NRG; PAM sequence: AAG
tctgaaatatcccctaaaaa

SEQ ID NO: 124168 - DNA, 20 bp, Artificial Sequence
  Description of Artificial Sequence: Synthetic oligonucleotide
  Target: ATXN1; (+) strand; PAM type: NRG; PAM sequence: AGG
ctgaaatatcccctaaaaaa

SEQ ID NO: 124169 - DNA, 20 bp, Artificial Sequence
  Description of Artificial Sequence: Synthetic oligonucleotide
  Target: ATXN1; (+) strand; PAM type: NRG; PAM sequence: TAG
gtctcaaacctccaacctat

SEQ ID NO: 124170 - DNA, 20 bp, Artificial Sequence
  Description of Artificial Sequence: Synthetic oligonucleotide
  Target: ATXN1; (+) strand; PAM type: NRG; PAM sequence: AGG
tctcaaacctccaacctatt

SEQ ID NO: 124171 - DNA, 20 bp, Artificial Sequence
  Description of Artificial Sequence: Synthetic oligonucleotide
  Target: ATXN1; (+) strand; PAM type: NRG; PAM sequence: TGG
aaacctccaacctattagga

SEQ ID NO: 124172 - DNA, 20 bp, Artificial Sequence
  Description of Artificial Sequence: Synthetic oligonucleotide
  Target: ATXN1; (+) strand; PAM type: NRG; PAM sequence: CAG
atcaaatacatttttttaac

SEQ ID NO: 124173 - DNA, 20 bp, Artificial Sequence
  Description of Artificial Sequence: Synthetic oligonucleotide
  Target: ATXN1; (+) strand; PAM type: NRG; PAM sequence: TGG
aaccagaaaataacaactgt

SEQ ID NO: 124174 - DNA, 20 bp, Artificial Sequence
  Description of Artificial Sequence: Synthetic oligonucleotide
  Target: ATXN1; (+) strand; PAM type: NRG; PAM sequence: GAG
agaaaataacaactgttggt

SEQ ID NO: 124175 - DNA, 20 bp, Artificial Sequence
  Description of Artificial Sequence: Synthetic oligonucleotide
  Target: ATXN1; (+) strand; PAM type: NRG; PAM sequence: AGG
gaaaataacaactgttggtg

SEQ ID NO: 124176 - DNA, 20 bp, Artificial Sequence
  Description of Artificial Sequence: Synthetic oligonucleotide
  Target: ATXN1; (+) strand; PAM type: NRG; PAM sequence: TAG
aacaactgttggtgaggaca

SEQ ID NO: 124177 - DNA, 20 bp, Artificial Sequence
  Description of Artificial Sequence: Synthetic oligonucleotide
  Target: ATXN1; (+) strand; PAM type: NRG; PAM sequence: GAG
caactgttggtgaggacata

SEQ ID NO: 124178 - DNA, 20 bp, Artificial Sequence
  Description of Artificial Sequence: Synthetic oligonucleotide
  Target: ATXN1; (+) strand; PAM type: NRG; PAM sequence: TGG
tggtgaggacatagagaaac

SEQ ID NO: 124179 - DNA, 20 bp, Artificial Sequence
  Description of Artificial Sequence: Synthetic oligonucleotide
  Target: ATXN1; (+) strand; PAM type: NRG; PAM sequence: TGG
ctggaacccttgtgcactgt

SEQ ID NO: 124180 - DNA, 20 bp, Artificial Sequence
  Description of Artificial Sequence: Synthetic oligonucleotide
  Target: ATXN1; (+) strand; PAM type: NRG; PAM sequence: TAG
gaacccttgtgcactgttgg

SEQ ID NO: 124181 - DNA, 20 bp, Artificial Sequence
  Description of Artificial Sequence: Synthetic oligonucleotide
  Target: ATXN1; (+) strand; PAM type: NRG; PAM sequence: AAG
gcactgttggtagaaatgca

SEQ ID NO: 124182 - DNA, 20 bp, Artificial Sequence
  Description of Artificial Sequence: Synthetic oligonucleotide
  Target: ATXN1; (+) strand; PAM type: NRG; PAM sequence: TGG
ctgttggtagaaatgcaaag

SEQ ID NO: 124183 - DNA, 20 bp, Artificial Sequence
  Description of Artificial Sequence: Synthetic oligonucleotide
  Target: ATXN1; (+) strand; PAM type: NRG; PAM sequence: CAG
ggtagaaatgcaaagtggtg

SEQ ID NO: 124184 - DNA, 20 bp, Artificial Sequence
  Description of Artificial Sequence: Synthetic oligonucleotide
  Target: ATXN1; (+) strand; PAM type: NRG; PAM sequence: TGG
gcaaagtggtgcagccactg

SEQ ID NO: 124185 - DNA, 20 bp, Artificial Sequence
  Description of Artificial Sequence: Synthetic oligonucleotide
  Target: ATXN1; (+) strand; PAM type: NRG; PAM sequence: CAG
agccactgtggaaaacgata

SEQ ID NO: 124186 - DNA, 20 bp, Artificial Sequence
  Description of Artificial Sequence: Synthetic oligonucleotide
  Target: ATXN1; (+) strand; PAM type: NRG; PAM sequence: CAG
cactgtggaaaacgatacag

SEQ ID NO: 124187 - DNA, 20 bp, Artificial Sequence
  Description of Artificial Sequence: Synthetic oligonucleotide
  Target: ATXN1; (+) strand; PAM type: NRG; PAM sequence: TAG
gttcataaaaaatttaaaaa

SEQ ID NO: 124188 - DNA, 20 bp, Artificial Sequence
  Description of Artificial Sequence: Synthetic oligonucleotide
  Target: ATXN1; (+) strand; PAM type: NRG; PAM sequence: CAG
aatagaattgccacgtgatc

SEQ ID NO: 124189 - DNA, 20 bp, Artificial Sequence
  Description of Artificial Sequence: Synthetic oligonucleotide
  Target: ATXN1; (+) strand; PAM type: NRG; PAM sequence: CAG
tgatccagcaattccatttc

SEQ ID NO: 124190 - DNA, 20 bp, Artificial Sequence
  Description of Artificial Sequence: Synthetic oligonucleotide
  Target: ATXN1; (+) strand; PAM type: NRG; PAM sequence: AGG
gatccagcaattccatttcc

SEQ ID NO: 124191 - DNA, 20 bp, Artificial Sequence
  Description of Artificial Sequence: Synthetic oligonucleotide
  Target: ATXN1; (+) strand; PAM type: NRG; PAM sequence: AAG
atttccaggtatatacccaa

SEQ ID NO: 124192 - DNA, 20 bp, Artificial Sequence
  Description of Artificial Sequence: Synthetic oligonucleotide
  Target: ATXN1; (+) strand; PAM type: NRG; PAM sequence: AAG
tatatacccaaaagaactga

SEQ ID NO: 124193 - DNA, 20 bp, Artificial Sequence
  Description of Artificial Sequence: Synthetic oligonucleotide
  Target: ATXN1; (+) strand; PAM type: NRG; PAM sequence: AGG
atatacccaaaagaactgaa

SEQ ID NO: 124194 - DNA, 20 bp, Artificial Sequence
  Description of Artificial Sequence: Synthetic oligonucleotide
  Target: ATXN1; (+) strand; PAM type: NRG; PAM sequence: GAG
atacccaaaagaactgaaag

SEQ ID NO: 124195 - DNA, 20 bp, Artificial Sequence
  Description of Artificial Sequence: Synthetic oligonucleotide
  Target: ATXN1; (+) strand; PAM type: NRG; PAM sequence: TAG
aatttgtacacccacattca

SEQ ID NO: 124196 - DNA, 20 bp, Artificial Sequence
  Description of Artificial Sequence: Synthetic oligonucleotide
  Target: ATXN1; (+) strand; PAM type: NRG; PAM sequence: CAG
ttgtacacccacattcatag

SEQ ID NO: 124197 - DNA, 20 bp, Artificial Sequence
  Description of Artificial Sequence: Synthetic oligonucleotide
  Target: ATXN1; (+) strand; PAM type: NRG; PAM sequence: CAG
attcatagcagcattattca

SEQ ID NO: 124198 - DNA, 20 bp, Artificial Sequence
  Description of Artificial Sequence: Synthetic oligonucleotide
  Target: ATXN1; (+) strand; PAM type: NRG; PAM sequence: AAG
gcattattcacagtaaccaa

SEQ ID NO: 124199 - DNA, 20 bp, Artificial Sequence
  Description of Artificial Sequence: Synthetic oligonucleotide
  Target: ATXN1; (+) strand; PAM type: NRG; PAM sequence: AGG
cattattcacagtaaccaaa

SEQ ID NO: 124200 - DNA, 20 bp, Artificial Sequence
  Description of Artificial Sequence: Synthetic oligonucleotide
  Target: ATXN1; (+) strand; PAM type: NRG; PAM sequence: TGG
tattcacagtaaccaaaagg

SEQ ID NO: 124201 - DNA, 20 bp, Artificial Sequence
  Description of Artificial Sequence: Synthetic oligonucleotide
  Target: ATXN1; (+) strand; PAM type: NRG; PAM sequence: AAG
ccaaaaggtggaaacaaccc

SEQ ID NO: 124202 - DNA, 20 bp, Artificial Sequence
  Description of Artificial Sequence: Synthetic oligonucleotide
  Target: ATXN1; (+) strand; PAM type: NRG; PAM sequence: TGG
ggaaacaacccaagtgttta

SEQ ID NO: 124203 - DNA, 20 bp, Artificial Sequence
  Description of Artificial Sequence: Synthetic oligonucleotide
  Target: ATXN1; (+) strand; PAM type: NRG; PAM sequence: CAG
acaacccaagtgtttatgga

SEQ ID NO: 124204 - DNA, 20 bp, Artificial Sequence
  Description of Artificial Sequence: Synthetic oligonucleotide
  Target: ATXN1; (+) strand; PAM type: NRG; PAM sequence: AAG
aaacaaaatgtgatatatac

SEQ ID NO: 124205 - DNA, 20 bp, Artificial Sequence
  Description of Artificial Sequence: Synthetic oligonucleotide
  Target: ATXN1; (+) strand; PAM type: NRG; PAM sequence: GAG
acaaaatgtgatatatacaa

SEQ ID NO: 124206 - DNA, 20 bp, Artificial Sequence
  Description of Artificial Sequence: Synthetic oligonucleotide
  Target: ATXN1; (+) strand; PAM type: NRG; PAM sequence: TGG
aaatgtgatatatacaagag

SEQ ID NO: 124207 - DNA, 20 bp, Artificial Sequence
  Description of Artificial Sequence: Synthetic oligonucleotide
  Target: ATXN1; (+) strand; PAM type: NRG; PAM sequence: CAG
tacaagagtggaatattcat

SEQ ID NO: 124208 - DNA, 20 bp, Artificial Sequence
  Description of Artificial Sequence: Synthetic oligonucleotide
  Target: ATXN1; (+) strand; PAM type: NRG; PAM sequence: AAG
atattcatcagccttaaaaa

SEQ ID NO: 124209 - DNA, 20 bp, Artificial Sequence
  Description of Artificial Sequence: Synthetic oligonucleotide
  Target: ATXN1; (+) strand; PAM type: NRG; PAM sequence: TGG
ttctgacacatgttacaaca

SEQ ID NO: 124210 - DNA, 20 bp, Artificial Sequence
  Description of Artificial Sequence: Synthetic oligonucleotide
  Target: ATXN1; (+) strand; PAM type: NRG; PAM sequence: GAG
gttacaacatggatgacctt

SEQ ID NO: 124211 - DNA, 20 bp, Artificial Sequence
  Description of Artificial Sequence: Synthetic oligonucleotide
  Target: ATXN1; (+) strand; PAM type: NRG; PAM sequence: AGG
ttacaacatggatgaccttg

SEQ ID NO: 124212 - DNA, 20 bp, Artificial Sequence
  Description of Artificial Sequence: Synthetic oligonucleotide
  Target: ATXN1; (+) strand; PAM type: NRG; PAM sequence: AAG
aggacattatgctaaacaaa

SEQ ID NO: 124213 - DNA, 20 bp, Artificial Sequence
  Description of Artificial Sequence: Synthetic oligonucleotide
  Target: ATXN1; (+) strand; PAM type: NRG; PAM sequence: AAG
tgctaaacaaaaagtcacaa

SEQ ID NO: 124214 - DNA, 20 bp, Artificial Sequence
  Description of Artificial Sequence: Synthetic oligonucleotide
  Target: ATXN1; (+) strand; PAM type: NRG; PAM sequence: AGG
gctaaacaaaaagtcacaaa

SEQ ID NO: 124215 - DNA, 20 bp, Artificial Sequence
  Description of Artificial Sequence: Synthetic oligonucleotide
  Target: ATXN1; (+) strand; PAM type: NRG; PAM sequence: TAG
accctgtgtgattctactca

SEQ ID NO: 124216 - DNA, 20 bp, Artificial Sequence
  Description of Artificial Sequence: Synthetic oligonucleotide
  Target: ATXN1; (+) strand; PAM type: NRG; PAM sequence: AGG
ccctgtgtgattctactcat

SEQ ID NO: 124217 - DNA, 20 bp, Artificial Sequence
  Description of Artificial Sequence: Synthetic oligonucleotide
  Target: ATXN1; (+) strand; PAM type: NRG; PAM sequence: GAG
ctgtgtgattctactcatag

SEQ ID NO: 124218 - DNA, 20 bp, Artificial Sequence
  Description of Artificial Sequence: Synthetic oligonucleotide
  Target: ATXN1; (+) strand; PAM type: NRG; PAM sequence: AGG
tgtgtgattctactcatagg

SEQ ID NO: 124219 - DNA, 20 bp, Artificial Sequence
  Description of Artificial Sequence: Synthetic oligonucleotide
  Target: ATXN1; (+) strand; PAM type: NRG; PAM sequence: TAG
ttctactcataggaggtccc

SEQ ID NO: 124220 - DNA, 20 bp, Artificial Sequence
  Description of Artificial Sequence: Synthetic oligonucleotide
  Target: ATXN1; (+) strand; PAM type: NRG; PAM sequence: GAG
ctactcataggaggtcccta

SEQ ID NO: 124221 - DNA, 20 bp, Artificial Sequence
  Description of Artificial Sequence: Synthetic oligonucleotide
  Target: ATXN1; (+) strand; PAM type: NRG; PAM sequence: CAG
ctcataggaggtccctagag

SEQ ID NO: 124222 - DNA, 20 bp, Artificial Sequence
  Description of Artificial Sequence: Synthetic oligonucleotide
  Target: ATXN1; (+) strand; PAM type: NRG; PAM sequence: TAG
ccctagagcagtcaaattca

SEQ ID NO: 124223 - DNA, 20 bp, Artificial Sequence
  Description of Artificial Sequence: Synthetic oligonucleotide
  Target: ATXN1; (+) strand; PAM type: NRG; PAM sequence: GAG
ctagagcagtcaaattcata

SEQ ID NO: 124224 - DNA, 20 bp, Artificial Sequence
  Description of Artificial Sequence: Synthetic oligonucleotide
  Target: ATXN1; (+) strand; PAM type: NRG; PAM sequence: AGG
tagagcagtcaaattcatag

SEQ ID NO: 124225 - DNA, 20 bp, Artificial Sequence
  Description of Artificial Sequence: Synthetic oligonucleotide
  Target: ATXN1; (+) strand; PAM type: NRG; PAM sequence: CAG
agcagtcaaattcatagagg

SEQ ID NO: 124226 - DNA, 20 bp, Artificial Sequence
  Description of Artificial Sequence: Synthetic oligonucleotide
  Target: ATXN1; (+) strand; PAM type: NRG; PAM sequence: AAG
gtcaaattcatagaggcaga

SEQ ID NO: 124227 - DNA, 20 bp, Artificial Sequence
  Description of Artificial Sequence: Synthetic oligonucleotide
  Target: ATXN1; (+) strand; PAM type: NRG; PAM sequence: TAG
aaattcatagaggcagaaag

SEQ ID NO: 124228 - DNA, 20 bp, Artificial Sequence
  Description of Artificial Sequence: Synthetic oligonucleotide
  Target: ATXN1; (+) strand; PAM type: NRG; PAM sequence: TGG
catagaggcagaaagtagaa

SEQ ID NO: 124229 - DNA, 20 bp, Artificial Sequence
  Description of Artificial Sequence: Synthetic oligonucleotide
  Target: ATXN1; (+) strand; PAM type: NRG; PAM sequence: CAG
gaaagtagaatggtgattac

SEQ ID NO: 124230 - DNA, 20 bp, Artificial Sequence
  Description of Artificial Sequence: Synthetic oligonucleotide
  Target: ATXN1; (+) strand; PAM type: NRG; PAM sequence: AGG
aaagtagaatggtgattacc

SEQ ID NO: 124231 - DNA, 20 bp, Artificial Sequence
  Description of Artificial Sequence: Synthetic oligonucleotide
  Target: ATXN1; (+) strand; PAM type: NRG; PAM sequence: GAG
agtagaatggtgattaccag

SEQ ID NO: 124232 - DNA, 20 bp, Artificial Sequence
  Description of Artificial Sequence: Synthetic oligonucleotide
  Target: ATXN1; (+) strand; PAM type: NRG; PAM sequence: AGG
gtagaatggtgattaccagg

SEQ ID NO: 124233 - DNA, 20 bp, Artificial Sequence
  Description of Artificial Sequence: Synthetic oligonucleotide
  Target: ATXN1; (+) strand; PAM type: NRG; PAM sequence: GGG
tagaatggtgattaccagga

SEQ ID NO: 124234 - DNA, 20 bp, Artificial Sequence
  Description of Artificial Sequence: Synthetic oligonucleotide
  Target: ATXN1; (+) strand; PAM type: NRG; PAM sequence: GAG
gaatggtgattaccaggagg

SEQ ID NO: 124235 - DNA, 20 bp, Artificial Sequence
  Description of Artificial Sequence: Synthetic oligonucleotide
  Target: ATXN1; (+) strand; PAM type: NRG; PAM sequence: AGG
aatggtgattaccaggaggg

SEQ ID NO: 124236 - DNA, 20 bp, Artificial Sequence
  Description of Artificial Sequence: Synthetic oligonucleotide
  Target: ATXN1; (+) strand; PAM type: NRG; PAM sequence: GGG
atggtgattaccaggaggga

SEQ ID NO: 124237 - DNA, 20 bp, Artificial Sequence
  Description of Artificial Sequence: Synthetic oligonucleotide
  Target: ATXN1; (+) strand; PAM type: NRG; PAM sequence: GGG
tggtgattaccaggagggag

SEQ ID NO: 124238 - DNA, 20 bp, Artificial Sequence
  Description of Artificial Sequence: Synthetic oligonucleotide
  Target: ATXN1; (+) strand; PAM type: NRG; PAM sequence: GGG
ggtgattaccaggagggagg

SEQ ID NO: 124239 - DNA, 20 bp, Artificial Sequence
  Description of Artificial Sequence: Synthetic oligonucleotide
  Target: ATXN1; (+) strand; PAM type: NRG; PAM sequence: AAG
gattaccaggagggaggggg

SEQ ID NO: 124240 - DNA, 20 bp, Artificial Sequence
  Description of Artificial Sequence: Synthetic oligonucleotide
  Target: ATXN1; (+) strand; PAM type: NRG; PAM sequence: AGG
attaccaggagggaggggga

SEQ ID NO: 124241 - DNA, 20 bp, Artificial Sequence
  Description of Artificial Sequence: Synthetic oligonucleotide
  Target: ATXN1; (+) strand; PAM type: NRG; PAM sequence: GGG
ttaccaggagggagggggaa

SEQ ID NO: 124242 - DNA, 20 bp, Artificial Sequence
  Description of Artificial Sequence: Synthetic oligonucleotide
  Target: ATXN1; (+) strand; PAM type: NRG; PAM sequence: GGG
taccaggagggagggggaag

SEQ ID NO: 124243 - DNA, 20 bp, Artificial Sequence
  Description of Artificial Sequence: Synthetic oligonucleotide
  Target: ATXN1; (+) strand; PAM type: NRG; PAM sequence: GGG
accaggagggagggggaagg

SEQ ID NO: 124244 - DNA, 20 bp, Artificial Sequence
  Description of Artificial Sequence: Synthetic oligonucleotide
  Target: ATXN1; (+) strand; PAM type: NRG; PAM sequence: AAG
aggagggagggggaaggggg

SEQ ID NO: 124245 - DNA, 20 bp, Artificial Sequence
  Description of Artificial Sequence: Synthetic oligonucleotide
  Target: ATXN1; (+) strand; PAM type: NRG; PAM sequence: AGG
ggagggagggggaaggggga

SEQ ID NO: 124246 - DNA, 20 bp, Artificial Sequence
  Description of Artificial Sequence: Synthetic oligonucleotide
  Target: ATXN1; (+) strand; PAM type: NRG; PAM sequence: GGG
gagggagggggaagggggaa

SEQ ID NO: 124247 - DNA, 20 bp, Artificial Sequence
  Description of Artificial Sequence: Synthetic oligonucleotide
  Target: ATXN1; (+) strand; PAM type: NRG; PAM sequence: GGG
agggagggggaagggggaag

SEQ ID NO: 124248 - DNA, 20 bp, Artificial Sequence
  Description of Artificial Sequence: Synthetic oligonucleotide
  Target: ATXN1; (+) strand; PAM type: NRG; PAM sequence: GGG
gggagggggaagggggaagg

SEQ ID NO: 124249 - DNA, 20 bp, Artificial Sequence
  Description of Artificial Sequence: Synthetic oligonucleotide
  Target: ATXN1; (+) strand; PAM type: NRG; PAM sequence: TGG
agggggaatttattgtctaa

SEQ ID NO: 124250 - DNA, 20 bp, Artificial Sequence
  Description of Artificial Sequence: Synthetic oligonucleotide
  Target: ATXN1; (+) strand; PAM type: NRG; PAM sequence: GGG
gggggaatttattgtctaat

SEQ ID NO: 124251 - DNA, 20 bp, Artificial Sequence
  Description of Artificial Sequence: Synthetic oligonucleotide
  Target: ATXN1; (+) strand; PAM type: NRG; PAM sequence: CAG
aatttattgtctaatgggta

SEQ ID NO: 124252 - DNA, 20 bp, Artificial Sequence
  Description of Artificial Sequence: Synthetic oligonucleotide
  Target: ATXN1; (+) strand; PAM type: NRG; PAM sequence: GAG
tttattgtctaatgggtaca

SEQ ID NO: 124253 - DNA, 20 bp, Artificial Sequence
  Description of Artificial Sequence: Synthetic oligonucleotide
  Target: ATXN1; (+) strand; PAM type: NRG; PAM sequence: AAG
taatgggtacagagttttgc

SEQ ID NO: 124254 - DNA, 20 bp, Artificial Sequence
  Description of Artificial Sequence: Synthetic oligonucleotide
  Target: ATXN1; (+) strand; PAM type: NRG; PAM sequence: CAG
agagttttgcaagacacaaa

SEQ ID NO: 124255 - DNA, 20 bp, Artificial Sequence
  Description of Artificial Sequence: Synthetic oligonucleotide
  Target: ATXN1; (+) strand; PAM type: NRG; PAM sequence: GAG
tttgcaagacacaaacagct

SEQ ID NO: 124256 - DNA, 20 bp, Artificial Sequence
  Description of Artificial Sequence: Synthetic oligonucleotide
  Target: ATXN1; (+) strand; PAM type: NRG; PAM sequence: TGG
aagacacaaacagctgagac

SEQ ID NO: 124257 - DNA, 20 bp, Artificial Sequence
  Description of Artificial Sequence: Synthetic oligonucleotide
  Target: ATXN1; (+) strand; PAM type: NRG; PAM sequence: GAG
gctgagactggatgcacaac

SEQ ID NO: 124258 - DNA, 20 bp, Artificial Sequence
  Description of Artificial Sequence: Synthetic oligonucleotide
  Target: ATXN1; (+) strand; PAM type: NRG; PAM sequence: TGG
gatgcacaacgagaatatac

SEQ ID NO: 124259 - DNA, 20 bp, Artificial Sequence
  Description of Artificial Sequence: Synthetic oligonucleotide
  Target: ATXN1; (+) strand; PAM type: NRG; PAM sequence: CAG
gagaatatactggatactat

SEQ ID NO: 124260 - DNA, 20 bp, Artificial Sequence
  Description of Artificial Sequence: Synthetic oligonucleotide
  Target: ATXN1; (+) strand; PAM type: NRG; PAM sequence: AGG
agaatatactggatactatc

SEQ ID NO: 124261 - DNA, 20 bp, Artificial Sequence
  Description of Artificial Sequence: Synthetic oligonucleotide
  Target: ATXN1; (+) strand; PAM type: NRG; PAM sequence: CAG
atcaggctgtatcttgaacc

SEQ ID NO: 124262 - DNA, 20 bp, Artificial Sequence
  Description of Artificial Sequence: Synthetic oligonucleotide
  Target: ATXN1; (+) strand; PAM type: NRG; PAM sequence: AAG
tgatgccactgccaccattc

SEQ ID NO: 124263 - DNA, 20 bp, Artificial Sequence
  Description of Artificial Sequence: Synthetic oligonucleotide
  Target: ATXN1; (+) strand; PAM type: NRG; PAM sequence: AAG
cactgccaccattcaagccc

SEQ ID NO: 124264 - DNA, 20 bp, Artificial Sequence
  Description of Artificial Sequence: Synthetic oligonucleotide
  Target: ATXN1; (+) strand; PAM type: NRG; PAM sequence: CAG
attttctatcctgtcaacta

SEQ ID NO: 124265 - DNA, 20 bp, Artificial Sequence
  Description of Artificial Sequence: Synthetic oligonucleotide
  Target: ATXN1; (+) strand; PAM type: NRG; PAM sequence: AGG
ttttctatcctgtcaactac

SEQ ID NO: 124266 - DNA, 20 bp, Artificial Sequence
  Description of Artificial Sequence: Synthetic oligonucleotide
  Target: ATXN1; (+) strand; PAM type: NRG; PAM sequence: TGG
tcaactacaggtttcttacc

SEQ ID NO: 124267 - DNA, 20 bp, Artificial Sequence
  Description of Artificial Sequence: Synthetic oligonucleotide
  Target: ATXN1; (+) strand; PAM type: NRG; PAM sequence: CAG
ttgccatccttttaatgtca

SEQ ID NO: 124268 - DNA, 20 bp, Artificial Sequence
  Description of Artificial Sequence: Synthetic oligonucleotide
  Target: ATXN1; (+) strand; PAM type: NRG; PAM sequence: AAG
ccttttaatgtcacagtaaa

SEQ ID NO: 124269 - DNA, 20 bp, Artificial Sequence
  Description of Artificial Sequence: Synthetic oligonucleotide
  Target: ATXN1; (+) strand; PAM type: NRG; PAM sequence: TAG
agtaaaaagtgtcatgaaaa

SEQ ID NO: 124270 - DNA, 20 bp, Artificial Sequence
  Description of Artificial Sequence: Synthetic oligonucleotide
  Target: ATXN1; (+) strand; PAM type: NRG; PAM sequence: AAG
aaagtgtcatgaaaatagca

SEQ ID NO: 124271 - DNA, 20 bp, Artificial Sequence
  Description of Artificial Sequence: Synthetic oligonucleotide
  Target: ATXN1; (+) strand; PAM type: NRG; PAM sequence: CAG
gtgtcatgaaaatagcaaag

SEQ ID NO: 124272 - DNA, 20 bp, Artificial Sequence
  Description of Artificial Sequence: Synthetic oligonucleotide
  Target: ATXN1; (+) strand; PAM type: NRG; PAM sequence: AGG
tgtcatgaaaatagcaaagc

SEQ ID NO: 124273 - DNA, 20 bp, Artificial Sequence
  Description of Artificial Sequence: Synthetic oligonucleotide
  Target: ATXN1; (+) strand; PAM type: NRG; PAM sequence: GGG
gtcatgaaaatagcaaagca

SEQ ID NO: 124274 - DNA, 20 bp, Artificial Sequence
  Description of Artificial Sequence: Synthetic oligonucleotide
  Target: ATXN1; (+) strand; PAM type: NRG; PAM sequence: AAG
tgaaaatagcaaagcagggt

SEQ ID NO: 124275 - DNA, 20 bp, Artificial Sequence
  Description of Artificial Sequence: Synthetic oligonucleotide
  Target: ATXN1; (+) strand; PAM type: NRG; PAM sequence: AAG
aaatagcaaagcagggtaag

SEQ ID NO: 124276 - DNA, 20 bp, Artificial Sequence
  Description of Artificial Sequence: Synthetic oligonucleotide
  Target: ATXN1; (+) strand; PAM type: NRG; PAM sequence: CGG
gcaaagcagggtaagaagac

SEQ ID NO: 124277 - DNA, 20 bp, Artificial Sequence
  Description of Artificial Sequence: Synthetic oligonucleotide
  Target: ATXN1; (+) strand; PAM type: NRG; PAM sequence: TAG
agaagaccggcatactatgt

SEQ ID NO: 124278 - DNA, 20 bp, Artificial Sequence
  Description of Artificial Sequence: Synthetic oligonucleotide
  Target: ATXN1; (+) strand; PAM type: NRG; PAM sequence: TAG
gaccggcatactatgttaga

SEQ ID NO: 124279 - DNA, 20 bp, Artificial Sequence
  Description of Artificial Sequence: Synthetic oligonucleotide
  Target: ATXN1; (+) strand; PAM type: NRG; PAM sequence: AGG
accggcatactatgttagat

SEQ ID NO: 124280 - DNA, 20 bp, Artificial Sequence
  Description of Artificial Sequence: Synthetic oligonucleotide
  Target: ATXN1; (+) strand; PAM type: NRG; PAM sequence: TGG
gcatactatgttagatagga

SEQ ID NO: 124281 - DNA, 20 bp, Artificial Sequence
  Description of Artificial Sequence: Synthetic oligonucleotide
  Target: ATXN1; (+) strand; PAM type: NRG; PAM sequence: AAG
ctatgttagataggatggac

SEQ ID NO: 124282 - DNA, 20 bp, Artificial Sequence
  Description of Artificial Sequence: Synthetic oligonucleotide
  Target: ATXN1; (+) strand; PAM type: NRG; PAM sequence: AGG
tatgttagataggatggaca

SEQ ID NO: 124283 - DNA, 20 bp, Artificial Sequence
  Description of Artificial Sequence: Synthetic oligonucleotide
  Target: ATXN1; (+) strand; PAM type: NRG; PAM sequence: AAG
gttagataggatggacaagg

SEQ ID NO: 124284 - DNA, 20 bp, Artificial Sequence
  Description of Artificial Sequence: Synthetic oligonucleotide
  Target: ATXN1; (+) strand; PAM type: NRG; PAM sequence: AGG
ttagataggatggacaagga

SEQ ID NO: 124285 - DNA, 20 bp, Artificial Sequence
  Description of Artificial Sequence: Synthetic oligonucleotide
  Target: ATXN1; (+) strand; PAM type: NRG; PAM sequence: TGG
gatggacaaggaaggcctct

SEQ ID NO: 124286 - DNA, 20 bp, Artificial Sequence
  Description of Artificial Sequence: Synthetic oligonucleotide
  Target: ATXN1; (+) strand; PAM type: NRG; PAM sequence: GAG
tggacaaggaaggcctcttg

SEQ ID NO: 124287 - DNA, 20 bp, Artificial Sequence
  Description of Artificial Sequence: Synthetic oligonucleotide
  Target: ATXN1; (+) strand; PAM type: NRG; PAM sequence: AGG
ggacaaggaaggcctcttgg

SEQ ID NO: 124288 - DNA, 20 bp, Artificial Sequence
  Description of Artificial Sequence: Synthetic oligonucleotide
  Target: ATXN1; (+) strand; PAM type: NRG; PAM sequence: CAG
gtgacatttgtgcactcatt

SEQ ID NO: 124289 - DNA, 20 bp, Artificial Sequence
  Description of Artificial Sequence: Synthetic oligonucleotide
  Target: ATXN1; (+) strand; PAM type: NRG; PAM sequence: AGG
tgacatttgtgcactcattc

SEQ ID NO: 124290 - DNA, 20 bp, Artificial Sequence
  Description of Artificial Sequence: Synthetic oligonucleotide
  Target: ATXN1; (+) strand; PAM type: NRG; PAM sequence: AAG
caggtcatttttccattcaa

SEQ ID NO: 124291 - DNA, 20 bp, Artificial Sequence
  Description of Artificial Sequence: Synthetic oligonucleotide
  Target: ATXN1; (+) strand; PAM type: NRG; PAM sequence: TAG
ttccattcaaaagcattcga

SEQ ID NO: 124292 - DNA, 20 bp, Artificial Sequence
  Description of Artificial Sequence: Synthetic oligonucleotide
  Target: ATXN1; (+) strand; PAM type: NRG; PAM sequence: TGG
cattctgactgtcctattta

SEQ ID NO: 124293 - DNA, 20 bp, Artificial Sequence
  Description of Artificial Sequence: Synthetic oligonucleotide
  Target: ATXN1; (+) strand; PAM type: NRG; PAM sequence: TAG
tcctatttatggtaattctg

SEQ ID NO: 124294 - DNA, 20 bp, Artificial Sequence
  Description of Artificial Sequence: Synthetic oligonucleotide
  Target: ATXN1; (+) strand; PAM type: NRG; PAM sequence: CAG
atggtaattctgtagccatt

SEQ ID NO: 124295 - DNA, 20 bp, Artificial Sequence
  Description of Artificial Sequence: Synthetic oligonucleotide
  Target: ATXN1; (+) strand; PAM type: NRG; PAM sequence: AGG
tggtaattctgtagccattc

SEQ ID NO: 124296 - DNA, 20 bp, Artificial Sequence
  Description of Artificial Sequence: Synthetic oligonucleotide
  Target: ATXN1; (+) strand; PAM type: NRG; PAM sequence: CAG
attcaggactgaaactctga

SEQ ID NO: 124297 - DNA, 20 bp, Artificial Sequence
  Description of Artificial Sequence: Synthetic oligonucleotide
  Target: ATXN1; (+) strand; PAM type: NRG; PAM sequence: TGG
actgaaactctgacagcccc

SEQ ID NO: 124298 - DNA, 20 bp, Artificial Sequence
  Description of Artificial Sequence: Synthetic oligonucleotide
  Target: ATXN1; (+) strand; PAM type: NRG; PAM sequence: TAG
ttctctctctgtatcgcatc

SEQ ID NO: 124299 - DNA, 20 bp, Artificial Sequence
  Description of Artificial Sequence: Synthetic oligonucleotide
  Target: ATXN1; (+) strand; PAM type: NRG; PAM sequence: AAG
tctctattttccccattgct

SEQ ID NO: 124300 - DNA, 20 bp, Artificial Sequence
  Description of Artificial Sequence: Synthetic oligonucleotide
  Target: ATXN1; (+) strand; PAM type: NRG; PAM sequence: GAG
tctattttccccattgctaa

SEQ ID NO: 124301 - DNA, 20 bp, Artificial Sequence
  Description of Artificial Sequence: Synthetic oligonucleotide
  Target: ATXN1; (+) strand; PAM type: NRG; PAM sequence: TGG
ctatctactactccttctct

SEQ ID NO: 124302 - DNA, 20 bp, Artificial Sequence
  Description of Artificial Sequence: Synthetic oligonucleotide
  Target: ATXN1; (+) strand; PAM type: NRG; PAM sequence: TGG
tactactccttctcttggaa

SEQ ID NO: 124303 - DNA, 20 bp, Artificial Sequence
  Description of Artificial Sequence: Synthetic oligonucleotide
  Target: ATXN1; (+) strand; PAM type: NRG; PAM sequence: GGG
actactccttctcttggaat

SEQ ID NO: 124304 - DNA, 20 bp, Artificial Sequence
  Description of Artificial Sequence: Synthetic oligonucleotide
  Target: ATXN1; (+) strand; PAM type: NRG; PAM sequence: CAG
tctatcctacatatacatgc

SEQ ID NO: 124305 - DNA, 20 bp, Artificial Sequence
  Description of Artificial Sequence: Synthetic oligonucleotide
  Target: ATXN1; (+) strand; PAM type: NRG; PAM sequence: CAG
agatgaatctttctaaactg

SEQ ID NO: 124306 - DNA, 20 bp, Artificial Sequence
  Description of Artificial Sequence: Synthetic oligonucleotide
  Target: ATXN1; (+) strand; PAM type: NRG; PAM sequence: TGG
gtttcaaaatctcttgttgc

SEQ ID NO: 124307 - DNA, 20 bp, Artificial Sequence
  Description of Artificial Sequence: Synthetic oligonucleotide
  Target: ATXN1; (+) strand; PAM type: NRG; PAM sequence: AAG
tcctcttcgcttcctgaatt

SEQ ID NO: 124308 - DNA, 20 bp, Artificial Sequence
  Description of Artificial Sequence: Synthetic oligonucleotide
  Target: ATXN1; (+) strand; PAM type: NRG; PAM sequence: CAG
ttcgcttcctgaattaagtc

SEQ ID NO: 124309 - DNA, 20 bp, Artificial Sequence
  Description of Artificial Sequence: Synthetic oligonucleotide
  Target: ATXN1; (+) strand; PAM type: NRG; PAM sequence: GAG
cgcttcctgaattaagtcca

SEQ ID NO: 124310 - DNA, 20 bp, Artificial Sequence
  Description of Artificial Sequence: Synthetic oligonucleotide
  Target: ATXN1; (+) strand; PAM type: NRG; PAM sequence: CAG
taagtccagagtttccatcc

SEQ ID NO: 124311 - DNA, 20 bp, Artificial Sequence
  Description of Artificial Sequence: Synthetic oligonucleotide
  Target: ATXN1; (+) strand; PAM type: NRG; PAM sequence: CAG
ttccatcccagactgtctga

SEQ ID NO: 124312 - DNA, 20 bp, Artificial Sequence
  Description of Artificial Sequence: Synthetic oligonucleotide
  Target: ATXN1; (+) strand; PAM type: NRG; PAM sequence: TGG
ctgtctgacagtctacaata

SEQ ID NO: 124313 - DNA, 20 bp, Artificial Sequence
  Description of Artificial Sequence: Synthetic oligonucleotide
  Target: ATXN1; (+) strand; PAM type: NRG; PAM sequence: CAG
tctcccacttttccccatca

SEQ ID NO: 124314 - DNA, 20 bp, Artificial Sequence
  Description of Artificial Sequence: Synthetic oligonucleotide
  Target: ATXN1; (+) strand; PAM type: NRG; PAM sequence: AGG
ctcccacttttccccatcac

SEQ ID NO: 124315 - DNA, 20 bp, Artificial Sequence
  Description of Artificial Sequence: Synthetic oligonucleotide
  Target: ATXN1; (+) strand; PAM type: NRG; PAM sequence: CGG
ttttccccatcacaggcata

SEQ ID NO: 124316 - DNA, 20 bp, Artificial Sequence
  Description of Artificial Sequence: Synthetic oligonucleotide
  Target: ATXN1; (+) strand; PAM type: NRG; PAM sequence: GGG
tttccccatcacaggcatac

SEQ ID NO: 124317 - DNA, 20 bp, Artificial Sequence
  Description of Artificial Sequence: Synthetic oligonucleotide
  Target: ATXN1; (+) strand; PAM type: NRG; PAM sequence: TGG
ccccatcacaggcatacggg

SEQ ID NO: 124318 - DNA, 20 bp, Artificial Sequence
  Description of Artificial Sequence: Synthetic oligonucleotide
  Target: ATXN1; (+) strand; PAM type: NRG; PAM sequence: CAG
atacgggtggccccttgttc

SEQ ID NO: 124319 - DNA, 20 bp, Artificial Sequence
  Description of Artificial Sequence: Synthetic oligonucleotide
  Target: ATXN1; (+) strand; PAM type: NRG; PAM sequence: CAG
agaacgtactcttcactttc

SEQ ID NO: 124320 - DNA, 20 bp, Artificial Sequence
  Description of Artificial Sequence: Synthetic oligonucleotide
  Target: ATXN1; (+) strand; PAM type: NRG; PAM sequence: TGG
ctttccagaatctgcgtctc

SEQ ID NO: 124321 - DNA, 20 bp, Artificial Sequence
  Description of Artificial Sequence: Synthetic oligonucleotide
  Target: ATXN1; (+) strand; PAM type: NRG; PAM sequence: TGG
atctgcgtctctggtctcaa

SEQ ID NO: 124322 - DNA, 20 bp, Artificial Sequence
  Description of Artificial Sequence: Synthetic oligonucleotide
  Target: ATXN1; (+) strand; PAM type: NRG; PAM sequence: TGG
ttcccaaatcaccttctctg

SEQ ID NO: 124323 - DNA, 20 bp, Artificial Sequence
  Description of Artificial Sequence: Synthetic oligonucleotide
  Target: ATXN1; (+) strand; PAM type: NRG; PAM sequence: TGG
atcaccttctctgtggaaat

SEQ ID NO: 124324 - DNA, 20 bp, Artificial Sequence
  Description of Artificial Sequence: Synthetic oligonucleotide
  Target: ATXN1; (+) strand; PAM type: NRG; PAM sequence: CAG
attggcctgatcttcccaat

SEQ ID NO: 124325 - DNA, 20 bp, Artificial Sequence
  Description of Artificial Sequence: Synthetic oligonucleotide
  Target: ATXN1; (+) strand; PAM type: NRG; PAM sequence: AAG
ggcctgatcttcccaatcag

SEQ ID NO: 124326 - DNA, 20 bp, Artificial Sequence
  Description of Artificial Sequence: Synthetic oligonucleotide
  Target: ATXN1; (+) strand; PAM type: NRG; PAM sequence: AAG
cttctatctttaaccctctg

SEQ ID NO: 124327 - DNA, 20 bp, Artificial Sequence
  Description of Artificial Sequence: Synthetic oligonucleotide
  Target: ATXN1; (+) strand; PAM type: NRG; PAM sequence: CAG
cgtgtttttacttttatata

SEQ ID NO: 124328 - DNA, 20 bp, Artificial Sequence
  Description of Artificial Sequence: Synthetic oligonucleotide
  Target: ATXN1; (+) strand; PAM type: NRG; PAM sequence: TAG
acttatttgtatacttctcc

SEQ ID NO: 124329 - DNA, 20 bp, Artificial Sequence
  Description of Artificial Sequence: Synthetic oligonucleotide
  Target: ATXN1; (+) strand; PAM type: NRG; PAM sequence: CAG
tacttctcctagttcctttt

SEQ ID NO: 124330 - DNA, 20 bp, Artificial Sequence
  Description of Artificial Sequence: Synthetic oligonucleotide
  Target: ATXN1; (+) strand; PAM type: NRG; PAM sequence: TAG
cctagttccttttcagatca

SEQ ID NO: 124331 - DNA, 20 bp, Artificial Sequence
  Description of Artificial Sequence: Synthetic oligonucleotide
  Target: ATXN1; (+) strand; PAM type: NRG; PAM sequence: AGG
ctagttccttttcagatcat

SEQ ID NO: 124332 - DNA, 20 bp, Artificial Sequence
  Description of Artificial Sequence: Synthetic oligonucleotide
  Target: ATXN1; (+) strand; PAM type: NRG; PAM sequence: TGG
ggatttttgaaaatcaaata

SEQ ID NO: 124333 - DNA, 20 bp, Artificial Sequence
  Description of Artificial Sequence: Synthetic oligonucleotide
  Target: ATXN1; (+) strand; PAM type: NRG; PAM sequence: TAG
cttctgtcttctgcatcacc

SEQ ID NO: 124334 - DNA, 20 bp, Artificial Sequence
  Description of Artificial Sequence: Synthetic oligonucleotide
  Target: ATXN1; (+) strand; PAM type: NRG; PAM sequence: AAG
acctagcaacttgttcctca

SEQ ID NO: 124335 - DNA, 20 bp, Artificial Sequence
  Description of Artificial Sequence: Synthetic oligonucleotide
  Target: ATXN1; (+) strand; PAM type: NRG; PAM sequence: TGG
tgttcctcaaagtgtcttcc

SEQ ID NO: 124336 - DNA, 20 bp, Artificial Sequence
  Description of Artificial Sequence: Synthetic oligonucleotide
  Target: ATXN1; (+) strand; PAM type: NRG; PAM sequence: GGG
gttcctcaaagtgtcttcct

SEQ ID NO: 124337 - DNA, 20 bp, Artificial Sequence
  Description of Artificial Sequence: Synthetic oligonucleotide
  Target: ATXN1; (+) strand; PAM type: NRG; PAM sequence: CAG
tcaaagtgtcttcctgggac

SEQ ID NO: 124338 - DNA, 20 bp, Artificial Sequence
  Description of Artificial Sequence: Synthetic oligonucleotide
  Target: ATXN1; (+) strand; PAM type: NRG; PAM sequence: CAG
aagtgtcttcctgggaccag

SEQ ID NO: 124339 - DNA, 20 bp, Artificial Sequence
  Description of Artificial Sequence: Synthetic oligonucleotide
  Target: ATXN1; (+) strand; PAM type: NRG; PAM sequence: CAG
tcctgggaccagcagcatct

SEQ ID NO: 124340 - DNA, 20 bp, Artificial Sequence
  Description of Artificial Sequence: Synthetic oligonucleotide
  Target: ATXN1; (+) strand; PAM type: NRG; PAM sequence: AGG
cctgggaccagcagcatctc

SEQ ID NO: 124341 - DNA, 20 bp, Artificial Sequence
  Description of Artificial Sequence: Synthetic oligonucleotide
  Target: ATXN1; (+) strand; PAM type: NRG; PAM sequence: CAG
cagcatctcaggccctatct

SEQ ID NO: 124342 - DNA, 20 bp, Artificial Sequence
  Description of Artificial Sequence: Synthetic oligonucleotide
  Target: ATXN1; (+) strand; PAM type: NRG; PAM sequence: CAG
caggccctatctcagaccga

SEQ ID NO: 124343 - DNA, 20 bp, Artificial Sequence
  Description of Artificial Sequence: Synthetic oligonucleotide
  Target: ATXN1; (+) strand; PAM type: NRG; PAM sequence: AGG
aggccctatctcagaccgac

SEQ ID NO: 124344 - DNA, 20 bp, Artificial Sequence
  Description of Artificial Sequence: Synthetic oligonucleotide
  Target: ATXN1; (+) strand; PAM type: NRG; PAM sequence: CAG
ctatctcagaccgacaggat

SEQ ID NO: 124345 - DNA, 20 bp, Artificial Sequence
  Description of Artificial Sequence: Synthetic oligonucleotide
  Target: ATXN1; (+) strand; PAM type: NRG; PAM sequence: CAG
ctgcattttaacaatattcc

SEQ ID NO: 124346 - DNA, 20 bp, Artificial Sequence
  Description of Artificial Sequence: Synthetic oligonucleotide
  Target: ATXN1; (+) strand; PAM type: NRG; PAM sequence: AGG
tgcattttaacaatattccc

SEQ ID NO: 124347 - DNA, 20 bp, Artificial Sequence
  Description of Artificial Sequence: Synthetic oligonucleotide
  Target: ATXN1; (+) strand; PAM type: NRG; PAM sequence: GGG
gcattttaacaatattccca

SEQ ID NO: 124348 - DNA, 20 bp, Artificial Sequence
  Description of Artificial Sequence: Synthetic oligonucleotide
  Target: ATXN1; (+) strand; PAM type: NRG; PAM sequence: GGG
cattttaacaatattcccag

SEQ ID NO: 124349 - DNA, 20 bp, Artificial Sequence
  Description of Artificial Sequence: Synthetic oligonucleotide
  Target: ATXN1; (+) strand; PAM type: NRG; PAM sequence: AAG
ggattccgacccacttgatc

SEQ ID NO: 124350 - DNA, 20 bp, Artificial Sequence
  Description of Artificial Sequence: Synthetic oligonucleotide
  Target: ATXN1; (+) strand; PAM type: NRG; PAM sequence: CAG
gacccacttgatcaagctca

SEQ ID NO: 124351 - DNA, 20 bp, Artificial Sequence
  Description of Artificial Sequence: Synthetic oligonucleotide
  Target: ATXN1; (+) strand; PAM type: NRG; PAM sequence: CAG
ccacttgatcaagctcacag

SEQ ID NO: 124352 - DNA, 20 bp, Artificial Sequence
  Description of Artificial Sequence: Synthetic oligonucleotide
  Target: ATXN1; (+) strand; PAM type: NRG; PAM sequence: TGG
ccactcatctcatacttgac

SEQ ID NO: 124353 - DNA, 20 bp, Artificial Sequence
  Description of Artificial Sequence: Synthetic oligonucleotide
  Target: ATXN1; (+) strand; PAM type: NRG; PAM sequence: TAG
acttgactggttgaactgac

SEQ ID NO: 124354 - DNA, 20 bp, Artificial Sequence
  Description of Artificial Sequence: Synthetic oligonucleotide
  Target: ATXN1; (+) strand; PAM type: NRG; PAM sequence: AGG
cttgactggttgaactgact

SEQ ID NO: 124355 - DNA, 20 bp, Artificial Sequence
  Description of Artificial Sequence: Synthetic oligonucleotide
  Target: ATXN1; (+) strand; PAM type: NRG; PAM sequence: AAG
ttgaactgactaggaaaaca

SEQ ID NO: 124356 - DNA, 20 bp, Artificial Sequence
  Description of Artificial Sequence: Synthetic oligonucleotide
  Target: ATXN1; (+) strand; PAM type: NRG; PAM sequence: TAG
aactgactaggaaaacaaag

SEQ ID NO: 124357 - DNA, 20 bp, Artificial Sequence
  Description of Artificial Sequence: Synthetic oligonucleotide
  Target: ATXN1; (+) strand; PAM type: NRG; PAM sequence: AGG
actgactaggaaaacaaagt

SEQ ID NO: 124358 - DNA, 20 bp, Artificial Sequence
  Description of Artificial Sequence: Synthetic oligonucleotide
  Target: ATXN1; (+) strand; PAM type: NRG; PAM sequence: GAG
tgactaggaaaacaaagtag

SEQ ID NO: 124359 - DNA, 20 bp, Artificial Sequence
  Description of Artificial Sequence: Synthetic oligonucleotide
  Target: ATXN1; (+) strand; PAM type: NRG; PAM sequence: AAG
taacttacataactcattca

SEQ ID NO: 124360 - DNA, 20 bp, Artificial Sequence
  Description of Artificial Sequence: Synthetic oligonucleotide
  Target: ATXN1; (+) strand; PAM type: NRG; PAM sequence: GAG
actcattcaaagatcattgt

SEQ ID NO: 124361 - DNA, 20 bp, Artificial Sequence
  Description of Artificial Sequence: Synthetic oligonucleotide
  Target: ATXN1; (+) strand; PAM type: NRG; PAM sequence: TAG
atgctttacctatataaaac

SEQ ID NO: 124362 - DNA, 20 bp, Artificial Sequence
  Description of Artificial Sequence: Synthetic oligonucleotide
  Target: ATXN1; (+) strand; PAM type: NRG; PAM sequence: AGG
tgctttacctatataaaact

SEQ ID NO: 124363 - DNA, 20 bp, Artificial Sequence
  Description of Artificial Sequence: Synthetic oligonucleotide
  Target: ATXN1; (+) strand; PAM type: NRG; PAM sequence: GGG
gctttacctatataaaacta

SEQ ID NO: 124364 - DNA, 20 bp, Artificial Sequence
  Description of Artificial Sequence: Synthetic oligonucleotide
  Target: ATXN1; (+) strand; PAM type: NRG; PAM sequence: CAG
tacctatataaaactagggc

SEQ ID NO: 124365 - DNA, 20 bp, Artificial Sequence
  Description of Artificial Sequence: Synthetic oligonucleotide
  Target: ATXN1; (+) strand; PAM type: NRG; PAM sequence: AGG
acctatataaaactagggcc

SEQ ID NO: 124366 - DNA, 20 bp, Artificial Sequence
  Description of Artificial Sequence: Synthetic oligonucleotide
  Target: ATXN1; (+) strand; PAM type: NRG; PAM sequence: CAG
tataaaactagggccaggca

SEQ ID NO: 124367 - DNA, 20 bp, Artificial Sequence
  Description of Artificial Sequence: Synthetic oligonucleotide
  Target: ATXN1; (+) strand; PAM type: NRG; PAM sequence: TGG
aaaactagggccaggcacag

SEQ ID NO: 124368 - DNA, 20 bp, Artificial Sequence
  Description of Artificial Sequence: Synthetic oligonucleotide
  Target: ATXN1; (+) strand; PAM type: NRG; PAM sequence: TAG
caggcacagtggcttatacc

SEQ ID NO: 124369 - DNA, 20 bp, Artificial Sequence
  Description of Artificial Sequence: Synthetic oligonucleotide
  Target: ATXN1; (+) strand; PAM type: NRG; PAM sequence: TGG
gtggcttatacctagcactg

SEQ ID NO: 124370 - DNA, 20 bp, Artificial Sequence
  Description of Artificial Sequence: Synthetic oligonucleotide
  Target: ATXN1; (+) strand; PAM type: NRG; PAM sequence: GGG
tggcttatacctagcactgt

SEQ ID NO: 124371 - DNA, 20 bp, Artificial Sequence
  Description of Artificial Sequence: Synthetic oligonucleotide
  Target: ATXN1; (+) strand; PAM type: NRG; PAM sequence: GAG
gcttatacctagcactgtgg

SEQ ID NO: 124372 - DNA, 20 bp, Artificial Sequence
  Description of Artificial Sequence: Synthetic oligonucleotide
  Target: ATXN1; (+) strand; PAM type: NRG; PAM sequence: AGG
cttatacctagcactgtggg

SEQ ID NO: 124373 - DNA, 20 bp, Artificial Sequence
  Description of Artificial Sequence: Synthetic oligonucleotide
  Target: ATXN1; (+) strand; PAM type: NRG; PAM sequence: CAG
atacctagcactgtgggagg

SEQ ID NO: 124374 - DNA, 20 bp, Artificial Sequence
  Description of Artificial Sequence: Synthetic oligonucleotide
  Target: ATXN1; (+) strand; PAM type: NRG; PAM sequence: GAG
acctagcactgtgggaggca

SEQ ID NO: 124375 - DNA, 20 bp, Artificial Sequence
  Description of Artificial Sequence: Synthetic oligonucleotide
  Target: ATXN1; (+) strand; PAM type: NRG; PAM sequence: AGG
cctagcactgtgggaggcag

SEQ ID NO: 124376 - DNA, 20 bp, Artificial Sequence
  Description of Artificial Sequence: Synthetic oligonucleotide
  Target: ATXN1; (+) strand; PAM type: NRG; PAM sequence: TGG
agcactgtgggaggcagagg

SEQ ID NO: 124377 - DNA, 20 bp, Artificial Sequence
  Description of Artificial Sequence: Synthetic oligonucleotide
  Target: ATXN1; (+) strand; PAM type: NRG; PAM sequence: GGG
gcactgtgggaggcagaggt

SEQ ID NO: 124378 - DNA, 20 bp, Artificial Sequence
  Description of Artificial Sequence: Synthetic oligonucleotide
  Target: ATXN1; (+) strand; PAM type: NRG; PAM sequence: GAG
actgtgggaggcagaggtgg

SEQ ID NO: 124379 - DNA, 20 bp, Artificial Sequence
  Description of Artificial Sequence: Synthetic oligonucleotide
  Target: ATXN1; (+) strand; PAM type: NRG; PAM sequence: GAG
cagaggtgggagaatcactt

SEQ ID NO: 124380 - DNA, 20 bp, Artificial Sequence
  Description of Artificial Sequence: Synthetic oligonucleotide
  Target: ATXN1; (+) strand; PAM type: NRG; PAM sequence: CAG
gtgggagaatcacttgagtc

SEQ ID NO: 124381 - DNA, 20 bp, Artificial Sequence
  Description of Artificial Sequence: Synthetic oligonucleotide
  Target: ATXN1; (+) strand; PAM type: NRG; PAM sequence: AGG
tgggagaatcacttgagtcc

SEQ ID NO: 124382 - DNA, 20 bp, Artificial Sequence
  Description of Artificial Sequence: Synthetic oligonucleotide
  Target: ATXN1; (+) strand; PAM type: NRG; PAM sequence: GAG
ggagaatcacttgagtccag

SEQ ID NO: 124383 - DNA, 20 bp, Artificial Sequence
  Description of Artificial Sequence: Synthetic oligonucleotide
  Target: ATXN1; (+) strand; PAM type: NRG; PAM sequence: AAG
tcacttgagtccaggagttc

SEQ ID NO: 124384 - DNA, 20 bp, Artificial Sequence
  Description of Artificial Sequence: Synthetic oligonucleotide
  Target: ATXN1; (+) strand; PAM type: NRG; PAM sequence: CAG
tccaggagttcaagaccaac

SEQ ID NO: 124385 - DNA, 20 bp, Artificial Sequence
  Description of Artificial Sequence: Synthetic oligonucleotide
  Target: ATXN1; (+) strand; PAM type: NRG; PAM sequence: GAG
caggagttcaagaccaacca

SEQ ID NO: 124386 - DNA, 20 bp, Artificial Sequence
  Description of Artificial Sequence: Synthetic oligonucleotide
  Target: ATXN1; (+) strand; PAM type: NRG; PAM sequence: AGG
aggagttcaagaccaaccag

SEQ ID NO: 124387 - DNA, 20 bp, Artificial Sequence
  Description of Artificial Sequence: Synthetic oligonucleotide
  Target: ATXN1; (+) strand; PAM type: NRG; PAM sequence: GAG
gagttcaagaccaaccagag

SEQ ID NO: 124388 - DNA, 20 bp, Artificial Sequence
  Description of Artificial Sequence: Synthetic oligonucleotide
  Target: ATXN1; (+) strand; PAM type: NRG; PAM sequence: CAG
caagaccaaccagaggagca

SEQ ID NO: 124389 - DNA, 20 bp, Artificial Sequence
  Description of Artificial Sequence: Synthetic oligonucleotide
  Target: ATXN1; (+) strand; PAM type: NRG; PAM sequence: TAG
tctaccaaaaatacaaaaat

SEQ ID NO: 124390 - DNA, 20 bp, Artificial Sequence
  Description of Artificial Sequence: Synthetic oligonucleotide
  Target: ATXN1; (+) strand; PAM type: NRG; PAM sequence: TGG
ccaaaaatacaaaaattagc

SEQ ID NO: 124391 - DNA, 20 bp, Artificial Sequence
  Description of Artificial Sequence: Synthetic oligonucleotide
  Target: ATXN1; (+) strand; PAM type: NRG; PAM sequence: GGG
caaaaatacaaaaattagct

SEQ ID NO: 124392 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagctgggca

SEQ ID NO: 124393 - DNA, 20 bp, Artificial Sequence
  Description of Artificial Sequence: Synthetic oligonucleotide
  Target: ATXN1; (+) strand; PAM type: NRG; PAM sequence: TGG
caaaaattagctgggcatgg

SEQ ID NO: 124394 - DNA, 20 bp, Artificial Sequence
  Description of Artificial Sequence: Synthetic oligonucleotide
  Target: ATXN1; (+) strand; PAM type: NRG; PAM sequence: TAG
ggcatggtggcacacacctg

SEQ ID NO: 124395 - DNA, 20 bp, Artificial Sequence
  Description of Artificial Sequence: Synthetic oligonucleotide
  Target: ATXN1; (+) strand; PAM type: NRG; PAM sequence: AAG
tggcacacacctgtagtccc

SEQ ID NO: 124396 - DNA, 20 bp, Artificial Sequence
  Description of Artificial Sequence: Synthetic oligonucleotide
  Target: ATXN1; (+) strand; PAM type: NRG; PAM sequence: TGG
acctgtagtcccaagctact

SEQ ID NO: 124397 - DNA, 20 bp, Artificial Sequence
  Description of Artificial Sequence: Synthetic oligonucleotide
  Target: ATXN1; (+) strand; PAM type: NRG; PAM sequence: GGG
cctgtagtcccaagctactt

SEQ ID NO: 124398 - DNA, 20 bp, Artificial Sequence
  Description of Artificial Sequence: Synthetic oligonucleotide
  Target: ATXN1; (+) strand; PAM type: NRG; PAM sequence: GAG
tgtagtcccaagctacttgg

SEQ ID NO: 124399 - DNA, 20 bp, Artificial Sequence
  Description of Artificial Sequence: Synthetic oligonucleotide
  Target: ATXN1; (+) strand; PAM type: NRG; PAM sequence: AGG
gtagtcccaagctacttggg

SEQ ID NO: 124400 - DNA, 20 bp, Artificial Sequence
  Description of Artificial Sequence: Synthetic oligonucleotide
  Target: ATXN1; (+) strand; PAM type: NRG; PAM sequence: AAG
cccaagctacttgggaggct

SEQ ID NO: 124401 - DNA, 20 bp, Artificial Sequence
  Description of Artificial Sequence: Synthetic oligonucleotide
  Target: ATXN1; (+) strand; PAM type: NRG; PAM sequence: AGG
ccaagctacttgggaggcta

SEQ ID NO: 124402 - DNA, 20 bp, Artificial Sequence
  Description of Artificial Sequence: Synthetic oligonucleotide
  Target: ATXN1; (+) strand; PAM type: NRG; PAM sequence: TGG
agctacttgggaggctaagg

SEQ ID NO: 124403 - DNA, 20 bp, Artificial Sequence
  Description of Artificial Sequence: Synthetic oligonucleotide
  Target: ATXN1; (+) strand; PAM type: NRG; PAM sequence: GGG
gctacttgggaggctaaggt

SEQ ID NO: 124404 - DNA, 20 bp, Artificial Sequence
  Description of Artificial Sequence: Synthetic oligonucleotide
  Target: ATXN1; (+) strand; PAM type: NRG; PAM sequence: GAG
tacttgggaggctaaggtgg

SEQ ID NO: 124405 - DNA, 20 bp, Artificial Sequence
  Description of Artificial Sequence: Synthetic oligonucleotide
  Target: ATXN1; (+) strand; PAM type: NRG; PAM sequence: AGG
acttgggaggctaaggtggg

SEQ ID NO: 124406 - DNA, 20 bp, Artificial Sequence
  Description of Artificial Sequence: Synthetic oligonucleotide
  Target: ATXN1; (+) strand; PAM type: NRG; PAM sequence: CAG
tgggaggactgcttgaaccc

SEQ ID NO: 124407 - DNA, 20 bp, Artificial Sequence
  Description of Artificial Sequence: Synthetic oligonucleotide
  Target: ATXN1; (+) strand; PAM type: NRG; PAM sequence: AGG
gggaggactgcttgaacccc

SEQ ID NO: 124408 - DNA, 20 bp, Artificial Sequence
  Description of Artificial Sequence: Synthetic oligonucleotide
  Target: ATXN1; (+) strand; PAM type: NRG; PAM sequence: GAG
gaggactgcttgaaccccag

SEQ ID NO: 124409 - DNA, 20 bp, Artificial Sequence
  Description of Artificial Sequence: Synthetic oligonucleotide
  Target: ATXN1; (+) strand; PAM type: NRG; PAM sequence: AGG
aggactgcttgaaccccagg

SEQ ID NO: 124410 - DNA, 20 bp, Artificial Sequence
  Description of Artificial Sequence: Synthetic oligonucleotide
  Target: ATXN1; (+) strand; PAM type: NRG; PAM sequence: GAG
tgcttgaaccccaggaggtt

SEQ ID NO: 124411 - DNA, 20 bp, Artificial Sequence
  Description of Artificial Sequence: Synthetic oligonucleotide
  Target: ATXN1; (+) strand; PAM type: NRG; PAM sequence: AGG
gcttgaaccccaggaggttg

SEQ ID NO: 124412 - DNA, 20 bp, Artificial Sequence
  Description of Artificial Sequence: Synthetic oligonucleotide
  Target: ATXN1; (+) strand; PAM type: NRG; PAM sequence: GAG
caggaggttgaggctgcaat

SEQ ID NO: 124413 - DNA, 20 bp, Artificial Sequence
  Description of Artificial Sequence: Synthetic oligonucleotide
  Target: ATXN1; (+) strand; PAM type: NRG; PAM sequence: GAG
ttgaggctgcaatgagctgt

SEQ ID NO: 124414 - DNA, 20 bp, Artificial Sequence
  Description of Artificial Sequence: Synthetic oligonucleotide
  Target: ATXN1; (+) strand; PAM type: NRG; PAM sequence: CAG
gtgagtgcaccactgcactc

SEQ ID NO: 124415 - DNA, 20 bp, Artificial Sequence
  Description of Artificial Sequence: Synthetic oligonucleotide
  Target: ATXN1; (+) strand; PAM type: NRG; PAM sequence: TGG
tgcaccactgcactccagcc

SEQ ID NO: 124416 - DNA, 20 bp, Artificial Sequence
  Description of Artificial Sequence: Synthetic oligonucleotide
  Target: ATXN1; (+) strand; PAM type: NRG; PAM sequence: GGG
gcaccactgcactccagcct

SEQ ID NO: 124417 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggtga

SEQ ID NO: 124418 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggtgaca

SEQ ID NO: 124419 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggtgacagagt

SEQ ID NO: 124420 - DNA, 20 bp, Artificial Sequence
  Description of Artificial Sequence: Synthetic oligonucleotide
  Target: ATXN1; (+) strand; PAM type: NRG; PAM sequence: AGG
ccagcctgggtgacagagtg

SEQ ID NO: 124421 - DNA, 20 bp, Artificial Sequence
  Description of Artificial Sequence: Synthetic oligonucleotide
  Target: ATXN1; (+) strand; PAM type: NRG; PAM sequence: TAG
ctcataaataaataaataaa

SEQ ID NO: 124422 - DNA, 20 bp, Artificial Sequence
  Description of Artificial Sequence: Synthetic oligonucleotide
  Target: ATXN1; (+) strand; PAM type: NRG; PAM sequence: CAG
aataaatagaaataaaaata

SEQ ID NO: 124423 - DNA, 20 bp, Artificial Sequence
  Description of Artificial Sequence: Synthetic oligonucleotide
  Target: ATXN1; (+) strand; PAM type: NRG; PAM sequence: AAG
atagaaataaaaatacagta

SEQ ID NO: 124424 - DNA, 20 bp, Artificial Sequence
  Description of Artificial Sequence: Synthetic oligonucleotide
  Target: ATXN1; (+) strand; PAM type: NRG; PAM sequence: AGG
tagaaataaaaatacagtaa

SEQ ID NO: 124425 - DNA, 20 bp, Artificial Sequence
  Description of Artificial Sequence: Synthetic oligonucleotide
  Target: ATXN1; (+) strand; PAM type: NRG; PAM sequence: CAG
aaaaatacagtaaaggtata

SEQ ID NO: 124426 - DNA, 20 bp, Artificial Sequence
  Description of Artificial Sequence: Synthetic oligonucleotide
  Target: ATXN1; (+) strand; PAM type: NRG; PAM sequence: AAG
atacagtaaaggtatacaga

SEQ ID NO: 124427 - DNA, 20 bp, Artificial Sequence
  Description of Artificial Sequence: Synthetic oligonucleotide
  Target: ATXN1; (+) strand; PAM type: NRG; PAM sequence: CAG
cagtaaaggtatacagaaag

SEQ ID NO: 124428 - DNA, 20 bp, Artificial Sequence
  Description of Artificial Sequence: Synthetic oligonucleotide
  Target: ATXN1; (+) strand; PAM type: NRG; PAM sequence: AAG
taaaggtatacagaaagcag

SEQ ID NO: 124429 - DNA, 20 bp, Artificial Sequence
  Description of Artificial Sequence: Synthetic oligonucleotide
  Target: ATXN1; (+) strand; PAM type: NRG; PAM sequence: AGG
aaaggtatacagaaagcaga

SEQ ID NO: 124430 - DNA, 20 bp, Artificial Sequence
  Description of Artificial Sequence: Synthetic oligonucleotide
  Target: ATXN1; (+) strand; PAM type: NRG; PAM sequence: GAG
gttaattttaccaaccttct

SEQ ID NO: 124431 - DNA, 20 bp, Artificial Sequence
  Description of Artificial Sequence: Synthetic oligonucleotide
  Target: ATXN1; (+) strand; PAM type: NRG; PAM sequence: AGG
ttaattttaccaaccttctg

SEQ ID NO: 124432 - DNA, 20 bp, Artificial Sequence
  Description of Artificial Sequence: Synthetic oligonucleotide
  Target: ATXN1; (+) strand; PAM type: NRG; PAM sequence: GGG
taattttaccaaccttctga

SEQ ID NO: 124433 - DNA, 20 bp, Artificial Sequence
  Description of Artificial Sequence: Synthetic oligonucleotide
  Target: ATXN1; (+) strand; PAM type: NRG; PAM sequence: GAG
attttaccaaccttctgagg

SEQ ID NO: 124434 - DNA, 20 bp, Artificial Sequence
  Description of Artificial Sequence: Synthetic oligonucleotide
  Target: ATXN1; (+) strand; PAM type: NRG; PAM sequence: AGG
ttttaccaaccttctgaggg

SEQ ID NO: 124435 - DNA, 20 bp, Artificial Sequence
  Description of Artificial Sequence: Synthetic oligonucleotide
  Target: ATXN1; (+) strand; PAM type: NRG; PAM sequence: AAG
taccaaccttctgagggagg

SEQ ID NO: 124436 - DNA, 20 bp, Artificial Sequence
  Description of Artificial Sequence: Synthetic oligonucleotide
  Target: ATXN1; (+) strand; PAM type: NRG; PAM sequence: TGG
gaggaagacaaatgtcacct

SEQ ID NO: 124437 - DNA, 20 bp, Artificial Sequence
  Description of Artificial Sequence: Synthetic oligonucleotide
  Target: ATXN1; (+) strand; PAM type: NRG; PAM sequence: TAG
tgtcaccttggccaaccaaa

SEQ ID NO: 124438 - DNA, 20 bp, Artificial Sequence
  Description of Artificial Sequence: Synthetic oligonucleotide
  Target: ATXN1; (+) strand; PAM type: NRG; PAM sequence: TGG
cttggccaaccaaatagatc

SEQ ID NO: 124439 - DNA, 20 bp, Artificial Sequence
  Description of Artificial Sequence: Synthetic oligonucleotide
  Target: ATXN1; (+) strand; PAM type: NRG; PAM sequence: GGG
ttggccaaccaaatagatct

SEQ ID NO: 124440 - DNA, 20 bp, Artificial Sequence
  Description of Artificial Sequence: Synthetic oligonucleotide
  Target: ATXN1; (+) strand; PAM type: NRG; PAM sequence: AAG
gccaaccaaatagatctggg

SEQ ID NO: 124441 - DNA, 20 bp, Artificial Sequence
  Description of Artificial Sequence: Synthetic oligonucleotide
  Target: ATXN1; (+) strand; PAM type: NRG; PAM sequence: AAG
gaagattttgtctttttata

SEQ ID NO: 124442 - DNA, 20 bp, Artificial Sequence
  Description of Artificial Sequence: Synthetic oligonucleotide
  Target: ATXN1; (+) strand; PAM type: NRG; PAM sequence: AAG
tttataaagcttgtctattt

SEQ ID NO: 124443 - DNA, 20 bp, Artificial Sequence
  Description of Artificial Sequence: Synthetic oligonucleotide
  Target: ATXN1; (+) strand; PAM type: NRG; PAM sequence: AGG
ttataaagcttgtctattta

SEQ ID NO: 124444 - DNA, 20 bp, Artificial Sequence
  Description of Artificial Sequence: Synthetic oligonucleotide
  Target: ATXN1; (+) strand; PAM type: NRG; PAM sequence: GGG
tataaagcttgtctatttaa

SEQ ID NO: 124445 - DNA, 20 bp, Artificial Sequence
  Description of Artificial Sequence: Synthetic oligonucleotide
  Target: ATXN1; (+) strand; PAM type: NRG; PAM sequence: TGG
aaagcttgtctatttaaggg

SEQ ID NO: 124446 - DNA, 20 bp, Artificial Sequence
  Description of Artificial Sequence: Synthetic oligonucleotide
  Target: ATXN1; (+) strand; PAM type: NRG; PAM sequence: GGG
aagcttgtctatttaagggt

SEQ ID NO: 124447 - DNA, 20 bp, Artificial Sequence
  Description of Artificial Sequence: Synthetic oligonucleotide
  Target: ATXN1; (+) strand; PAM type: NRG; PAM sequence: AAG
cttgtctatttaagggtggg

SEQ ID NO: 124448 - DNA, 20 bp, Artificial Sequence
  Description of Artificial Sequence: Synthetic oligonucleotide
  Target: ATXN1; (+) strand; PAM type: NRG; PAM sequence: CAG
tctatttaagggtgggaagt

SEQ ID NO: 124449 - DNA, 20 bp, Artificial Sequence
  Description of Artificial Sequence: Synthetic oligonucleotide
  Target: ATXN1; (+) strand; PAM type: NRG; PAM sequence: CAG
atttaagggtgggaagtcag

SEQ ID NO: 124450 - DNA, 20 bp, Artificial Sequence
  Description of Artificial Sequence: Synthetic oligonucleotide
  Target: ATXN1; (+) strand; PAM type: NRG; PAM sequence: TAG
gcagaaaaactgcttgccaa

SEQ ID NO: 124451 - DNA, 20 bp, Artificial Sequence
  Description of Artificial Sequence: Synthetic oligonucleotide
  Target: ATXN1; (+) strand; PAM type: NRG; PAM sequence: CGG
ttctcccactttaatgaaat

SEQ ID NO: 124452 - DNA, 20 bp, Artificial Sequence
  Description of Artificial Sequence: Synthetic oligonucleotide
  Target: ATXN1; (+) strand; PAM type: NRG; PAM sequence: TGG
cccactttaatgaaatcggt

SEQ ID NO: 124453 - DNA, 20 bp, Artificial Sequence
  Description of Artificial Sequence: Synthetic oligonucleotide
  Target: ATXN1; (+) strand; PAM type: NRG; PAM sequence: AAG
ctgtgaaaatatgtgcatca

SEQ ID NO: 124454 - DNA, 20 bp, Artificial Sequence
  Description of Artificial Sequence: Synthetic oligonucleotide
  Target: ATXN1; (+) strand; PAM type: NRG; PAM sequence: AAG
atatgtgcatcaaagtttta

SEQ ID NO: 124455 - DNA, 20 bp, Artificial Sequence
  Description of Artificial Sequence: Synthetic oligonucleotide
  Target: ATXN1; (+) strand; PAM type: NRG; PAM sequence: GAG
atgtgcatcaaagttttaaa

SEQ ID NO: 124456 - DNA, 20 bp, Artificial Sequence
  Description of Artificial Sequence: Synthetic oligonucleotide
  Target: ATXN1; (+) strand; PAM type: NRG; PAM sequence: CAG
aaagagttttctgtcacatc

SEQ ID NO: 124457 - DNA, 20 bp, Artificial Sequence
  Description of Artificial Sequence: Synthetic oligonucleotide
  Target: ATXN1; (+) strand; PAM type: NRG; PAM sequence: TAG
gagttttctgtcacatccag

SEQ ID NO: 124458 - DNA, 20 bp, Artificial Sequence
  Description of Artificial Sequence: Synthetic oligonucleotide
  Target: ATXN1; (+) strand; PAM type: NRG; PAM sequence: CAG
catccagtagacttataata

SEQ ID NO: 124459 - DNA, 20 bp, Artificial Sequence
  Description of Artificial Sequence: Synthetic oligonucleotide
  Target: ATXN1; (+) strand; PAM type: NRG; PAM sequence: CAG
acttataatacagattgcta

SEQ ID NO: 124460 - DNA, 20 bp, Artificial Sequence
  Description of Artificial Sequence: Synthetic oligonucleotide
  Target: ATXN1; (+) strand; PAM type: NRG; PAM sequence: TGG
ataatacagattgctacaga

SEQ ID NO: 124461 - DNA, 20 bp, Artificial Sequence
  Description of Artificial Sequence: Synthetic oligonucleotide
  Target: ATXN1; (+) strand; PAM type: NRG; PAM sequence: AAG
atacagattgctacagatgg

SEQ ID NO: 124462 - DNA, 20 bp, Artificial Sequence
  Description of Artificial Sequence: Synthetic oligonucleotide
  Target: ATXN1; (+) strand; PAM type: NRG; PAM sequence: TAG
agatttatcctcacttgatg

SEQ ID NO: 124463 - DNA, 20 bp, Artificial Sequence
  Description of Artificial Sequence: Synthetic oligonucleotide
  Target: ATXN1; (+) strand; PAM type: NRG; PAM sequence: CAG
atcctcacttgatgtagcaa

SEQ ID NO: 124464 - DNA, 20 bp, Artificial Sequence
  Description of Artificial Sequence: Synthetic oligonucleotide
  Target: ATXN1; (+) strand; PAM type: NRG; PAM sequence: AAG
acgttctttgaactgtaaca

SEQ ID NO: 124465 - DNA, 20 bp, Artificial Sequence
  Description of Artificial Sequence: Synthetic oligonucleotide
  Target: ATXN1; (+) strand; PAM type: NRG; PAM sequence: TGG
ttgattttttttttcccacg

SEQ ID NO: 124466 - DNA, 20 bp, Artificial Sequence
  Description of Artificial Sequence: Synthetic oligonucleotide
  Target: ATXN1; (+) strand; PAM type: NRG; PAM sequence: TAG
attttttttttcccacgtgg

SEQ ID NO: 124467 - DNA, 20 bp, Artificial Sequence
  Description of Artificial Sequence: Synthetic oligonucleotide
  Target: ATXN1; (+) strand; PAM type: NRG; PAM sequence: TAG
cccacgtggtagatgaatct

SEQ ID NO: 124468 - DNA, 20 bp, Artificial Sequence
  Description of Artificial Sequence: Synthetic oligonucleotide
  Target: ATXN1; (+) strand; PAM type: NRG; PAM sequence: AAG
cgtggtagatgaatcttagt

SEQ ID NO: 124469 - DNA, 20 bp, Artificial Sequence
  Description of Artificial Sequence: Synthetic oligonucleotide
  Target: ATXN1; (+) strand; PAM type: NRG; PAM sequence: CAG
tgaatcttagtaagaaaata

SEQ ID NO: 124470 - DNA, 20 bp, Artificial Sequence
  Description of Artificial Sequence: Synthetic oligonucleotide
  Target: ATXN1; (+) strand; PAM type: NRG; PAM sequence: AAG
acacatactcaactactgta

SEQ ID NO: 124471 - DNA, 20 bp, Artificial Sequence
  Description of Artificial Sequence: Synthetic oligonucleotide
  Target: ATXN1; (+) strand; PAM type: NRG; PAM sequence: TGG
catactcaactactgtaaag

SEQ ID NO: 124472 - DNA, 20 bp, Artificial Sequence
  Description of Artificial Sequence: Synthetic oligonucleotide
  Target: ATXN1; (+) strand; PAM type: NRG; PAM sequence: GGG
atactcaactactgtaaagt

SEQ ID NO: 124473 - DNA, 20 bp, Artificial Sequence
  Description of Artificial Sequence: Synthetic oligonucleotide
  Target: ATXN1; (+) strand; PAM type: NRG; PAM sequence: TAG
tgtaaagtgggtgcttaatt

SEQ ID NO: 124474 - DNA, 20 bp, Artificial Sequence
  Description of Artificial Sequence: Synthetic oligonucleotide
  Target: ATXN1; (+) strand; PAM type: NRG; PAM sequence: TAG
aagtgggtgcttaatttagt

SEQ ID NO: 124475 - DNA, 20 bp, Artificial Sequence
  Description of Artificial Sequence: Synthetic oligonucleotide
  Target: ATXN1; (+) strand; PAM type: NRG; PAM sequence: AGG
agtgggtgcttaatttagtt

SEQ ID NO: 124476 - DNA, 20 bp, Artificial Sequence
  Description of Artificial Sequence: Synthetic oligonucleotide
  Target: ATXN1; (+) strand; PAM type: NRG; PAM sequence: GGG
gtgggtgcttaatttagtta

SEQ ID NO: 124477 - DNA, 20 bp, Artificial Sequence
  Description of Artificial Sequence: Synthetic oligonucleotide
  Target: ATXN1; (+) strand; PAM type: NRG; PAM sequence: GAG
gggtgcttaatttagttagg

SEQ ID NO: 124478 - DNA, 20 bp, Artificial Sequence
  Description of Artificial Sequence: Synthetic oligonucleotide
  Target: ATXN1; (+) strand; PAM type: NRG; PAM sequence: GAG
gtgcttaatttagttaggga

SEQ ID NO: 124479 - DNA, 20 bp, Artificial Sequence
  Description of Artificial Sequence: Synthetic oligonucleotide
  Target: ATXN1; (+) strand; PAM type: NRG; PAM sequence: AGG
tgcttaatttagttagggag

SEQ ID NO: 124480 - DNA, 20 bp, Artificial Sequence
  Description of Artificial Sequence: Synthetic oligonucleotide
  Target: ATXN1; (+) strand; PAM type: NRG; PAM sequence: AAG
ttaatttagttagggagagg

SEQ ID NO: 124481 - DNA, 20 bp, Artificial Sequence
  Description of Artificial Sequence: Synthetic oligonucleotide
  Target: ATXN1; (+) strand; PAM type: NRG; PAM sequence: AGG
taatttagttagggagagga

SEQ ID NO: 124482 - DNA, 20 bp, Artificial Sequence
  Description of Artificial Sequence: Synthetic oligonucleotide
  Target: ATXN1; (+) strand; PAM type: NRG; PAM sequence: GGG
aatttagttagggagaggaa

SEQ ID NO: 124483 - DNA, 20 bp, Artificial Sequence
  Description of Artificial Sequence: Synthetic oligonucleotide
  Target: ATXN1; (+) strand; PAM type: NRG; PAM sequence: GGG
atttagttagggagaggaag

SEQ ID NO: 124484 - DNA, 20 bp, Artificial Sequence
  Description of Artificial Sequence: Synthetic oligonucleotide
  Target: ATXN1; (+) strand; PAM type: NRG; PAM sequence: TGG
tagttagggagaggaagggg

SEQ ID NO: 124485 - DNA, 20 bp, Artificial Sequence
  Description of Artificial Sequence: Synthetic oligonucleotide
  Target: ATXN1; (+) strand; PAM type: NRG; PAM sequence: AAG
ttagggagaggaaggggtgg

SEQ ID NO: 124486 - DNA, 20 bp, Artificial Sequence
  Description of Artificial Sequence: Synthetic oligonucleotide
  Target: ATXN1; (+) strand; PAM type: NRG; PAM sequence: TGG
ggagaggaaggggtggaagc

SEQ ID NO: 124487 - DNA, 20 bp, Artificial Sequence
  Description of Artificial Sequence: Synthetic oligonucleotide
  Target: ATXN1; (+) strand; PAM type: NRG; PAM sequence: GGG
gagaggaaggggtggaagct

SEQ ID NO: 124488 - DNA, 20 bp, Artificial Sequence
  Description of Artificial Sequence: Synthetic oligonucleotide
  Target: ATXN1; (+) strand; PAM type: NRG; PAM sequence: GGG
agaggaaggggtggaagctg

SEQ ID NO: 124489 - DNA, 20 bp, Artificial Sequence
  Description of Artificial Sequence: Synthetic oligonucleotide
  Target: ATXN1; (+) strand; PAM type: NRG; PAM sequence: AAG
gaaggggtggaagctgggga

SEQ ID NO: 124490 - DNA, 20 bp, Artificial Sequence
  Description of Artificial Sequence: Synthetic oligonucleotide
  Target: ATXN1; (+) strand; PAM type: NRG; PAM sequence: TAG
aagctggggaaagtcctgct

SEQ ID NO: 124491 - DNA, 20 bp, Artificial Sequence
  Description of Artificial Sequence: Synthetic oligonucleotide
  Target: ATXN1; (+) strand; PAM type: NRG; PAM sequence: GAG
gctggggaaagtcctgctta

SEQ ID NO: 124492 - DNA, 20 bp, Artificial Sequence
  Description of Artificial Sequence: Synthetic oligonucleotide
  Target: ATXN1; (+) strand; PAM type: NRG; PAM sequence: AGG
ctggggaaagtcctgcttag

SEQ ID NO: 124493 - DNA, 20 bp, Artificial Sequence
  Description of Artificial Sequence: Synthetic oligonucleotide
  Target: ATXN1; (+) strand; PAM type: NRG; PAM sequence: GGG
tggggaaagtcctgcttaga

SEQ ID NO: 124494 - DNA, 20 bp, Artificial Sequence
  Description of Artificial Sequence: Synthetic oligonucleotide
  Target: ATXN1; (+) strand; PAM type: NRG; PAM sequence: TAG
ctgcttagagggcacctcac

SEQ ID NO: 124495 - DNA, 20 bp, Artificial Sequence
  Description of Artificial Sequence: Synthetic oligonucleotide
  Target: ATXN1; (+) strand; PAM type: NRG; PAM sequence: TAG
gagggcacctcactagccac

SEQ ID NO: 124496 - DNA, 20 bp, Artificial Sequence
  Description of Artificial Sequence: Synthetic oligonucleotide
  Target: ATXN1; (+) strand; PAM type: NRG; PAM sequence: GAG
gggcacctcactagccacta

SEQ ID NO: 124497 - DNA, 20 bp, Artificial Sequence
  Description of Artificial Sequence: Synthetic oligonucleotide
  Target: ATXN1; (+) strand; PAM type: NRG; PAM sequence: AGG
ggcacctcactagccactag

SEQ ID NO: 124498 - DNA, 20 bp, Artificial Sequence
  Description of Artificial Sequence: Synthetic oligonucleotide
  Target: ATXN1; (+) strand; PAM type: NRG; PAM sequence: GGG
gcacctcactagccactaga

SEQ ID NO: 124499 - DNA, 20 bp, Artificial Sequence
  Description of Artificial Sequence: Synthetic oligonucleotide
  Target: ATXN1; (+) strand; PAM type: NRG; PAM sequence: CAG
aataaaatcatcctgatttc

SEQ ID NO: 124500 - DNA, 20 bp, Artificial Sequence
  Description of Artificial Sequence: Synthetic oligonucleotide
  Target: ATXN1; (+) strand; PAM type: NRG; PAM sequence: AGG
ataaaatcatcctgatttcc

SEQ ID NO: 124501 - DNA, 20 bp, Artificial Sequence
  Description of Artificial Sequence: Synthetic oligonucleotide
  Target: ATXN1; (+) strand; PAM type: NRG; PAM sequence: CAG
cctgatttccaggattcaaa

SEQ ID NO: 124502 - DNA, 20 bp, Artificial Sequence
  Description of Artificial Sequence: Synthetic oligonucleotide
  Target: ATXN1; (+) strand; PAM type: NRG; PAM sequence: CAG
gatttccaggattcaaacag

SEQ ID NO: 124503 - DNA, 20 bp, Artificial Sequence
  Description of Artificial Sequence: Synthetic oligonucleotide
  Target: ATXN1; (+) strand; PAM type: NRG; PAM sequence: TGG
caaacagcagacaccatgca

SEQ ID NO: 124504 - DNA, 20 bp, Artificial Sequence
  Description of Artificial Sequence: Synthetic oligonucleotide
  Target: ATXN1; (+) strand; PAM type: NRG; PAM sequence: GGG
aaacagcagacaccatgcat

SEQ ID NO: 124505 - DNA, 20 bp, Artificial Sequence
  Description of Artificial Sequence: Synthetic oligonucleotide
  Target: ATXN1; (+) strand; PAM type: NRG; PAM sequence: TGG
acaccatgcatgggaattaa

SEQ ID NO: 124506 - DNA, 20 bp, Artificial Sequence
  Description of Artificial Sequence: Synthetic oligonucleotide
  Target: ATXN1; (+) strand; PAM type: NRG; PAM sequence: GGG
caccatgcatgggaattaat

SEQ ID NO: 124507 - DNA, 20 bp, Artificial Sequence
  Description of Artificial Sequence: Synthetic oligonucleotide
  Target: ATXN1; (+) strand; PAM type: NRG; PAM sequence: GGG
accatgcatgggaattaatg

SEQ ID NO: 124508 - DNA, 20 bp, Artificial Sequence
  Description of Artificial Sequence: Synthetic oligonucleotide
  Target: ATXN1; (+) strand; PAM type: NRG; PAM sequence: CAG
cctttccctttataaatgtc

SEQ ID NO: 124509 - DNA, 20 bp, Artificial Sequence
  Description of Artificial Sequence: Synthetic oligonucleotide
  Target: ATXN1; (+) strand; PAM type: NRG; PAM sequence: GAG
tttccctttataaatgtcca

SEQ ID NO: 124510 - DNA, 20 bp, Artificial Sequence
  Description of Artificial Sequence: Synthetic oligonucleotide
  Target: ATXN1; (+) strand; PAM type: NRG; PAM sequence: GAG
tccctttataaatgtccaga

SEQ ID NO: 124511 - DNA, 20 bp, Artificial Sequence
  Description of Artificial Sequence: Synthetic oligonucleotide
  Target: ATXN1; (+) strand; PAM type: NRG; PAM sequence: AAG
ccagagagctaacaactgca

SEQ ID NO: 124512 - DNA, 20 bp, Artificial Sequence
  Description of Artificial Sequence: Synthetic oligonucleotide
  Target: ATXN1; (+) strand; PAM type: NRG; PAM sequence: TGG
agctaacaactgcaaagatg

SEQ ID NO: 124513 - DNA, 20 bp, Artificial Sequence
  Description of Artificial Sequence: Synthetic oligonucleotide
  Target: ATXN1; (+) strand; PAM type: NRG; PAM sequence: AAG
taacaactgcaaagatgtgg

SEQ ID NO: 124514 - DNA, 20 bp, Artificial Sequence
  Description of Artificial Sequence: Synthetic oligonucleotide
  Target: ATXN1; (+) strand; PAM type: NRG; PAM sequence: TAG
ctttttatgttttaacacaa

SEQ ID NO: 124515 - DNA, 20 bp, Artificial Sequence
  Description of Artificial Sequence: Synthetic oligonucleotide
  Target: ATXN1; (+) strand; PAM type: NRG; PAM sequence: AAG
ttttaacacaatagacattt

SEQ ID NO: 124516 - DNA, 20 bp, Artificial Sequence
  Description of Artificial Sequence: Synthetic oligonucleotide
  Target: ATXN1; (+) strand; PAM type: NRG; PAM sequence: AGG
tttaacacaatagacattta

SEQ ID NO: 124517 - DNA, 20 bp, Artificial Sequence
  Description of Artificial Sequence: Synthetic oligonucleotide
  Target: ATXN1; (+) strand; PAM type: NRG; PAM sequence: GGG
ttaacacaatagacatttaa

SEQ ID NO: 124518 - DNA, 20 bp, Artificial Sequence
  Description of Artificial Sequence: Synthetic oligonucleotide
  Target: ATXN1; (+) strand; PAM type: NRG; PAM sequence: GAG
acatttaagggaataaactt

SEQ ID NO: 124519 - DNA, 20 bp, Artificial Sequence
  Description of Artificial Sequence: Synthetic oligonucleotide
  Target: ATXN1; (+) strand; PAM type: NRG; PAM sequence: TAG
ggaataaacttgagccatgc

SEQ ID NO: 124520 - DNA, 20 bp, Artificial Sequence
  Description of Artificial Sequence: Synthetic oligonucleotide
  Target: ATXN1; (+) strand; PAM type: NRG; PAM sequence: CAG
aacttgagccatgctagctc

SEQ ID NO: 124521 - DNA, 20 bp, Artificial Sequence
  Description of Artificial Sequence: Synthetic oligonucleotide
  Target: ATXN1; (+) strand; PAM type: NRG; PAM sequence: AGG
acttgagccatgctagctcc

SEQ ID NO: 124522 - DNA, 20 bp, Artificial Sequence
  Description of Artificial Sequence: Synthetic oligonucleotide
  Target: ATXN1; (+) strand; PAM type: NRG; PAM sequence: TAG
agccatgctagctccaggac

SEQ ID NO: 124523 - DNA, 20 bp, Artificial Sequence
  Description of Artificial Sequence: Synthetic oligonucleotide
  Target: ATXN1; (+) strand; PAM type: NRG; PAM sequence: AGG
gccatgctagctccaggact

SEQ ID NO: 124524 - DNA, 20 bp, Artificial Sequence
  Description of Artificial Sequence: Synthetic oligonucleotide
  Target: ATXN1; (+) strand; PAM type: NRG; PAM sequence: CAG
ggattgacatatgtttcctt

SEQ ID NO: 124525 - DNA, 20 bp, Artificial Sequence
  Description of Artificial Sequence: Synthetic oligonucleotide
  Target: ATXN1; (+) strand; PAM type: NRG; PAM sequence: AGG
gattgacatatgtttccttc

SEQ ID NO: 124526 - DNA, 20 bp, Artificial Sequence
  Description of Artificial Sequence: Synthetic oligonucleotide
  Target: ATXN1; (+) strand; PAM type: NRG; PAM sequence: GGG
attgacatatgtttccttca

SEQ ID NO: 124527 - DNA, 20 bp, Artificial Sequence
  Description of Artificial Sequence: Synthetic oligonucleotide
  Target: ATXN1; (+) strand; PAM type: NRG; PAM sequence: CAG
ggtgcccgatttccattctt

SEQ ID NO: 124528 - DNA, 20 bp, Artificial Sequence
  Description of Artificial Sequence: Synthetic oligonucleotide
  Target: ATXN1; (+) strand; PAM type: NRG; PAM sequence: AAG
gcccgatttccattcttcag

SEQ ID NO: 124529 - DNA, 20 bp, Artificial Sequence
  Description of Artificial Sequence: Synthetic oligonucleotide
  Target: ATXN1; (+) strand; PAM type: NRG; PAM sequence: CAG
gtccacaaccttctgaataa

SEQ ID NO: 124530 - DNA, 20 bp, Artificial Sequence
  Description of Artificial Sequence: Synthetic oligonucleotide
  Target: ATXN1; (+) strand; PAM type: NRG; PAM sequence: GAG
ccacaaccttctgaataaca

SEQ ID NO: 124531 - DNA, 20 bp, Artificial Sequence
  Description of Artificial Sequence: Synthetic oligonucleotide
  Target: ATXN1; (+) strand; PAM type: NRG; PAM sequence: AGG
cacaaccttctgaataacag

SEQ ID NO: 124532 - DNA, 20 bp, Artificial Sequence
  Description of Artificial Sequence: Synthetic oligonucleotide
  Target: ATXN1; (+) strand; PAM type: NRG; PAM sequence: CAG
aacagaggtcttttctccct

SEQ ID NO: 124533 - DNA, 20 bp, Artificial Sequence
  Description of Artificial Sequence: Synthetic oligonucleotide
  Target: ATXN1; (+) strand; PAM type: NRG; PAM sequence: TAG
tttctccctcagaatcaacc

SEQ ID NO: 124534 - DNA, 20 bp, Artificial Sequence
  Description of Artificial Sequence: Synthetic oligonucleotide
  Target: ATXN1; (+) strand; PAM type: NRG; PAM sequence: AAG
ctcagaatcaacctagcaac

SEQ ID NO: 124535 - DNA, 20 bp, Artificial Sequence
  Description of Artificial Sequence: Synthetic oligonucleotide
  Target: ATXN1; (+) strand; PAM type: NRG; PAM sequence: TAG
acttctcatacctgtaatcc

SEQ ID NO: 124536 - DNA, 20 bp, Artificial Sequence
  Description of Artificial Sequence: Synthetic oligonucleotide
  Target: ATXN1; (+) strand; PAM type: NRG; PAM sequence: TGG
tacctgtaatcctagcactt

SEQ ID NO: 124537 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcctagcacttt

SEQ ID NO: 124538 - DNA, 20 bp, Artificial Sequence
  Description of Artificial Sequence: Synthetic oligonucleotide
  Target: ATXN1; (+) strand; PAM type: NRG; PAM sequence: AAG
tgtaatcctagcactttggg

SEQ ID NO: 124539 - DNA, 20 bp, Artificial Sequence
  Description of Artificial Sequence: Synthetic oligonucleotide
  Target: ATXN1; (+) strand; PAM type: NRG; PAM sequence: AAG
cctagcactttgggaagcca

SEQ ID NO: 124540 - DNA, 20 bp, Artificial Sequence
  Description of Artificial Sequence: Synthetic oligonucleotide
  Target: ATXN1; (+) strand; PAM type: NRG; PAM sequence: GAG
gcactttgggaagccaaagt

SEQ ID NO: 124541 - DNA, 20 bp, Artificial Sequence
  Description of Artificial Sequence: Synthetic oligonucleotide
  Target: ATXN1; (+) strand; PAM type: NRG; PAM sequence: GAG
actttgggaagccaaagtga

SEQ ID NO: 124542 - DNA, 20 bp, Artificial Sequence
  Description of Artificial Sequence: Synthetic oligonucleotide
  Target: ATXN1; (+) strand; PAM type: NRG; PAM sequence: AGG
ctttgggaagccaaagtgag

SEQ ID NO: 124543 - DNA, 20 bp, Artificial Sequence
  Description of Artificial Sequence: Synthetic oligonucleotide
  Target: ATXN1; (+) strand; PAM type: NRG; PAM sequence: GAG
ccaaagtgagaggattgctt

SEQ ID NO: 124544 - DNA, 20 bp, Artificial Sequence
  Description of Artificial Sequence: Synthetic oligonucleotide
  Target: ATXN1; (+) strand; PAM type: NRG; PAM sequence: CAG
gtgagaggattgcttgagcc

SEQ ID NO: 124545 - DNA, 20 bp, Artificial Sequence
  Description of Artificial Sequence: Synthetic oligonucleotide
  Target: ATXN1; (+) strand; PAM type: NRG; PAM sequence: AGG
tgagaggattgcttgagccc

SEQ ID NO: 124546 - DNA, 20 bp, Artificial Sequence
  Description of Artificial Sequence: Synthetic oligonucleotide
  Target: ATXN1; (+) strand; PAM type: NRG; PAM sequence: AAG
ttgcttgagcccaggaattc

SEQ ID NO: 124547 - DNA, 20 bp, Artificial Sequence
  Description of Artificial Sequence: Synthetic oligonucleotide
  Target: ATXN1; (+) strand; PAM type: NRG; PAM sequence: CAG
tgagcccaggaattcaagac

SEQ ID NO: 124548 - DNA, 20 bp, Artificial Sequence
  Description of Artificial Sequence: Synthetic oligonucleotide
  Target: ATXN1; (+) strand; PAM type: NRG; PAM sequence: CAG
aaaacttccaaaaacttctc

SEQ ID NO: 124549 - DNA, 20 bp, Artificial Sequence
  Description of Artificial Sequence: Synthetic oligonucleotide
  Target: ATXN1; (+) strand; PAM type: NRG; PAM sequence: AAG
agcctgcttgctaaaaattc

SEQ ID NO: 124550 - DNA, 20 bp, Artificial Sequence
  Description of Artificial Sequence: Synthetic oligonucleotide
  Target: ATXN1; (+) strand; PAM type: NRG; PAM sequence: TAG
ttgctaaaaattcaagttga

SEQ ID NO: 124551 - DNA, 20 bp, Artificial Sequence
  Description of Artificial Sequence: Synthetic oligonucleotide
  Target: ATXN1; (+) strand; PAM type: NRG; PAM sequence: AAG
tgatagtccacccattgcaa

SEQ ID NO: 124552 - DNA, 20 bp, Artificial Sequence
  Description of Artificial Sequence: Synthetic oligonucleotide
  Target: ATXN1; (+) strand; PAM type: NRG; PAM sequence: AGG
gatagtccacccattgcaaa

SEQ ID NO: 124553 - DNA, 20 bp, Artificial Sequence
  Description of Artificial Sequence: Synthetic oligonucleotide
  Target: ATXN1; (+) strand; PAM type: NRG; PAM sequence: CAG
ttgcaaaaggatatttcctt

SEQ ID NO: 124554 - DNA, 20 bp, Artificial Sequence
  Description of Artificial Sequence: Synthetic oligonucleotide
  Target: ATXN1; (+) strand; PAM type: NRG; PAM sequence: AGG
tgcaaaaggatatttccttc

SEQ ID NO: 124555 - DNA, 20 bp, Artificial Sequence
  Description of Artificial Sequence: Synthetic oligonucleotide
  Target: ATXN1; (+) strand; PAM type: NRG; PAM sequence: AAG
aaaaggatatttccttcagg

SEQ ID NO: 124556 - DNA, 20 bp, Artificial Sequence
  Description of Artificial Sequence: Synthetic oligonucleotide
  Target: ATXN1; (+) strand; PAM type: NRG; PAM sequence: CAG
aggatatttccttcaggaag

SEQ ID NO: 124557 - DNA, 20 bp, Artificial Sequence
  Description of Artificial Sequence: Synthetic oligonucleotide
  Target: ATXN1; (+) strand; PAM type: NRG; PAM sequence: AGG
ggatatttccttcaggaagc

SEQ ID NO: 124558 - DNA, 20 bp, Artificial Sequence
  Description of Artificial Sequence: Synthetic oligonucleotide
  Target: ATXN1; (+) strand; PAM type: NRG; PAM sequence: GAG
atatttccttcaggaagcag

SEQ ID NO: 124559 - DNA, 20 bp, Artificial Sequence
  Description of Artificial Sequence: Synthetic oligonucleotide
  Target: ATXN1; (+) strand; PAM type: NRG; PAM sequence: AGG
tatttccttcaggaagcagg

SEQ ID NO: 124560 - DNA, 20 bp, Artificial Sequence
  Description of Artificial Sequence: Synthetic oligonucleotide
  Target: ATXN1; (+) strand; PAM type: NRG; PAM sequence: AAG
ttccttcaggaagcaggagg

SEQ ID NO: 124561 - DNA, 20 bp, Artificial Sequence
  Description of Artificial Sequence: Synthetic oligonucleotide
  Target: ATXN1; (+) strand; PAM type: NRG; PAM sequence: AAG
tcaggaagcaggaggaagat

SEQ ID NO: 124562 - DNA, 20 bp, Artificial Sequence
  Description of Artificial Sequence: Synthetic oligonucleotide
  Target: ATXN1; (+) strand; PAM type: NRG; PAM sequence: GAG
gaagcaggaggaagataagc

SEQ ID NO: 124563 - DNA, 20 bp, Artificial Sequence
  Description of Artificial Sequence: Synthetic oligonucleotide
  Target: ATXN1; (+) strand; PAM type: NRG; PAM sequence: AGG
aagcaggaggaagataagcg

SEQ ID NO: 124564 - DNA, 20 bp, Artificial Sequence
  Description of Artificial Sequence: Synthetic oligonucleotide
  Target: ATXN1; (+) strand; PAM type: NRG; PAM sequence: TGG
aggaggaagataagcgaggc

SEQ ID NO: 124565 - DNA, 20 bp, Artificial Sequence
  Description of Artificial Sequence: Synthetic oligonucleotide
  Target: ATXN1; (+) strand; PAM type: NRG; PAM sequence: GGG
ggaggaagataagcgaggct

SEQ ID NO: 124566 - DNA, 20 bp, Artificial Sequence
  Description of Artificial Sequence: Synthetic oligonucleotide
  Target: ATXN1; (+) strand; PAM type: NRG; PAM sequence: GGG
gaggaagataagcgaggctg

SEQ ID NO: 124567 - DNA, 20 bp, Artificial Sequence
  Description of Artificial Sequence: Synthetic oligonucleotide
  Target: ATXN1; (+) strand; PAM type: NRG; PAM sequence: AAG
gaagataagcgaggctgggg

SEQ ID NO: 124568 - DNA, 20 bp, Artificial Sequence
  Description of Artificial Sequence: Synthetic oligonucleotide
  Target: ATXN1; (+) strand; PAM type: NRG; PAM sequence: AAG
agcgaggctggggaagactg

SEQ ID NO: 124569 - DNA, 20 bp, Artificial Sequence
  Description of Artificial Sequence: Synthetic oligonucleotide
  Target: ATXN1; (+) strand; PAM type: NRG; PAM sequence: CAG
ctggggaagactgaagacaa

SEQ ID NO: 124570 - DNA, 20 bp, Artificial Sequence
  Description of Artificial Sequence: Synthetic oligonucleotide
  Target: ATXN1; (+) strand; PAM type: NRG; PAM sequence: CAG
agactgaagacaacagtcct

SEQ ID NO: 124571 - DNA, 20 bp, Artificial Sequence
  Description of Artificial Sequence: Synthetic oligonucleotide
  Target: ATXN1; (+) strand; PAM type: NRG; PAM sequence: GAG
agacaacagtcctcagttct

SEQ ID NO: 124572 - DNA, 20 bp, Artificial Sequence
  Description of Artificial Sequence: Synthetic oligonucleotide
  Target: ATXN1; (+) strand; PAM type: NRG; PAM sequence: AGG
gacaacagtcctcagttctg

SEQ ID NO: 124573 - DNA, 20 bp, Artificial Sequence
  Description of Artificial Sequence: Synthetic oligonucleotide
  Target: ATXN1; (+) strand; PAM type: NRG; PAM sequence: GAG
caacagtcctcagttctgag

SEQ ID NO: 124574 - DNA, 20 bp, Artificial Sequence
  Description of Artificial Sequence: Synthetic oligonucleotide
  Target: ATXN1; (+) strand; PAM type: NRG; PAM sequence: GAG
tcctcagttctgaggagaat

SEQ ID NO: 124575 - DNA, 20 bp, Artificial Sequence
  Description of Artificial Sequence: Synthetic oligonucleotide
  Target: ATXN1; (+) strand; PAM type: NRG; PAM sequence: CGG
tcagttctgaggagaatgag

SEQ ID NO: 124576 - DNA, 20 bp, Artificial Sequence
  Description of Artificial Sequence: Synthetic oligonucleotide
  Target: ATXN1; (+) strand; PAM type: NRG; PAM sequence: GGG
cagttctgaggagaatgagc

SEQ ID NO: 124577 - DNA, 20 bp, Artificial Sequence
  Description of Artificial Sequence: Synthetic oligonucleotide
  Target: ATXN1; (+) strand; PAM type: NRG; PAM sequence: AAG
ttctgaggagaatgagcggg

SEQ ID NO: 124578 - DNA, 20 bp, Artificial Sequence
  Description of Artificial Sequence: Synthetic oligonucleotide
  Target: ATXN1; (+) strand; PAM type: NRG; PAM sequence: TGG
aatgagcgggaagtgattga

SEQ ID NO: 124579 - DNA, 20 bp, Artificial Sequence
  Description of Artificial Sequence: Synthetic oligonucleotide
  Target: ATXN1; (+) strand; PAM type: NRG; PAM sequence: CAG
agcgggaagtgattgatggt

SEQ ID NO: 124580 - DNA, 20 bp, Artificial Sequence
  Description of Artificial Sequence: Synthetic oligonucleotide
  Target: ATXN1; (+) strand; PAM type: NRG; PAM sequence: CAG
aagtgattgatggtcagtcc

SEQ ID NO: 124581 - DNA, 20 bp, Artificial Sequence
  Description of Artificial Sequence: Synthetic oligonucleotide
  Target: ATXN1; (+) strand; PAM type: NRG; PAM sequence: AGG
agtgattgatggtcagtccc

SEQ ID NO: 124582 - DNA, 20 bp, Artificial Sequence
  Description of Artificial Sequence: Synthetic oligonucleotide
  Target: ATXN1; (+) strand; PAM type: NRG; PAM sequence: TAG
cccaggccaccgccctgcct

SEQ ID NO: 124583 - DNA, 20 bp, Artificial Sequence
  Description of Artificial Sequence: Synthetic oligonucleotide
  Target: ATXN1; (+) strand; PAM type: NRG; PAM sequence: TGG
aggccaccgccctgccttag

SEQ ID NO: 124584 - DNA, 20 bp, Artificial Sequence
  Description of Artificial Sequence: Synthetic oligonucleotide
  Target: ATXN1; (+) strand; PAM type: NRG; PAM sequence: GGG
ggccaccgccctgccttagt

SEQ ID NO: 124585 - DNA, 20 bp, Artificial Sequence
  Description of Artificial Sequence: Synthetic oligonucleotide
  Target: ATXN1; (+) strand; PAM type: NRG; PAM sequence: GAG
ttagtgggtgtctttgccac

SEQ ID NO: 124586 - DNA, 20 bp, Artificial Sequence
  Description of Artificial Sequence: Synthetic oligonucleotide
  Target: ATXN1; (+) strand; PAM type: NRG; PAM sequence: AGG
tagtgggtgtctttgccacg

SEQ ID NO: 124587 - DNA, 20 bp, Artificial Sequence
  Description of Artificial Sequence: Synthetic oligonucleotide
  Target: ATXN1; (+) strand; PAM type: NRG; PAM sequence: TGG
tgggtgtctttgccacgagg

SEQ ID NO: 124588 - DNA, 20 bp, Artificial Sequence
  Description of Artificial Sequence: Synthetic oligonucleotide
  Target: ATXN1; (+) strand; PAM type: NRG; PAM sequence: CAG
tttgccacgaggtggccttc

SEQ ID NO: 124589 - DNA, 20 bp, Artificial Sequence
  Description of Artificial Sequence: Synthetic oligonucleotide
  Target: ATXN1; (+) strand; PAM type: NRG; PAM sequence: AGG
ttgccacgaggtggccttcc

SEQ ID NO: 124590 - DNA, 20 bp, Artificial Sequence
  Description of Artificial Sequence: Synthetic oligonucleotide
  Target: ATXN1; (+) strand; PAM type: NRG; PAM sequence: TAG
ccacgaggtggccttccagg

SEQ ID NO: 124591 - DNA, 20 bp, Artificial Sequence
  Description of Artificial Sequence: Synthetic oligonucleotide
  Target: ATXN1; (+) strand; PAM type: NRG; PAM sequence: TGG
aggtggccttccaggtagct

SEQ ID NO: 124592 - DNA, 20 bp, Artificial Sequence
  Description of Artificial Sequence: Synthetic oligonucleotide
  Target: ATXN1; (+) strand; PAM type: NRG; PAM sequence: AAG
cttggcttccttctgcacct

SEQ ID NO: 124593 - DNA, 20 bp, Artificial Sequence
  Description of Artificial Sequence: Synthetic oligonucleotide
  Target: ATXN1; (+) strand; PAM type: NRG; PAM sequence: TGG
ttctgcacctaagcttataa

SEQ ID NO: 124594 - DNA, 20 bp, Artificial Sequence
  Description of Artificial Sequence: Synthetic oligonucleotide
  Target: ATXN1; (+) strand; PAM type: NRG; PAM sequence: AAG
gcacctaagcttataatggc

SEQ ID NO: 124595 - DNA, 20 bp, Artificial Sequence
  Description of Artificial Sequence: Synthetic oligonucleotide
  Target: ATXN1; (+) strand; PAM type: NRG; PAM sequence: CAG
caagactaaccttgcctctc

SEQ ID NO: 124596 - DNA, 20 bp, Artificial Sequence
  Description of Artificial Sequence: Synthetic oligonucleotide
  Target: ATXN1; (+) strand; PAM type: NRG; PAM sequence: CGG
cccccatctttctcctcaaa

SEQ ID NO: 124597 - DNA, 20 bp, Artificial Sequence
  Description of Artificial Sequence: Synthetic oligonucleotide
  Target: ATXN1; (+) strand; PAM type: NRG; PAM sequence: TGG
ctaatctttgtacatactca

SEQ ID NO: 124598 - DNA, 20 bp, Artificial Sequence
  Description of Artificial Sequence: Synthetic oligonucleotide
  Target: ATXN1; (+) strand; PAM type: NRG; PAM sequence: GGG
taatctttgtacatactcat

SEQ ID NO: 124599 - DNA, 20 bp, Artificial Sequence
  Description of Artificial Sequence: Synthetic oligonucleotide
  Target: ATXN1; (+) strand; PAM type: NRG; PAM sequence: CAG
atactcatgggttcaattac

SEQ ID NO: 124600 - DNA, 20 bp, Artificial Sequence
  Description of Artificial Sequence: Synthetic oligonucleotide
  Target: ATXN1; (+) strand; PAM type: NRG; PAM sequence: AGG
tactcatgggttcaattacc

SEQ ID NO: 124601 - DNA, 20 bp, Artificial Sequence
  Description of Artificial Sequence: Synthetic oligonucleotide
  Target: ATXN1; (+) strand; PAM type: NRG; PAM sequence: CAG
tcatgggttcaattaccagg

SEQ ID NO: 124602 - DNA, 20 bp, Artificial Sequence
  Description of Artificial Sequence: Synthetic oligonucleotide
  Target: ATXN1; (+) strand; PAM type: NRG; PAM sequence: AGG
catgggttcaattaccaggc

SEQ ID NO: 124603 - DNA, 20 bp, Artificial Sequence
  Description of Artificial Sequence: Synthetic oligonucleotide
  Target: ATXN1; (+) strand; PAM type: NRG; PAM sequence: GAG
attaccaggcaggatgccct

SEQ ID NO: 124604 - DNA, 20 bp, Artificial Sequence
  Description of Artificial Sequence: Synthetic oligonucleotide
  Target: ATXN1; (+) strand; PAM type: NRG; PAM sequence: AGG
ttaccaggcaggatgccctg

SEQ ID NO: 124605 - DNA, 20 bp, Artificial Sequence
  Description of Artificial Sequence: Synthetic oligonucleotide
  Target: ATXN1; (+) strand; PAM type: NRG; PAM sequence: CAG
ccaggcaggatgccctgagg

SEQ ID NO: 124606 - DNA, 20 bp, Artificial Sequence
  Description of Artificial Sequence: Synthetic oligonucleotide
  Target: ATXN1; (+) strand; PAM type: NRG; PAM sequence: CAG
gcaggatgccctgaggcagc

SEQ ID NO: 124607 - DNA, 20 bp, Artificial Sequence
  Description of Artificial Sequence: Synthetic oligonucleotide
  Target: ATXN1; (+) strand; PAM type: NRG; PAM sequence: AGG
caggatgccctgaggcagcc

SEQ ID NO: 124608 - DNA, 20 bp, Artificial Sequence
  Description of Artificial Sequence: Synthetic oligonucleotide
  Target: ATXN1; (+) strand; PAM type: NRG; PAM sequence: TAG
gccctgaggcagccaggtgt

SEQ ID NO: 124609 - DNA, 20 bp, Artificial Sequence
  Description of Artificial Sequence: Synthetic oligonucleotide
  Target: ATXN1; (+) strand; PAM type: NRG; PAM sequence: TGG
tgaggcagccaggtgttagt

SEQ ID NO: 124610 - DNA, 20 bp, Artificial Sequence
  Description of Artificial Sequence: Synthetic oligonucleotide
  Target: ATXN1; (+) strand; PAM type: NRG; PAM sequence: CAG
agccaggtgttagttggcaa

SEQ ID NO: 124611 - DNA, 20 bp, Artificial Sequence
  Description of Artificial Sequence: Synthetic oligonucleotide
  Target: ATXN1; (+) strand; PAM type: NRG; PAM sequence: AAG
agttggcaacagaacacaca

SEQ ID NO: 124612 - DNA, 20 bp, Artificial Sequence
  Description of Artificial Sequence: Synthetic oligonucleotide
  Target: ATXN1; (+) strand; PAM type: NRG; PAM sequence: AGG
gttggcaacagaacacacaa

SEQ ID NO: 124613 - DNA, 20 bp, Artificial Sequence
  Description of Artificial Sequence: Synthetic oligonucleotide
  Target: ATXN1; (+) strand; PAM type: NRG; PAM sequence: CAG
aaggcctccccgcctccatt

SEQ ID NO: 124614 - DNA, 20 bp, Artificial Sequence
  Description of Artificial Sequence: Synthetic oligonucleotide
  Target: ATXN1; (+) strand; PAM type: NRG; PAM sequence: CAG
tccccgcctccattcagcgt

SEQ ID NO: 124615 - DNA, 20 bp, Artificial Sequence
  Description of Artificial Sequence: Synthetic oligonucleotide
  Target: ATXN1; (+) strand; PAM type: NRG; PAM sequence: AGG
ccccgcctccattcagcgtc

SEQ ID NO: 124616 - DNA, 20 bp, Artificial Sequence
  Description of Artificial Sequence: Synthetic oligonucleotide
  Target: ATXN1; (+) strand; PAM type: NRG; PAM sequence: GGG
cccgcctccattcagcgtca

SEQ ID NO: 124617 - DNA, 20 bp, Artificial Sequence
  Description of Artificial Sequence: Synthetic oligonucleotide
  Target: ATXN1; (+) strand; PAM type: NRG; PAM sequence: AAG
cattcagcgtcagggtgata

SEQ ID NO: 124618 - DNA, 20 bp, Artificial Sequence
  Description of Artificial Sequence: Synthetic oligonucleotide
  Target: ATXN1; (+) strand; PAM type: NRG; PAM sequence: AAG
taaagatatcattaccctca

SEQ ID NO: 124619 - DNA, 20 bp, Artificial Sequence
  Description of Artificial Sequence: Synthetic oligonucleotide
  Target: ATXN1; (+) strand; PAM type: NRG; PAM sequence: CAG
gatatcattaccctcaaagc

SEQ ID NO: 124620 - DNA, 20 bp, Artificial Sequence
  Description of Artificial Sequence: Synthetic oligonucleotide
  Target: ATXN1; (+) strand; PAM type: NRG; PAM sequence: CAG
taccctcaaagccagctcct

SEQ ID NO: 124621 - DNA, 20 bp, Artificial Sequence
  Description of Artificial Sequence: Synthetic oligonucleotide
  Target: ATXN1; (+) strand; PAM type: NRG; PAM sequence: AAG
cctcaaagccagctcctcag

SEQ ID NO: 124622 - DNA, 20 bp, Artificial Sequence
  Description of Artificial Sequence: Synthetic oligonucleotide
  Target: ATXN1; (+) strand; PAM type: NRG; PAM sequence: CGG
cctcagaagttctgccacca

SEQ ID NO: 124623 - DNA, 20 bp, Artificial Sequence
  Description of Artificial Sequence: Synthetic oligonucleotide
  Target: ATXN1; (+) strand; PAM type: NRG; PAM sequence: CAG
cagaagttctgccaccacgg

SEQ ID NO: 124624 - DNA, 20 bp, Artificial Sequence
  Description of Artificial Sequence: Synthetic oligonucleotide
  Target: ATXN1; (+) strand; PAM type: NRG; PAM sequence: AAG
tgccaccacggcagatatga

SEQ ID NO: 124625 - DNA, 20 bp, Artificial Sequence
  Description of Artificial Sequence: Synthetic oligonucleotide
  Target: ATXN1; (+) strand; PAM type: NRG; PAM sequence: AGG
gccaccacggcagatatgaa

SEQ ID NO: 124626 - DNA, 20 bp, Artificial Sequence
  Description of Artificial Sequence: Synthetic oligonucleotide
  Target: ATXN1; (+) strand; PAM type: NRG; PAM sequence: TAG
atatgaaaggctttaccaca

SEQ ID NO: 124627 - DNA, 20 bp, Artificial Sequence
  Description of Artificial Sequence: Synthetic oligonucleotide
  Target: ATXN1; (+) strand; PAM type: NRG; PAM sequence: CAG
taccacatagttttcataca

SEQ ID NO: 124628 - DNA, 20 bp, Artificial Sequence
  Description of Artificial Sequence: Synthetic oligonucleotide
  Target: ATXN1; (+) strand; PAM type: NRG; PAM sequence: CAG
catacacagttcttcttcct

SEQ ID NO: 124629 - DNA, 20 bp, Artificial Sequence
  Description of Artificial Sequence: Synthetic oligonucleotide
  Target: ATXN1; (+) strand; PAM type: NRG; PAM sequence: AAG
cacagttcttcttcctcaga

SEQ ID NO: 124630 - DNA, 20 bp, Artificial Sequence
  Description of Artificial Sequence: Synthetic oligonucleotide
  Target: ATXN1; (+) strand; PAM type: NRG; PAM sequence: GAG
tcagaaagcaccatttgttt

SEQ ID NO: 124631 - DNA, 20 bp, Artificial Sequence
  Description of Artificial Sequence: Synthetic oligonucleotide
  Target: ATXN1; (+) strand; PAM type: NRG; PAM sequence: CAG
gtatccgtaaataactccta

SEQ ID NO: 124632 - DNA, 20 bp, Artificial Sequence
  Description of Artificial Sequence: Synthetic oligonucleotide
  Target: ATXN1; (+) strand; PAM type: NRG; PAM sequence: AAG
tccgtaaataactcctacag

SEQ ID NO: 124633 - DNA, 20 bp, Artificial Sequence
  Description of Artificial Sequence: Synthetic oligonucleotide
  Target: ATXN1; (+) strand; PAM type: NRG; PAM sequence: TGG
cacaatttgctctaatgttt

SEQ ID NO: 124634 - DNA, 20 bp, Artificial Sequence
  Description of Artificial Sequence: Synthetic oligonucleotide
  Target: ATXN1; (+) strand; PAM type: NRG; PAM sequence: GAG
caatttgctctaatgttttg

SEQ ID NO: 124635 - DNA, 20 bp, Artificial Sequence
  Description of Artificial Sequence: Synthetic oligonucleotide
  Target: ATXN1; (+) strand; PAM type: NRG; PAM sequence: TGG
gctctaatgttttggagcta

SEQ ID NO: 124636 - DNA, 20 bp, Artificial Sequence
  Description of Artificial Sequence: Synthetic oligonucleotide
  Target: ATXN1; (+) strand; PAM type: NRG; PAM sequence: CAG
tatggaatttattatgatca

SEQ ID NO: 124637 - DNA, 20 bp, Artificial Sequence
  Description of Artificial Sequence: Synthetic oligonucleotide
  Target: ATXN1; (+) strand; PAM type: NRG; PAM sequence: CAG
atttattatgatcacagaac

SEQ ID NO: 124638 - DNA, 20 bp, Artificial Sequence
  Description of Artificial Sequence: Synthetic oligonucleotide
  Target: ATXN1; (+) strand; PAM type: NRG; PAM sequence: AGG
tttattatgatcacagaacc

SEQ ID NO: 124639 - DNA, 20 bp, Artificial Sequence
  Description of Artificial Sequence: Synthetic oligonucleotide
  Target: ATXN1; (+) strand; PAM type: NRG; PAM sequence: TAG
atgatcacagaaccaggaaa

SEQ ID NO: 124640 - DNA, 20 bp, Artificial Sequence
  Description of Artificial Sequence: Synthetic oligonucleotide
  Target: ATXN1; (+) strand; PAM type: NRG; PAM sequence: CAG
gaaatagctgaatgtgaaaa

SEQ ID NO: 124641 - DNA, 20 bp, Artificial Sequence
  Description of Artificial Sequence: Synthetic oligonucleotide
  Target: ATXN1; (+) strand; PAM type: NRG; PAM sequence: AGG
aaatagctgaatgtgaaaac

SEQ ID NO: 124642 - DNA, 20 bp, Artificial Sequence
  Description of Artificial Sequence: Synthetic oligonucleotide
  Target: ATXN1; (+) strand; PAM type: NRG; PAM sequence: CAG
gaacatctcaaatcacccct

SEQ ID NO: 124643 - DNA, 20 bp, Artificial Sequence
  Description of Artificial Sequence: Synthetic oligonucleotide
  Target: ATXN1; (+) strand; PAM type: NRG; PAM sequence: AAG
tcaaatcacccctcagctct

SEQ ID NO: 124644 - DNA, 20 bp, Artificial Sequence
  Description of Artificial Sequence: Synthetic oligonucleotide
  Target: ATXN1; (+) strand; PAM type: NRG; PAM sequence: AAG
aatcacccctcagctctaag

SEQ ID NO: 124645 - DNA, 20 bp, Artificial Sequence
  Description of Artificial Sequence: Synthetic oligonucleotide
  Target: ATXN1; (+) strand; PAM type: NRG; PAM sequence: GAG
tcacccctcagctctaagaa

SEQ ID NO: 124646 - DNA, 20 bp, Artificial Sequence
  Description of Artificial Sequence: Synthetic oligonucleotide
  Target: ATXN1; (+) strand; PAM type: NRG; PAM sequence: AAG
agtaacgcatttcaaattaa

SEQ ID NO: 124647 - DNA, 20 bp, Artificial Sequence
  Description of Artificial Sequence: Synthetic oligonucleotide
  Target: ATXN1; (+) strand; PAM type: NRG; PAM sequence: AAG
cgcatttcaaattaaaagca

SEQ ID NO: 124648 - DNA, 20 bp, Artificial Sequence
  Description of Artificial Sequence: Synthetic oligonucleotide
  Target: ATXN1; (+) strand; PAM type: NRG; PAM sequence: GAG
gtttactgttctctctcaat

SEQ ID NO: 124649 - DNA, 20 bp, Artificial Sequence
  Description of Artificial Sequence: Synthetic oligonucleotide
  Target: ATXN1; (+) strand; PAM type: NRG; PAM sequence: AGG
tttactgttctctctcaatg

SEQ ID NO: 124650 - DNA, 20 bp, Artificial Sequence
  Description of Artificial Sequence: Synthetic oligonucleotide
  Target: ATXN1; (+) strand; PAM type: NRG; PAM sequence: GGG
ttactgttctctctcaatga

SEQ ID NO: 124651 - DNA, 20 bp, Artificial Sequence
  Description of Artificial Sequence: Synthetic oligonucleotide
  Target: ATXN1; (+) strand; PAM type: NRG; PAM sequence: GGG
tactgttctctctcaatgag

SEQ ID NO: 124652 - DNA, 20 bp, Artificial Sequence
  Description of Artificial Sequence: Synthetic oligonucleotide
  Target: ATXN1; (+) strand; PAM type: NRG; PAM sequence: CAG
caatgaggggcctgcactcc

SEQ ID NO: 124653 - DNA, 20 bp, Artificial Sequence
  Description of Artificial Sequence: Synthetic oligonucleotide
  Target: ATXN1; (+) strand; PAM type: NRG; PAM sequence: AGG
aatgaggggcctgcactccc

SEQ ID NO: 124654 - DNA, 20 bp, Artificial Sequence
  Description of Artificial Sequence: Synthetic oligonucleotide
  Target: ATXN1; (+) strand; PAM type: NRG; PAM sequence: CAG
aggggcctgcactcccagga

SEQ ID NO: 124655 - DNA, 20 bp, Artificial Sequence
  Description of Artificial Sequence: Synthetic oligonucleotide
  Target: ATXN1; (+) strand; PAM type: NRG; PAM sequence: CAG
ctgcactcccaggacagtgt

SEQ ID NO: 124656 - DNA, 20 bp, Artificial Sequence
  Description of Artificial Sequence: Synthetic oligonucleotide
  Target: ATXN1; (+) strand; PAM type: NRG; PAM sequence: TAG
caggacagtgtcagcatact

SEQ ID NO: 124657 - DNA, 20 bp, Artificial Sequence
  Description of Artificial Sequence: Synthetic oligonucleotide
  Target: ATXN1; (+) strand; PAM type: NRG; PAM sequence: CAG
caaatactaaataaaaacaa

SEQ ID NO: 124658 - DNA, 20 bp, Artificial Sequence
  Description of Artificial Sequence: Synthetic oligonucleotide
  Target: ATXN1; (+) strand; PAM type: NRG; PAM sequence: AAG
ataaaaacaacagcatctcc

SEQ ID NO: 124659 - DNA, 20 bp, Artificial Sequence
  Description of Artificial Sequence: Synthetic oligonucleotide
  Target: ATXN1; (+) strand; PAM type: NRG; PAM sequence: AAG
caacagcatctccaagttct

SEQ ID NO: 124660 - DNA, 20 bp, Artificial Sequence
  Description of Artificial Sequence: Synthetic oligonucleotide
  Target: ATXN1; (+) strand; PAM type: NRG; PAM sequence: AAG
caagttctaagcatttataa

SEQ ID NO: 124661 - DNA, 20 bp, Artificial Sequence
  Description of Artificial Sequence: Synthetic oligonucleotide
  Target: ATXN1; (+) strand; PAM type: NRG; PAM sequence: AGG
aagttctaagcatttataaa

SEQ ID NO: 124662 - DNA, 20 bp, Artificial Sequence
  Description of Artificial Sequence: Synthetic oligonucleotide
  Target: ATXN1; (+) strand; PAM type: NRG; PAM sequence: AAG
ataaaaggtattctctttta

SEQ ID NO: 124663 - DNA, 20 bp, Artificial Sequence
  Description of Artificial Sequence: Synthetic oligonucleotide
  Target: ATXN1; (+) strand; PAM type: NRG; PAM sequence: AAG
ggtattctcttttaaagata

SEQ ID NO: 124664 - DNA, 20 bp, Artificial Sequence
  Description of Artificial Sequence: Synthetic oligonucleotide
  Target: ATXN1; (+) strand; PAM type: NRG; PAM sequence: AAG
tctcttttaaagataaagac

SEQ ID NO: 124665 - DNA, 20 bp, Artificial Sequence
  Description of Artificial Sequence: Synthetic oligonucleotide
  Target: ATXN1; (+) strand; PAM type: NRG; PAM sequence: TAG
tttaaagataaagacaagtt

SEQ ID NO: 124666 - DNA, 20 bp, Artificial Sequence
  Description of Artificial Sequence: Synthetic oligonucleotide
  Target: ATXN1; (+) strand; PAM type: NRG; PAM sequence: AAG
aaagataaagacaagtttag

SEQ ID NO: 124667 - DNA, 20 bp, Artificial Sequence
  Description of Artificial Sequence: Synthetic oligonucleotide
  Target: ATXN1; (+) strand; PAM type: NRG; PAM sequence: AGG
aagataaagacaagtttaga

SEQ ID NO: 124668 - DNA, 20 bp, Artificial Sequence
  Description of Artificial Sequence: Synthetic oligonucleotide
  Target: ATXN1; (+) strand; PAM type: NRG; PAM sequence: CAG
ataaagacaagtttagaagg

SEQ ID NO: 124669 - DNA, 20 bp, Artificial Sequence
  Description of Artificial Sequence: Synthetic oligonucleotide
  Target: ATXN1; (+) strand; PAM type: NRG; PAM sequence: AGG
taaagacaagtttagaaggc

SEQ ID NO: 124670 - DNA, 20 bp, Artificial Sequence
  Description of Artificial Sequence: Synthetic oligonucleotide
  Target: ATXN1; (+) strand; PAM type: NRG; PAM sequence: CGG
gcccctttttttgtcgcaat

SEQ ID NO: 124671 - DNA, 20 bp, Artificial Sequence
  Description of Artificial Sequence: Synthetic oligonucleotide
  Target: ATXN1; (+) strand; PAM type: NRG; PAM sequence: AAG
ttttgtcgcaatcggttaaa

SEQ ID NO: 124672 - DNA, 20 bp, Artificial Sequence
  Description of Artificial Sequence: Synthetic oligonucleotide
  Target: ATXN1; (+) strand; PAM type: NRG; PAM sequence: AAG
tcgcaatcggttaaaaagtg

SEQ ID NO: 124673 - DNA, 20 bp, Artificial Sequence
  Description of Artificial Sequence: Synthetic oligonucleotide
  Target: ATXN1; (+) strand; PAM type: NRG; PAM sequence: GAG
gcaatcggttaaaaagtgaa

SEQ ID NO: 124674 - DNA, 20 bp, Artificial Sequence
  Description of Artificial Sequence: Synthetic oligonucleotide
  Target: ATXN1; (+) strand; PAM type: NRG; PAM sequence: TAG
ggttaaaaagtgaagagaaa

SEQ ID NO: 124675 - DNA, 20 bp, Artificial Sequence
  Description of Artificial Sequence: Synthetic oligonucleotide
  Target: ATXN1; (+) strand; PAM type: NRG; PAM sequence: TGG
aaaagtgaagagaaatagaa

SEQ ID NO: 124676 - DNA, 20 bp, Artificial Sequence
  Description of Artificial Sequence: Synthetic oligonucleotide
  Target: ATXN1; (+) strand; PAM type: NRG; PAM sequence: GGG
aaagtgaagagaaatagaat

SEQ ID NO: 124677 - DNA, 20 bp, Artificial Sequence
  Description of Artificial Sequence: Synthetic oligonucleotide
  Target: ATXN1; (+) strand; PAM type: NRG; PAM sequence: TAG
aatgggctgaacaaaatata

SEQ ID NO: 124678 - DNA, 20 bp, Artificial Sequence
  Description of Artificial Sequence: Synthetic oligonucleotide
  Target: ATXN1; (+) strand; PAM type: NRG; PAM sequence: CAG
gggctgaacaaaatatatag

SEQ ID NO: 124679 - DNA, 20 bp, Artificial Sequence
  Description of Artificial Sequence: Synthetic oligonucleotide
  Target: ATXN1; (+) strand; PAM type: NRG; PAM sequence: AGG
ggctgaacaaaatatatagc

SEQ ID NO: 124680 - DNA, 20 bp, Artificial Sequence
  Description of Artificial Sequence: Synthetic oligonucleotide
  Target: ATXN1; (+) strand; PAM type: NRG; PAM sequence: TGG
aaaatatatagcaggctctg

SEQ ID NO: 124681 - DNA, 20 bp, Artificial Sequence
  Description of Artificial Sequence: Synthetic oligonucleotide
  Target: ATXN1; (+) strand; PAM type: NRG; PAM sequence: AAG
ctgtggtctgctttttctaa

SEQ ID NO: 124682 - DNA, 20 bp, Artificial Sequence
  Description of Artificial Sequence: Synthetic oligonucleotide
  Target: ATXN1; (+) strand; PAM type: NRG; PAM sequence: CAG
ttttctaaaagttctgccca

SEQ ID NO: 124683 - DNA, 20 bp, Artificial Sequence
  Description of Artificial Sequence: Synthetic oligonucleotide
  Target: ATXN1; (+) strand; PAM type: NRG; PAM sequence: CAG
aagttctgcccacagatttt

SEQ ID NO: 124684 - DNA, 20 bp, Artificial Sequence
  Description of Artificial Sequence: Synthetic oligonucleotide
  Target: ATXN1; (+) strand; PAM type: NRG; PAM sequence: CAG
cacagattttcagacaccaa

SEQ ID NO: 124685 - DNA, 20 bp, Artificial Sequence
  Description of Artificial Sequence: Synthetic oligonucleotide
  Target: ATXN1; (+) strand; PAM type: NRG; PAM sequence: CAG
cagacaccaacagcaacaaa

SEQ ID NO: 124686 - DNA, 20 bp, Artificial Sequence
  Description of Artificial Sequence: Synthetic oligonucleotide
  Target: ATXN1; (+) strand; PAM type: NRG; PAM sequence: AAG
agtcattccctccctcctgc

SEQ ID NO: 124687 - DNA, 20 bp, Artificial Sequence
  Description of Artificial Sequence: Synthetic oligonucleotide
  Target: ATXN1; (+) strand; PAM type: NRG; PAM sequence: GAG
attccctccctcctgcaagt

SEQ ID NO: 124688 - DNA, 20 bp, Artificial Sequence
  Description of Artificial Sequence: Synthetic oligonucleotide
  Target: ATXN1; (+) strand; PAM type: NRG; PAM sequence: AGG
ttccctccctcctgcaagtg

SEQ ID NO: 124689 - DNA, 20 bp, Artificial Sequence
  Description of Artificial Sequence: Synthetic oligonucleotide
  Target: ATXN1; (+) strand; PAM type: NRG; PAM sequence: GGG
tccctccctcctgcaagtga

SEQ ID NO: 124690 - DNA, 20 bp, Artificial Sequence
  Description of Artificial Sequence: Synthetic oligonucleotide
  Target: ATXN1; (+) strand; PAM type: NRG; PAM sequence: CAG
cctcctgcaagtgagggtga

SEQ ID NO: 124691 - DNA, 20 bp, Artificial Sequence
  Description of Artificial Sequence: Synthetic oligonucleotide
  Target: ATXN1; (+) strand; PAM type: NRG; PAM sequence: CAG
gtgagggtgacagccaatgc

SEQ ID NO: 124692 - DNA, 20 bp, Artificial Sequence
  Description of Artificial Sequence: Synthetic oligonucleotide
  Target: ATXN1; (+) strand; PAM type: NRG; PAM sequence: AGG
tgagggtgacagccaatgcc

SEQ ID NO: 124693 - DNA, 20 bp, Artificial Sequence
  Description of Artificial Sequence: Synthetic oligonucleotide
  Target: ATXN1; (+) strand; PAM type: NRG; PAM sequence: GAG
agggtgacagccaatgccag

SEQ ID NO: 124694 - DNA, 20 bp, Artificial Sequence
  Description of Artificial Sequence: Synthetic oligonucleotide
  Target: ATXN1; (+) strand; PAM type: NRG; PAM sequence: CAG
acagccaatgccaggagcta

SEQ ID NO: 124695 - DNA, 20 bp, Artificial Sequence
  Description of Artificial Sequence: Synthetic oligonucleotide
  Target: ATXN1; (+) strand; PAM type: NRG; PAM sequence: CAG
aatgccaggagctacagcaa

SEQ ID NO: 124696 - DNA, 20 bp, Artificial Sequence
  Description of Artificial Sequence: Synthetic oligonucleotide
  Target: ATXN1; (+) strand; PAM type: NRG; PAM sequence: AAG
gccaggagctacagcaacag

SEQ ID NO: 124697 - DNA, 20 bp, Artificial Sequence
  Description of Artificial Sequence: Synthetic oligonucleotide
  Target: ATXN1; (+) strand; PAM type: NRG; PAM sequence: AAG
aacagaagaatgtactttaa

SEQ ID NO: 124698 - DNA, 20 bp, Artificial Sequence
  Description of Artificial Sequence: Synthetic oligonucleotide
  Target: ATXN1; (+) strand; PAM type: NRG; PAM sequence: GAG
cagaagaatgtactttaaaa

SEQ ID NO: 124699 - DNA, 20 bp, Artificial Sequence
  Description of Artificial Sequence: Synthetic oligonucleotide
  Target: ATXN1; (+) strand; PAM type: NRG; PAM sequence: GAG
gaagaatgtactttaaaaga

SEQ ID NO: 124700 - DNA, 20 bp, Artificial Sequence
  Description of Artificial Sequence: Synthetic oligonucleotide
  Target: ATXN1; (+) strand; PAM type: NRG; PAM sequence: CAG
aatgtactttaaaagagaga

SEQ ID NO: 124701 - DNA, 20 bp, Artificial Sequence
  Description of Artificial Sequence: Synthetic oligonucleotide
  Target: ATXN1; (+) strand; PAM type: NRG; PAM sequence: AGG
atgtactttaaaagagagac

SEQ ID NO: 124702 - DNA, 20 bp, Artificial Sequence
  Description of Artificial Sequence: Synthetic oligonucleotide
  Target: ATXN1; (+) strand; PAM type: NRG; PAM sequence: GAG
gtactttaaaagagagacag

SEQ ID NO: 124703 - DNA, 20 bp, Artificial Sequence
  Description of Artificial Sequence: Synthetic oligonucleotide
  Target: ATXN1; (+) strand; PAM type: NRG; PAM sequence: TGG
ttaaaagagagacaggagaa

SEQ ID NO: 124704 - DNA, 20 bp, Artificial Sequence
  Description of Artificial Sequence: Synthetic oligonucleotide
  Target: ATXN1; (+) strand; PAM type: NRG; PAM sequence: TAG
agagagacaggagaatggct

SEQ ID NO: 124705 - DNA, 20 bp, Artificial Sequence
  Description of Artificial Sequence: Synthetic oligonucleotide
  Target: ATXN1; (+) strand; PAM type: NRG; PAM sequence: CAG
catcaccatcacctcctaac

SEQ ID NO: 124706 - DNA, 20 bp, Artificial Sequence
  Description of Artificial Sequence: Synthetic oligonucleotide
  Target: ATXN1; (+) strand; PAM type: NRG; PAM sequence: AAG
tcctaaccagaaatgacaac

SEQ ID NO: 124707 - DNA, 20 bp, Artificial Sequence
  Description of Artificial Sequence: Synthetic oligonucleotide
  Target: ATXN1; (+) strand; PAM type: NRG; PAM sequence: CAG
taaccagaaatgacaacaag

SEQ ID NO: 124708 - DNA, 20 bp, Artificial Sequence
  Description of Artificial Sequence: Synthetic oligonucleotide
  Target: ATXN1; (+) strand; PAM type: NRG; PAM sequence: TAG
tgacaacaagcagcactttc

SEQ ID NO: 124709 - DNA, 20 bp, Artificial Sequence
  Description of Artificial Sequence: Synthetic oligonucleotide
  Target: ATXN1; (+) strand; PAM type: NRG; PAM sequence: AGG
gacaacaagcagcactttct

SEQ ID NO: 124710 - DNA, 20 bp, Artificial Sequence
  Description of Artificial Sequence: Synthetic oligonucleotide
  Target: ATXN1; (+) strand; PAM type: NRG; PAM sequence: TAG
agcactttctaggaatttgt

SEQ ID NO: 124711 - DNA, 20 bp, Artificial Sequence
  Description of Artificial Sequence: Synthetic oligonucleotide
  Target: ATXN1; (+) strand; PAM type: NRG; PAM sequence: TGG
actttctaggaatttgttag

SEQ ID NO: 124712 - DNA, 20 bp, Artificial Sequence
  Description of Artificial Sequence: Synthetic oligonucleotide
  Target: ATXN1; (+) strand; PAM type: NRG; PAM sequence: TAG
tcttttgaccaaatattatt

SEQ ID NO: 124713 - DNA, 20 bp, Artificial Sequence
  Description of Artificial Sequence: Synthetic oligonucleotide
  Target: ATXN1; (+) strand; PAM type: NRG; PAM sequence: AAG
ttgaccaaatattatttagt

SEQ ID NO: 124714 - DNA, 20 bp, Artificial Sequence
  Description of Artificial Sequence: Synthetic oligonucleotide
  Target: ATXN1; (+) strand; PAM type: NRG; PAM sequence: TGG
aaatattatttagtaagatg

SEQ ID NO: 124715 - DNA, 20 bp, Artificial Sequence
  Description of Artificial Sequence: Synthetic oligonucleotide
  Target: ATXN1; (+) strand; PAM type: NRG; PAM sequence: GAG
ttatttagtaagatgtggtt

SEQ ID NO: 124716 - DNA, 20 bp, Artificial Sequence
  Description of Artificial Sequence: Synthetic oligonucleotide
  Target: ATXN1; (+) strand; PAM type: NRG; PAM sequence: TGG
tttagtaagatgtggttgag

SEQ ID NO: 124717 - DNA, 20 bp, Artificial Sequence
  Description of Artificial Sequence: Synthetic oligonucleotide
  Target: ATXN1; (+) strand; PAM type: NRG; PAM sequence: TGG
agatgtggttgagtggcccc

SEQ ID NO: 124718 - DNA, 20 bp, Artificial Sequence
  Description of Artificial Sequence: Synthetic oligonucleotide
  Target: ATXN1; (+) strand; PAM type: NRG; PAM sequence: GGG
gatgtggttgagtggcccct

SEQ ID NO: 124719 - DNA, 20 bp, Artificial Sequence
  Description of Artificial Sequence: Synthetic oligonucleotide
  Target: ATXN1; (+) strand; PAM type: NRG; PAM sequence: CAG
cctgggaatcaccattgaaa

SEQ ID NO: 124720 - DNA, 20 bp, Artificial Sequence
  Description of Artificial Sequence: Synthetic oligonucleotide
  Target: ATXN1; (+) strand; PAM type: NRG; PAM sequence: AAG
gggaatcaccattgaaacag

SEQ ID NO: 124721 - DNA, 20 bp, Artificial Sequence
  Description of Artificial Sequence: Synthetic oligonucleotide
  Target: ATXN1; (+) strand; PAM type: NRG; PAM sequence: AGG
ggaatcaccattgaaacaga

SEQ ID NO: 124722 - DNA, 20 bp, Artificial Sequence
  Description of Artificial Sequence: Synthetic oligonucleotide
  Target: ATXN1; (+) strand; PAM type: NRG; PAM sequence: AAG
attgaaacagaaggctttct

SEQ ID NO: 124723 - DNA, 20 bp, Artificial Sequence
  Description of Artificial Sequence: Synthetic oligonucleotide
  Target: ATXN1; (+) strand; PAM type: NRG; PAM sequence: CAG
ttctaagtaaaatatctgtt

SEQ ID NO: 124724 - DNA, 20 bp, Artificial Sequence
  Description of Artificial Sequence: Synthetic oligonucleotide
  Target: ATXN1; (+) strand; PAM type: NRG; PAM sequence: CAG
ctgttcagtatctgttcttg

SEQ ID NO: 124725 - DNA, 20 bp, Artificial Sequence
  Description of Artificial Sequence: Synthetic oligonucleotide
  Target: ATXN1; (+) strand; PAM type: NRG; PAM sequence: AAG
gtatctgttcttgcagtgca

SEQ ID NO: 124726 - DNA, 20 bp, Artificial Sequence
  Description of Artificial Sequence: Synthetic oligonucleotide
  Target: ATXN1; (+) strand; PAM type: NRG; PAM sequence: AAG
cagtgcaaagcacatttcaa

SEQ ID NO: 124727 - DNA, 20 bp, Artificial Sequence
  Description of Artificial Sequence: Synthetic oligonucleotide
  Target: ATXN1; (+) strand; PAM type: NRG; PAM sequence: CAG
caaagcacatttcaaaagtt

SEQ ID NO: 124728 - DNA, 20 bp, Artificial Sequence
  Description of Artificial Sequence: Synthetic oligonucleotide
  Target: ATXN1; (+) strand; PAM type: NRG; PAM sequence: CGG
catttcaaaagttcagccaa

SEQ ID NO: 124729 - DNA, 20 bp, Artificial Sequence
  Description of Artificial Sequence: Synthetic oligonucleotide
  Target: ATXN1; (+) strand; PAM type: NRG; PAM sequence: TAG
tcaaaagttcagccaacggc

SEQ ID NO: 124730 - DNA, 20 bp, Artificial Sequence
  Description of Artificial Sequence: Synthetic oligonucleotide
  Target: ATXN1; (+) strand; PAM type: NRG; PAM sequence: AGG
caaaagttcagccaacggct

SEQ ID NO: 124731 - DNA, 20 bp, Artificial Sequence
  Description of Artificial Sequence: Synthetic oligonucleotide
  Target: ATXN1; (+) strand; PAM type: NRG; PAM sequence: TGG
ccaacggctaggaaaatgtt

SEQ ID NO: 124732 - DNA, 20 bp, Artificial Sequence
  Description of Artificial Sequence: Synthetic oligonucleotide
  Target: ATXN1; (+) strand; PAM type: NRG; PAM sequence: GGG
caacggctaggaaaatgttt

SEQ ID NO: 124733 - DNA, 20 bp, Artificial Sequence
  Description of Artificial Sequence: Synthetic oligonucleotide
  Target: ATXN1; (+) strand; PAM type: NRG; PAM sequence: GGG
aacggctaggaaaatgtttg

SEQ ID NO: 124734 - DNA, 20 bp, Artificial Sequence
  Description of Artificial Sequence: Synthetic oligonucleotide
  Target: ATXN1; (+) strand; PAM type: NRG; PAM sequence: CAG
aggaaaatgtttggggcacg

SEQ ID NO: 124735 - DNA, 20 bp, Artificial Sequence
  Description of Artificial Sequence: Synthetic oligonucleotide
  Target: ATXN1; (+) strand; PAM type: NRG; PAM sequence: CAG
cagaatcccttctacgccaa

SEQ ID NO: 124736 - DNA, 20 bp, Artificial Sequence
  Description of Artificial Sequence: Synthetic oligonucleotide
  Target: ATXN1; (+) strand; PAM type: NRG; PAM sequence: CAG
aatctcatgtatgcattttt

SEQ ID NO: 124737 - DNA, 20 bp, Artificial Sequence
  Description of Artificial Sequence: Synthetic oligonucleotide
  Target: ATXN1; (+) strand; PAM type: NRG; PAM sequence: GAG
gtatgcatttttcagctcct

SEQ ID NO: 124738 - DNA, 20 bp, Artificial Sequence
  Description of Artificial Sequence: Synthetic oligonucleotide
  Target: ATXN1; (+) strand; PAM type: NRG; PAM sequence: GAG
catttttcagctcctgagtt

SEQ ID NO: 124739 - DNA, 20 bp, Artificial Sequence
  Description of Artificial Sequence: Synthetic oligonucleotide
  Target: ATXN1; (+) strand; PAM type: NRG; PAM sequence: AAG
ttttcagctcctgagttgag

SEQ ID NO: 124740 - DNA, 20 bp, Artificial Sequence
  Description of Artificial Sequence: Synthetic oligonucleotide
  Target: ATXN1; (+) strand; PAM type: NRG; PAM sequence: CAG
gagaagacatattaaaaacc

SEQ ID NO: 124741 - DNA, 20 bp, Artificial Sequence
  Description of Artificial Sequence: Synthetic oligonucleotide
  Target: ATXN1; (+) strand; PAM type: NRG; PAM sequence: CAG
acatgtttatcttcattaaa

SEQ ID NO: 124742 - DNA, 20 bp, Artificial Sequence
  Description of Artificial Sequence: Synthetic oligonucleotide
  Target: ATXN1; (+) strand; PAM type: NRG; PAM sequence: CAG
tcctttcaaacaatatacaa

SEQ ID NO: 124743 - DNA, 20 bp, Artificial Sequence
  Description of Artificial Sequence: Synthetic oligonucleotide
  Target: ATXN1; (+) strand; PAM type: NRG; PAM sequence: AGG
cctttcaaacaatatacaac

SEQ ID NO: 124744 - DNA, 20 bp, Artificial Sequence
  Description of Artificial Sequence: Synthetic oligonucleotide
  Target: ATXN1; (+) strand; PAM type: NRG; PAM sequence: GGG
ctttcaaacaatatacaaca

SEQ ID NO: 124745 - DNA, 20 bp, Artificial Sequence
  Description of Artificial Sequence: Synthetic oligonucleotide
  Target: ATXN1; (+) strand; PAM type: NRG; PAM sequence: CAG
tcaaacaatatacaacaggg

SEQ ID NO: 124746 - DNA, 20 bp, Artificial Sequence
  Description of Artificial Sequence: Synthetic oligonucleotide
  Target: ATXN1; (+) strand; PAM type: NRG; PAM sequence: GAG
aaacaatatacaacagggca

SEQ ID NO: 124747 - DNA, 20 bp, Artificial Sequence
  Description of Artificial Sequence: Synthetic oligonucleotide
  Target: ATXN1; (+) strand; PAM type: NRG; PAM sequence: TGG
gagatcactgtttgtgctaa

SEQ ID NO: 124748 - DNA, 20 bp, Artificial Sequence
  Description of Artificial Sequence: Synthetic oligonucleotide
  Target: ATXN1; (+) strand; PAM type: NRG; PAM sequence: AAG
tcactgtttgtgctaatgga

SEQ ID NO: 124749 - DNA, 20 bp, Artificial Sequence
  Description of Artificial Sequence: Synthetic oligonucleotide
  Target: ATXN1; (+) strand; PAM type: NRG; PAM sequence: AAG
tgctaatggaaagtgatcaa

SEQ ID NO: 124750 - DNA, 20 bp, Artificial Sequence
  Description of Artificial Sequence: Synthetic oligonucleotide
  Target: ATXN1; (+) strand; PAM type: NRG; PAM sequence: AAG
ggaaagtgatcaaaagcccc

SEQ ID NO: 124751 - DNA, 20 bp, Artificial Sequence
  Description of Artificial Sequence: Synthetic oligonucleotide
  Target: ATXN1; (+) strand; PAM type: NRG; PAM sequence: TGG
tcaaaagccccaagattctt

SEQ ID NO: 124752 - DNA, 20 bp, Artificial Sequence
  Description of Artificial Sequence: Synthetic oligonucleotide
  Target: ATXN1; (+) strand; PAM type: NRG; PAM sequence: TAG
aagccccaagattctttggt

SEQ ID NO: 124753 - DNA, 20 bp, Artificial Sequence
  Description of Artificial Sequence: Synthetic oligonucleotide
  Target: ATXN1; (+) strand; PAM type: NRG; PAM sequence: AAG
tctttggttagctgactctg

SEQ ID NO: 124754 - DNA, 20 bp, Artificial Sequence
  Description of Artificial Sequence: Synthetic oligonucleotide
  Target: ATXN1; (+) strand; PAM type: NRG; PAM sequence: GAG
tctgaagcctgctcgtgctt

SEQ ID NO: 124755 - DNA, 20 bp, Artificial Sequence
  Description of Artificial Sequence: Synthetic oligonucleotide
  Target: ATXN1; (+) strand; PAM type: NRG; PAM sequence: AAG
cgtgcttgagtttctacaca

SEQ ID NO: 124756 - DNA, 20 bp, Artificial Sequence
  Description of Artificial Sequence: Synthetic oligonucleotide
  Target: ATXN1; (+) strand; PAM type: NRG; PAM sequence: AAG
ttctacacaaagtacatcaa

SEQ ID NO: 124757 - DNA, 20 bp, Artificial Sequence
  Description of Artificial Sequence: Synthetic oligonucleotide
  Target: ATXN1; (+) strand; PAM type: NRG; PAM sequence: TAG
caaagtacatcaaaagaata

SEQ ID NO: 124758 - DNA, 20 bp, Artificial Sequence
  Description of Artificial Sequence: Synthetic oligonucleotide
  Target: ATXN1; (+) strand; PAM type: NRG; PAM sequence: TGG
caaaagaatatagatatcac

SEQ ID NO: 124759 - DNA, 20 bp, Artificial Sequence
  Description of Artificial Sequence: Synthetic oligonucleotide
  Target: ATXN1; (+) strand; PAM type: NRG; PAM sequence: GAG
aaagaatatagatatcactg

SEQ ID NO: 124760 - DNA, 20 bp, Artificial Sequence
  Description of Artificial Sequence: Synthetic oligonucleotide
  Target: ATXN1; (+) strand; PAM type: NRG; PAM sequence: AAG
ctggagattctaaatgttta

SEQ ID NO: 124761 - DNA, 20 bp, Artificial Sequence
  Description of Artificial Sequence: Synthetic oligonucleotide
  Target: ATXN1; (+) strand; PAM type: NRG; PAM sequence: TAG
ttctaaatgtttaaagtctc

SEQ ID NO: 124762 - DNA, 20 bp, Artificial Sequence
  Description of Artificial Sequence: Synthetic oligonucleotide
  Target: ATXN1; (+) strand; PAM type: NRG; PAM sequence: AGG
tctaaatgtttaaagtctct

SEQ ID NO: 124763 - DNA, 20 bp, Artificial Sequence
  Description of Artificial Sequence: Synthetic oligonucleotide
  Target: ATXN1; (+) strand; PAM type: NRG; PAM sequence: TAG
atgtttaaagtctctaggac

SEQ ID NO: 124764 - DNA, 20 bp, Artificial Sequence
  Description of Artificial Sequence: Synthetic oligonucleotide
  Target: ATXN1; (+) strand; PAM type: NRG; PAM sequence: AAG
ttaaagtctctaggactagc

SEQ ID NO: 124765 - DNA, 20 bp, Artificial Sequence
  Description of Artificial Sequence: Synthetic oligonucleotide
  Target: ATXN1; (+) strand; PAM type: NRG; PAM sequence: TAG
agaaaatatgcttgaaacta

SEQ ID NO: 124766 - DNA, 20 bp, Artificial Sequence
  Description of Artificial Sequence: Synthetic oligonucleotide
  Target: ATXN1; (+) strand; PAM type: NRG; PAM sequence: AGG
gaaaatatgcttgaaactat

SEQ ID NO: 124767 - DNA, 20 bp, Artificial Sequence
  Description of Artificial Sequence: Synthetic oligonucleotide
  Target: ATXN1; (+) strand; PAM type: NRG; PAM sequence: TGG
atgcttgaaactataggaaa

SEQ ID NO: 124768 - DNA, 20 bp, Artificial Sequence
  Description of Artificial Sequence: Synthetic oligonucleotide
  Target: ATXN1; (+) strand; PAM type: NRG; PAM sequence: GGG
tgcttgaaactataggaaat

SEQ ID NO: 124769 - DNA, 20 bp, Artificial Sequence
  Description of Artificial Sequence: Synthetic oligonucleotide
  Target: ATXN1; (+) strand; PAM type: NRG; PAM sequence: GGG
gcttgaaactataggaaatg

SEQ ID NO: 124770 - DNA, 20 bp, Artificial Sequence
  Description of Artificial Sequence: Synthetic oligonucleotide
  Target: ATXN1; (+) strand; PAM type: NRG; PAM sequence: CAG
aaactataggaaatggggaa

SEQ ID NO: 124771 - DNA, 20 bp, Artificial Sequence
  Description of Artificial Sequence: Synthetic oligonucleotide
  Target: ATXN1; (+) strand; PAM type: NRG; PAM sequence: TAG
aatacattacaatctataaa

SEQ ID NO: 124772 - DNA, 20 bp, Artificial Sequence
  Description of Artificial Sequence: Synthetic oligonucleotide
  Target: ATXN1; (+) strand; PAM type: NRG; PAM sequence: TAG
attacaatctataaatagct

SEQ ID NO: 124773 - DNA, 20 bp, Artificial Sequence
  Description of Artificial Sequence: Synthetic oligonucleotide
  Target: ATXN1; (+) strand; PAM type: NRG; PAM sequence: AGG
ttacaatctataaatagctt

SEQ ID NO: 124774 - DNA, 20 bp, Artificial Sequence
  Description of Artificial Sequence: Synthetic oligonucleotide
  Target: ATXN1; (+) strand; PAM type: NRG; PAM sequence: CGG
gtttaaatatgcacctcccc

SEQ ID NO: 124775 - DNA, 20 bp, Artificial Sequence
  Description of Artificial Sequence: Synthetic oligonucleotide
  Target: ATXN1; (+) strand; PAM type: NRG; PAM sequence: AAG
aatatgcacctcccccggaa

SEQ ID NO: 124776 - DNA, 20 bp, Artificial Sequence
  Description of Artificial Sequence: Synthetic oligonucleotide
  Target: ATXN1; (+) strand; PAM type: NRG; PAM sequence: TAG
tgcacctcccccggaaaaga

SEQ ID NO: 124777 - DNA, 20 bp, Artificial Sequence
  Description of Artificial Sequence: Synthetic oligonucleotide
  Target: ATXN1; (+) strand; PAM type: NRG; PAM sequence: GAG
cacctcccccggaaaagata

SEQ ID NO: 124778 - DNA, 20 bp, Artificial Sequence
  Description of Artificial Sequence: Synthetic oligonucleotide
  Target: ATXN1; (+) strand; PAM type: NRG; PAM sequence: AGG
acctcccccggaaaagatag

SEQ ID NO: 124779 - DNA, 20 bp, Artificial Sequence
  Description of Artificial Sequence: Synthetic oligonucleotide
  Target: ATXN1; (+) strand; PAM type: NRG; PAM sequence: AAG
ccgatcatcttgctatttgc

SEQ ID NO: 124780 - DNA, 20 bp, Artificial Sequence
  Description of Artificial Sequence: Synthetic oligonucleotide
  Target: ATXN1; (+) strand; PAM type: NRG; PAM sequence: AGG
cgatcatcttgctatttgca

SEQ ID NO: 124781 - DNA, 20 bp, Artificial Sequence
  Description of Artificial Sequence: Synthetic oligonucleotide
  Target: ATXN1; (+) strand; PAM type: NRG; PAM sequence: CAG
ttactcacaaatcaatctaa

SEQ ID NO: 124782 - DNA, 20 bp, Artificial Sequence
  Description of Artificial Sequence: Synthetic oligonucleotide
  Target: ATXN1; (+) strand; PAM type: NRG; PAM sequence: AGG
tactcacaaatcaatctaac

SEQ ID NO: 124783 - DNA, 20 bp, Artificial Sequence
  Description of Artificial Sequence: Synthetic oligonucleotide
  Target: ATXN1; (+) strand; PAM type: NRG; PAM sequence: CGG
caaatcaatctaacaggcca

SEQ ID NO: 124784 - DNA, 20 bp, Artificial Sequence
  Description of Artificial Sequence: Synthetic oligonucleotide
  Target: ATXN1; (+) strand; PAM type: NRG; PAM sequence: TGG
aacaggccacggtgatatta

SEQ ID NO: 124785 - DNA, 20 bp, Artificial Sequence
  Description of Artificial Sequence: Synthetic oligonucleotide
  Target: ATXN1; (+) strand; PAM type: NRG; PAM sequence: GGG
acaggccacggtgatattat

SEQ ID NO: 124786 - DNA, 20 bp, Artificial Sequence
  Description of Artificial Sequence: Synthetic oligonucleotide
  Target: ATXN1; (+) strand; PAM type: NRG; PAM sequence: GGG
caggccacggtgatattatg

SEQ ID NO: 124787 - DNA, 20 bp, Artificial Sequence
  Description of Artificial Sequence: Synthetic oligonucleotide
  Target: ATXN1; (+) strand; PAM type: NRG; PAM sequence: AAG
gtgatattatggggatgtaa

SEQ ID NO: 124788 - DNA, 20 bp, Artificial Sequence
  Description of Artificial Sequence: Synthetic oligonucleotide
  Target: ATXN1; (+) strand; PAM type: NRG; PAM sequence: AGG
tgatattatggggatgtaaa

SEQ ID NO: 124789 - DNA, 20 bp, Artificial Sequence
  Description of Artificial Sequence: Synthetic oligonucleotide
  Target: ATXN1; (+) strand; PAM type: NRG; PAM sequence: GGG
gatattatggggatgtaaaa

SEQ ID NO: 124790 - DNA, 20 bp, Artificial Sequence
  Description of Artificial Sequence: Synthetic oligonucleotide
  Target: ATXN1; (+) strand; PAM type: NRG; PAM sequence: AAG
taaaagggactgaaatgatc

SEQ ID NO: 124791 - DNA, 20 bp, Artificial Sequence
  Description of Artificial Sequence: Synthetic oligonucleotide
  Target: ATXN1; (+) strand; PAM type: NRG; PAM sequence: GAG
aaagggactgaaatgatcaa

SEQ ID NO: 124792 - DNA, 20 bp, Artificial Sequence
  Description of Artificial Sequence: Synthetic oligonucleotide
  Target: ATXN1; (+) strand; PAM type: NRG; PAM sequence: AAG
aagagcgtcacgtgtcttcc

SEQ ID NO: 124793 - DNA, 20 bp, Artificial Sequence
  Description of Artificial Sequence: Synthetic oligonucleotide
  Target: ATXN1; (+) strand; PAM type: NRG; PAM sequence: AAG
cgtcacgtgtcttccaagcc

SEQ ID NO: 124794 - DNA, 20 bp, Artificial Sequence
  Description of Artificial Sequence: Synthetic oligonucleotide
  Target: ATXN1; (+) strand; PAM type: NRG; PAM sequence: TGG
cacgtgtcttccaagccaag

SEQ ID NO: 124795 - DNA, 20 bp, Artificial Sequence
  Description of Artificial Sequence: Synthetic oligonucleotide
  Target: ATXN1; (+) strand; PAM type: NRG; PAM sequence: GGG
acgtgtcttccaagccaagt

SEQ ID NO: 124796 - DNA, 20 bp, Artificial Sequence
  Description of Artificial Sequence: Synthetic oligonucleotide
  Target: ATXN1; (+) strand; PAM type: NRG; PAM sequence: GGG
cgtgtcttccaagccaagtg

SEQ ID NO: 124797 - DNA, 20 bp, Artificial Sequence
  Description of Artificial Sequence: Synthetic oligonucleotide
  Target: ATXN1; (+) strand; PAM type: NRG; PAM sequence: TGG
agtggggtcctatgccttgc

SEQ ID NO: 124798 - DNA, 20 bp, Artificial Sequence
  Description of Artificial Sequence: Synthetic oligonucleotide
  Target: ATXN1; (+) strand; PAM type: NRG; PAM sequence: AAG
tcctatgccttgctggtttg

SEQ ID NO: 124799 - DNA, 20 bp, Artificial Sequence
  Description of Artificial Sequence: Synthetic oligonucleotide
  Target: ATXN1; (+) strand; PAM type: NRG; PAM sequence: AAG
tatgccttgctggtttgaag

SEQ ID NO: 124800 - DNA, 20 bp, Artificial Sequence
  Description of Artificial Sequence: Synthetic oligonucleotide
  Target: ATXN1; (+) strand; PAM type: NRG; PAM sequence: TGG
gccttgctggtttgaagaag

SEQ ID NO: 124801 - DNA, 20 bp, Artificial Sequence
  Description of Artificial Sequence: Synthetic oligonucleotide
  Target: ATXN1; (+) strand; PAM type: NRG; PAM sequence: GGG
ccttgctggtttgaagaagt

SEQ ID NO: 124802 - DNA, 20 bp, Artificial Sequence
  Description of Artificial Sequence: Synthetic oligonucleotide
  Target: ATXN1; (+) strand; PAM type: NRG; PAM sequence: GAG
ttgctggtttgaagaagtgg

SEQ ID NO: 124803 - DNA, 20 bp, Artificial Sequence
  Description of Artificial Sequence: Synthetic oligonucleotide
  Target: ATXN1; (+) strand; PAM type: NRG; PAM sequence: AAG
gaagtgggagaaacttcatc

SEQ ID NO: 124804 - DNA, 20 bp, Artificial Sequence
  Description of Artificial Sequence: Synthetic oligonucleotide
  Target: ATXN1; (+) strand; PAM type: NRG; PAM sequence: GAG
agtgggagaaacttcatcaa

SEQ ID NO: 124805 - DNA, 20 bp, Artificial Sequence
  Description of Artificial Sequence: Synthetic oligonucleotide
  Target: ATXN1; (+) strand; PAM type: NRG; PAM sequence: CAG
gggagaaacttcatcaagag

SEQ ID NO: 124806 - DNA, 20 bp, Artificial Sequence
  Description of Artificial Sequence: Synthetic oligonucleotide
  Target: ATXN1; (+) strand; PAM type: NRG; PAM sequence: CAG
cttcatcaagagcagcaact

SEQ ID NO: 124807 - DNA, 20 bp, Artificial Sequence
  Description of Artificial Sequence: Synthetic oligonucleotide
  Target: ATXN1; (+) strand; PAM type: NRG; PAM sequence: AGG
ttcatcaagagcagcaactc

SEQ ID NO: 124808 - DNA, 20 bp, Artificial Sequence
  Description of Artificial Sequence: Synthetic oligonucleotide
  Target: ATXN1; (+) strand; PAM type: NRG; PAM sequence: CAG
caactcaggtgtctgtccac

SEQ ID NO: 124809 - DNA, 20 bp, Artificial Sequence
  Description of Artificial Sequence: Synthetic oligonucleotide
  Target: ATXN1; (+) strand; PAM type: NRG; PAM sequence: GAG
actcaggtgtctgtccacca

SEQ ID NO: 124810 - DNA, 20 bp, Artificial Sequence
  Description of Artificial Sequence: Synthetic oligonucleotide
  Target: ATXN1; (+) strand; PAM type: NRG; PAM sequence: AAG
aggtgtctgtccaccagagt

SEQ ID NO: 124811 - DNA, 20 bp, Artificial Sequence
  Description of Artificial Sequence: Synthetic oligonucleotide
  Target: ATXN1; (+) strand; PAM type: NRG; PAM sequence: CAG
tgtctgtccaccagagtaag

SEQ ID NO: 124812 - DNA, 20 bp, Artificial Sequence
  Description of Artificial Sequence: Synthetic oligonucleotide
  Target: ATXN1; (+) strand; PAM type: NRG; PAM sequence: AGG
gtctgtccaccagagtaagc

SEQ ID NO: 124813 - DNA, 20 bp, Artificial Sequence
  Description of Artificial Sequence: Synthetic oligonucleotide
  Target: ATXN1; (+) strand; PAM type: NRG; PAM sequence: GAG
ctgtccaccagagtaagcag

SEQ ID NO: 124814 - DNA, 20 bp, Artificial Sequence
  Description of Artificial Sequence: Synthetic oligonucleotide
  Target: ATXN1; (+) strand; PAM type: NRG; PAM sequence: AGG
tgtccaccagagtaagcagg

SEQ ID NO: 124815 - DNA, 20 bp, Artificial Sequence
  Description of Artificial Sequence: Synthetic oligonucleotide
  Target: ATXN1; (+) strand; PAM type: NRG; PAM sequence: CAG
agtaagcaggaggttctgac

SEQ ID NO: 124816 - DNA, 20 bp, Artificial Sequence
  Description of Artificial Sequence: Synthetic oligonucleotide
  Target: ATXN1; (+) strand; PAM type: NRG; PAM sequence: AAG
agcaggaggttctgaccagc

SEQ ID NO: 124817 - DNA, 20 bp, Artificial Sequence
  Description of Artificial Sequence: Synthetic oligonucleotide
  Target: ATXN1; (+) strand; PAM type: NRG; PAM sequence: AGG
gcaggaggttctgaccagca

SEQ ID NO: 124818 - DNA, 20 bp, Artificial Sequence
  Description of Artificial Sequence: Synthetic oligonucleotide
  Target: ATXN1; (+) strand; PAM type: NRG; PAM sequence: GGG
caggaggttctgaccagcaa

SEQ ID NO: 124819 - DNA, 20 bp, Artificial Sequence
  Description of Artificial Sequence: Synthetic oligonucleotide
  Target: ATXN1; (+) strand; PAM type: NRG; PAM sequence: TAG
gaggttctgaccagcaaggg

SEQ ID NO: 124820 - DNA, 20 bp, Artificial Sequence
  Description of Artificial Sequence: Synthetic oligonucleotide
  Target: ATXN1; (+) strand; PAM type: NRG; PAM sequence: TAG
tctgaccagcaagggtagcc

SEQ ID NO: 124821 - DNA, 20 bp, Artificial Sequence
  Description of Artificial Sequence: Synthetic oligonucleotide
  Target: ATXN1; (+) strand; PAM type: NRG; PAM sequence: AGG
ctgaccagcaagggtagcct

SEQ ID NO: 124822 - DNA, 20 bp, Artificial Sequence
  Description of Artificial Sequence: Synthetic oligonucleotide
  Target: ATXN1; (+) strand; PAM type: NRG; PAM sequence: GGG
tgaccagcaagggtagccta

SEQ ID NO: 124823 - DNA, 20 bp, Artificial Sequence
  Description of Artificial Sequence: Synthetic oligonucleotide
  Target: ATXN1; (+) strand; PAM type: NRG; PAM sequence: TGG
agcaagggtagcctagggca

SEQ ID NO: 124824 - DNA, 20 bp, Artificial Sequence
  Description of Artificial Sequence: Synthetic oligonucleotide
  Target: ATXN1; (+) strand; PAM type: NRG; PAM sequence: GGG
gcaagggtagcctagggcat

SEQ ID NO: 124825 - DNA, 20 bp, Artificial Sequence
  Description of Artificial Sequence: Synthetic oligonucleotide
  Target: ATXN1; (+) strand; PAM type: NRG; PAM sequence: GAG
aagggtagcctagggcatgg

SEQ ID NO: 124826 - DNA, 20 bp, Artificial Sequence
  Description of Artificial Sequence: Synthetic oligonucleotide
  Target: ATXN1; (+) strand; PAM type: NRG; PAM sequence: AGG
agggtagcctagggcatggg

SEQ ID NO: 124827 - DNA, 20 bp, Artificial Sequence
  Description of Artificial Sequence: Synthetic oligonucleotide
  Target: ATXN1; (+) strand; PAM type: NRG; PAM sequence: GGG
gggtagcctagggcatggga

SEQ ID NO: 124828 - DNA, 20 bp, Artificial Sequence
  Description of Artificial Sequence: Synthetic oligonucleotide
  Target: ATXN1; (+) strand; PAM type: NRG; PAM sequence: GAG
gtagcctagggcatgggagg

SEQ ID NO: 124829 - DNA, 20 bp, Artificial Sequence
  Description of Artificial Sequence: Synthetic oligonucleotide
  Target: ATXN1; (+) strand; PAM type: NRG; PAM sequence: AGG
tagcctagggcatgggaggg

SEQ ID NO: 124830 - DNA, 20 bp, Artificial Sequence
  Description of Artificial Sequence: Synthetic oligonucleotide
  Target: ATXN1; (+) strand; PAM type: NRG; PAM sequence: GGG
agcctagggcatgggaggga

SEQ ID NO: 124831 - DNA, 20 bp, Artificial Sequence
  Description of Artificial Sequence: Synthetic oligonucleotide
  Target: ATXN1; (+) strand; PAM type: NRG; PAM sequence: GAG
cctagggcatgggagggagg

SEQ ID NO: 124832 - DNA, 20 bp, Artificial Sequence
  Description of Artificial Sequence: Synthetic oligonucleotide
  Target: ATXN1; (+) strand; PAM type: NRG; PAM sequence: CAG
gggcatgggagggagggaga

SEQ ID NO: 124833 - DNA, 20 bp, Artificial Sequence
  Description of Artificial Sequence: Synthetic oligonucleotide
  Target: ATXN1; (+) strand; PAM type: NRG; PAM sequence: AAG
ggagggagacagtgacttta

SEQ ID NO: 124834 - DNA, 20 bp, Artificial Sequence
  Description of Artificial Sequence: Synthetic oligonucleotide
  Target: ATXN1; (+) strand; PAM type: NRG; PAM sequence: CAG
acacttcctgcacctctgcc

SEQ ID NO: 124835 - DNA, 20 bp, Artificial Sequence
  Description of Artificial Sequence: Synthetic oligonucleotide
  Target: ATXN1; (+) strand; PAM type: NRG; PAM sequence: GAG
acttcctgcacctctgccca

SEQ ID NO: 124836 - DNA, 20 bp, Artificial Sequence
  Description of Artificial Sequence: Synthetic oligonucleotide
  Target: ATXN1; (+) strand; PAM type: NRG; PAM sequence: AGG
cttcctgcacctctgcccag

SEQ ID NO: 124837 - DNA, 20 bp, Artificial Sequence
  Description of Artificial Sequence: Synthetic oligonucleotide
  Target: ATXN1; (+) strand; PAM type: NRG; PAM sequence: TGG
cctgcacctctgcccagagg

SEQ ID NO: 124838 - DNA, 20 bp, Artificial Sequence
  Description of Artificial Sequence: Synthetic oligonucleotide
  Target: ATXN1; (+) strand; PAM type: NRG; PAM sequence: CAG
gcccagaggtggctgctcca

SEQ ID NO: 124839 - DNA, 20 bp, Artificial Sequence
  Description of Artificial Sequence: Synthetic oligonucleotide
  Target: ATXN1; (+) strand; PAM type: NRG; PAM sequence: AAG
ggtggctgctccacagaccc

SEQ ID NO: 124840 - DNA, 20 bp, Artificial Sequence
  Description of Artificial Sequence: Synthetic oligonucleotide
  Target: ATXN1; (+) strand; PAM type: NRG; PAM sequence: CAG
ggctgctccacagacccaag

SEQ ID NO: 124841 - DNA, 20 bp, Artificial Sequence
  Description of Artificial Sequence: Synthetic oligonucleotide
  Target: ATXN1; (+) strand; PAM type: NRG; PAM sequence: AAG
gctccacagacccaagcaga

SEQ ID NO: 124842 - DNA, 20 bp, Artificial Sequence
  Description of Artificial Sequence: Synthetic oligonucleotide
  Target: ATXN1; (+) strand; PAM type: NRG; PAM sequence: CAG
ccacagacccaagcagaaag

SEQ ID NO: 124843 - DNA, 20 bp, Artificial Sequence
  Description of Artificial Sequence: Synthetic oligonucleotide
  Target: ATXN1; (+) strand; PAM type: NRG; PAM sequence: AAG
gacccaagcagaaagcagac

SEQ ID NO: 124844 - DNA, 20 bp, Artificial Sequence
  Description of Artificial Sequence: Synthetic oligonucleotide
  Target: ATXN1; (+) strand; PAM type: NRG; PAM sequence: AAG
caagcagaaagcagacaaga

SEQ ID NO: 124845 - DNA, 20 bp, Artificial Sequence
  Description of Artificial Sequence: Synthetic oligonucleotide
  Target: ATXN1; (+) strand; PAM type: NRG; PAM sequence: AGG
aagcagaaagcagacaagaa

SEQ ID NO: 124846 - DNA, 20 bp, Artificial Sequence
  Description of Artificial Sequence: Synthetic oligonucleotide
  Target: ATXN1; (+) strand; PAM type: NRG; PAM sequence: AAG
agaaagcagacaagaaaggc

SEQ ID NO: 124847 - DNA, 20 bp, Artificial Sequence
  Description of Artificial Sequence: Synthetic oligonucleotide
  Target: ATXN1; (+) strand; PAM type: NRG; PAM sequence: CAG
agacaagaaaggcaagatgt

SEQ ID NO: 124848 - DNA, 20 bp, Artificial Sequence
  Description of Artificial Sequence: Synthetic oligonucleotide
  Target: ATXN1; (+) strand; PAM type: NRG; PAM sequence: AGG
gacaagaaaggcaagatgtc

SEQ ID NO: 124849 - DNA, 20 bp, Artificial Sequence
  Description of Artificial Sequence: Synthetic oligonucleotide
  Target: ATXN1; (+) strand; PAM type: NRG; PAM sequence: CAG
tcaggaattctcttctctcc

SEQ ID NO: 124850 - DNA, 20 bp, Artificial Sequence
  Description of Artificial Sequence: Synthetic oligonucleotide
  Target: ATXN1; (+) strand; PAM type: NRG; PAM sequence: TAG
ggaattctcttctctcccag

SEQ ID NO: 124851 - DNA, 20 bp, Artificial Sequence
  Description of Artificial Sequence: Synthetic oligonucleotide
  Target: ATXN1; (+) strand; PAM type: NRG; PAM sequence: TAG
cagtagcatctttcctgttc

SEQ ID NO: 124852 - DNA, 20 bp, Artificial Sequence
  Description of Artificial Sequence: Synthetic oligonucleotide
  Target: ATXN1; (+) strand; PAM type: NRG; PAM sequence: CAG
ttcctgttctagcctaaatg

SEQ ID NO: 124853 - DNA, 20 bp, Artificial Sequence
  Description of Artificial Sequence: Synthetic oligonucleotide
  Target: ATXN1; (+) strand; PAM type: NRG; PAM sequence: AGG
tcctgttctagcctaaatgc

SEQ ID NO: 124854 - DNA, 20 bp, Artificial Sequence
  Description of Artificial Sequence: Synthetic oligonucleotide
  Target: ATXN1; (+) strand; PAM type: NRG; PAM sequence: GGG
cctgttctagcctaaatgca

SEQ ID NO: 124855 - DNA, 20 bp, Artificial Sequence
  Description of Artificial Sequence: Synthetic oligonucleotide
  Target: ATXN1; (+) strand; PAM type: NRG; PAM sequence: GGG
ctgttctagcctaaatgcag

SEQ ID NO: 124856 - DNA, 20 bp, Artificial Sequence
  Description of Artificial Sequence: Synthetic oligonucleotide
  Target: ATXN1; (+) strand; PAM type: NRG; PAM sequence: AAG
tagcctaaatgcaggggaaa

SEQ ID NO: 124857 - DNA, 20 bp, Artificial Sequence
  Description of Artificial Sequence: Synthetic oligonucleotide
  Target: ATXN1; (+) strand; PAM type: NRG; PAM sequence: TGG
aaatgcaggggaaaaagatt

SEQ ID NO: 124858 - DNA, 20 bp, Artificial Sequence
  Description of Artificial Sequence: Synthetic oligonucleotide
  Target: ATXN1; (+) strand; PAM type: NRG; PAM sequence: GGG
aatgcaggggaaaaagattt

SEQ ID NO: 124859 - DNA, 20 bp, Artificial Sequence
  Description of Artificial Sequence: Synthetic oligonucleotide
  Target: ATXN1; (+) strand; PAM type: NRG; PAM sequence: GGG
atgcaggggaaaaagatttg

SEQ ID NO: 124860 - DNA, 20 bp, Artificial Sequence
  Description of Artificial Sequence: Synthetic oligonucleotide
  Target: ATXN1; (+) strand; PAM type: NRG; PAM sequence: GAG
ggggaaaaagatttggggct

SEQ ID NO: 124861 - DNA, 20 bp, Artificial Sequence
  Description of Artificial Sequence: Synthetic oligonucleotide
  Target: ATXN1; (+) strand; PAM type: NRG; PAM sequence: AGG
gggaaaaagatttggggctg

SEQ ID NO: 124862 - DNA, 20 bp, Artificial Sequence
  Description of Artificial Sequence: Synthetic oligonucleotide
  Target: ATXN1; (+) strand; PAM type: NRG; PAM sequence: CAG
gctgaggcacctctgaatcc

SEQ ID NO: 124863 - DNA, 20 bp, Artificial Sequence
  Description of Artificial Sequence: Synthetic oligonucleotide
  Target: ATXN1; (+) strand; PAM type: NRG; PAM sequence: AGG
ctgaggcacctctgaatccc

SEQ ID NO: 124864 - DNA, 20 bp, Artificial Sequence
  Description of Artificial Sequence: Synthetic oligonucleotide
  Target: ATXN1; (+) strand; PAM type: NRG; PAM sequence: GGG
tgaggcacctctgaatccca

SEQ ID NO: 124865 - DNA, 20 bp, Artificial Sequence
  Description of Artificial Sequence: Synthetic oligonucleotide
  Target: ATXN1; (+) strand; PAM type: NRG; PAM sequence: GAG
aggcacctctgaatcccagg

SEQ ID NO: 124866 - DNA, 20 bp, Artificial Sequence
  Description of Artificial Sequence: Synthetic oligonucleotide
  Target: ATXN1; (+) strand; PAM type: NRG; PAM sequence: CAG
cctctgaatcccagggagct

SEQ ID NO: 124867 - DNA, 20 bp, Artificial Sequence
  Description of Artificial Sequence: Synthetic oligonucleotide
  Target: ATXN1; (+) strand; PAM type: NRG; PAM sequence: AGG
ctctgaatcccagggagctc

SEQ ID NO: 124868 - DNA, 20 bp, Artificial Sequence
  Description of Artificial Sequence: Synthetic oligonucleotide
  Target: ATXN1; (+) strand; PAM type: NRG; PAM sequence: GAG
ctgaatcccagggagctcag

SEQ ID NO: 124869 - DNA, 20 bp, Artificial Sequence
  Description of Artificial Sequence: Synthetic oligonucleotide
  Target: ATXN1; (+) strand; PAM type: NRG; PAM sequence: TGG
aggagctcactctgattcct

SEQ ID NO: 124870 - DNA, 20 bp, Artificial Sequence
  Description of Artificial Sequence: Synthetic oligonucleotide
  Target: ATXN1; (+) strand; PAM type: NRG; PAM sequence: GAG
gagctcactctgattccttg

SEQ ID NO: 124871 - DNA, 20 bp, Artificial Sequence
  Description of Artificial Sequence: Synthetic oligonucleotide
  Target: ATXN1; (+) strand; PAM type: NRG; PAM sequence: AAG
actctgattccttggagctg

SEQ ID NO: 124872 - DNA, 20 bp, Artificial Sequence
  Description of Artificial Sequence: Synthetic oligonucleotide
  Target: ATXN1; (+) strand; PAM type: NRG; PAM sequence: GAG
tctgattccttggagctgaa

SEQ ID NO: 124873 - DNA, 20 bp, Artificial Sequence
  Description of Artificial Sequence: Synthetic oligonucleotide
  Target: ATXN1; (+) strand; PAM type: NRG; PAM sequence: AAG
gctgaagagttgctgtgtgc

SEQ ID NO: 124874 - DNA, 20 bp, Artificial Sequence
  Description of Artificial Sequence: Synthetic oligonucleotide
  Target: ATXN1; (+) strand; PAM type: NRG; PAM sequence: CAG
tgctgtgtgcaagctgcaca

SEQ ID NO: 124875 - DNA, 20 bp, Artificial Sequence
  Description of Artificial Sequence: Synthetic oligonucleotide
  Target: ATXN1; (+) strand; PAM type: NRG; PAM sequence: TAG
gtgcaagctgcacacagccg

SEQ ID NO: 124876 - DNA, 20 bp, Artificial Sequence
  Description of Artificial Sequence: Synthetic oligonucleotide
  Target: ATXN1; (+) strand; PAM type: NRG; PAM sequence: TAG
acagccgtagcgtctctcat

SEQ ID NO: 124877 - DNA, 20 bp, Artificial Sequence
  Description of Artificial Sequence: Synthetic oligonucleotide
  Target: ATXN1; (+) strand; PAM type: NRG; PAM sequence: TAG
attagactctcttctaccac

SEQ ID NO: 124878 - DNA, 20 bp, Artificial Sequence
  Description of Artificial Sequence: Synthetic oligonucleotide
  Target: ATXN1; (+) strand; PAM type: NRG; PAM sequence: GAG
tagactctcttctaccacta

SEQ ID NO: 124879 - DNA, 20 bp, Artificial Sequence
  Description of Artificial Sequence: Synthetic oligonucleotide
  Target: ATXN1; (+) strand; PAM type: NRG; PAM sequence: CAG
ctctcttctaccactagagc

SEQ ID NO: 124880 - DNA, 20 bp, Artificial Sequence
  Description of Artificial Sequence: Synthetic oligonucleotide
  Target: ATXN1; (+) strand; PAM type: NRG; PAM sequence: AGG
tctcttctaccactagagcc

SEQ ID NO: 124881 - DNA, 20 bp, Artificial Sequence
  Description of Artificial Sequence: Synthetic oligonucleotide
  Target: ATXN1; (+) strand; PAM type: NRG; PAM sequence: CAG
cttctaccactagagccagg

SEQ ID NO: 124882 - DNA, 20 bp, Artificial Sequence
  Description of Artificial Sequence: Synthetic oligonucleotide
  Target: ATXN1; (+) strand; PAM type: NRG; PAM sequence: AAG
actagagccaggcagctatg

SEQ ID NO: 124883 - DNA, 20 bp, Artificial Sequence
  Description of Artificial Sequence: Synthetic oligonucleotide
  Target: ATXN1; (+) strand; PAM type: NRG; PAM sequence: GAG
tagagccaggcagctatgaa

SEQ ID NO: 124884 - DNA, 20 bp, Artificial Sequence
  Description of Artificial Sequence: Synthetic oligonucleotide
  Target: ATXN1; (+) strand; PAM type: NRG; PAM sequence: CAG
gctatgaagagtgacatgac

SEQ ID NO: 124885 - DNA, 20 bp, Artificial Sequence
  Description of Artificial Sequence: Synthetic oligonucleotide
  Target: ATXN1; (+) strand; PAM type: NRG; PAM sequence: CAG
tgaagagtgacatgaccagc

SEQ ID NO: 124886 - DNA, 20 bp, Artificial Sequence
  Description of Artificial Sequence: Synthetic oligonucleotide
  Target: ATXN1; (+) strand; PAM type: NRG; PAM sequence: CAG
gtgacatgaccagccagccc

SEQ ID NO: 124887 - DNA, 20 bp, Artificial Sequence
  Description of Artificial Sequence: Synthetic oligonucleotide
  Target: ATXN1; (+) strand; PAM type: NRG; PAM sequence: AAG
catgaccagccagccccaga

SEQ ID NO: 124888 - DNA, 20 bp, Artificial Sequence
  Description of Artificial Sequence: Synthetic oligonucleotide
  Target: ATXN1; (+) strand; PAM type: NRG; PAM sequence: CGG
gccagccccagaaagcaaaa

SEQ ID NO: 124889 - DNA, 20 bp, Artificial Sequence
  Description of Artificial Sequence: Synthetic oligonucleotide
  Target: ATXN1; (+) strand; PAM type: NRG; PAM sequence: GGG
ccagccccagaaagcaaaac

SEQ ID NO: 124890 - DNA, 20 bp, Artificial Sequence
  Description of Artificial Sequence: Synthetic oligonucleotide
  Target: ATXN1; (+) strand; PAM type: NRG; PAM sequence: CAG
gcctcctctcgcccatcaaa

SEQ ID NO: 124891 - DNA, 20 bp, Artificial Sequence
  Description of Artificial Sequence: Synthetic oligonucleotide
  Target: ATXN1; (+) strand; PAM type: NRG; PAM sequence: TGG
caaaactgactccctcttgt

SEQ ID NO: 124892 - DNA, 20 bp, Artificial Sequence
  Description of Artificial Sequence: Synthetic oligonucleotide
  Target: ATXN1; (+) strand; PAM type: NRG; PAM sequence: AAG
ctccctcttgttggatcaca

SEQ ID NO: 124893 - DNA, 20 bp, Artificial Sequence
  Description of Artificial Sequence: Synthetic oligonucleotide
  Target: ATXN1; (+) strand; PAM type: NRG; PAM sequence: GAG
ccctcttgttggatcacaaa

SEQ ID NO: 124894 - DNA, 20 bp, Artificial Sequence
  Description of Artificial Sequence: Synthetic oligonucleotide
  Target: ATXN1; (+) strand; PAM type: NRG; PAM sequence: AAG
cttgttggatcacaaagagc

SEQ ID NO: 124895 - DNA, 20 bp, Artificial Sequence
  Description of Artificial Sequence: Synthetic oligonucleotide
  Target: ATXN1; (+) strand; PAM type: NRG; PAM sequence: CAG
aagagcaagaacgcaatgtg

SEQ ID NO: 124896 - DNA, 20 bp, Artificial Sequence
  Description of Artificial Sequence: Synthetic oligonucleotide
  Target: ATXN1; (+) strand; PAM type: NRG; PAM sequence: TAG
agcaagaacgcaatgtgcag

SEQ ID NO: 124897 - DNA, 20 bp, Artificial Sequence
  Description of Artificial Sequence: Synthetic oligonucleotide
  Target: ATXN1; (+) strand; PAM type: NRG; PAM sequence: TGG
cgcaatgtgcagtagccttg

SEQ ID NO: 124898 - DNA, 20 bp, Artificial Sequence
  Description of Artificial Sequence: Synthetic oligonucleotide
  Target: ATXN1; (+) strand; PAM type: NRG; PAM sequence: GAG
caatgtgcagtagccttgtg

SEQ ID NO: 124899 - DNA, 20 bp, Artificial Sequence
  Description of Artificial Sequence: Synthetic oligonucleotide
  Target: ATXN1; (+) strand; PAM type: NRG; PAM sequence: AAG
gccttgtggagcttaaaaaa

SEQ ID NO: 124900 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaagaaaaacaaaaa

SEQ ID NO: 124901 - DNA, 20 bp, Artificial Sequence
  Description of Artificial Sequence: Synthetic oligonucleotide
  Target: ATXN1; (+) strand; PAM type: NRG; PAM sequence: CAG
gaaaaacaaaaaaagactgt

SEQ ID NO: 124902 - DNA, 20 bp, Artificial Sequence
  Description of Artificial Sequence: Synthetic oligonucleotide
  Target: ATXN1; (+) strand; PAM type: NRG; PAM sequence: AAG
aaaaaagactgtcagcttgc

SEQ ID NO: 124903 - DNA, 20 bp, Artificial Sequence
  Description of Artificial Sequence: Synthetic oligonucleotide
  Target: ATXN1; (+) strand; PAM type: NRG; PAM sequence: CGG
cttgcaagaattttaccaac

SEQ ID NO: 124904 - DNA, 20 bp, Artificial Sequence
  Description of Artificial Sequence: Synthetic oligonucleotide
  Target: ATXN1; (+) strand; PAM type: NRG; PAM sequence: AAG
caagaattttaccaaccggc

SEQ ID NO: 124905 - DNA, 20 bp, Artificial Sequence
  Description of Artificial Sequence: Synthetic oligonucleotide
  Target: ATXN1; (+) strand; PAM type: NRG; PAM sequence: CAG
agacattacccctcatgtcc

SEQ ID NO: 124906 - DNA, 20 bp, Artificial Sequence
  Description of Artificial Sequence: Synthetic oligonucleotide
  Target: ATXN1; (+) strand; PAM type: NRG; PAM sequence: GAG
acattacccctcatgtccca

SEQ ID NO: 124907 - DNA, 20 bp, Artificial Sequence
  Description of Artificial Sequence: Synthetic oligonucleotide
  Target: ATXN1; (+) strand; PAM type: NRG; PAM sequence: TAG
cccctcatgtcccagagcca

SEQ ID NO: 124908 - DNA, 20 bp, Artificial Sequence
  Description of Artificial Sequence: Synthetic oligonucleotide
  Target: ATXN1; (+) strand; PAM type: NRG; PAM sequence: AGG
ccctcatgtcccagagccat

SEQ ID NO: 124909 - DNA, 20 bp, Artificial Sequence
  Description of Artificial Sequence: Synthetic oligonucleotide
  Target: ATXN1; (+) strand; PAM type: NRG; PAM sequence: GGG
cctcatgtcccagagccata

SEQ ID NO: 124910 - DNA, 20 bp, Artificial Sequence
  Description of Artificial Sequence: Synthetic oligonucleotide
  Target: ATXN1; (+) strand; PAM type: NRG; PAM sequence: GAG
tcatgtcccagagccatagg

SEQ ID NO: 124911 - DNA, 20 bp, Artificial Sequence
  Description of Artificial Sequence: Synthetic oligonucleotide
  Target: ATXN1; (+) strand; PAM type: NRG; PAM sequence: AGG
catgtcccagagccataggg

SEQ ID NO: 124912 - DNA, 20 bp, Artificial Sequence
  Description of Artificial Sequence: Synthetic oligonucleotide
  Target: ATXN1; (+) strand; PAM type: NRG; PAM sequence: GAG
gccatagggaggctgcgtct

SEQ ID NO: 124913 - DNA, 20 bp, Artificial Sequence
  Description of Artificial Sequence: Synthetic oligonucleotide
  Target: ATXN1; (+) strand; PAM type: NRG; PAM sequence: GAG
catagggaggctgcgtctga

SEQ ID NO: 124914 - DNA, 20 bp, Artificial Sequence
  Description of Artificial Sequence: Synthetic oligonucleotide
  Target: ATXN1; (+) strand; PAM type: NRG; PAM sequence: GAG
gggaggctgcgtctgagagc

SEQ ID NO: 124915 - DNA, 20 bp, Artificial Sequence
  Description of Artificial Sequence: Synthetic oligonucleotide
  Target: ATXN1; (+) strand; PAM type: NRG; PAM sequence: AGG
ggaggctgcgtctgagagcg

SEQ ID NO: 124916 - DNA, 20 bp, Artificial Sequence
  Description of Artificial Sequence: Synthetic oligonucleotide
  Target: ATXN1; (+) strand; PAM type: NRG; PAM sequence: CAG
cgtctgagagcgaggcacac

SEQ ID NO: 124917 - DNA, 20 bp, Artificial Sequence
  Description of Artificial Sequence: Synthetic oligonucleotide
  Target: ATXN1; (+) strand; PAM type: NRG; PAM sequence: CAG
ctgagagcgaggcacaccag

SEQ ID NO: 124918 - DNA, 20 bp, Artificial Sequence
  Description of Artificial Sequence: Synthetic oligonucleotide
  Target: ATXN1; (+) strand; PAM type: NRG; PAM sequence: AGG
tgagagcgaggcacaccagc

SEQ ID NO: 124919 - DNA, 20 bp, Artificial Sequence
  Description of Artificial Sequence: Synthetic oligonucleotide
  Target: ATXN1; (+) strand; PAM type: NRG; PAM sequence: GAG
agagcgaggcacaccagcag

SEQ ID NO: 124920 - DNA, 20 bp, Artificial Sequence
  Description of Artificial Sequence: Synthetic oligonucleotide
  Target: ATXN1; (+) strand; PAM type: NRG; PAM sequence: GAG
agcgaggcacaccagcagga

SEQ ID NO: 124921 - DNA, 20 bp, Artificial Sequence
  Description of Artificial Sequence: Synthetic oligonucleotide
  Target: ATXN1; (+) strand; PAM type: NRG; PAM sequence: GAG
cgaggcacaccagcaggaga

SEQ ID NO: 124922 - DNA, 20 bp, Artificial Sequence
  Description of Artificial Sequence: Synthetic oligonucleotide
  Target: ATXN1; (+) strand; PAM type: NRG; PAM sequence: CAG
gcacaccagcaggagagaga

SEQ ID NO: 124923 - DNA, 20 bp, Artificial Sequence
  Description of Artificial Sequence: Synthetic oligonucleotide
  Target: ATXN1; (+) strand; PAM type: NRG; PAM sequence: TGG
caggagagagacagttctca

SEQ ID NO: 124924 - DNA, 20 bp, Artificial Sequence
  Description of Artificial Sequence: Synthetic oligonucleotide
  Target: ATXN1; (+) strand; PAM type: NRG; PAM sequence: GGG
aggagagagacagttctcat

SEQ ID NO: 124925 - DNA, 20 bp, Artificial Sequence
  Description of Artificial Sequence: Synthetic oligonucleotide
  Target: ATXN1; (+) strand; PAM type: NRG; PAM sequence: TGG
agagagacagttctcatggg

SEQ ID NO: 124926 - DNA, 20 bp, Artificial Sequence
  Description of Artificial Sequence: Synthetic oligonucleotide
  Target: ATXN1; (+) strand; PAM type: NRG; PAM sequence: TGG
agacagttctcatgggtgga

SEQ ID NO: 124927 - DNA, 20 bp, Artificial Sequence
  Description of Artificial Sequence: Synthetic oligonucleotide
  Target: ATXN1; (+) strand; PAM type: NRG; PAM sequence: CAG
ggtgaaccctctcttatcaa

SEQ ID NO: 124928 - DNA, 20 bp, Artificial Sequence
  Description of Artificial Sequence: Synthetic oligonucleotide
  Target: ATXN1; (+) strand; PAM type: NRG; PAM sequence: TAG
aaccctctcttatcaacagc

SEQ ID NO: 124929 - DNA, 20 bp, Artificial Sequence
  Description of Artificial Sequence: Synthetic oligonucleotide
  Target: ATXN1; (+) strand; PAM type: NRG; PAM sequence: CAG
ctcttatcaacagctagact

SEQ ID NO: 124930 - DNA, 20 bp, Artificial Sequence
  Description of Artificial Sequence: Synthetic oligonucleotide
  Target: ATXN1; (+) strand; PAM type: NRG; PAM sequence: TAG
tcaaaccattttatctccac

SEQ ID NO: 124931 - DNA, 20 bp, Artificial Sequence
  Description of Artificial Sequence: Synthetic oligonucleotide
  Target: ATXN1; (+) strand; PAM type: NRG; PAM sequence: GAG
aaaccattttatctccacta

SEQ ID NO: 124932 - DNA, 20 bp, Artificial Sequence
  Description of Artificial Sequence: Synthetic oligonucleotide
  Target: ATXN1; (+) strand; PAM type: NRG; PAM sequence: AGG
aaccattttatctccactag

SEQ ID NO: 124933 - DNA, 20 bp, Artificial Sequence
  Description of Artificial Sequence: Synthetic oligonucleotide
  Target: ATXN1; (+) strand; PAM type: NRG; PAM sequence: GGG
accattttatctccactaga

SEQ ID NO: 124934 - DNA, 20 bp, Artificial Sequence
  Description of Artificial Sequence: Synthetic oligonucleotide
  Target: ATXN1; (+) strand; PAM type: NRG; PAM sequence: CAG
ttttatctccactagagggc

SEQ ID NO: 124935 - DNA, 20 bp, Artificial Sequence
  Description of Artificial Sequence: Synthetic oligonucleotide
  Target: ATXN1; (+) strand; PAM type: NRG; PAM sequence: AGG
tttatctccactagagggcc

SEQ ID NO: 124936 - DNA, 20 bp, Artificial Sequence
  Description of Artificial Sequence: Synthetic oligonucleotide
  Target: ATXN1; (+) strand; PAM type: NRG; PAM sequence: TGG
tctccactagagggccagga

SEQ ID NO: 124937 - DNA, 20 bp, Artificial Sequence
  Description of Artificial Sequence: Synthetic oligonucleotide
  Target: ATXN1; (+) strand; PAM type: NRG; PAM sequence: GAG
tccactagagggccaggatg

SEQ ID NO: 124938 - DNA, 20 bp, Artificial Sequence
  Description of Artificial Sequence: Synthetic oligonucleotide
  Target: ATXN1; (+) strand; PAM type: NRG; PAM sequence: CAG
ccaggatggagatgaaattt

SEQ ID NO: 124939 - DNA, 20 bp, Artificial Sequence
  Description of Artificial Sequence: Synthetic oligonucleotide
  Target: ATXN1; (+) strand; PAM type: NRG; PAM sequence: TGG
atggagatgaaatttcagcc

SEQ ID NO: 124940 - DNA, 20 bp, Artificial Sequence
  Description of Artificial Sequence: Synthetic oligonucleotide
  Target: ATXN1; (+) strand; PAM type: NRG; PAM sequence: CAG
gagatgaaatttcagcctgg

SEQ ID NO: 124941 - DNA, 20 bp, Artificial Sequence
  Description of Artificial Sequence: Synthetic oligonucleotide
  Target: ATXN1; (+) strand; PAM type: NRG; PAM sequence: AAG
ggcagttttgctgctgattt

SEQ ID NO: 124942 - DNA, 20 bp, Artificial Sequence
  Description of Artificial Sequence: Synthetic oligonucleotide
  Target: ATXN1; (+) strand; PAM type: NRG; PAM sequence: TGG
taagatttgatcctaaacct

SEQ ID NO: 124943 - DNA, 20 bp, Artificial Sequence
  Description of Artificial Sequence: Synthetic oligonucleotide
  Target: ATXN1; (+) strand; PAM type: NRG; PAM sequence: GGG
aagatttgatcctaaacctt

SEQ ID NO: 124944 - DNA, 20 bp, Artificial Sequence
  Description of Artificial Sequence: Synthetic oligonucleotide
  Target: ATXN1; (+) strand; PAM type: NRG; PAM sequence: GGG
agatttgatcctaaaccttg

SEQ ID NO: 124945 - DNA, 20 bp, Artificial Sequence
  Description of Artificial Sequence: Synthetic oligonucleotide
  Target: ATXN1; (+) strand; PAM type: NRG; PAM sequence: GAG
atttgatcctaaaccttggg

SEQ ID NO: 124946 - DNA, 20 bp, Artificial Sequence
  Description of Artificial Sequence: Synthetic oligonucleotide
  Target: ATXN1; (+) strand; PAM type: NRG; PAM sequence: AGG
tttgatcctaaaccttgggg

SEQ ID NO: 124947 - DNA, 20 bp, Artificial Sequence
  Description of Artificial Sequence: Synthetic oligonucleotide
  Target: ATXN1; (+) strand; PAM type: NRG; PAM sequence: GGG
ttgatcctaaaccttgggga

SEQ ID NO: 124948 - DNA, 20 bp, Artificial Sequence
  Description of Artificial Sequence: Synthetic oligonucleotide
  Target: ATXN1; (+) strand; PAM type: NRG; PAM sequence: GAG
gatcctaaaccttggggagg

SEQ ID NO: 124949 - DNA, 20 bp, Artificial Sequence
  Description of Artificial Sequence: Synthetic oligonucleotide
  Target: ATXN1; (+) strand; PAM type: NRG; PAM sequence: AGG
atcctaaaccttggggaggg

SEQ ID NO: 124950 - DNA, 20 bp, Artificial Sequence
  Description of Artificial Sequence: Synthetic oligonucleotide
  Target: ATXN1; (+) strand; PAM type: NRG; PAM sequence: GGG
tcctaaaccttggggaggga

SEQ ID NO: 124951 - DNA, 20 bp, Artificial Sequence
  Description of Artificial Sequence: Synthetic oligonucleotide
  Target: ATXN1; (+) strand; PAM type: NRG; PAM sequence: AAG
ccttggggagggagggctcg

SEQ ID NO: 124952 - DNA, 20 bp, Artificial Sequence
  Description of Artificial Sequence: Synthetic oligonucleotide
  Target: ATXN1; (+) strand; PAM type: NRG; PAM sequence: AGG
cttggggagggagggctcga

SEQ ID NO: 124953 - DNA, 20 bp, Artificial Sequence
  Description of Artificial Sequence: Synthetic oligonucleotide
  Target: ATXN1; (+) strand; PAM type: NRG; PAM sequence: AAG
ggggagggagggctcgaagg

SEQ ID NO: 124954 - DNA, 20 bp, Artificial Sequence
  Description of Artificial Sequence: Synthetic oligonucleotide
  Target: ATXN1; (+) strand; PAM type: NRG; PAM sequence: AGG
gggagggagggctcgaagga

SEQ ID NO: 124955 - DNA, 20 bp, Artificial Sequence
  Description of Artificial Sequence: Synthetic oligonucleotide
  Target: ATXN1; (+) strand; PAM type: NRG; PAM sequence: GGG
ggagggagggctcgaaggaa

SEQ ID NO: 124956 - DNA, 20 bp, Artificial Sequence
  Description of Artificial Sequence: Synthetic oligonucleotide
  Target: ATXN1; (+) strand; PAM type: NRG; PAM sequence: GAG
agggagggctcgaaggaagg

SEQ ID NO: 124957 - DNA, 20 bp, Artificial Sequence
  Description of Artificial Sequence: Synthetic oligonucleotide
  Target: ATXN1; (+) strand; PAM type: NRG; PAM sequence: AGG
gggagggctcgaaggaaggg

SEQ ID NO: 124958 - DNA, 20 bp, Artificial Sequence
  Description of Artificial Sequence: Synthetic oligonucleotide
  Target: ATXN1; (+) strand; PAM type: NRG; PAM sequence: TGG
agggctcgaaggaagggagg

SEQ ID NO: 124959 - DNA, 20 bp, Artificial Sequence
  Description of Artificial Sequence: Synthetic oligonucleotide
  Target: ATXN1; (+) strand; PAM type: NRG; PAM sequence: GGG
gggctcgaaggaagggaggt

SEQ ID NO: 124960 - DNA, 20 bp, Artificial Sequence
  Description of Artificial Sequence: Synthetic oligonucleotide
  Target: ATXN1; (+) strand; PAM type: NRG; PAM sequence: GGG
ggctcgaaggaagggaggtg

SEQ ID NO: 124961 - DNA, 20 bp, Artificial Sequence
  Description of Artificial Sequence: Synthetic oligonucleotide
  Target: ATXN1; (+) strand; PAM type: NRG; PAM sequence: AAG
gaaggaagggaggtggggtt

SEQ ID NO: 124962 - DNA, 20 bp, Artificial Sequence
  Description of Artificial Sequence: Synthetic oligonucleotide
  Target: ATXN1; (+) strand; PAM type: NRG; PAM sequence: AGG
aaggaagggaggtggggtta

SEQ ID NO: 124963 - DNA, 20 bp, Artificial Sequence
  Description of Artificial Sequence: Synthetic oligonucleotide
  Target: ATXN1; (+) strand; PAM type: NRG; PAM sequence: CAG
gaggtggggttaaggcaact

SEQ ID NO: 124964 - DNA, 20 bp, Artificial Sequence
  Description of Artificial Sequence: Synthetic oligonucleotide
  Target: ATXN1; (+) strand; PAM type: NRG; PAM sequence: TGG
aggcaactcagatactcacg

SEQ ID NO: 124965 - DNA, 20 bp, Artificial Sequence
  Description of Artificial Sequence: Synthetic oligonucleotide
  Target: ATXN1; (+) strand; PAM type: NRG; PAM sequence: GGG
ggcaactcagatactcacgt

SEQ ID NO: 124966 - DNA, 20 bp, Artificial Sequence
  Description of Artificial Sequence: Synthetic oligonucleotide
  Target: ATXN1; (+) strand; PAM type: NRG; PAM sequence: TGG
gatactcacgtgggcatatc

SEQ ID NO: 124967 - DNA, 20 bp, Artificial Sequence
  Description of Artificial Sequence: Synthetic oligonucleotide
  Target: ATXN1; (+) strand; PAM type: NRG; PAM sequence: GGG
atactcacgtgggcatatct

SEQ ID NO: 124968 - DNA, 20 bp, Artificial Sequence
  Description of Artificial Sequence: Synthetic oligonucleotide
  Target: ATXN1; (+) strand; PAM type: NRG; PAM sequence: CAG
acgtgggcatatctgggtcc

SEQ ID NO: 124969 - DNA, 20 bp, Artificial Sequence
  Description of Artificial Sequence: Synthetic oligonucleotide
  Target: ATXN1; (+) strand; PAM type: NRG; PAM sequence: AGG
cgtgggcatatctgggtccc

SEQ ID NO: 124970 - DNA, 20 bp, Artificial Sequence
  Description of Artificial Sequence: Synthetic oligonucleotide
  Target: ATXN1; (+) strand; PAM type: NRG; PAM sequence: TGG
tctgggtcccaggcaatccc

SEQ ID NO: 124971 - DNA, 20 bp, Artificial Sequence
  Description of Artificial Sequence: Synthetic oligonucleotide
  Target: ATXN1; (+) strand; PAM type: NRG; PAM sequence: GGG
ctgggtcccaggcaatccct

SEQ ID NO: 124972 - DNA, 20 bp, Artificial Sequence
  Description of Artificial Sequence: Synthetic oligonucleotide
  Target: ATXN1; (+) strand; PAM type: NRG; PAM sequence: CAG
gcaatccctgggttctgcca

SEQ ID NO: 124973 - DNA, 20 bp, Artificial Sequence
  Description of Artificial Sequence: Synthetic oligonucleotide
  Target: ATXN1; (+) strand; PAM type: NRG; PAM sequence: AGG
caatccctgggttctgccac

SEQ ID NO: 124974 - DNA, 20 bp, Artificial Sequence
  Description of Artificial Sequence: Synthetic oligonucleotide
  Target: ATXN1; (+) strand; PAM type: NRG; PAM sequence: TGG
gccacaggctctctatctca

SEQ ID NO: 124975 - DNA, 20 bp, Artificial Sequence
  Description of Artificial Sequence: Synthetic oligonucleotide
  Target: ATXN1; (+) strand; PAM type: NRG; PAM sequence: GGG
ccacaggctctctatctcat

SEQ ID NO: 124976 - DNA, 20 bp, Artificial Sequence
  Description of Artificial Sequence: Synthetic oligonucleotide
  Target: ATXN1; (+) strand; PAM type: NRG; PAM sequence: CGG
tgttattaaaataatatcca

SEQ ID NO: 124977 - DNA, 20 bp, Artificial Sequence
  Description of Artificial Sequence: Synthetic oligonucleotide
  Target: ATXN1; (+) strand; PAM type: NRG; PAM sequence: TGG
aaataatatccacggcactt

SEQ ID NO: 124978 - DNA, 20 bp, Artificial Sequence
  Description of Artificial Sequence: Synthetic oligonucleotide
  Target: ATXN1; (+) strand; PAM type: NRG; PAM sequence: GGG
aataatatccacggcacttt

SEQ ID NO: 124979 - DNA, 20 bp, Artificial Sequence
  Description of Artificial Sequence: Synthetic oligonucleotide
  Target: ATXN1; (+) strand; PAM type: NRG; PAM sequence: GAG
taatatccacggcactttgg

SEQ ID NO: 124980 - DNA, 20 bp, Artificial Sequence
  Description of Artificial Sequence: Synthetic oligonucleotide
  Target: ATXN1; (+) strand; PAM type: NRG; PAM sequence: AGG
aatatccacggcactttggg

SEQ ID NO: 124981 - DNA, 20 bp, Artificial Sequence
  Description of Artificial Sequence: Synthetic oligonucleotide
  Target: ATXN1; (+) strand; PAM type: NRG; PAM sequence: AAG
ccacggcactttgggaggcc

SEQ ID NO: 124982 - DNA, 20 bp, Artificial Sequence
  Description of Artificial Sequence: Synthetic oligonucleotide
  Target: ATXN1; (+) strand; PAM type: NRG; PAM sequence: AGG
cacggcactttgggaggcca

SEQ ID NO: 124983 - DNA, 20 bp, Artificial Sequence
  Description of Artificial Sequence: Synthetic oligonucleotide
  Target: ATXN1; (+) strand; PAM type: NRG; PAM sequence: TGG
ggcactttgggaggccaagg

SEQ ID NO: 124984 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccaaggt

SEQ ID NO: 124985 - DNA, 20 bp, Artificial Sequence
  Description of Artificial Sequence: Synthetic oligonucleotide
  Target: ATXN1; (+) strand; PAM type: NRG; PAM sequence: CAG
ctttgggaggccaaggtggg

SEQ ID NO: 124986 - DNA, 20 bp, Artificial Sequence
  Description of Artificial Sequence: Synthetic oligonucleotide
  Target: ATXN1; (+) strand; PAM type: NRG; PAM sequence: GAG
ggccaaggtgggcagatcac

SEQ ID NO: 124987 - DNA, 20 bp, Artificial Sequence
  Description of Artificial Sequence: Synthetic oligonucleotide
  Target: ATXN1; (+) strand; PAM type: NRG; PAM sequence: AGG
gccaaggtgggcagatcacg

SEQ ID NO: 124988 - DNA, 20 bp, Artificial Sequence
  Description of Artificial Sequence: Synthetic oligonucleotide
  Target: ATXN1; (+) strand; PAM type: NRG; PAM sequence: AAG
ggtgggcagatcacgaggtc

SEQ ID NO: 124989 - DNA, 20 bp, Artificial Sequence
  Description of Artificial Sequence: Synthetic oligonucleotide
  Target: ATXN1; (+) strand; PAM type: NRG; PAM sequence: GAG
tgggcagatcacgaggtcaa

SEQ ID NO: 124990 - DNA, 20 bp, Artificial Sequence
  Description of Artificial Sequence: Synthetic oligonucleotide
  Target: ATXN1; (+) strand; PAM type: NRG; PAM sequence: GAG
gatcacgaggtcaagagatc

SEQ ID NO: 124991 - DNA, 20 bp, Artificial Sequence
  Description of Artificial Sequence: Synthetic oligonucleotide
  Target: ATXN1; (+) strand; PAM type: NRG; PAM sequence: CAG
cgaggtcaagagatcgagac

SEQ ID NO: 124992 - DNA, 20 bp, Artificial Sequence
  Description of Artificial Sequence: Synthetic oligonucleotide
  Target: ATXN1; (+) strand; PAM type: NRG; PAM sequence: TGG
tcaagagatcgagaccagcc

SEQ ID NO: 124993 - DNA, 20 bp, Artificial Sequence
  Description of Artificial Sequence: Synthetic oligonucleotide
  Target: ATXN1; (+) strand; PAM type: NRG; PAM sequence: TGG
cgagaccagcctggccaaca

SEQ ID NO: 124994 - DNA, 20 bp, Artificial Sequence
  Description of Artificial Sequence: Synthetic oligonucleotide
  Target: ATXN1; (+) strand; PAM type: NRG; PAM sequence: TAG
ctactaaaaatacaaaaaat

SEQ ID NO: 124995 - DNA, 20 bp, Artificial Sequence
  Description of Artificial Sequence: Synthetic oligonucleotide
  Target: ATXN1; (+) strand; PAM type: NRG; PAM sequence: CAG
taaaaatacaaaaaattagc

SEQ ID NO: 124996 - DNA, 20 bp, Artificial Sequence
  Description of Artificial Sequence: Synthetic oligonucleotide
  Target: ATXN1; (+) strand; PAM type: NRG; PAM sequence: AGG
aaaaatacaaaaaattagcc

SEQ ID NO: 124997 - DNA, 20 bp, Artificial Sequence
  Description of Artificial Sequence: Synthetic oligonucleotide
  Target: ATXN1; (+) strand; PAM type: NRG; PAM sequence: TGG
tacaaaaaattagccaggcg

SEQ ID NO: 124998 - DNA, 20 bp, Artificial Sequence
  Description of Artificial Sequence: Synthetic oligonucleotide
  Target: ATXN1; (+) strand; PAM type: NRG; PAM sequence: TGG
aaaaaattagccaggcgtgg

SEQ ID NO: 124999 - DNA, 20 bp, Artificial Sequence
  Description of Artificial Sequence: Synthetic oligonucleotide
  Target: ATXN1; (+) strand; PAM type: NRG; PAM sequence: TGG
aaattagccaggcgtggtgg

SEQ ID NO: 125000 - DNA, 20 bp, Artificial Sequence
  Description of Artificial Sequence: Synthetic oligonucleotide
  Target: ATXN1; (+) strand; PAM type: NRG; PAM sequence: GGG
aattagccaggcgtggtggt

SEQ ID NO: 125001 - DNA, 20 bp, Artificial Sequence
  Description of Artificial Sequence: Synthetic oligonucleotide
  Target: ATXN1; (+) strand; PAM type: NRG; PAM sequence: GAG
ttagccaggcgtggtggtgg

SEQ ID NO: 125002 - DNA, 20 bp, Artificial Sequence
  Description of Artificial Sequence: Synthetic oligonucleotide
  Target: ATXN1; (+) strand; PAM type: NRG; PAM sequence: AGG
tagccaggcgtggtggtggg

SEQ ID NO: 125003 - DNA, 20 bp, Artificial Sequence
  Description of Artificial Sequence: Synthetic oligonucleotide
  Target: ATXN1; (+) strand; PAM type: NRG; PAM sequence: CAG
gtggtgggaggctgtaatcc

SEQ ID NO: 125004 - DNA, 20 bp, Artificial Sequence
  Description of Artificial Sequence: Synthetic oligonucleotide
  Target: ATXN1; (+) strand; PAM type: NRG; PAM sequence: TGG
aggctgtaatcccagctact

SEQ ID NO: 125005 - DNA, 20 bp, Artificial Sequence
  Description of Artificial Sequence: Synthetic oligonucleotide
  Target: ATXN1; (+) strand; PAM type: NRG; PAM sequence: GGG
ggctgtaatcccagctactt

SEQ ID NO: 125006 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctacttgg

SEQ ID NO: 125007 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctacttggg

SEQ ID NO: 125008 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttgggaggct

SEQ ID NO: 125009 - DNA, 20 bp, Artificial Sequence
  Description of Artificial Sequence: Synthetic oligonucleotide
  Target: ATXN1; (+) strand; PAM type: NRG; PAM sequence: AGG
cccagctacttgggaggctg

SEQ ID NO: 125010 - DNA, 20 bp, Artificial Sequence
  Description of Artificial Sequence: Synthetic oligonucleotide
  Target: ATXN1; (+) strand; PAM type: NRG; PAM sequence: CAG
agctacttgggaggctgagg

SEQ ID NO: 125011 - DNA, 20 bp, Artificial Sequence
  Description of Artificial Sequence: Synthetic oligonucleotide
  Target: ATXN1; (+) strand; PAM type: NRG; PAM sequence: AGG
gctacttgggaggctgaggc

SEQ ID NO: 125012 - DNA, 20 bp, Artificial Sequence
  Description of Artificial Sequence: Synthetic oligonucleotide
  Target: ATXN1; (+) strand; PAM type: NRG; PAM sequence: CGG
gcaggtgaatcacttgaacc

SEQ ID NO: 125013 - DNA, 20 bp, Artificial Sequence
  Description of Artificial Sequence: Synthetic oligonucleotide
  Target: ATXN1; (+) strand; PAM type: NRG; PAM sequence: GGG
caggtgaatcacttgaaccc

SEQ ID NO: 125014 - DNA, 20 bp, Artificial Sequence
  Description of Artificial Sequence: Synthetic oligonucleotide
  Target: ATXN1; (+) strand; PAM type: NRG; PAM sequence: GAG
ggtgaatcacttgaacccgg

SEQ ID NO: 125015 - DNA, 20 bp, Artificial Sequence
  Description of Artificial Sequence: Synthetic oligonucleotide
  Target: ATXN1; (+) strand; PAM type: NRG; PAM sequence: AGG
gtgaatcacttgaacccggg

SEQ ID NO: 125016 - DNA, 20 bp, Artificial Sequence
  Description of Artificial Sequence: Synthetic oligonucleotide
  Target: ATXN1; (+) strand; PAM type: NRG; PAM sequence: CAG
aatcacttgaacccgggagg

SEQ ID NO: 125017 - DNA, 20 bp, Artificial Sequence
  Description of Artificial Sequence: Synthetic oligonucleotide
  Target: ATXN1; (+) strand; PAM type: NRG; PAM sequence: GAG
tcacttgaacccgggaggca

SEQ ID NO: 125018 - DNA, 20 bp, Artificial Sequence
  Description of Artificial Sequence: Synthetic oligonucleotide
  Target: ATXN1; (+) strand; PAM type: NRG; PAM sequence: AGG
cacttgaacccgggaggcag

SEQ ID NO: 125019 - DNA, 20 bp, Artificial Sequence
  Description of Artificial Sequence: Synthetic oligonucleotide
  Target: ATXN1; (+) strand; PAM type: NRG; PAM sequence: CAG
aacccgggaggcagaggttg

SEQ ID NO: 125020 - DNA, 20 bp, Artificial Sequence
  Description of Artificial Sequence: Synthetic oligonucleotide
  Target: ATXN1; (+) strand; PAM type: NRG; PAM sequence: GAG
cgggaggcagaggttgcagt

SEQ ID NO: 125021 - DNA, 20 bp, Artificial Sequence
  Description of Artificial Sequence: Synthetic oligonucleotide
  Target: ATXN1; (+) strand; PAM type: NRG; PAM sequence: GAG
ggcagaggttgcagtgagcc

SEQ ID NO: 125022 - DNA, 20 bp, Artificial Sequence
  Description of Artificial Sequence: Synthetic oligonucleotide
  Target: ATXN1; (+) strand; PAM type: NRG; PAM sequence: CAG
gagatcacgccactgcactc

SEQ ID NO: 125023 - DNA, 20 bp, Artificial Sequence
  Description of Artificial Sequence: Synthetic oligonucleotide
  Target: ATXN1; (+) strand; PAM type: NRG; PAM sequence: TGG
cacgccactgcactccagcc

SEQ ID NO: 125024 - DNA, 20 bp, Artificial Sequence
  Description of Artificial Sequence: Synthetic oligonucleotide
  Target: ATXN1; (+) strand; PAM type: NRG; PAM sequence: CAG
actgcactccagcctggcga

SEQ ID NO: 125025 - DNA, 20 bp, Artificial Sequence
  Description of Artificial Sequence: Synthetic oligonucleotide
  Target: ATXN1; (+) strand; PAM type: NRG; PAM sequence: GAG
tgcactccagcctggcgaca

SEQ ID NO: 125026 - DNA, 20 bp, Artificial Sequence
  Description of Artificial Sequence: Synthetic oligonucleotide
  Target: ATXN1; (+) strand; PAM type: NRG; PAM sequence: GAG
ctccagcctggcgacagagc

SEQ ID NO: 125027 - DNA, 20 bp, Artificial Sequence
  Description of Artificial Sequence: Synthetic oligonucleotide
  Target: ATXN1; (+) strand; PAM type: NRG; PAM sequence: AGG
tccagcctggcgacagagcg

SEQ ID NO: 125028 - DNA, 20 bp, Artificial Sequence
  Description of Artificial Sequence: Synthetic oligonucleotide
  Target: ATXN1; (+) strand; PAM type: NRG; PAM sequence: AAG
taataataataatatccata

SEQ ID NO: 125029 - DNA, 20 bp, Artificial Sequence
  Description of Artificial Sequence: Synthetic oligonucleotide
  Target: ATXN1; (+) strand; PAM type: NRG; PAM sequence: CAG
aatatccataaagtacaaca

SEQ ID NO: 125030 - DNA, 20 bp, Artificial Sequence
  Description of Artificial Sequence: Synthetic oligonucleotide
  Target: ATXN1; (+) strand; PAM type: NRG; PAM sequence: AGG
atatccataaagtacaacac

SEQ ID NO: 125031 - DNA, 20 bp, Artificial Sequence
  Description of Artificial Sequence: Synthetic oligonucleotide
  Target: ATXN1; (+) strand; PAM type: NRG; PAM sequence: CGG
agtacaacacaggacacctt

SEQ ID NO: 125032 - DNA, 20 bp, Artificial Sequence
  Description of Artificial Sequence: Synthetic oligonucleotide
  Target: ATXN1; (+) strand; PAM type: NRG; PAM sequence: TAG
acaacacaggacaccttcgg

SEQ ID NO: 125033 - DNA, 20 bp, Artificial Sequence
  Description of Artificial Sequence: Synthetic oligonucleotide
  Target: ATXN1; (+) strand; PAM type: NRG; PAM sequence: TAG
ggacaccttcggtagccacc

SEQ ID NO: 125034 - DNA, 20 bp, Artificial Sequence
  Description of Artificial Sequence: Synthetic oligonucleotide
  Target: ATXN1; (+) strand; PAM type: NRG; PAM sequence: AGG
gacaccttcggtagccacct

SEQ ID NO: 125035 - DNA, 20 bp, Artificial Sequence
  Description of Artificial Sequence: Synthetic oligonucleotide
  Target: ATXN1; (+) strand; PAM type: NRG; PAM sequence: TGG
agccacctaggctcaaaaat

SEQ ID NO: 125036 - DNA, 20 bp, Artificial Sequence
  Description of Artificial Sequence: Synthetic oligonucleotide
  Target: ATXN1; (+) strand; PAM type: NRG; PAM sequence: GGG
gccacctaggctcaaaaatt

SEQ ID NO: 125037 - DNA, 20 bp, Artificial Sequence
  Description of Artificial Sequence: Synthetic oligonucleotide
  Target: ATXN1; (+) strand; PAM type: NRG; PAM sequence: CAG
ctttcattgtttctaatacc

SEQ ID NO: 125038 - DNA, 20 bp, Artificial Sequence
  Description of Artificial Sequence: Synthetic oligonucleotide
  Target: ATXN1; (+) strand; PAM type: NRG; PAM sequence: CAG
gtttctaatacccagttgct

SEQ ID NO: 125039 - DNA, 20 bp, Artificial Sequence
  Description of Artificial Sequence: Synthetic oligonucleotide
  Target: ATXN1; (+) strand; PAM type: NRG; PAM sequence: TAG
tttgttcaactctttctttg

SEQ ID NO: 125040 - DNA, 20 bp, Artificial Sequence
  Description of Artificial Sequence: Synthetic oligonucleotide
  Target: ATXN1; (+) strand; PAM type: NRG; PAM sequence: CGG
ctttgtagtgtcctccacat

SEQ ID NO: 125041 - DNA, 20 bp, Artificial Sequence
  Description of Artificial Sequence: Synthetic oligonucleotide
  Target: ATXN1; (+) strand; PAM type: NRG; PAM sequence: CAG
gtccctttgtaacacgccca

SEQ ID NO: 125042 - DNA, 20 bp, Artificial Sequence
  Description of Artificial Sequence: Synthetic oligonucleotide
  Target: ATXN1; (+) strand; PAM type: NRG; PAM sequence: TAG
cctttgtaacacgcccacag

SEQ ID NO: 125043 - DNA, 20 bp, Artificial Sequence
  Description of Artificial Sequence: Synthetic oligonucleotide
  Target: ATXN1; (+) strand; PAM type: NRG; PAM sequence: TGG
gcctgcaactgccttccctc

SEQ ID NO: 125044 - DNA, 20 bp, Artificial Sequence
  Description of Artificial Sequence: Synthetic oligonucleotide
  Target: ATXN1; (+) strand; PAM type: NRG; PAM sequence: GGG
cctgcaactgccttccctct

SEQ ID NO: 125045 - DNA, 20 bp, Artificial Sequence
  Description of Artificial Sequence: Synthetic oligonucleotide
  Target: ATXN1; (+) strand; PAM type: NRG; PAM sequence: CAG
ctgccttccctctgggaccc

SEQ ID NO: 125046 - DNA, 20 bp, Artificial Sequence
  Description of Artificial Sequence: Synthetic oligonucleotide
  Target: ATXN1; (+) strand; PAM type: NRG; PAM sequence: CGG
cttttttctccaccatctca

SEQ ID NO: 125047 - DNA, 20 bp, Artificial Sequence
  Description of Artificial Sequence: Synthetic oligonucleotide
  Target: ATXN1; (+) strand; PAM type: NRG; PAM sequence: GGG
ttttttctccaccatctcac

SEQ ID NO: 125048 - DNA, 20 bp, Artificial Sequence
  Description of Artificial Sequence: Synthetic oligonucleotide
  Target: ATXN1; (+) strand; PAM type: NRG; PAM sequence: TGG
ctccaccatctcacgggata

SEQ ID NO: 125049 - DNA, 20 bp, Artificial Sequence
  Description of Artificial Sequence: Synthetic oligonucleotide
  Target: ATXN1; (+) strand; PAM type: NRG; PAM sequence: CAG
catctcacgggatatggaca

SEQ ID NO: 125050 - DNA, 20 bp, Artificial Sequence
  Description of Artificial Sequence: Synthetic oligonucleotide
  Target: ATXN1; (+) strand; PAM type: NRG; PAM sequence: AAG
gggatatggacacagctgta

SEQ ID NO: 125051 - DNA, 20 bp, Artificial Sequence
  Description of Artificial Sequence: Synthetic oligonucleotide
  Target: ATXN1; (+) strand; PAM type: NRG; PAM sequence: TGG
aagctcatctcactaaaaca

SEQ ID NO: 125052 - DNA, 20 bp, Artificial Sequence
  Description of Artificial Sequence: Synthetic oligonucleotide
  Target: ATXN1; (+) strand; PAM type: NRG; PAM sequence: CAG
ccaacttgttgaaaaatctc

SEQ ID NO: 125053 - DNA, 20 bp, Artificial Sequence
  Description of Artificial Sequence: Synthetic oligonucleotide
  Target: ATXN1; (+) strand; PAM type: NRG; PAM sequence: CAG
ctccagtgactgccaacccc

SEQ ID NO: 125054 - DNA, 20 bp, Artificial Sequence
  Description of Artificial Sequence: Synthetic oligonucleotide
  Target: ATXN1; (+) strand; PAM type: NRG; PAM sequence: CAG
gtgactgccaacccccagtt

SEQ ID NO: 125055 - DNA, 20 bp, Artificial Sequence
  Description of Artificial Sequence: Synthetic oligonucleotide
  Target: ATXN1; (+) strand; PAM type: NRG; PAM sequence: AGG
tgactgccaacccccagttc

SEQ ID NO: 125056 - DNA, 20 bp, Artificial Sequence
  Description of Artificial Sequence: Synthetic oligonucleotide
  Target: ATXN1; (+) strand; PAM type: NRG; PAM sequence: CAG
cagttcaggacccctcccca

SEQ ID NO: 125057 - DNA, 20 bp, Artificial Sequence
  Description of Artificial Sequence: Synthetic oligonucleotide
  Target: ATXN1; (+) strand; PAM type: NRG; PAM sequence: CAG
cacagcactgcccatttaca

SEQ ID NO: 125058 - DNA, 20 bp, Artificial Sequence
  Description of Artificial Sequence: Synthetic oligonucleotide
  Target: ATXN1; (+) strand; PAM type: NRG; PAM sequence: AAG
cccccaaaccacaaaccaac

SEQ ID NO: 125059 - DNA, 20 bp, Artificial Sequence
  Description of Artificial Sequence: Synthetic oligonucleotide
  Target: ATXN1; (+) strand; PAM type: NRG; PAM sequence: AAG
ccaaaccacaaaccaacaag

SEQ ID NO: 125060 - DNA, 20 bp, Artificial Sequence
  Description of Artificial Sequence: Synthetic oligonucleotide
  Target: ATXN1; (+) strand; PAM type: NRG; PAM sequence: TGG
caacaagaagcaccgtgtcc

SEQ ID NO: 125061 - DNA, 20 bp, Artificial Sequence
  Description of Artificial Sequence: Synthetic oligonucleotide
  Target: ATXN1; (+) strand; PAM type: NRG; PAM sequence: GGG
aacaagaagcaccgtgtcct

SEQ ID NO: 125062 - DNA, 20 bp, Artificial Sequence
  Description of Artificial Sequence: Synthetic oligonucleotide
  Target: ATXN1; (+) strand; PAM type: NRG; PAM sequence: CAG
accgtgtcctgggaatctgt

SEQ ID NO: 125063 - DNA, 20 bp, Artificial Sequence
  Description of Artificial Sequence: Synthetic oligonucleotide
  Target: ATXN1; (+) strand; PAM type: NRG; PAM sequence: TGG
gtgtcctgggaatctgtcag

SEQ ID NO: 125064 - DNA, 20 bp, Artificial Sequence
  Description of Artificial Sequence: Synthetic oligonucleotide
  Target: ATXN1; (+) strand; PAM type: NRG; PAM sequence: TGG
cctgggaatctgtcagtggc

SEQ ID NO: 125065 - DNA, 20 bp, Artificial Sequence
  Description of Artificial Sequence: Synthetic oligonucleotide
  Target: ATXN1; (+) strand; PAM type: NRG; PAM sequence: GGG
ctgggaatctgtcagtggct

SEQ ID NO: 125066 - DNA, 20 bp, Artificial Sequence
  Description of Artificial Sequence: Synthetic oligonucleotide
  Target: ATXN1; (+) strand; PAM type: NRG; PAM sequence: CAG
atctgtcagtggctgggact

SEQ ID NO: 125067 - DNA, 20 bp, Artificial Sequence
  Description of Artificial Sequence: Synthetic oligonucleotide
  Target: ATXN1; (+) strand; PAM type: NRG; PAM sequence: CAG
ctgggactcagtcctcctcg

SEQ ID NO: 125068 - DNA, 20 bp, Artificial Sequence
  Description of Artificial Sequence: Synthetic oligonucleotide
  Target: ATXN1; (+) strand; PAM type: NRG; PAM sequence: AGG
tgggactcagtcctcctcgc

SEQ ID NO: 125069 - DNA, 20 bp, Artificial Sequence
  Description of Artificial Sequence: Synthetic oligonucleotide
  Target: ATXN1; (+) strand; PAM type: NRG; PAM sequence: CAG
gactcagtcctcctcgcagg

SEQ ID NO: 125070 - DNA, 20 bp, Artificial Sequence
  Description of Artificial Sequence: Synthetic oligonucleotide
  Target: ATXN1; (+) strand; PAM type: NRG; PAM sequence: AGG
actcagtcctcctcgcaggc

SEQ ID NO: 125071 - DNA, 20 bp, Artificial Sequence
  Description of Artificial Sequence: Synthetic oligonucleotide
  Target: ATXN1; (+) strand; PAM type: NRG; PAM sequence: TAG
ttcaccacataatacacacg

SEQ ID NO: 125072 - DNA, 20 bp, Artificial Sequence
  Description of Artificial Sequence: Synthetic oligonucleotide
  Target: ATXN1; (+) strand; PAM type: NRG; PAM sequence: TGG
taatacacacgtagcgaatg

SEQ ID NO: 125073 - DNA, 20 bp, Artificial Sequence
  Description of Artificial Sequence: Synthetic oligonucleotide
  Target: ATXN1; (+) strand; PAM type: NRG; PAM sequence: GAG
cacacgtagcgaatgtggtt

SEQ ID NO: 125074 - DNA, 20 bp, Artificial Sequence
  Description of Artificial Sequence: Synthetic oligonucleotide
  Target: ATXN1; (+) strand; PAM type: NRG; PAM sequence: AGG
acacgtagcgaatgtggttg

SEQ ID NO: 125075 - DNA, 20 bp, Artificial Sequence
  Description of Artificial Sequence: Synthetic oligonucleotide
  Target: ATXN1; (+) strand; PAM type: NRG; PAM sequence: GGG
cacgtagcgaatgtggttga

SEQ ID NO: 125076 - DNA, 20 bp, Artificial Sequence
  Description of Artificial Sequence: Synthetic oligonucleotide
  Target: ATXN1; (+) strand; PAM type: NRG; PAM sequence: GGG
acgtagcgaatgtggttgag

SEQ ID NO: 125077 - DNA, 20 bp, Artificial Sequence
  Description of Artificial Sequence: Synthetic oligonucleotide
  Target: ATXN1; (+) strand; PAM type: NRG; PAM sequence: TGG
gttgaggggtccccattctt

SEQ ID NO: 125078 - DNA, 20 bp, Artificial Sequence
  Description of Artificial Sequence: Synthetic oligonucleotide
  Target: ATXN1; (+) strand; PAM type: NRG; PAM sequence: TGG
attctttggtctgacacatg

SEQ ID NO: 125079 - DNA, 20 bp, Artificial Sequence
  Description of Artificial Sequence: Synthetic oligonucleotide
  Target: ATXN1; (+) strand; PAM type: NRG; PAM sequence: AAG
tgacccctatctccctgtcc

SEQ ID NO: 125080 - DNA, 20 bp, Artificial Sequence
  Description of Artificial Sequence: Synthetic oligonucleotide
  Target: ATXN1; (+) strand; PAM type: NRG; PAM sequence: AGG
gacccctatctccctgtcca

SEQ ID NO: 125081 - DNA, 20 bp, Artificial Sequence
  Description of Artificial Sequence: Synthetic oligonucleotide
  Target: ATXN1; (+) strand; PAM type: NRG; PAM sequence: CAG
ccctatctccctgtccaagg

SEQ ID NO: 125082 - DNA, 20 bp, Artificial Sequence
  Description of Artificial Sequence: Synthetic oligonucleotide
  Target: ATXN1; (+) strand; PAM type: NRG; PAM sequence: GAG
gtctccccctttctctctat

SEQ ID NO: 125083 - DNA, 20 bp, Artificial Sequence
  Description of Artificial Sequence: Synthetic oligonucleotide
  Target: ATXN1; (+) strand; PAM type: NRG; PAM sequence: GAG
agctgtccattctccgtgtt

SEQ ID NO: 125084 - DNA, 20 bp, Artificial Sequence
  Description of Artificial Sequence: Synthetic oligonucleotide
  Target: ATXN1; (+) strand; PAM type: NRG; PAM sequence: CGG
tctccgtgttgagtcctaca

SEQ ID NO: 125085 - DNA, 20 bp, Artificial Sequence
  Description of Artificial Sequence: Synthetic oligonucleotide
  Target: ATXN1; (+) strand; PAM type: NRG; PAM sequence: GAG
tccgtgttgagtcctacacg

SEQ ID NO: 125086 - DNA, 20 bp, Artificial Sequence
  Description of Artificial Sequence: Synthetic oligonucleotide
  Target: ATXN1; (+) strand; PAM type: NRG; PAM sequence: TAG
ttcccacttactttacatgt

SEQ ID NO: 125087 - DNA, 20 bp, Artificial Sequence
  Description of Artificial Sequence: Synthetic oligonucleotide
  Target: ATXN1; (+) strand; PAM type: NRG; PAM sequence: CAG
ttagattgctgtgttttcct

SEQ ID NO: 125088 - DNA, 20 bp, Artificial Sequence
  Description of Artificial Sequence: Synthetic oligonucleotide
  Target: ATXN1; (+) strand; PAM type: NRG; PAM sequence: TGG
tgttttcctcagcatatgcg

SEQ ID NO: 125089 - DNA, 20 bp, Artificial Sequence
  Description of Artificial Sequence: Synthetic oligonucleotide
  Target: ATXN1; (+) strand; PAM type: NRG; PAM sequence: TGG
gcatatgcgtggcccctgtc

SEQ ID NO: 125090 - DNA, 20 bp, Artificial Sequence
  Description of Artificial Sequence: Synthetic oligonucleotide
  Target: ATXN1; (+) strand; PAM type: NRG; PAM sequence: AAG
tatgcgtggcccctgtctgg

SEQ ID NO: 125091 - DNA, 20 bp, Artificial Sequence
  Description of Artificial Sequence: Synthetic oligonucleotide
  Target: ATXN1; (+) strand; PAM type: NRG; PAM sequence: TGG
gaagcccctcttcgttgatc

SEQ ID NO: 125092 - DNA, 20 bp, Artificial Sequence
  Description of Artificial Sequence: Synthetic oligonucleotide
  Target: ATXN1; (+) strand; PAM type: NRG; PAM sequence: GAG
agcccctcttcgttgatctg

SEQ ID NO: 125093 - DNA, 20 bp, Artificial Sequence
  Description of Artificial Sequence: Synthetic oligonucleotide
  Target: ATXN1; (+) strand; PAM type: NRG; PAM sequence: TGG
gttgatctggagctgaattg

SEQ ID NO: 125094 - DNA, 20 bp, Artificial Sequence
  Description of Artificial Sequence: Synthetic oligonucleotide
  Target: ATXN1; (+) strand; PAM type: NRG; PAM sequence: CAG
ctgaattgtggtctgttcac

SEQ ID NO: 125095 - DNA, 20 bp, Artificial Sequence
  Description of Artificial Sequence: Synthetic oligonucleotide
  Target: ATXN1; (+) strand; PAM type: NRG; PAM sequence: AGG
tgaattgtggtctgttcacc

SEQ ID NO: 125096 - DNA, 20 bp, Artificial Sequence
  Description of Artificial Sequence: Synthetic oligonucleotide
  Target: ATXN1; (+) strand; PAM type: NRG; PAM sequence: CAG
tggtctgttcaccaggaccc

SEQ ID NO: 125097 - DNA, 20 bp, Artificial Sequence
  Description of Artificial Sequence: Synthetic oligonucleotide
  Target: ATXN1; (+) strand; PAM type: NRG; PAM sequence: AAG
ttcaccaggaccccagatga

SEQ ID NO: 125098 - DNA, 20 bp, Artificial Sequence
  Description of Artificial Sequence: Synthetic oligonucleotide
  Target: ATXN1; (+) strand; PAM type: NRG; PAM sequence: AAG
ggaccccagatgaaagatga

SEQ ID NO: 125099 - DNA, 20 bp, Artificial Sequence
  Description of Artificial Sequence: Synthetic oligonucleotide
  Target: ATXN1; (+) strand; PAM type: NRG; PAM sequence: GAG
cagatgaaagatgaaagcat

SEQ ID NO: 125100 - DNA, 20 bp, Artificial Sequence
  Description of Artificial Sequence: Synthetic oligonucleotide
  Target: ATXN1; (+) strand; PAM type: NRG; PAM sequence: GAG
gatgaaagatgaaagcatga

SEQ ID NO: 125101 - DNA, 20 bp, Artificial Sequence
  Description of Artificial Sequence: Synthetic oligonucleotide
  Target: ATXN1; (+) strand; PAM type: NRG; PAM sequence: AAG
gaaagatgaaagcatgagag

SEQ ID NO: 125102 - DNA, 20 bp, Artificial Sequence
  Description of Artificial Sequence: Synthetic oligonucleotide
  Target: ATXN1; (+) strand; PAM type: NRG; PAM sequence: CGG
agatgaaagcatgagagaag

SEQ ID NO: 125103 - DNA, 20 bp, Artificial Sequence
  Description of Artificial Sequence: Synthetic oligonucleotide
  Target: ATXN1; (+) strand; PAM type: NRG; PAM sequence: CAG
aagcatgagagaagcggatg

SEQ ID NO: 125104 - DNA, 20 bp, Artificial Sequence
  Description of Artificial Sequence: Synthetic oligonucleotide
  Target: ATXN1; (+) strand; PAM type: NRG; PAM sequence: AGG
agcatgagagaagcggatgc

SEQ ID NO: 125105 - DNA, 20 bp, Artificial Sequence
  Description of Artificial Sequence: Synthetic oligonucleotide
  Target: ATXN1; (+) strand; PAM type: NRG; PAM sequence: GAG
catgagagaagcggatgcag

SEQ ID NO: 125106 - DNA, 20 bp, Artificial Sequence
  Description of Artificial Sequence: Synthetic oligonucleotide
  Target: ATXN1; (+) strand; PAM type: NRG; PAM sequence: AGG
atgagagaagcggatgcagg

SEQ ID NO: 125107 - DNA, 20 bp, Artificial Sequence
  Description of Artificial Sequence: Synthetic oligonucleotide
  Target: ATXN1; (+) strand; PAM type: NRG; PAM sequence: GGG
tgagagaagcggatgcagga

SEQ ID NO: 125108 - DNA, 20 bp, Artificial Sequence
  Description of Artificial Sequence: Synthetic oligonucleotide
  Target: ATXN1; (+) strand; PAM type: NRG; PAM sequence: GGG
gagagaagcggatgcaggag

SEQ ID NO: 125109 - DNA, 20 bp, Artificial Sequence
  Description of Artificial Sequence: Synthetic oligonucleotide
  Target: ATXN1; (+) strand; PAM type: NRG; PAM sequence: GGG
agagaagcggatgcaggagg

SEQ ID NO: 125110 - DNA, 20 bp, Artificial Sequence
  Description of Artificial Sequence: Synthetic oligonucleotide
  Target: ATXN1; (+) strand; PAM type: NRG; PAM sequence: TGG
aagcggatgcaggaggggga

SEQ ID NO: 125111 - DNA, 20 bp, Artificial Sequence
  Description of Artificial Sequence: Synthetic oligonucleotide
  Target: ATXN1; (+) strand; PAM type: NRG; PAM sequence: TAG
gatgcaggagggggatggta

SEQ ID NO: 125112 - DNA, 20 bp, Artificial Sequence
  Description of Artificial Sequence: Synthetic oligonucleotide
  Target: ATXN1; (+) strand; PAM type: NRG; PAM sequence: AGG
atgcaggagggggatggtat

SEQ ID NO: 125113 - DNA, 20 bp, Artificial Sequence
  Description of Artificial Sequence: Synthetic oligonucleotide
  Target: ATXN1; (+) strand; PAM type: NRG; PAM sequence: GGG
tgcaggagggggatggtata

SEQ ID NO: 125114 - DNA, 20 bp, Artificial Sequence
  Description of Artificial Sequence: Synthetic oligonucleotide
  Target: ATXN1; (+) strand; PAM type: NRG; PAM sequence: TGG
aggagggggatggtataggg

SEQ ID NO: 125115 - DNA, 20 bp, Artificial Sequence
  Description of Artificial Sequence: Synthetic oligonucleotide
  Target: ATXN1; (+) strand; PAM type: NRG; PAM sequence: TGG
tatagggtggtccatacacc

SEQ ID NO: 125116 - DNA, 20 bp, Artificial Sequence
  Description of Artificial Sequence: Synthetic oligonucleotide
  Target: ATXN1; (+) strand; PAM type: NRG; PAM sequence: GGG
atagggtggtccatacacct

SEQ ID NO: 125117 - DNA, 20 bp, Artificial Sequence
  Description of Artificial Sequence: Synthetic oligonucleotide
  Target: ATXN1; (+) strand; PAM type: NRG; PAM sequence: TGG
ggtggtccatacacctggga

SEQ ID NO: 125118 - DNA, 20 bp, Artificial Sequence
  Description of Artificial Sequence: Synthetic oligonucleotide
  Target: ATXN1; (+) strand; PAM type: NRG; PAM sequence: TGG
atacacctgggatggaatca

SEQ ID NO: 125119 - DNA, 20 bp, Artificial Sequence
  Description of Artificial Sequence: Synthetic oligonucleotide
  Target: ATXN1; (+) strand; PAM type: NRG; PAM sequence: AAG
cacctgggatggaatcatgg

SEQ ID NO: 125120 - DNA, 20 bp, Artificial Sequence
  Description of Artificial Sequence: Synthetic oligonucleotide
  Target: ATXN1; (+) strand; PAM type: NRG; PAM sequence: CAG
atggaatcatggaagcatcc

SEQ ID NO: 125121 - DNA, 20 bp, Artificial Sequence
  Description of Artificial Sequence: Synthetic oligonucleotide
  Target: ATXN1; (+) strand; PAM type: NRG; PAM sequence: CAG
aatcatggaagcatcccaga

SEQ ID NO: 125122 - DNA, 20 bp, Artificial Sequence
  Description of Artificial Sequence: Synthetic oligonucleotide
  Target: ATXN1; (+) strand; PAM type: NRG; PAM sequence: AGG
atcatggaagcatcccagac

SEQ ID NO: 125123 - DNA, 20 bp, Artificial Sequence
  Description of Artificial Sequence: Synthetic oligonucleotide
  Target: ATXN1; (+) strand; PAM type: NRG; PAM sequence: AAG
aggttaactttgccttaata

SEQ ID NO: 125124 - DNA, 20 bp, Artificial Sequence
  Description of Artificial Sequence: Synthetic oligonucleotide
  Target: ATXN1; (+) strand; PAM type: NRG; PAM sequence: AAG
aaagcttcttaatttttaac

SEQ ID NO: 125125 - DNA, 20 bp, Artificial Sequence
  Description of Artificial Sequence: Synthetic oligonucleotide
  Target: ATXN1; (+) strand; PAM type: NRG; PAM sequence: CAG
ctaatgatctccatctcatt

SEQ ID NO: 125126 - DNA, 20 bp, Artificial Sequence
  Description of Artificial Sequence: Synthetic oligonucleotide
  Target: ATXN1; (+) strand; PAM type: NRG; PAM sequence: AGG
taatgatctccatctcattc

SEQ ID NO: 125127 - DNA, 20 bp, Artificial Sequence
  Description of Artificial Sequence: Synthetic oligonucleotide
  Target: ATXN1; (+) strand; PAM type: NRG; PAM sequence: GAG
atgatctccatctcattcag

SEQ ID NO: 125128 - DNA, 20 bp, Artificial Sequence
  Description of Artificial Sequence: Synthetic oligonucleotide
  Target: ATXN1; (+) strand; PAM type: NRG; PAM sequence: AGG
tgatctccatctcattcagg

SEQ ID NO: 125129 - DNA, 20 bp, Artificial Sequence
  Description of Artificial Sequence: Synthetic oligonucleotide
  Target: ATXN1; (+) strand; PAM type: NRG; PAM sequence: AAG
ccatctcattcaggaggaac

SEQ ID NO: 125130 - DNA, 20 bp, Artificial Sequence
  Description of Artificial Sequence: Synthetic oligonucleotide
  Target: ATXN1; (+) strand; PAM type: NRG; PAM sequence: AGG
catctcattcaggaggaaca

SEQ ID NO: 125131 - DNA, 20 bp, Artificial Sequence
  Description of Artificial Sequence: Synthetic oligonucleotide
  Target: ATXN1; (+) strand; PAM type: NRG; PAM sequence: CAG
tcattcaggaggaacaaggt

SEQ ID NO: 125132 - DNA, 20 bp, Artificial Sequence
  Description of Artificial Sequence: Synthetic oligonucleotide
  Target: ATXN1; (+) strand; PAM type: NRG; PAM sequence: AAG
tcaggaggaacaaggtcaga

SEQ ID NO: 125133 - DNA, 20 bp, Artificial Sequence
  Description of Artificial Sequence: Synthetic oligonucleotide
  Target: ATXN1; (+) strand; PAM type: NRG; PAM sequence: AAG
aggaacaaggtcagaaagac

SEQ ID NO: 125134 - DNA, 20 bp, Artificial Sequence
  Description of Artificial Sequence: Synthetic oligonucleotide
  Target: ATXN1; (+) strand; PAM type: NRG; PAM sequence: TGG
acaaggtcagaaagacaaga

SEQ ID NO: 125135 - DNA, 20 bp, Artificial Sequence
  Description of Artificial Sequence: Synthetic oligonucleotide
  Target: ATXN1; (+) strand; PAM type: NRG; PAM sequence: GGG
caaggtcagaaagacaagat

SEQ ID NO: 125136 - DNA, 20 bp, Artificial Sequence
  Description of Artificial Sequence: Synthetic oligonucleotide
  Target: ATXN1; (+) strand; PAM type: NRG; PAM sequence: CAG
tcagaaagacaagatgggac

SEQ ID NO: 125137 - DNA, 20 bp, Artificial Sequence
  Description of Artificial Sequence: Synthetic oligonucleotide
  Target: ATXN1; (+) strand; PAM type: NRG; PAM sequence: GAG
ccagatgacttgtgaactgt

SEQ ID NO: 125138 - DNA, 20 bp, Artificial Sequence
  Description of Artificial Sequence: Synthetic oligonucleotide
  Target: ATXN1; (+) strand; PAM type: NRG; PAM sequence: GAG
tgacttgtgaactgtgagtt

SEQ ID NO: 125139 - DNA, 20 bp, Artificial Sequence
  Description of Artificial Sequence: Synthetic oligonucleotide
  Target: ATXN1; (+) strand; PAM type: NRG; PAM sequence: TGG
gtgaactgtgagttgagctc

SEQ ID NO: 125140 - DNA, 20 bp, Artificial Sequence
  Description of Artificial Sequence: Synthetic oligonucleotide
  Target: ATXN1; (+) strand; PAM type: NRG; PAM sequence: TAG
tgagttgagctctggactgt

SEQ ID NO: 125141 - DNA, 20 bp, Artificial Sequence
  Description of Artificial Sequence: Synthetic oligonucleotide
  Target: ATXN1; (+) strand; PAM type: NRG; PAM sequence: CAG
ttgagctctggactgttaga

SEQ ID NO: 125142 - DNA, 20 bp, Artificial Sequence
  Description of Artificial Sequence: Synthetic oligonucleotide
  Target: ATXN1; (+) strand; PAM type: NRG; PAM sequence: AAG
tgttagacagtgatgtgtct

SEQ ID NO: 125143 - DNA, 20 bp, Artificial Sequence
  Description of Artificial Sequence: Synthetic oligonucleotide
  Target: ATXN1; (+) strand; PAM type: NRG; PAM sequence: AAG
gacagtgatgtgtctaagac

SEQ ID NO: 125144 - DNA, 20 bp, Artificial Sequence
  Description of Artificial Sequence: Synthetic oligonucleotide
  Target: ATXN1; (+) strand; PAM type: NRG; PAM sequence: AGG
acagtgatgtgtctaagaca

SEQ ID NO: 125145 - DNA, 20 bp, Artificial Sequence
  Description of Artificial Sequence: Synthetic oligonucleotide
  Target: ATXN1; (+) strand; PAM type: NRG; PAM sequence: TGG
tctaagacaaggccaatgtc

SEQ ID NO: 125146 - DNA, 20 bp, Artificial Sequence
  Description of Artificial Sequence: Synthetic oligonucleotide
  Target: ATXN1; (+) strand; PAM type: NRG; PAM sequence: CAG
aagacaaggccaatgtctgg

SEQ ID NO: 125147 - DNA, 20 bp, Artificial Sequence
  Description of Artificial Sequence: Synthetic oligonucleotide
  Target: ATXN1; (+) strand; PAM type: NRG; PAM sequence: AGG
agacaaggccaatgtctggc

SEQ ID NO: 125148 - DNA, 20 bp, Artificial Sequence
  Description of Artificial Sequence: Synthetic oligonucleotide
  Target: ATXN1; (+) strand; PAM type: NRG; PAM sequence: CGG
aaggccaatgtctggcaggc

SEQ ID NO: 125149 - DNA, 20 bp, Artificial Sequence
  Description of Artificial Sequence: Synthetic oligonucleotide
  Target: ATXN1; (+) strand; PAM type: NRG; PAM sequence: GGG
aggccaatgtctggcaggcc

SEQ ID NO: 125150 - DNA, 20 bp, Artificial Sequence
  Description of Artificial Sequence: Synthetic oligonucleotide
  Target: ATXN1; (+) strand; PAM type: NRG; PAM sequence: GGG
ggccaatgtctggcaggccg

SEQ ID NO: 125151 - DNA, 20 bp, Artificial Sequence
  Description of Artificial Sequence: Synthetic oligonucleotide
  Target: ATXN1; (+) strand; PAM type: NRG; PAM sequence: TAG
tgtctggcaggccggggctt

SEQ ID NO: 125152 - DNA, 20 bp, Artificial Sequence
  Description of Artificial Sequence: Synthetic oligonucleotide
  Target: ATXN1; (+) strand; PAM type: NRG; PAM sequence: AAG
gcaggccggggctttagcgt

SEQ ID NO: 125153 - DNA, 20 bp, Artificial Sequence
  Description of Artificial Sequence: Synthetic oligonucleotide
  Target: ATXN1; (+) strand; PAM type: NRG; PAM sequence: TAG
ccggggctttagcgtaagtt

SEQ ID NO: 125154 - DNA, 20 bp, Artificial Sequence
  Description of Artificial Sequence: Synthetic oligonucleotide
  Target: ATXN1; (+) strand; PAM type: NRG; PAM sequence: GAG
gtttagccacctgctaaatt

SEQ ID NO: 125155 - DNA, 20 bp, Artificial Sequence
  Description of Artificial Sequence: Synthetic oligonucleotide
  Target: ATXN1; (+) strand; PAM type: NRG; PAM sequence: TAG
ttatgattgtcccatcacca

SEQ ID NO: 125156 - DNA, 20 bp, Artificial Sequence
  Description of Artificial Sequence: Synthetic oligonucleotide
  Target: ATXN1; (+) strand; PAM type: NRG; PAM sequence: TAG
tattaatgctcttttaattt

SEQ ID NO: 125157 - DNA, 20 bp, Artificial Sequence
  Description of Artificial Sequence: Synthetic oligonucleotide
  Target: ATXN1; (+) strand; PAM type: NRG; PAM sequence: GAG
taattttagtaaatattttt

SEQ ID NO: 125158 - DNA, 20 bp, Artificial Sequence
  Description of Artificial Sequence: Synthetic oligonucleotide
  Target: ATXN1; (+) strand; PAM type: NRG; PAM sequence: CAG
tttagtaaatatttttgagc

SEQ ID NO: 125159 - DNA, 20 bp, Artificial Sequence
  Description of Artificial Sequence: Synthetic oligonucleotide
  Target: ATXN1; (+) strand; PAM type: NRG; PAM sequence: AAG
gagccagatctgactgttcc

SEQ ID NO: 125160 - DNA, 20 bp, Artificial Sequence
  Description of Artificial Sequence: Synthetic oligonucleotide
  Target: ATXN1; (+) strand; PAM type: NRG; PAM sequence: TGG
agatctgactgttccaagcc

SEQ ID NO: 125161 - DNA, 20 bp, Artificial Sequence
  Description of Artificial Sequence: Synthetic oligonucleotide
  Target: ATXN1; (+) strand; PAM type: NRG; PAM sequence: GGG
gatctgactgttccaagcct

SEQ ID NO: 125162 - DNA, 20 bp, Artificial Sequence
  Description of Artificial Sequence: Synthetic oligonucleotide
  Target: ATXN1; (+) strand; PAM type: NRG; PAM sequence: TGG
actgttccaagcctgggctt

SEQ ID NO: 125163 - DNA, 20 bp, Artificial Sequence
  Description of Artificial Sequence: Synthetic oligonucleotide
  Target: ATXN1; (+) strand; PAM type: NRG; PAM sequence: GGG
ctgttccaagcctgggcttt

SEQ ID NO: 125164 - DNA, 20 bp, Artificial Sequence
  Description of Artificial Sequence: Synthetic oligonucleotide
  Target: ATXN1; (+) strand; PAM type: NRG; PAM sequence: GGG
tgttccaagcctgggctttg

SEQ ID NO: 125165 - DNA, 20 bp, Artificial Sequence
  Description of Artificial Sequence: Synthetic oligonucleotide
  Target: ATXN1; (+) strand; PAM type: NRG; PAM sequence: GGG
gttccaagcctgggctttgg

SEQ ID NO: 125166 - DNA, 20 bp, Artificial Sequence
  Description of Artificial Sequence: Synthetic oligonucleotide
  Target: ATXN1; (+) strand; PAM type: NRG; PAM sequence: CAG
gcctgggctttgggggctgc

SEQ ID NO: 125167 - DNA, 20 bp, Artificial Sequence
  Description of Artificial Sequence: Synthetic oligonucleotide
  Target: ATXN1; (+) strand; PAM type: NRG; PAM sequence: AGG
cctgggctttgggggctgcc

SEQ ID NO: 125168 - DNA, 20 bp, Artificial Sequence
  Description of Artificial Sequence: Synthetic oligonucleotide
  Target: ATXN1; (+) strand; PAM type: NRG; PAM sequence: CAG
tattactgctacaacaccat

SEQ ID NO: 125169 - DNA, 20 bp, Artificial Sequence
  Description of Artificial Sequence: Synthetic oligonucleotide
  Target: ATXN1; (+) strand; PAM type: NRG; PAM sequence: AGG
attactgctacaacaccatc

SEQ ID NO: 125170 - DNA, 20 bp, Artificial Sequence
  Description of Artificial Sequence: Synthetic oligonucleotide
  Target: ATXN1; (+) strand; PAM type: NRG; PAM sequence: GAG
tactgctacaacaccatcag

SEQ ID NO: 125171 - DNA, 20 bp, Artificial Sequence
  Description of Artificial Sequence: Synthetic oligonucleotide
  Target: ATXN1; (+) strand; PAM type: NRG; PAM sequence: AAG
gctacaacaccatcaggagc

SEQ ID NO: 125172 - DNA, 20 bp, Artificial Sequence
  Description of Artificial Sequence: Synthetic oligonucleotide
  Target: ATXN1; (+) strand; PAM type: NRG; PAM sequence: AAG
gcaagtcacaatgcattctt

SEQ ID NO: 125173 - DNA, 20 bp, Artificial Sequence
  Description of Artificial Sequence: Synthetic oligonucleotide
  Target: ATXN1; (+) strand; PAM type: NRG; PAM sequence: GAG
cttttaccctacacgttatc

SEQ ID NO: 125174 - DNA, 20 bp, Artificial Sequence
  Description of Artificial Sequence: Synthetic oligonucleotide
  Target: ATXN1; (+) strand; PAM type: NRG; PAM sequence: GAG
gcacctactgtgtgctgtgt

SEQ ID NO: 125175 - DNA, 20 bp, Artificial Sequence
  Description of Artificial Sequence: Synthetic oligonucleotide
  Target: ATXN1; (+) strand; PAM type: NRG; PAM sequence: GAG
acctactgtgtgctgtgtga

SEQ ID NO: 125176 - DNA, 20 bp, Artificial Sequence
  Description of Artificial Sequence: Synthetic oligonucleotide
  Target: ATXN1; (+) strand; PAM type: NRG; PAM sequence: AGG
cctactgtgtgctgtgtgag

SEQ ID NO: 125177 - DNA, 20 bp, Artificial Sequence
  Description of Artificial Sequence: Synthetic oligonucleotide
  Target: ATXN1; (+) strand; PAM type: NRG; PAM sequence: TGG
tgtgtgctgtgtgagaggac

SEQ ID NO: 125178 - DNA, 20 bp, Artificial Sequence
  Description of Artificial Sequence: Synthetic oligonucleotide
  Target: ATXN1; (+) strand; PAM type: NRG; PAM sequence: GGG
gtgtgctgtgtgagaggact

SEQ ID NO: 125179 - DNA, 20 bp, Artificial Sequence
  Description of Artificial Sequence: Synthetic oligonucleotide
  Target: ATXN1; (+) strand; PAM type: NRG; PAM sequence: TGG
gtgtgagaggactgggacgt

SEQ ID NO: 125180 - DNA, 20 bp, Artificial Sequence
  Description of Artificial Sequence: Synthetic oligonucleotide
  Target: ATXN1; (+) strand; PAM type: NRG; PAM sequence: GGG
tgtgagaggactgggacgtt

SEQ ID NO: 125181 - DNA, 20 bp, Artificial Sequence
  Description of Artificial Sequence: Synthetic oligonucleotide
  Target: ATXN1; (+) strand; PAM type: NRG; PAM sequence: GAG
tgagaggactgggacgttgg

SEQ ID NO: 125182 - DNA, 20 bp, Artificial Sequence
  Description of Artificial Sequence: Synthetic oligonucleotide
  Target: ATXN1; (+) strand; PAM type: NRG; PAM sequence: AAG
gacgttgggagttatacaaa

SEQ ID NO: 125183 - DNA, 20 bp, Artificial Sequence
  Description of Artificial Sequence: Synthetic oligonucleotide
  Target: ATXN1; (+) strand; PAM type: NRG; PAM sequence: AAG
ggagttatacaaaaagctaa

SEQ ID NO: 125184 - DNA, 20 bp, Artificial Sequence
  Description of Artificial Sequence: Synthetic oligonucleotide
  Target: ATXN1; (+) strand; PAM type: NRG; PAM sequence: TAG
aaaaagctaaaagccatgct

SEQ ID NO: 125185 - DNA, 20 bp, Artificial Sequence
  Description of Artificial Sequence: Synthetic oligonucleotide
  Target: ATXN1; (+) strand; PAM type: NRG; PAM sequence: AGG
aaaagctaaaagccatgctt

SEQ ID NO: 125186 - DNA, 20 bp, Artificial Sequence
  Description of Artificial Sequence: Synthetic oligonucleotide
  Target: ATXN1; (+) strand; PAM type: NRG; PAM sequence: TAG
taaaagccatgcttaggaca

SEQ ID NO: 125187 - DNA, 20 bp, Artificial Sequence
  Description of Artificial Sequence: Synthetic oligonucleotide
  Target: ATXN1; (+) strand; PAM type: NRG; PAM sequence: CAG
aagccatgcttaggacatag

SEQ ID NO: 125188 - DNA, 20 bp, Artificial Sequence
  Description of Artificial Sequence: Synthetic oligonucleotide
  Target: ATXN1; (+) strand; PAM type: NRG; PAM sequence: AGG
agccatgcttaggacatagc

SEQ ID NO: 125189 - DNA, 20 bp, Artificial Sequence
  Description of Artificial Sequence: Synthetic oligonucleotide
  Target: ATXN1; (+) strand; PAM type: NRG; PAM sequence: AAG
cttaggacatagcaggtgac

SEQ ID NO: 125190 - DNA, 20 bp, Artificial Sequence
  Description of Artificial Sequence: Synthetic oligonucleotide
  Target: ATXN1; (+) strand; PAM type: NRG; PAM sequence: TAG
caggtgacaagtgtcccttc

SEQ ID NO: 125191 - DNA, 20 bp, Artificial Sequence
  Description of Artificial Sequence: Synthetic oligonucleotide
  Target: ATXN1; (+) strand; PAM type: NRG; PAM sequence: AGG
aggtgacaagtgtcccttct

SEQ ID NO: 125192 - DNA, 20 bp, Artificial Sequence
  Description of Artificial Sequence: Synthetic oligonucleotide
  Target: ATXN1; (+) strand; PAM type: NRG; PAM sequence: AAG
caagtgtcccttctaggcca

SEQ ID NO: 125193 - DNA, 20 bp, Artificial Sequence
  Description of Artificial Sequence: Synthetic oligonucleotide
  Target: ATXN1; (+) strand; PAM type: NRG; PAM sequence: AAG
ccttctaggccaaagctttg

SEQ ID NO: 125194 - DNA, 20 bp, Artificial Sequence
  Description of Artificial Sequence: Synthetic oligonucleotide
  Target: ATXN1; (+) strand; PAM type: NRG; PAM sequence: TGG
gctttgaagcattgaattgc

SEQ ID NO: 125195 - DNA, 20 bp, Artificial Sequence
  Description of Artificial Sequence: Synthetic oligonucleotide
  Target: ATXN1; (+) strand; PAM type: NRG; PAM sequence: CAG
tttccaatttttctctcttc

SEQ ID NO: 125196 - DNA, 20 bp, Artificial Sequence
  Description of Artificial Sequence: Synthetic oligonucleotide
  Target: ATXN1; (+) strand; PAM type: NRG; PAM sequence: AAG
ctctcttccagtgatcatga

SEQ ID NO: 125197 - DNA, 20 bp, Artificial Sequence
  Description of Artificial Sequence: Synthetic oligonucleotide
  Target: ATXN1; (+) strand; PAM type: NRG; PAM sequence: GAG
ctcttccagtgatcatgaaa

SEQ ID NO: 125198 - DNA, 20 bp, Artificial Sequence
  Description of Artificial Sequence: Synthetic oligonucleotide
  Target: ATXN1; (+) strand; PAM type: NRG; PAM sequence: AGG
tcttccagtgatcatgaaag

SEQ ID NO: 125199 - DNA, 20 bp, Artificial Sequence
  Description of Artificial Sequence: Synthetic oligonucleotide
  Target: ATXN1; (+) strand; PAM type: NRG; PAM sequence: TAG
gtgatcatgaaagaggcccc

SEQ ID NO: 125200 - DNA, 20 bp, Artificial Sequence
  Description of Artificial Sequence: Synthetic oligonucleotide
  Target: ATXN1; (+) strand; PAM type: NRG; PAM sequence: TGG
tcatgaaagaggcccctaga

SEQ ID NO: 125201 - DNA, 20 bp, Artificial Sequence
  Description of Artificial Sequence: Synthetic oligonucleotide
  Target: ATXN1; (+) strand; PAM type: NRG; PAM sequence: TGG
gaaagaggcccctagatggc

SEQ ID NO: 125202 - DNA, 20 bp, Artificial Sequence
  Description of Artificial Sequence: Synthetic oligonucleotide
  Target: ATXN1; (+) strand; PAM type: NRG; PAM sequence: AAG
cccctagatggctggataaa

SEQ ID NO: 125203 - DNA, 20 bp, Artificial Sequence
  Description of Artificial Sequence: Synthetic oligonucleotide
  Target: ATXN1; (+) strand; PAM type: NRG; PAM sequence: AAG
atggctggataaaaagatca

SEQ ID NO: 125204 - DNA, 20 bp, Artificial Sequence
  Description of Artificial Sequence: Synthetic oligonucleotide
  Target: ATXN1; (+) strand; PAM type: NRG; PAM sequence: CAG
gctggataaaaagatcaaag

SEQ ID NO: 125205 - DNA, 20 bp, Artificial Sequence
  Description of Artificial Sequence: Synthetic oligonucleotide
  Target: ATXN1; (+) strand; PAM type: NRG; PAM sequence: TGG
gatcaaagcagactgcatca

SEQ ID NO: 125206 - DNA, 20 bp, Artificial Sequence
  Description of Artificial Sequence: Synthetic oligonucleotide
  Target: ATXN1; (+) strand; PAM type: NRG; PAM sequence: GAG
tcaaagcagactgcatcatg

SEQ ID NO: 125207 - DNA, 20 bp, Artificial Sequence
  Description of Artificial Sequence: Synthetic oligonucleotide
  Target: ATXN1; (+) strand; PAM type: NRG; PAM sequence: TGG
ctgcatcatggagttatgca

SEQ ID NO: 125208 - DNA, 20 bp, Artificial Sequence
  Description of Artificial Sequence: Synthetic oligonucleotide
  Target: ATXN1; (+) strand; PAM type: NRG; PAM sequence: GAG
gcatcatggagttatgcatg

SEQ ID NO: 125209 - DNA, 20 bp, Artificial Sequence
  Description of Artificial Sequence: Synthetic oligonucleotide
  Target: ATXN1; (+) strand; PAM type: NRG; PAM sequence: AGG
catcatggagttatgcatgg

SEQ ID NO: 125210 - DNA, 20 bp, Artificial Sequence
  Description of Artificial Sequence: Synthetic oligonucleotide
  Target: ATXN1; (+) strand; PAM type: NRG; PAM sequence: CAG
atggagttatgcatggagga

SEQ ID NO: 125211 - DNA, 20 bp, Artificial Sequence
  Description of Artificial Sequence: Synthetic oligonucleotide
  Target: ATXN1; (+) strand; PAM type: NRG; PAM sequence: TGG
tgcatggaggacagttgtcc

SEQ ID NO: 125212 - DNA, 20 bp, Artificial Sequence
  Description of Artificial Sequence: Synthetic oligonucleotide
  Target: ATXN1; (+) strand; PAM type: NRG; PAM sequence: GAG
catggaggacagttgtcctg

SEQ ID NO: 125213 - DNA, 20 bp, Artificial Sequence
  Description of Artificial Sequence: Synthetic oligonucleotide
  Target: ATXN1; (+) strand; PAM type: NRG; PAM sequence: GAG
tggaggacagttgtcctgga

SEQ ID NO: 125214 - DNA, 20 bp, Artificial Sequence
  Description of Artificial Sequence: Synthetic oligonucleotide
  Target: ATXN1; (+) strand; PAM type: NRG; PAM sequence: CAG
ctggagagatactgcatcca

SEQ ID NO: 125215 - DNA, 20 bp, Artificial Sequence
  Description of Artificial Sequence: Synthetic oligonucleotide
  Target: ATXN1; (+) strand; PAM type: NRG; PAM sequence: CGG
gagagatactgcatccacag

SEQ ID NO: 125216 - DNA, 20 bp, Artificial Sequence
  Description of Artificial Sequence: Synthetic oligonucleotide
  Target: ATXN1; (+) strand; PAM type: NRG; PAM sequence: GAG
acagcggtcactgtatgaat

SEQ ID NO: 125217 - DNA, 20 bp, Artificial Sequence
  Description of Artificial Sequence: Synthetic oligonucleotide
  Target: ATXN1; (+) strand; PAM type: NRG; PAM sequence: AAG
aaataaacttttattttgct

SEQ ID NO: 125218 - DNA, 20 bp, Artificial Sequence
  Description of Artificial Sequence: Synthetic oligonucleotide
  Target: ATXN1; (+) strand; PAM type: NRG; PAM sequence: AAG
ttattttgctaagctactga

SEQ ID NO: 125219 - DNA, 20 bp, Artificial Sequence
  Description of Artificial Sequence: Synthetic oligonucleotide
  Target: ATXN1; (+) strand; PAM type: NRG; PAM sequence: TAG
ttgctaagctactgaaagtt

SEQ ID NO: 125220 - DNA, 20 bp, Artificial Sequence
  Description of Artificial Sequence: Synthetic oligonucleotide
  Target: ATXN1; (+) strand; PAM type: NRG; PAM sequence: AGG
tgctaagctactgaaagttt

SEQ ID NO: 125221 - DNA, 20 bp, Artificial Sequence
  Description of Artificial Sequence: Synthetic oligonucleotide
  Target: ATXN1; (+) strand; PAM type: NRG; PAM sequence: GGG
gctaagctactgaaagttta

SEQ ID NO: 125222 - DNA, 20 bp, Artificial Sequence
  Description of Artificial Sequence: Synthetic oligonucleotide
  Target: ATXN1; (+) strand; PAM type: NRG; PAM sequence: AAG
ggttgacctttctgcaacaa

SEQ ID NO: 125223 - DNA, 20 bp, Artificial Sequence
  Description of Artificial Sequence: Synthetic oligonucleotide
  Target: ATXN1; (+) strand; PAM type: NRG; PAM sequence: TAG
tcctatcctgactaatacaa

SEQ ID NO: 125224 - DNA, 20 bp, Artificial Sequence
  Description of Artificial Sequence: Synthetic oligonucleotide
  Target: ATXN1; (+) strand; PAM type: NRG; PAM sequence: TGG
ttttctctattattaccatt

SEQ ID NO: 125225 - DNA, 20 bp, Artificial Sequence
  Description of Artificial Sequence: Synthetic oligonucleotide
  Target: ATXN1; (+) strand; PAM type: NRG; PAM sequence: TAG
tgtctaacaatgccttgtgc

SEQ ID NO: 125226 - DNA, 20 bp, Artificial Sequence
  Description of Artificial Sequence: Synthetic oligonucleotide
  Target: ATXN1; (+) strand; PAM type: NRG; PAM sequence: AGG
gtctaacaatgccttgtgct

SEQ ID NO: 125227 - DNA, 20 bp, Artificial Sequence
  Description of Artificial Sequence: Synthetic oligonucleotide
  Target: ATXN1; (+) strand; PAM type: NRG; PAM sequence: CAG
ggctttatatttactgccct

SEQ ID NO: 125228 - DNA, 20 bp, Artificial Sequence
  Description of Artificial Sequence: Synthetic oligonucleotide
  Target: ATXN1; (+) strand; PAM type: NRG; PAM sequence: GAG
ctcactccttgccacttaat

SEQ ID NO: 125229 - DNA, 20 bp, Artificial Sequence
  Description of Artificial Sequence: Synthetic oligonucleotide
  Target: ATXN1; (+) strand; PAM type: NRG; PAM sequence: AAG
tccttgccacttaatgagac

SEQ ID NO: 125230 - DNA, 20 bp, Artificial Sequence
  Description of Artificial Sequence: Synthetic oligonucleotide
  Target: ATXN1; (+) strand; PAM type: NRG; PAM sequence: GAG
cttgccacttaatgagacaa

SEQ ID NO: 125231 - DNA, 20 bp, Artificial Sequence
  Description of Artificial Sequence: Synthetic oligonucleotide
  Target: ATXN1; (+) strand; PAM type: NRG; PAM sequence: AAG
aatgagacaagagcctcttg

SEQ ID NO: 125232 - DNA, 20 bp, Artificial Sequence
  Description of Artificial Sequence: Synthetic oligonucleotide
  Target: ATXN1; (+) strand; PAM type: NRG; PAM sequence: CAG
agacaagagcctcttgaaga

SEQ ID NO: 125233 - DNA, 20 bp, Artificial Sequence
  Description of Artificial Sequence: Synthetic oligonucleotide
  Target: ATXN1; (+) strand; PAM type: NRG; PAM sequence: TGG
cctcttgaagacagtgacct

SEQ ID NO: 125234 - DNA, 20 bp, Artificial Sequence
  Description of Artificial Sequence: Synthetic oligonucleotide
  Target: ATXN1; (+) strand; PAM type: NRG; PAM sequence: CAG
gtgaccttggcttgtacttt

SEQ ID NO: 125235 - DNA, 20 bp, Artificial Sequence
  Description of Artificial Sequence: Synthetic oligonucleotide
  Target: ATXN1; (+) strand; PAM type: NRG; PAM sequence: AGG
tgaccttggcttgtactttc

SEQ ID NO: 125236 - DNA, 20 bp, Artificial Sequence
  Description of Artificial Sequence: Synthetic oligonucleotide
  Target: ATXN1; (+) strand; PAM type: NRG; PAM sequence: GGG
gaccttggcttgtactttca

SEQ ID NO: 125237 - DNA, 20 bp, Artificial Sequence
  Description of Artificial Sequence: Synthetic oligonucleotide
  Target: ATXN1; (+) strand; PAM type: NRG; PAM sequence: TAG
tcatcattttccccaaaatt

SEQ ID NO: 125238 - DNA, 20 bp, Artificial Sequence
  Description of Artificial Sequence: Synthetic oligonucleotide
  Target: ATXN1; (+) strand; PAM type: NRG; PAM sequence: GAG
tttccccaaaatttagttgt

SEQ ID NO: 125239 - DNA, 20 bp, Artificial Sequence
  Description of Artificial Sequence: Synthetic oligonucleotide
  Target: ATXN1; (+) strand; PAM type: NRG; PAM sequence: AAG
aatttagttgtgagcctcgc

SEQ ID NO: 125240 - DNA, 20 bp, Artificial Sequence
  Description of Artificial Sequence: Synthetic oligonucleotide
  Target: ATXN1; (+) strand; PAM type: NRG; PAM sequence: CAG
ttagttgtgagcctcgcaag

SEQ ID NO: 125241 - DNA, 20 bp, Artificial Sequence
  Description of Artificial Sequence: Synthetic oligonucleotide
  Target: ATXN1; (+) strand; PAM type: NRG; PAM sequence: TAG
gttgtgagcctcgcaagcag

SEQ ID NO: 125242 - DNA, 20 bp, Artificial Sequence
  Description of Artificial Sequence: Synthetic oligonucleotide
  Target: ATXN1; (+) strand; PAM type: NRG; PAM sequence: TAG
atgacttgatattttcccac

SEQ ID NO: 125243 - DNA, 20 bp, Artificial Sequence
  Description of Artificial Sequence: Synthetic oligonucleotide
  Target: ATXN1; (+) strand; PAM type: NRG; PAM sequence: AGG
tgacttgatattttcccact

SEQ ID NO: 125244 - DNA, 20 bp, Artificial Sequence
  Description of Artificial Sequence: Synthetic oligonucleotide
  Target: ATXN1; (+) strand; PAM type: NRG; PAM sequence: CAG
cattaaccaataccaccatg

SEQ ID NO: 125245 - DNA, 20 bp, Artificial Sequence
  Description of Artificial Sequence: Synthetic oligonucleotide
  Target: ATXN1; (+) strand; PAM type: NRG; PAM sequence: AGG
attaaccaataccaccatgc

SEQ ID NO: 125246 - DNA, 20 bp, Artificial Sequence
  Description of Artificial Sequence: Synthetic oligonucleotide
  Target: ATXN1; (+) strand; PAM type: NRG; PAM sequence: TGG
ccaataccaccatgcaggca

SEQ ID NO: 125247 - DNA, 20 bp, Artificial Sequence
  Description of Artificial Sequence: Synthetic oligonucleotide
  Target: ATXN1; (+) strand; PAM type: NRG; PAM sequence: CAG
accatgcaggcatggatcat

SEQ ID NO: 125248 - DNA, 20 bp, Artificial Sequence
  Description of Artificial Sequence: Synthetic oligonucleotide
  Target: ATXN1; (+) strand; PAM type: NRG; PAM sequence: AGG
ccatgcaggcatggatcatc

SEQ ID NO: 125249 - DNA, 20 bp, Artificial Sequence
  Description of Artificial Sequence: Synthetic oligonucleotide
  Target: ATXN1; (+) strand; PAM type: NRG; PAM sequence: AAG
ggcatggatcatcaggaatt

SEQ ID NO: 125250 - DNA, 20 bp, Artificial Sequence
  Description of Artificial Sequence: Synthetic oligonucleotide
  Target: ATXN1; (+) strand; PAM type: NRG; PAM sequence: TGG
tcatcaggaattaagtgcaa

SEQ ID NO: 125251 - DNA, 20 bp, Artificial Sequence
  Description of Artificial Sequence: Synthetic oligonucleotide
  Target: ATXN1; (+) strand; PAM type: NRG; PAM sequence: AAG
gaattaagtgcaatggctac

SEQ ID NO: 125252 - DNA, 20 bp, Artificial Sequence
  Description of Artificial Sequence: Synthetic oligonucleotide
  Target: ATXN1; (+) strand; PAM type: NRG; PAM sequence: AAG
ttaagtgcaatggctacaag

SEQ ID NO: 125253 - DNA, 20 bp, Artificial Sequence
  Description of Artificial Sequence: Synthetic oligonucleotide
  Target: ATXN1; (+) strand; PAM type: NRG; PAM sequence: AGG
taagtgcaatggctacaaga

SEQ ID NO: 125254 - DNA, 20 bp, Artificial Sequence
  Description of Artificial Sequence: Synthetic oligonucleotide
  Target: ATXN1; (+) strand; PAM type: NRG; PAM sequence: TAG
caatggctacaagaaggcat

SEQ ID NO: 125255 - DNA, 20 bp, Artificial Sequence
  Description of Artificial Sequence: Synthetic oligonucleotide
  Target: ATXN1; (+) strand; PAM type: NRG; PAM sequence: TAG
attcatctgtgaatttatct

SEQ ID NO: 125256 - DNA, 20 bp, Artificial Sequence
  Description of Artificial Sequence: Synthetic oligonucleotide
  Target: ATXN1; (+) strand; PAM type: NRG; PAM sequence: TGG
ctgtgaatttatcttagcca

SEQ ID NO: 125257 - DNA, 20 bp, Artificial Sequence
  Description of Artificial Sequence: Synthetic oligonucleotide
  Target: ATXN1; (+) strand; PAM type: NRG; PAM sequence: TGG
ccttgattctgtgtcaacca

SEQ ID NO: 125258 - DNA, 20 bp, Artificial Sequence
  Description of Artificial Sequence: Synthetic oligonucleotide
  Target: ATXN1; (+) strand; PAM type: NRG; PAM sequence: TAG
tgtgttgaccctaatgtctt

SEQ ID NO: 125259 - DNA, 20 bp, Artificial Sequence
  Description of Artificial Sequence: Synthetic oligonucleotide
  Target: ATXN1; (+) strand; PAM type: NRG; PAM sequence: AGG
gtgttgaccctaatgtcttt

SEQ ID NO: 125260 - DNA, 20 bp, Artificial Sequence
  Description of Artificial Sequence: Synthetic oligonucleotide
  Target: ATXN1; (+) strand; PAM type: NRG; PAM sequence: TGG
ttaggtctatttaatgattt

SEQ ID NO: 125261 - DNA, 20 bp, Artificial Sequence
  Description of Artificial Sequence: Synthetic oligonucleotide
  Target: ATXN1; (+) strand; PAM type: NRG; PAM sequence: TGG
tctatttaatgattttggtc

SEQ ID NO: 125262 - DNA, 20 bp, Artificial Sequence
  Description of Artificial Sequence: Synthetic oligonucleotide
  Target: ATXN1; (+) strand; PAM type: NRG; PAM sequence: GGG
ctatttaatgattttggtct

SEQ ID NO: 125263 - DNA, 20 bp, Artificial Sequence
  Description of Artificial Sequence: Synthetic oligonucleotide
  Target: ATXN1; (+) strand; PAM type: NRG; PAM sequence: CAG
gggcttctaaaattctcatt

SEQ ID NO: 125264 - DNA, 20 bp, Artificial Sequence
  Description of Artificial Sequence: Synthetic oligonucleotide
  Target: ATXN1; (+) strand; PAM type: NRG; PAM sequence: CAG
tttgttcattcacacaaata

SEQ ID NO: 125265 - DNA, 20 bp, Artificial Sequence
  Description of Artificial Sequence: Synthetic oligonucleotide
  Target: ATXN1; (+) strand; PAM type: NRG; PAM sequence: TAG
gttcattcacacaaatacag

SEQ ID NO: 125266 - DNA, 20 bp, Artificial Sequence
  Description of Artificial Sequence: Synthetic oligonucleotide
  Target: ATXN1; (+) strand; PAM type: NRG; PAM sequence: CAG
attcacacaaatacagtagt

SEQ ID NO: 125267 - DNA, 20 bp, Artificial Sequence
  Description of Artificial Sequence: Synthetic oligonucleotide
  Target: ATXN1; (+) strand; PAM type: NRG; PAM sequence: GAG
aaatacagtagtcagtttct

SEQ ID NO: 125268 - DNA, 20 bp, Artificial Sequence
  Description of Artificial Sequence: Synthetic oligonucleotide
  Target: ATXN1; (+) strand; PAM type: NRG; PAM sequence: GAG
atacagtagtcagtttctga

SEQ ID NO: 125269 - DNA, 20 bp, Artificial Sequence
  Description of Artificial Sequence: Synthetic oligonucleotide
  Target: ATXN1; (+) strand; PAM type: NRG; PAM sequence: AGG
tacagtagtcagtttctgag

SEQ ID NO: 125270 - DNA, 20 bp, Artificial Sequence
  Description of Artificial Sequence: Synthetic oligonucleotide
  Target: ATXN1; (+) strand; PAM type: NRG; PAM sequence: TAG
agtagtcagtttctgagagg

SEQ ID NO: 125271 - DNA, 20 bp, Artificial Sequence
  Description of Artificial Sequence: Synthetic oligonucleotide
  Target: ATXN1; (+) strand; PAM type: NRG; PAM sequence: CAG
agtcagtttctgagaggtag

SEQ ID NO: 125272 - DNA, 20 bp, Artificial Sequence
  Description of Artificial Sequence: Synthetic oligonucleotide
  Target: ATXN1; (+) strand; PAM type: NRG; PAM sequence: GAG
tcagtttctgagaggtagca

SEQ ID NO: 125273 - DNA, 20 bp, Artificial Sequence
  Description of Artificial Sequence: Synthetic oligonucleotide
  Target: ATXN1; (+) strand; PAM type: NRG; PAM sequence: AAG
tgagaggtagcagagaaaaa

SEQ ID NO: 125274 - DNA, 20 bp, Artificial Sequence
  Description of Artificial Sequence: Synthetic oligonucleotide
  Target: ATXN1; (+) strand; PAM type: NRG; PAM sequence: TGG
gtagcagagaaaaaaagcta

SEQ ID NO: 125275 - DNA, 20 bp, Artificial Sequence
  Description of Artificial Sequence: Synthetic oligonucleotide
  Target: ATXN1; (+) strand; PAM type: NRG; PAM sequence: GAG
agcagagaaaaaaagctatg

SEQ ID NO: 125276 - DNA, 20 bp, Artificial Sequence
  Description of Artificial Sequence: Synthetic oligonucleotide
  Target: ATXN1; (+) strand; PAM type: NRG; PAM sequence: CAG
gagaaaaaaagctatggagt

SEQ ID NO: 125277 - DNA, 20 bp, Artificial Sequence
  Description of Artificial Sequence: Synthetic oligonucleotide
  Target: ATXN1; (+) strand; PAM type: NRG; PAM sequence: AGG
agaaaaaaagctatggagtc

SEQ ID NO: 125278 - DNA, 20 bp, Artificial Sequence
  Description of Artificial Sequence: Synthetic oligonucleotide
  Target: ATXN1; (+) strand; PAM type: NRG; PAM sequence: TAG
aaaaagctatggagtcaggc

SEQ ID NO: 125279 - DNA, 20 bp, Artificial Sequence
  Description of Artificial Sequence: Synthetic oligonucleotide
  Target: ATXN1; (+) strand; PAM type: NRG; PAM sequence: GAG
tatggagtcaggctagctgt

SEQ ID NO: 125280 - DNA, 20 bp, Artificial Sequence
  Description of Artificial Sequence: Synthetic oligonucleotide
  Target: ATXN1; (+) strand; PAM type: NRG; PAM sequence: TGG
tcaggctagctgtgagactg

SEQ ID NO: 125281 - DNA, 20 bp, Artificial Sequence
  Description of Artificial Sequence: Synthetic oligonucleotide
  Target: ATXN1; (+) strand; PAM type: NRG; PAM sequence: GGG
caggctagctgtgagactgt

SEQ ID NO: 125282 - DNA, 20 bp, Artificial Sequence
  Description of Artificial Sequence: Synthetic oligonucleotide
  Target: ATXN1; (+) strand; PAM type: NRG; PAM sequence: CAG
ctagctgtgagactgtgggc

SEQ ID NO: 125283 - DNA, 20 bp, Artificial Sequence
  Description of Artificial Sequence: Synthetic oligonucleotide
  Target: ATXN1; (+) strand; PAM type: NRG; PAM sequence: CAG
acttgacctcttcatgtccc

SEQ ID NO: 125284 - DNA, 20 bp, Artificial Sequence
  Description of Artificial Sequence: Synthetic oligonucleotide
  Target: ATXN1; (+) strand; PAM type: NRG; PAM sequence: GAG
agtttcctttcccacaaaac

SEQ ID NO: 125285 - DNA, 20 bp, Artificial Sequence
  Description of Artificial Sequence: Synthetic oligonucleotide
  Target: ATXN1; (+) strand; PAM type: NRG; PAM sequence: AAG
gagtttaaaatgtatcttgt

SEQ ID NO: 125286 - DNA, 20 bp, Artificial Sequence
  Description of Artificial Sequence: Synthetic oligonucleotide
  Target: ATXN1; (+) strand; PAM type: NRG; PAM sequence: AGG
agtttaaaatgtatcttgta

SEQ ID NO: 125287 - DNA, 20 bp, Artificial Sequence
  Description of Artificial Sequence: Synthetic oligonucleotide
  Target: ATXN1; (+) strand; PAM type: NRG; PAM sequence: GAG
gtatcttgtaaggttgttgt

SEQ ID NO: 125288 - DNA, 20 bp, Artificial Sequence
  Description of Artificial Sequence: Synthetic oligonucleotide
  Target: ATXN1; (+) strand; PAM type: NRG; PAM sequence: AAG
ggttgttgtgagaattacac

SEQ ID NO: 125289 - DNA, 20 bp, Artificial Sequence
  Description of Artificial Sequence: Synthetic oligonucleotide
  Target: ATXN1; (+) strand; PAM type: NRG; PAM sequence: AAG
ttacacaagttaatatatgc

SEQ ID NO: 125290 - DNA, 20 bp, Artificial Sequence
  Description of Artificial Sequence: Synthetic oligonucleotide
  Target: ATXN1; (+) strand; PAM type: NRG; PAM sequence: AAG
aatatatgcaagatacataa

SEQ ID NO: 125291 - DNA, 20 bp, Artificial Sequence
  Description of Artificial Sequence: Synthetic oligonucleotide
  Target: ATXN1; (+) strand; PAM type: NRG; PAM sequence: AAG
ttattttaaattttaaaata

SEQ ID NO: 125292 - DNA, 20 bp, Artificial Sequence
  Description of Artificial Sequence: Synthetic oligonucleotide
  Target: ATXN1; (+) strand; PAM type: NRG; PAM sequence: CAG
ttttaaattttaaaataaag

SEQ ID NO: 125293 - DNA, 20 bp, Artificial Sequence
  Description of Artificial Sequence: Synthetic oligonucleotide
  Target: ATXN1; (+) strand; PAM type: NRG; PAM sequence: TGG
attttaaaataaagcagtac

SEQ ID NO: 125294 - DNA, 20 bp, Artificial Sequence
  Description of Artificial Sequence: Synthetic oligonucleotide
  Target: ATXN1; (+) strand; PAM type: NRG; PAM sequence: GGG
ttttaaaataaagcagtact

SEQ ID NO: 125295 - DNA, 20 bp, Artificial Sequence
  Description of Artificial Sequence: Synthetic oligonucleotide
  Target: ATXN1; (+) strand; PAM type: NRG; PAM sequence: AAG
agcagtactgggcatgttgt

SEQ ID NO: 125296 - DNA, 20 bp, Artificial Sequence
  Description of Artificial Sequence: Synthetic oligonucleotide
  Target: ATXN1; (+) strand; PAM type: NRG; PAM sequence: TAG
ctgggcatgttgtaagtgct

SEQ ID NO: 125297 - DNA, 20 bp, Artificial Sequence
  Description of Artificial Sequence: Synthetic oligonucleotide
  Target: ATXN1; (+) strand; PAM type: NRG; PAM sequence: GAG
tgctaatattatcatatact

SEQ ID NO: 125298 - DNA, 20 bp, Artificial Sequence
  Description of Artificial Sequence: Synthetic oligonucleotide
  Target: ATXN1; (+) strand; PAM type: NRG; PAM sequence: TGG
tatactgagcacctactaca

SEQ ID NO: 125299 - DNA, 20 bp, Artificial Sequence
  Description of Artificial Sequence: Synthetic oligonucleotide
  Target: ATXN1; (+) strand; PAM type: NRG; PAM sequence: CAG
actgagcacctactacatgg

SEQ ID NO: 125300 - DNA, 20 bp, Artificial Sequence
  Description of Artificial Sequence: Synthetic oligonucleotide
  Target: ATXN1; (+) strand; PAM type: NRG; PAM sequence: TAG
acctactacatggcagatat

SEQ ID NO: 125301 - DNA, 20 bp, Artificial Sequence
  Description of Artificial Sequence: Synthetic oligonucleotide
  Target: ATXN1; (+) strand; PAM type: NRG; PAM sequence: GAG
ctactacatggcagatatta

SEQ ID NO: 125302 - DNA, 20 bp, Artificial Sequence
  Description of Artificial Sequence: Synthetic oligonucleotide
  Target: ATXN1; (+) strand; PAM type: NRG; PAM sequence: AGG
tactacatggcagatattag

SEQ ID NO: 125303 - DNA, 20 bp, Artificial Sequence
  Description of Artificial Sequence: Synthetic oligonucleotide
  Target: ATXN1; (+) strand; PAM type: NRG; PAM sequence: AAG
atggcagatattagaggaac

SEQ ID NO: 125304 - DNA, 20 bp, Artificial Sequence
  Description of Artificial Sequence: Synthetic oligonucleotide
  Target: ATXN1; (+) strand; PAM type: NRG; PAM sequence: CAG
agaggaacaagaatgattaa

SEQ ID NO: 125305 - DNA, 20 bp, Artificial Sequence
  Description of Artificial Sequence: Synthetic oligonucleotide
  Target: ATXN1; (+) strand; PAM type: NRG; PAM sequence: AGG
gaggaacaagaatgattaac

SEQ ID NO: 125306 - DNA, 20 bp, Artificial Sequence
  Description of Artificial Sequence: Synthetic oligonucleotide
  Target: ATXN1; (+) strand; PAM type: NRG; PAM sequence: CAG
agaatgattaacaggttccc

SEQ ID NO: 125307 - DNA, 20 bp, Artificial Sequence
  Description of Artificial Sequence: Synthetic oligonucleotide
  Target: ATXN1; (+) strand; PAM type: NRG; PAM sequence: AAG
aacaggttccccagttcttc

SEQ ID NO: 125308 - DNA, 20 bp, Artificial Sequence
  Description of Artificial Sequence: Synthetic oligonucleotide
  Target: ATXN1; (+) strand; PAM type: NRG; PAM sequence: TAG
ttcttcaagcatttgcaatc

SEQ ID NO: 125309 - DNA, 20 bp, Artificial Sequence
  Description of Artificial Sequence: Synthetic oligonucleotide
  Target: ATXN1; (+) strand; PAM type: NRG; PAM sequence: AAG
tcaagcatttgcaatctagt

SEQ ID NO: 125310 - DNA, 20 bp, Artificial Sequence
  Description of Artificial Sequence: Synthetic oligonucleotide
  Target: ATXN1; (+) strand; PAM type: NRG; PAM sequence: AGG
caagcatttgcaatctagta

SEQ ID NO: 125311 - DNA, 20 bp, Artificial Sequence
  Description of Artificial Sequence: Synthetic oligonucleotide
  Target: ATXN1; (+) strand; PAM type: NRG; PAM sequence: GGG
aagcatttgcaatctagtaa

SEQ ID NO: 125312 - DNA, 20 bp, Artificial Sequence
  Description of Artificial Sequence: Synthetic oligonucleotide
  Target: ATXN1; (+) strand; PAM type: NRG; PAM sequence: AAG
ttgcaatctagtaagggtaa

SEQ ID NO: 125313 - DNA, 20 bp, Artificial Sequence
  Description of Artificial Sequence: Synthetic oligonucleotide
  Target: ATXN1; (+) strand; PAM type: NRG; PAM sequence: AAG
taaaagatatgtaaacaaat

SEQ ID NO: 125314 - DNA, 20 bp, Artificial Sequence
  Description of Artificial Sequence: Synthetic oligonucleotide
  Target: ATXN1; (+) strand; PAM type: NRG; PAM sequence: AAG
gatatgtaaacaaataagtg

SEQ ID NO: 125315 - DNA, 20 bp, Artificial Sequence
  Description of Artificial Sequence: Synthetic oligonucleotide
  Target: ATXN1; (+) strand; PAM type: NRG; PAM sequence: CAG
aacaaataagtgaagtatta

SEQ ID NO: 125316 - DNA, 20 bp, Artificial Sequence
  Description of Artificial Sequence: Synthetic oligonucleotide
  Target: ATXN1; (+) strand; PAM type: NRG; PAM sequence: GAG
caaataagtgaagtattaca

SEQ ID NO: 125317 - DNA, 20 bp, Artificial Sequence
  Description of Artificial Sequence: Synthetic oligonucleotide
  Target: ATXN1; (+) strand; PAM type: NRG; PAM sequence: CAG
taagtgaagtattacagagc

SEQ ID NO: 125318 - DNA, 20 bp, Artificial Sequence
  Description of Artificial Sequence: Synthetic oligonucleotide
  Target: ATXN1; (+) strand; PAM type: NRG; PAM sequence: GAG
agtgaagtattacagagcca

SEQ ID NO: 125319 - DNA, 20 bp, Artificial Sequence
  Description of Artificial Sequence: Synthetic oligonucleotide
  Target: ATXN1; (+) strand; PAM type: NRG; PAM sequence: GAG
tgaagtattacagagccaga

SEQ ID NO: 125320 - DNA, 20 bp, Artificial Sequence
  Description of Artificial Sequence: Synthetic oligonucleotide
  Target: ATXN1; (+) strand; PAM type: NRG; PAM sequence: GAG
aagtattacagagccagaga

SEQ ID NO: 125321 - DNA, 20 bp, Artificial Sequence
  Description of Artificial Sequence: Synthetic oligonucleotide
  Target: ATXN1; (+) strand; PAM type: NRG; PAM sequence: GAG
gtattacagagccagagaga

SEQ ID NO: 125322 - DNA, 20 bp, Artificial Sequence
  Description of Artificial Sequence: Synthetic oligonucleotide
  Target: ATXN1; (+) strand; PAM type: NRG; PAM sequence: GAG
attacagagccagagagaga

SEQ ID NO: 125323 - DNA, 20 bp, Artificial Sequence
  Description of Artificial Sequence: Synthetic oligonucleotide
  Target: ATXN1; (+) strand; PAM type: NRG; PAM sequence: AAG
gccagagagagagagaacac

SEQ ID NO: 125324 - DNA, 20 bp, Artificial Sequence
  Description of Artificial Sequence: Synthetic oligonucleotide
  Target: ATXN1; (+) strand; PAM type: NRG; PAM sequence: AAG
atacaaatacatatgcacaa

SEQ ID NO: 125325 - DNA, 20 bp, Artificial Sequence
  Description of Artificial Sequence: Synthetic oligonucleotide
  Target: ATXN1; (+) strand; PAM type: NRG; PAM sequence: AGG
tacaaatacatatgcacaaa

SEQ ID NO: 125326 - DNA, 20 bp, Artificial Sequence
  Description of Artificial Sequence: Synthetic oligonucleotide
  Target: ATXN1; (+) strand; PAM type: NRG; PAM sequence: CAG
tacatatgcacaaaaggata

SEQ ID NO: 125327 - DNA, 20 bp, Artificial Sequence
  Description of Artificial Sequence: Synthetic oligonucleotide
  Target: ATXN1; (+) strand; PAM type: NRG; PAM sequence: AGG
acatatgcacaaaaggatac

SEQ ID NO: 125328 - DNA, 20 bp, Artificial Sequence
  Description of Artificial Sequence: Synthetic oligonucleotide
  Target: ATXN1; (+) strand; PAM type: NRG; PAM sequence: TAG
cacaaaaggatacaggtatg

SEQ ID NO: 125329 - DNA, 20 bp, Artificial Sequence
  Description of Artificial Sequence: Synthetic oligonucleotide
  Target: ATXN1; (+) strand; PAM type: NRG; PAM sequence: AGG
acaaaaggatacaggtatgt

SEQ ID NO: 125330 - DNA, 20 bp, Artificial Sequence
  Description of Artificial Sequence: Synthetic oligonucleotide
  Target: ATXN1; (+) strand; PAM type: NRG; PAM sequence: AAG
ggtgcacacacatgcataca

SEQ ID NO: 125331 - DNA, 20 bp, Artificial Sequence
  Description of Artificial Sequence: Synthetic oligonucleotide
  Target: ATXN1; (+) strand; PAM type: NRG; PAM sequence: GAG
acatgcacactcacctacat

SEQ ID NO: 125332 - DNA, 20 bp, Artificial Sequence
  Description of Artificial Sequence: Synthetic oligonucleotide
  Target: ATXN1; (+) strand; PAM type: NRG; PAM sequence: GAG
atgcacactcacctacatga

SEQ ID NO: 125333 - DNA, 20 bp, Artificial Sequence
  Description of Artificial Sequence: Synthetic oligonucleotide
  Target: ATXN1; (+) strand; PAM type: NRG; PAM sequence: GAG
gccaactactgccaactgat

SEQ ID NO: 125334 - DNA, 20 bp, Artificial Sequence
  Description of Artificial Sequence: Synthetic oligonucleotide
  Target: ATXN1; (+) strand; PAM type: NRG; PAM sequence: CAG
gccaactgatgagctacata

SEQ ID NO: 125335 - DNA, 20 bp, Artificial Sequence
  Description of Artificial Sequence: Synthetic oligonucleotide
  Target: ATXN1; (+) strand; PAM type: NRG; PAM sequence: GAG
caactgatgagctacataca

SEQ ID NO: 125336 - DNA, 20 bp, Artificial Sequence
  Description of Artificial Sequence: Synthetic oligonucleotide
  Target: ATXN1; (+) strand; PAM type: NRG; PAM sequence: AAG
tgatgagctacatacagagc

SEQ ID NO: 125337 - DNA, 20 bp, Artificial Sequence
  Description of Artificial Sequence: Synthetic oligonucleotide
  Target: ATXN1; (+) strand; PAM type: NRG; PAM sequence: AAG
tgagctacatacagagcaag

SEQ ID NO: 125338 - DNA, 20 bp, Artificial Sequence
  Description of Artificial Sequence: Synthetic oligonucleotide
  Target: ATXN1; (+) strand; PAM type: NRG; PAM sequence: GAG
agctacatacagagcaagaa

SEQ ID NO: 125339 - DNA, 20 bp, Artificial Sequence
  Description of Artificial Sequence: Synthetic oligonucleotide
  Target: ATXN1; (+) strand; PAM type: NRG; PAM sequence: TAG
agagaccacgattgctgaac

SEQ ID NO: 125340 - DNA, 20 bp, Artificial Sequence
  Description of Artificial Sequence: Synthetic oligonucleotide
  Target: ATXN1; (+) strand; PAM type: NRG; PAM sequence: CAG
gattgctgaactagctccta

SEQ ID NO: 125341 - DNA, 20 bp, Artificial Sequence
  Description of Artificial Sequence: Synthetic oligonucleotide
  Target: ATXN1; (+) strand; PAM type: NRG; PAM sequence: CAG
actagctcctacagacttgc

SEQ ID NO: 125342 - DNA, 20 bp, Artificial Sequence
  Description of Artificial Sequence: Synthetic oligonucleotide
  Target: ATXN1; (+) strand; PAM type: NRG; PAM sequence: AAG
ctcctacagacttgccagac

SEQ ID NO: 125343 - DNA, 20 bp, Artificial Sequence
  Description of Artificial Sequence: Synthetic oligonucleotide
  Target: ATXN1; (+) strand; PAM type: NRG; PAM sequence: CAG
tacagacttgccagacaaga

SEQ ID NO: 125344 - DNA, 20 bp, Artificial Sequence
  Description of Artificial Sequence: Synthetic oligonucleotide
  Target: ATXN1; (+) strand; PAM type: NRG; PAM sequence: AGG
acagacttgccagacaagac

SEQ ID NO: 125345 - DNA, 20 bp, Artificial Sequence
  Description of Artificial Sequence: Synthetic oligonucleotide
  Target: ATXN1; (+) strand; PAM type: NRG; PAM sequence: GGG
cagacttgccagacaagaca

SEQ ID NO: 125346 - DNA, 20 bp, Artificial Sequence
  Description of Artificial Sequence: Synthetic oligonucleotide
  Target: ATXN1; (+) strand; PAM type: NRG; PAM sequence: CAG
tgccagacaagacagggcac

SEQ ID NO: 125347 - DNA, 20 bp, Artificial Sequence
  Description of Artificial Sequence: Synthetic oligonucleotide
  Target: ATXN1; (+) strand; PAM type: NRG; PAM sequence: AGG
gccagacaagacagggcacc

SEQ ID NO: 125348 - DNA, 20 bp, Artificial Sequence
  Description of Artificial Sequence: Synthetic oligonucleotide
  Target: ATXN1; (+) strand; PAM type: NRG; PAM sequence: GGG
ccagacaagacagggcacca

SEQ ID NO: 125349 - DNA, 20 bp, Artificial Sequence
  Description of Artificial Sequence: Synthetic oligonucleotide
  Target: ATXN1; (+) strand; PAM type: NRG; PAM sequence: CAG
gacagggcaccagggatgtc

SEQ ID NO: 125350 - DNA, 20 bp, Artificial Sequence
  Description of Artificial Sequence: Synthetic oligonucleotide
  Target: ATXN1; (+) strand; PAM type: NRG; PAM sequence: AGG
acagggcaccagggatgtcc

SEQ ID NO: 125351 - DNA, 20 bp, Artificial Sequence
  Description of Artificial Sequence: Synthetic oligonucleotide
  Target: ATXN1; (+) strand; PAM type: NRG; PAM sequence: AAG
cagggatgtccaggtaatta

SEQ ID NO: 125352 - DNA, 20 bp, Artificial Sequence
  Description of Artificial Sequence: Synthetic oligonucleotide
  Target: ATXN1; (+) strand; PAM type: NRG; PAM sequence: GAG
gggatgtccaggtaattaaa

SEQ ID NO: 125353 - DNA, 20 bp, Artificial Sequence
  Description of Artificial Sequence: Synthetic oligonucleotide
  Target: ATXN1; (+) strand; PAM type: NRG; PAM sequence: GAG
tccaggtaattaaagagtgt

SEQ ID NO: 125354 - DNA, 20 bp, Artificial Sequence
  Description of Artificial Sequence: Synthetic oligonucleotide
  Target: ATXN1; (+) strand; PAM type: NRG; PAM sequence: CAG
aggtaattaaagagtgtgag

SEQ ID NO: 125355 - DNA, 20 bp, Artificial Sequence
  Description of Artificial Sequence: Synthetic oligonucleotide
  Target: ATXN1; (+) strand; PAM type: NRG; PAM sequence: GAG
gtaattaaagagtgtgagca

SEQ ID NO: 125356 - DNA, 20 bp, Artificial Sequence
  Description of Artificial Sequence: Synthetic oligonucleotide
  Target: ATXN1; (+) strand; PAM type: NRG; PAM sequence: AGG
taattaaagagtgtgagcag

SEQ ID NO: 125357 - DNA, 20 bp, Artificial Sequence
  Description of Artificial Sequence: Synthetic oligonucleotide
  Target: ATXN1; (+) strand; PAM type: NRG; PAM sequence: TGG
tcaaatgcctcctatgtgct

SEQ ID NO: 125358 - DNA, 20 bp, Artificial Sequence
  Description of Artificial Sequence: Synthetic oligonucleotide
  Target: ATXN1; (+) strand; PAM type: NRG; PAM sequence: CAG
tgcctcctatgtgcttggca

SEQ ID NO: 125359 - DNA, 20 bp, Artificial Sequence
  Description of Artificial Sequence: Synthetic oligonucleotide
  Target: ATXN1; (+) strand; PAM type: NRG; PAM sequence: TGG
cttggcacagttttaaatac

SEQ ID NO: 125360 - DNA, 20 bp, Artificial Sequence
  Description of Artificial Sequence: Synthetic oligonucleotide
  Target: ATXN1; (+) strand; PAM type: NRG; PAM sequence: GGG
ttggcacagttttaaatact

SEQ ID NO: 125361 - DNA, 20 bp, Artificial Sequence
  Description of Artificial Sequence: Synthetic oligonucleotide
  Target: ATXN1; (+) strand; PAM type: NRG; PAM sequence: CAG
tttaaatactgggatacatg

SEQ ID NO: 125362 - DNA, 20 bp, Artificial Sequence
  Description of Artificial Sequence: Synthetic oligonucleotide
  Target: ATXN1; (+) strand; PAM type: NRG; PAM sequence: GAG
ctgggatacatgcagtccat

SEQ ID NO: 125363 - DNA, 20 bp, Artificial Sequence
  Description of Artificial Sequence: Synthetic oligonucleotide
  Target: ATXN1; (+) strand; PAM type: NRG; PAM sequence: AAG
atgcagtccatgagaccgac

SEQ ID NO: 125364 - DNA, 20 bp, Artificial Sequence
  Description of Artificial Sequence: Synthetic oligonucleotide
  Target: ATXN1; (+) strand; PAM type: NRG; PAM sequence: AGG
tgcagtccatgagaccgaca

SEQ ID NO: 125365 - DNA, 20 bp, Artificial Sequence
  Description of Artificial Sequence: Synthetic oligonucleotide
  Target: ATXN1; (+) strand; PAM type: NRG; PAM sequence: GAG
acaaggcttttgcttccact

SEQ ID NO: 125366 - DNA, 20 bp, Artificial Sequence
  Description of Artificial Sequence: Synthetic oligonucleotide
  Target: ATXN1; (+) strand; PAM type: NRG; PAM sequence: TAG
ttccactgagctaattctaa

SEQ ID NO: 125367 - DNA, 20 bp, Artificial Sequence
  Description of Artificial Sequence: Synthetic oligonucleotide
  Target: ATXN1; (+) strand; PAM type: NRG; PAM sequence: GAG
ccactgagctaattctaata

SEQ ID NO: 125368 - DNA, 20 bp, Artificial Sequence
  Description of Artificial Sequence: Synthetic oligonucleotide
  Target: ATXN1; (+) strand; PAM type: NRG; PAM sequence: AGG
cactgagctaattctaatag

SEQ ID NO: 125369 - DNA, 20 bp, Artificial Sequence
  Description of Artificial Sequence: Synthetic oligonucleotide
  Target: ATXN1; (+) strand; PAM type: NRG; PAM sequence: GAG
ctgagctaattctaatagag

SEQ ID NO: 125370 - DNA, 20 bp, Artificial Sequence
  Description of Artificial Sequence: Synthetic oligonucleotide
  Target: ATXN1; (+) strand; PAM type: NRG; PAM sequence: CAG
agaggagactaacaataaac

SEQ ID NO: 125371 - DNA, 20 bp, Artificial Sequence
  Description of Artificial Sequence: Synthetic oligonucleotide
  Target: ATXN1; (+) strand; PAM type: NRG; PAM sequence: CAG
ggagactaacaataaaccag

SEQ ID NO: 125372 - DNA, 20 bp, Artificial Sequence
  Description of Artificial Sequence: Synthetic oligonucleotide
  Target: ATXN1; (+) strand; PAM type: NRG; PAM sequence: CGG
actaacaataaaccagcagt

SEQ ID NO: 125373 - DNA, 20 bp, Artificial Sequence
  Description of Artificial Sequence: Synthetic oligonucleotide
  Target: ATXN1; (+) strand; PAM type: NRG; PAM sequence: CAG
aataaaccagcagtcggatg

SEQ ID NO: 125374 - DNA, 20 bp, Artificial Sequence
  Description of Artificial Sequence: Synthetic oligonucleotide
  Target: ATXN1; (+) strand; PAM type: NRG; PAM sequence: AAG
aaaccagcagtcggatgcag

SEQ ID NO: 125375 - DNA, 20 bp, Artificial Sequence
  Description of Artificial Sequence: Synthetic oligonucleotide
  Target: ATXN1; (+) strand; PAM type: NRG; PAM sequence: AAG
gcagtcggatgcagaagccc

SEQ ID NO: 125376 - DNA, 20 bp, Artificial Sequence
  Description of Artificial Sequence: Synthetic oligonucleotide
  Target: ATXN1; (+) strand; PAM type: NRG; PAM sequence: AAG
gcagaagcccaagcgccacg

SEQ ID NO: 125377 - DNA, 20 bp, Artificial Sequence
  Description of Artificial Sequence: Synthetic oligonucleotide
  Target: ATXN1; (+) strand; PAM type: NRG; PAM sequence: CAG
aagcgccacgaagaaaacaa

SEQ ID NO: 125378 - DNA, 20 bp, Artificial Sequence
  Description of Artificial Sequence: Synthetic oligonucleotide
  Target: ATXN1; (+) strand; PAM type: NRG; PAM sequence: AGG
agcgccacgaagaaaacaac

SEQ ID NO: 125379 - DNA, 20 bp, Artificial Sequence
  Description of Artificial Sequence: Synthetic oligonucleotide
  Target: ATXN1; (+) strand; PAM type: NRG; PAM sequence: AAG
ccacgaagaaaacaacaggt

SEQ ID NO: 125380 - DNA, 20 bp, Artificial Sequence
  Description of Artificial Sequence: Synthetic oligonucleotide
  Target: ATXN1; (+) strand; PAM type: NRG; PAM sequence: AAG
cgaagaaaacaacaggtaag

SEQ ID NO: 125381 - DNA, 20 bp, Artificial Sequence
  Description of Artificial Sequence: Synthetic oligonucleotide
  Target: ATXN1; (+) strand; PAM type: NRG; PAM sequence: AGG
gaagaaaacaacaggtaaga

SEQ ID NO: 125382 - DNA, 20 bp, Artificial Sequence
  Description of Artificial Sequence: Synthetic oligonucleotide
  Target: ATXN1; (+) strand; PAM type: NRG; PAM sequence: GAG
aacaacaggtaagaaggctt

SEQ ID NO: 125383 - DNA, 20 bp, Artificial Sequence
  Description of Artificial Sequence: Synthetic oligonucleotide
  Target: ATXN1; (+) strand; PAM type: NRG; PAM sequence: GAG
acaggtaagaaggcttgagt

SEQ ID NO: 125384 - DNA, 20 bp, Artificial Sequence
  Description of Artificial Sequence: Synthetic oligonucleotide
  Target: ATXN1; (+) strand; PAM type: NRG; PAM sequence: TGG
gtaagaaggcttgagtgagc

SEQ ID NO: 125385 - DNA, 20 bp, Artificial Sequence
  Description of Artificial Sequence: Synthetic oligonucleotide
  Target: ATXN1; (+) strand; PAM type: NRG; PAM sequence: GGG
taagaaggcttgagtgagct

SEQ ID NO: 125386 - DNA, 20 bp, Artificial Sequence
  Description of Artificial Sequence: Synthetic oligonucleotide
  Target: ATXN1; (+) strand; PAM type: NRG; PAM sequence: GGG
aagaaggcttgagtgagctg

SEQ ID NO: 125387 - DNA, 20 bp, Artificial Sequence
  Description of Artificial Sequence: Synthetic oligonucleotide
  Target: ATXN1; (+) strand; PAM type: NRG; PAM sequence: GGG
agaaggcttgagtgagctgg

SEQ ID NO: 125388 - DNA, 20 bp, Artificial Sequence
  Description of Artificial Sequence: Synthetic oligonucleotide
  Target: ATXN1; (+) strand; PAM type: NRG; PAM sequence: CGG
aggcttgagtgagctggggg

SEQ ID NO: 125389 - DNA, 20 bp, Artificial Sequence
  Description of Artificial Sequence: Synthetic oligonucleotide
  Target: ATXN1; (+) strand; PAM type: NRG; PAM sequence: GGG
ggcttgagtgagctgggggc

SEQ ID NO: 125390 - DNA, 20 bp, Artificial Sequence
  Description of Artificial Sequence: Synthetic oligonucleotide
  Target: ATXN1; (+) strand; PAM type: NRG; PAM sequence: TAG
ttgagtgagctgggggcggg

SEQ ID NO: 125391 - DNA, 20 bp, Artificial Sequence
  Description of Artificial Sequence: Synthetic oligonucleotide
  Target: ATXN1; (+) strand; PAM type: NRG; PAM sequence: AGG
tgagtgagctgggggcgggt

SEQ ID NO: 125392 - DNA, 20 bp, Artificial Sequence
  Description of Artificial Sequence: Synthetic oligonucleotide
  Target: ATXN1; (+) strand; PAM type: NRG; PAM sequence: TGG
ctgggggcgggtaggcctga

SEQ ID NO: 125393 - DNA, 20 bp, Artificial Sequence
  Description of Artificial Sequence: Synthetic oligonucleotide
  Target: ATXN1; (+) strand; PAM type: NRG; PAM sequence: GGG
tgggggcgggtaggcctgat

SEQ ID NO: 125394 - DNA, 20 bp, Artificial Sequence
  Description of Artificial Sequence: Synthetic oligonucleotide
  Target: ATXN1; (+) strand; PAM type: NRG; PAM sequence: GGG
gggggcgggtaggcctgatg

SEQ ID NO: 125395 - DNA, 20 bp, Artificial Sequence
  Description of Artificial Sequence: Synthetic oligonucleotide
  Target: ATXN1; (+) strand; PAM type: NRG; PAM sequence: CAG
cgggtaggcctgatggggtg

SEQ ID NO: 125396 - DNA, 20 bp, Artificial Sequence
  Description of Artificial Sequence: Synthetic oligonucleotide
  Target: ATXN1; (+) strand; PAM type: NRG; PAM sequence: AGG
gggtaggcctgatggggtgc

SEQ ID NO: 125397 - DNA, 20 bp, Artificial Sequence
  Description of Artificial Sequence: Synthetic oligonucleotide
  Target: ATXN1; (+) strand; PAM type: NRG; PAM sequence: GGG
ggtaggcctgatggggtgca

SEQ ID NO: 125398 - DNA, 20 bp, Artificial Sequence
  Description of Artificial Sequence: Synthetic oligonucleotide
  Target: ATXN1; (+) strand; PAM type: NRG; PAM sequence: GAG
taggcctgatggggtgcagg

SEQ ID NO: 125399 - DNA, 20 bp, Artificial Sequence
  Description of Artificial Sequence: Synthetic oligonucleotide
  Target: ATXN1; (+) strand; PAM type: NRG; PAM sequence: CAG
gcctgatggggtgcagggag

SEQ ID NO: 125400 - DNA, 20 bp, Artificial Sequence
  Description of Artificial Sequence: Synthetic oligonucleotide
  Target: ATXN1; (+) strand; PAM type: NRG; PAM sequence: TGG
gggtgcagggagcagaaata

SEQ ID NO: 125401 - DNA, 20 bp, Artificial Sequence
  Description of Artificial Sequence: Synthetic oligonucleotide
  Target: ATXN1; (+) strand; PAM type: NRG; PAM sequence: CAG
gcagggagcagaaatatggc

SEQ ID NO: 125402 - DNA, 20 bp, Artificial Sequence
  Description of Artificial Sequence: Synthetic oligonucleotide
  Target: ATXN1; (+) strand; PAM type: NRG; PAM sequence: GAG
agggagcagaaatatggcca

SEQ ID NO: 125403 - DNA, 20 bp, Artificial Sequence
  Description of Artificial Sequence: Synthetic oligonucleotide
  Target: ATXN1; (+) strand; PAM type: NRG; PAM sequence: CAG
gagcagaaatatggccagag

SEQ ID NO: 125404 - DNA, 20 bp, Artificial Sequence
  Description of Artificial Sequence: Synthetic oligonucleotide
  Target: ATXN1; (+) strand; PAM type: NRG; PAM sequence: AGG
agcagaaatatggccagagc

SEQ ID NO: 125405 - DNA, 20 bp, Artificial Sequence
  Description of Artificial Sequence: Synthetic oligonucleotide
  Target: ATXN1; (+) strand; PAM type: NRG; PAM sequence: AAG
agaaatatggccagagcagg

SEQ ID NO: 125406 - DNA, 20 bp, Artificial Sequence
  Description of Artificial Sequence: Synthetic oligonucleotide
  Target: ATXN1; (+) strand; PAM type: NRG; PAM sequence: AGG
gaaatatggccagagcagga

SEQ ID NO: 125407 - DNA, 20 bp, Artificial Sequence
  Description of Artificial Sequence: Synthetic oligonucleotide
  Target: ATXN1; (+) strand; PAM type: NRG; PAM sequence: CAG
ggaaacgccacgccccaccc

SEQ ID NO: 125408 - DNA, 20 bp, Artificial Sequence
  Description of Artificial Sequence: Synthetic oligonucleotide
  Target: ATXN1; (+) strand; PAM type: NRG; PAM sequence: TGG
cgccccaccccagctttcta

SEQ ID NO: 125409 - DNA, 20 bp, Artificial Sequence
  Description of Artificial Sequence: Synthetic oligonucleotide
  Target: ATXN1; (+) strand; PAM type: NRG; PAM sequence: GGG
gccccaccccagctttctat

SEQ ID NO: 125410 - DNA, 20 bp, Artificial Sequence
  Description of Artificial Sequence: Synthetic oligonucleotide
  Target: ATXN1; (+) strand; PAM type: NRG; PAM sequence: GGG
ccccaccccagctttctatg

SEQ ID NO: 125411 - DNA, 20 bp, Artificial Sequence
  Description of Artificial Sequence: Synthetic oligonucleotide
  Target: ATXN1; (+) strand; PAM type: NRG; PAM sequence: GGG
cccaccccagctttctatgg

SEQ ID NO: 125412 - DNA, 20 bp, Artificial Sequence
  Description of Artificial Sequence: Synthetic oligonucleotide
  Target: ATXN1; (+) strand; PAM type: NRG; PAM sequence: GAG
caccccagctttctatgggg

SEQ ID NO: 125413 - DNA, 20 bp, Artificial Sequence
  Description of Artificial Sequence: Synthetic oligonucleotide
  Target: ATXN1; (+) strand; PAM type: NRG; PAM sequence: AGG
accccagctttctatggggg

SEQ ID NO: 125414 - DNA, 20 bp, Artificial Sequence
  Description of Artificial Sequence: Synthetic oligonucleotide
  Target: ATXN1; (+) strand; PAM type: NRG; PAM sequence: AAG
gctccaaccttttcttcccc

SEQ ID NO: 125415 - DNA, 20 bp, Artificial Sequence
  Description of Artificial Sequence: Synthetic oligonucleotide
  Target: ATXN1; (+) strand; PAM type: NRG; PAM sequence: AGG
ctccaaccttttcttcccca

SEQ ID NO: 125416 - DNA, 20 bp, Artificial Sequence
  Description of Artificial Sequence: Synthetic oligonucleotide
  Target: ATXN1; (+) strand; PAM type: NRG; PAM sequence: GGG
tccaaccttttcttccccaa

SEQ ID NO: 125417 - DNA, 20 bp, Artificial Sequence
  Description of Artificial Sequence: Synthetic oligonucleotide
  Target: ATXN1; (+) strand; PAM type: NRG; PAM sequence: TGG
ccttttcttccccaagggtg

SEQ ID NO: 125418 - DNA, 20 bp, Artificial Sequence
  Description of Artificial Sequence: Synthetic oligonucleotide
  Target: ATXN1; (+) strand; PAM type: NRG; PAM sequence: GAG
cttccccaagggtgtggaat

SEQ ID NO: 125419 - DNA, 20 bp, Artificial Sequence
  Description of Artificial Sequence: Synthetic oligonucleotide
  Target: ATXN1; (+) strand; PAM type: NRG; PAM sequence: CGG
agggtgtggaatgagtaacc

SEQ ID NO: 125420 - DNA, 20 bp, Artificial Sequence
  Description of Artificial Sequence: Synthetic oligonucleotide
  Target: ATXN1; (+) strand; PAM type: NRG; PAM sequence: TGG
tgtggaatgagtaacccggc

SEQ ID NO: 125421 - DNA, 20 bp, Artificial Sequence
  Description of Artificial Sequence: Synthetic oligonucleotide
  Target: ATXN1; (+) strand; PAM type: NRG; PAM sequence: GGG
gtggaatgagtaacccggct

SEQ ID NO: 125422 - DNA, 20 bp, Artificial Sequence
  Description of Artificial Sequence: Synthetic oligonucleotide
  Target: ATXN1; (+) strand; PAM type: NRG; PAM sequence: GGG
tggaatgagtaacccggctg

SEQ ID NO: 125423 - DNA, 20 bp, Artificial Sequence
  Description of Artificial Sequence: Synthetic oligonucleotide
  Target: ATXN1; (+) strand; PAM type: NRG; PAM sequence: AAG
gagtaacccggctggggcta

SEQ ID NO: 125424 - DNA, 20 bp, Artificial Sequence
  Description of Artificial Sequence: Synthetic oligonucleotide
  Target: ATXN1; (+) strand; PAM type: NRG; PAM sequence: TGG
ggctggggctaaagccaacg

SEQ ID NO: 125425 - DNA, 20 bp, Artificial Sequence
  Description of Artificial Sequence: Synthetic oligonucleotide
  Target: ATXN1; (+) strand; PAM type: NRG; PAM sequence: TGG
cgtggcctatgccccctcct

SEQ ID NO: 125426 - DNA, 20 bp, Artificial Sequence
  Description of Artificial Sequence: Synthetic oligonucleotide
  Target: ATXN1; (+) strand; PAM type: NRG; PAM sequence: TAG
gcctatgccccctccttgga

SEQ ID NO: 125427 - DNA, 20 bp, Artificial Sequence
  Description of Artificial Sequence: Synthetic oligonucleotide
  Target: ATXN1; (+) strand; PAM type: NRG; PAM sequence: AGG
cctatgccccctccttggat

SEQ ID NO: 125428 - DNA, 20 bp, Artificial Sequence
  Description of Artificial Sequence: Synthetic oligonucleotide
  Target: ATXN1; (+) strand; PAM type: NRG; PAM sequence: GGG
ctatgccccctccttggata

SEQ ID NO: 125429 - DNA, 20 bp, Artificial Sequence
  Description of Artificial Sequence: Synthetic oligonucleotide
  Target: ATXN1; (+) strand; PAM type: NRG; PAM sequence: GAG
gggtgaatctatataatttt

SEQ ID NO: 125430 - DNA, 20 bp, Artificial Sequence
  Description of Artificial Sequence: Synthetic oligonucleotide
  Target: ATXN1; (+) strand; PAM type: NRG; PAM sequence: CAG
tgaatctatataattttgag

SEQ ID NO: 125431 - DNA, 20 bp, Artificial Sequence
  Description of Artificial Sequence: Synthetic oligonucleotide
  Target: ATXN1; (+) strand; PAM type: NRG; PAM sequence: AGG
gaatctatataattttgagc

SEQ ID NO: 125432 - DNA, 20 bp, Artificial Sequence
  Description of Artificial Sequence: Synthetic oligonucleotide
  Target: ATXN1; (+) strand; PAM type: NRG; PAM sequence: GGG
aatctatataattttgagca

SEQ ID NO: 125433 - DNA, 20 bp, Artificial Sequence
  Description of Artificial Sequence: Synthetic oligonucleotide
  Target: ATXN1; (+) strand; PAM type: NRG; PAM sequence: TAG
tatataattttgagcagggt

SEQ ID NO: 125434 - DNA, 20 bp, Artificial Sequence
  Description of Artificial Sequence: Synthetic oligonucleotide
  Target: ATXN1; (+) strand; PAM type: NRG; PAM sequence: CAG
ataattttgagcagggttag

SEQ ID NO: 125435 - DNA, 20 bp, Artificial Sequence
  Description of Artificial Sequence: Synthetic oligonucleotide
  Target: ATXN1; (+) strand; PAM type: NRG; PAM sequence: AGG
taattttgagcagggttagc

SEQ ID NO: 125436 - DNA, 20 bp, Artificial Sequence
  Description of Artificial Sequence: Synthetic oligonucleotide
  Target: ATXN1; (+) strand; PAM type: NRG; PAM sequence: GGG
aattttgagcagggttagca

SEQ ID NO: 125437 - DNA, 20 bp, Artificial Sequence
  Description of Artificial Sequence: Synthetic oligonucleotide
  Target: ATXN1; (+) strand; PAM type: NRG; PAM sequence: TGG
gagcagggttagcagggatt

SEQ ID NO: 125438 - DNA, 20 bp, Artificial Sequence
  Description of Artificial Sequence: Synthetic oligonucleotide
  Target: ATXN1; (+) strand; PAM type: NRG; PAM sequence: GGG
agcagggttagcagggattt

SEQ ID NO: 125439 - DNA, 20 bp, Artificial Sequence
  Description of Artificial Sequence: Synthetic oligonucleotide
  Target: ATXN1; (+) strand; PAM type: NRG; PAM sequence: CAG
tttctccttccctcttcaca

SEQ ID NO: 125440 - DNA, 20 bp, Artificial Sequence
  Description of Artificial Sequence: Synthetic oligonucleotide
  Target: ATXN1; (+) strand; PAM type: NRG; PAM sequence: CAG
tccttccctcttcacacaga

SEQ ID NO: 125441 - DNA, 20 bp, Artificial Sequence
  Description of Artificial Sequence: Synthetic oligonucleotide
  Target: ATXN1; (+) strand; PAM type: NRG; PAM sequence: AGG
ccttccctcttcacacagac

SEQ ID NO: 125442 - DNA, 20 bp, Artificial Sequence
  Description of Artificial Sequence: Synthetic oligonucleotide
  Target: ATXN1; (+) strand; PAM type: NRG; PAM sequence: TAG
ttcacacagacaggtgcctg

SEQ ID NO: 125443 - DNA, 20 bp, Artificial Sequence
  Description of Artificial Sequence: Synthetic oligonucleotide
  Target: ATXN1; (+) strand; PAM type: NRG; PAM sequence: CAG
gtagactcaaaactttcctg

SEQ ID NO: 125444 - DNA, 20 bp, Artificial Sequence
  Description of Artificial Sequence: Synthetic oligonucleotide
  Target: ATXN1; (+) strand; PAM type: NRG; PAM sequence: AGG
tagactcaaaactttcctgc

SEQ ID NO: 125445 - DNA, 20 bp, Artificial Sequence
  Description of Artificial Sequence: Synthetic oligonucleotide
  Target: ATXN1; (+) strand; PAM type: NRG; PAM sequence: TGG
actcaaaactttcctgcagg

SEQ ID NO: 125446 - DNA, 20 bp, Artificial Sequence
  Description of Artificial Sequence: Synthetic oligonucleotide
  Target: ATXN1; (+) strand; PAM type: NRG; PAM sequence: CAG
tcctgcaggtggcctgcgac

SEQ ID NO: 125447 - DNA, 20 bp, Artificial Sequence
  Description of Artificial Sequence: Synthetic oligonucleotide
  Target: ATXN1; (+) strand; PAM type: NRG; PAM sequence: AGG
cctgcaggtggcctgcgacc

SEQ ID NO: 125448 - DNA, 20 bp, Artificial Sequence
  Description of Artificial Sequence: Synthetic oligonucleotide
  Target: ATXN1; (+) strand; PAM type: NRG; PAM sequence: TAG
caggtggcctgcgaccaggc

SEQ ID NO: 125449 - DNA, 20 bp, Artificial Sequence
  Description of Artificial Sequence: Synthetic oligonucleotide
  Target: ATXN1; (+) strand; PAM type: NRG; PAM sequence: TGG
ggcctgcgaccaggctagac

SEQ ID NO: 125450 - DNA, 20 bp, Artificial Sequence
  Description of Artificial Sequence: Synthetic oligonucleotide
  Target: ATXN1; (+) strand; PAM type: NRG; PAM sequence: GGG
gcctgcgaccaggctagact

SEQ ID NO: 125451 - DNA, 20 bp, Artificial Sequence
  Description of Artificial Sequence: Synthetic oligonucleotide
  Target: ATXN1; (+) strand; PAM type: NRG; PAM sequence: GGG
cctgcgaccaggctagactg

SEQ ID NO: 125452 - DNA, 20 bp, Artificial Sequence
  Description of Artificial Sequence: Synthetic oligonucleotide
  Target: ATXN1; (+) strand; PAM type: NRG; PAM sequence: CAG
gaccaggctagactggggaa

SEQ ID NO: 125453 - DNA, 20 bp, Artificial Sequence
  Description of Artificial Sequence: Synthetic oligonucleotide
  Target: ATXN1; (+) strand; PAM type: NRG; PAM sequence: AGG
accaggctagactggggaac

SEQ ID NO: 125454 - DNA, 20 bp, Artificial Sequence
  Description of Artificial Sequence: Synthetic oligonucleotide
  Target: ATXN1; (+) strand; PAM type: NRG; PAM sequence: CAG
aggctagactggggaacagg

SEQ ID NO: 125455 - DNA, 20 bp, Artificial Sequence
  Description of Artificial Sequence: Synthetic oligonucleotide
  Target: ATXN1; (+) strand; PAM type: NRG; PAM sequence: AGG
ggctagactggggaacaggc

SEQ ID NO: 125456 - DNA, 20 bp, Artificial Sequence
  Description of Artificial Sequence: Synthetic oligonucleotide
  Target: ATXN1; (+) strand; PAM type: NRG; PAM sequence: AAG
ctggggaacaggcaggtgtc

SEQ ID NO: 125457 - DNA, 20 bp, Artificial Sequence
  Description of Artificial Sequence: Synthetic oligonucleotide
  Target: ATXN1; (+) strand; PAM type: NRG; PAM sequence: TAG
ggaacaggcaggtgtcaagt

SEQ ID NO: 125458 - DNA, 20 bp, Artificial Sequence
  Description of Artificial Sequence: Synthetic oligonucleotide
  Target: ATXN1; (+) strand; PAM type: NRG; PAM sequence: CAG
tcaagttagctcattgccct

SEQ ID NO: 125459 - DNA, 20 bp, Artificial Sequence
  Description of Artificial Sequence: Synthetic oligonucleotide
  Target: ATXN1; (+) strand; PAM type: NRG; PAM sequence: TAG
gctcattgccctcagtcaca

SEQ ID NO: 125460 - DNA, 20 bp, Artificial Sequence
  Description of Artificial Sequence: Synthetic oligonucleotide
  Target: ATXN1; (+) strand; PAM type: NRG; PAM sequence: TGG
tcagtcacatagttgcattc

SEQ ID NO: 125461 - DNA, 20 bp, Artificial Sequence
  Description of Artificial Sequence: Synthetic oligonucleotide
  Target: ATXN1; (+) strand; PAM type: NRG; PAM sequence: CAG
aatactcttgtcttatttct

SEQ ID NO: 125462 - DNA, 20 bp, Artificial Sequence
  Description of Artificial Sequence: Synthetic oligonucleotide
  Target: ATXN1; (+) strand; PAM type: NRG; PAM sequence: TGG
actcttgtcttatttctcag

SEQ ID NO: 125463 - DNA, 20 bp, Artificial Sequence
  Description of Artificial Sequence: Synthetic oligonucleotide
  Target: ATXN1; (+) strand; PAM type: NRG; PAM sequence: GGG
ctcttgtcttatttctcagt

SEQ ID NO: 125464 - DNA, 20 bp, Artificial Sequence
  Description of Artificial Sequence: Synthetic oligonucleotide
  Target: ATXN1; (+) strand; PAM type: NRG; PAM sequence: CAG
gtcttatttctcagtgggct

SEQ ID NO: 125465 - DNA, 20 bp, Artificial Sequence
  Description of Artificial Sequence: Synthetic oligonucleotide
  Target: ATXN1; (+) strand; PAM type: NRG; PAM sequence: TGG
ttctcagtgggctcagaact

SEQ ID NO: 125466 - DNA, 20 bp, Artificial Sequence
  Description of Artificial Sequence: Synthetic oligonucleotide
  Target: ATXN1; (+) strand; PAM type: NRG; PAM sequence: GGG
tctcagtgggctcagaactt

SEQ ID NO: 125467 - DNA, 20 bp, Artificial Sequence
  Description of Artificial Sequence: Synthetic oligonucleotide
  Target: ATXN1; (+) strand; PAM type: NRG; PAM sequence: CGG
agtgggctcagaacttggga

SEQ ID NO: 125468 - DNA, 20 bp, Artificial Sequence
  Description of Artificial Sequence: Synthetic oligonucleotide
  Target: ATXN1; (+) strand; PAM type: NRG; PAM sequence: GGG
gtgggctcagaacttgggac

SEQ ID NO: 125469 - DNA, 20 bp, Artificial Sequence
  Description of Artificial Sequence: Synthetic oligonucleotide
  Target: ATXN1; (+) strand; PAM type: NRG; PAM sequence: AAG
ggctcagaacttgggacggg

SEQ ID NO: 125470 - DNA, 20 bp, Artificial Sequence
  Description of Artificial Sequence: Synthetic oligonucleotide
  Target: ATXN1; (+) strand; PAM type: NRG; PAM sequence: GAG
ctcagaacttgggacgggaa

SEQ ID NO: 125471 - DNA, 20 bp, Artificial Sequence
  Description of Artificial Sequence: Synthetic oligonucleotide
  Target: ATXN1; (+) strand; PAM type: NRG; PAM sequence: AAG
gacgggaagagaactcttgt

SEQ ID NO: 125472 - DNA, 20 bp, Artificial Sequence
  Description of Artificial Sequence: Synthetic oligonucleotide
  Target: ATXN1; (+) strand; PAM type: NRG; PAM sequence: AAG
agagaactcttgtaagataa

SEQ ID NO: 125473 - DNA, 20 bp, Artificial Sequence
  Description of Artificial Sequence: Synthetic oligonucleotide
  Target: ATXN1; (+) strand; PAM type: NRG; PAM sequence: AAG
tgtaagataaaagtttccat

SEQ ID NO: 125474 - DNA, 20 bp, Artificial Sequence
  Description of Artificial Sequence: Synthetic oligonucleotide
  Target: ATXN1; (+) strand; PAM type: NRG; PAM sequence: CAG
aaaaccttccctcccctaaa

SEQ ID NO: 125475 - DNA, 20 bp, Artificial Sequence
  Description of Artificial Sequence: Synthetic oligonucleotide
  Target: ATXN1; (+) strand; PAM type: NRG; PAM sequence: TAG
aacagacctcaaaaccaaat

SEQ ID NO: 125476 - DNA, 20 bp, Artificial Sequence
  Description of Artificial Sequence: Synthetic oligonucleotide
  Target: ATXN1; (+) strand; PAM type: NRG; PAM sequence: AGG
acagacctcaaaaccaaatt

SEQ ID NO: 125477 - DNA, 20 bp, Artificial Sequence
  Description of Artificial Sequence: Synthetic oligonucleotide
  Target: ATXN1; (+) strand; PAM type: NRG; PAM sequence: TGG
taatctatctgtcatcttaa

SEQ ID NO: 125478 - DNA, 20 bp, Artificial Sequence
  Description of Artificial Sequence: Synthetic oligonucleotide
  Target: ATXN1; (+) strand; PAM type: NRG; PAM sequence: TAG
ccctcaaatctcttacttaa

SEQ ID NO: 125479 - DNA, 20 bp, Artificial Sequence
  Description of Artificial Sequence: Synthetic oligonucleotide
  Target: ATXN1; (+) strand; PAM type: NRG; PAM sequence: TAG
tacttaatagtccaaaacgc

SEQ ID NO: 125480 - DNA, 20 bp, Artificial Sequence
  Description of Artificial Sequence: Synthetic oligonucleotide
  Target: ATXN1; (+) strand; PAM type: NRG; PAM sequence: GAG
atagtccaaaacgctagact

SEQ ID NO: 125481 - DNA, 20 bp, Artificial Sequence
  Description of Artificial Sequence: Synthetic oligonucleotide
  Target: ATXN1; (+) strand; PAM type: NRG; PAM sequence: AAG
gtccaaaacgctagactgag

SEQ ID NO: 125482 - DNA, 20 bp, Artificial Sequence
  Description of Artificial Sequence: Synthetic oligonucleotide
  Target: ATXN1; (+) strand; PAM type: NRG; PAM sequence: AAG
gactgagaagtctgatccca

SEQ ID NO: 125483 - DNA, 20 bp, Artificial Sequence
  Description of Artificial Sequence: Synthetic oligonucleotide
  Target: ATXN1; (+) strand; PAM type: NRG; PAM sequence: CAG
tcccaaagacaaattcaata

SEQ ID NO: 125484 - DNA, 20 bp, Artificial Sequence
  Description of Artificial Sequence: Synthetic oligonucleotide
  Target: ATXN1; (+) strand; PAM type: NRG; PAM sequence: TGG
aaattcaatacagtgaatat

SEQ ID NO: 125485 - DNA, 20 bp, Artificial Sequence
  Description of Artificial Sequence: Synthetic oligonucleotide
  Target: ATXN1; (+) strand; PAM type: NRG; PAM sequence: GGG
aattcaatacagtgaatatt

SEQ ID NO: 125486 - DNA, 20 bp, Artificial Sequence
  Description of Artificial Sequence: Synthetic oligonucleotide
  Target: ATXN1; (+) strand; PAM type: NRG; PAM sequence: GAG
ttcaatacagtgaatattgg

SEQ ID NO: 125487 - DNA, 20 bp, Artificial Sequence
  Description of Artificial Sequence: Synthetic oligonucleotide
  Target: ATXN1; (+) strand; PAM type: NRG; PAM sequence: GAG
atacagtgaatattgggagt

SEQ ID NO: 125488 - DNA, 20 bp, Artificial Sequence
  Description of Artificial Sequence: Synthetic oligonucleotide
  Target: ATXN1; (+) strand; PAM type: NRG; PAM sequence: AGG
tacagtgaatattgggagtg

SEQ ID NO: 125489 - DNA, 20 bp, Artificial Sequence
  Description of Artificial Sequence: Synthetic oligonucleotide
  Target: ATXN1; (+) strand; PAM type: NRG; PAM sequence: TGG
agtgaatattgggagtgagg

SEQ ID NO: 125490 - DNA, 20 bp, Artificial Sequence
  Description of Artificial Sequence: Synthetic oligonucleotide
  Target: ATXN1; (+) strand; PAM type: NRG; PAM sequence: GGG
gtgaatattgggagtgaggt

SEQ ID NO: 125491 - DNA, 20 bp, Artificial Sequence
  Description of Artificial Sequence: Synthetic oligonucleotide
  Target: ATXN1; (+) strand; PAM type: NRG; PAM sequence: AAG
attgggagtgaggtgggaaa

SEQ ID NO: 125492 - DNA, 20 bp, Artificial Sequence
  Description of Artificial Sequence: Synthetic oligonucleotide
  Target: ATXN1; (+) strand; PAM type: NRG; PAM sequence: AGG
ttgggagtgaggtgggaaaa

SEQ ID NO: 125493 - DNA, 20 bp, Artificial Sequence
  Description of Artificial Sequence: Synthetic oligonucleotide
  Target: ATXN1; (+) strand; PAM type: NRG; PAM sequence: TGG
ggtgggaaaaaggatgattt

SEQ ID NO: 125494 - DNA, 20 bp, Artificial Sequence
  Description of Artificial Sequence: Synthetic oligonucleotide
  Target: ATXN1; (+) strand; PAM type: NRG; PAM sequence: CAG
aaaaaggatgattttggtgc

SEQ ID NO: 125495 - DNA, 20 bp, Artificial Sequence
  Description of Artificial Sequence: Synthetic oligonucleotide
  Target: ATXN1; (+) strand; PAM type: NRG; PAM sequence: CAG
tttggtgccagtataaaacc

SEQ ID NO: 125496 - DNA, 20 bp, Artificial Sequence
  Description of Artificial Sequence: Synthetic oligonucleotide
  Target: ATXN1; (+) strand; PAM type: NRG; PAM sequence: AGG
ttggtgccagtataaaaccc

SEQ ID NO: 125497 - DNA, 20 bp, Artificial Sequence
  Description of Artificial Sequence: Synthetic oligonucleotide
  Target: ATXN1; (+) strand; PAM type: NRG; PAM sequence: GGG
tggtgccagtataaaaccca

SEQ ID NO: 125498 - DNA, 20 bp, Artificial Sequence
  Description of Artificial Sequence: Synthetic oligonucleotide
  Target: ATXN1; (+) strand; PAM type: NRG; PAM sequence: GGG
ggtgccagtataaaacccag

SEQ ID NO: 125499 - DNA, 20 bp, Artificial Sequence
  Description of Artificial Sequence: Synthetic oligonucleotide
  Target: ATXN1; (+) strand; PAM type: NRG; PAM sequence: TGG
aaacccaggggtatatgcta

SEQ ID NO: 125500 - DNA, 20 bp, Artificial Sequence
  Description of Artificial Sequence: Synthetic oligonucleotide
  Target: ATXN1; (+) strand; PAM type: NRG; PAM sequence: CAG
ccaggggtatatgctatggt

SEQ ID NO: 125501 - DNA, 20 bp, Artificial Sequence
  Description of Artificial Sequence: Synthetic oligonucleotide
  Target: ATXN1; (+) strand; PAM type: NRG; PAM sequence: TAG
ggggtatatgctatggtcag

SEQ ID NO: 125502 - DNA, 20 bp, Artificial Sequence
  Description of Artificial Sequence: Synthetic oligonucleotide
  Target: ATXN1; (+) strand; PAM type: NRG; PAM sequence: CAG
tatatgctatggtcagtagc

SEQ ID NO: 125503 - DNA, 20 bp, Artificial Sequence
  Description of Artificial Sequence: Synthetic oligonucleotide
  Target: ATXN1; (+) strand; PAM type: NRG; PAM sequence: AAG
tgctatggtcagtagccaga

SEQ ID NO: 125504 - DNA, 20 bp, Artificial Sequence
  Description of Artificial Sequence: Synthetic oligonucleotide
  Target: ATXN1; (+) strand; PAM type: NRG; PAM sequence: GAG
ctatggtcagtagccagaaa

SEQ ID NO: 125505 - DNA, 20 bp, Artificial Sequence
  Description of Artificial Sequence: Synthetic oligonucleotide
  Target: ATXN1; (+) strand; PAM type: NRG; PAM sequence: AGG
tatggtcagtagccagaaag

SEQ ID NO: 125506 - DNA, 20 bp, Artificial Sequence
  Description of Artificial Sequence: Synthetic oligonucleotide
  Target: ATXN1; (+) strand; PAM type: NRG; PAM sequence: AAG
ggtcagtagccagaaagagg

SEQ ID NO: 125507 - DNA, 20 bp, Artificial Sequence
  Description of Artificial Sequence: Synthetic oligonucleotide
  Target: ATXN1; (+) strand; PAM type: NRG; PAM sequence: GAG
gtagccagaaagaggaagat

SEQ ID NO: 125508 - DNA, 20 bp, Artificial Sequence
  Description of Artificial Sequence: Synthetic oligonucleotide
  Target: ATXN1; (+) strand; PAM type: NRG; PAM sequence: AGG
tagccagaaagaggaagatg

SEQ ID NO: 125509 - DNA, 20 bp, Artificial Sequence
  Description of Artificial Sequence: Synthetic oligonucleotide
  Target: ATXN1; (+) strand; PAM type: NRG; PAM sequence: AAG
gaggaagatgaggaaatatg

SEQ ID NO: 125510 - DNA, 20 bp, Artificial Sequence
  Description of Artificial Sequence: Synthetic oligonucleotide
  Target: ATXN1; (+) strand; PAM type: NRG; PAM sequence: TAG
atgaggaaatatgaagcctt

SEQ ID NO: 125511 - DNA, 20 bp, Artificial Sequence
  Description of Artificial Sequence: Synthetic oligonucleotide
  Target: ATXN1; (+) strand; PAM type: NRG; PAM sequence: TAG
ctgcattaaaaaaaccacat

SEQ ID NO: 125512 - DNA, 20 bp, Artificial Sequence
  Description of Artificial Sequence: Synthetic oligonucleotide
  Target: ATXN1; (+) strand; PAM type: NRG; PAM sequence: AGG
tgcattaaaaaaaccacatt

SEQ ID NO: 125513 - DNA, 20 bp, Artificial Sequence
  Description of Artificial Sequence: Synthetic oligonucleotide
  Target: ATXN1; (+) strand; PAM type: NRG; PAM sequence: GAG
cattaggaaaataatttctt

SEQ ID NO: 125514 - DNA, 20 bp, Artificial Sequence
  Description of Artificial Sequence: Synthetic oligonucleotide
  Target: ATXN1; (+) strand; PAM type: NRG; PAM sequence: AAG
ttgagtttatcttttctttg

SEQ ID NO: 125515 - DNA, 20 bp, Artificial Sequence
  Description of Artificial Sequence: Synthetic oligonucleotide
  Target: ATXN1; (+) strand; PAM type: NRG; PAM sequence: TGG
cacttgcctcacaatttcct

SEQ ID NO: 125516 - DNA, 20 bp, Artificial Sequence
  Description of Artificial Sequence: Synthetic oligonucleotide
  Target: ATXN1; (+) strand; PAM type: NRG; PAM sequence: GGG
acttgcctcacaatttcctt

SEQ ID NO: 125517 - DNA, 20 bp, Artificial Sequence
  Description of Artificial Sequence: Synthetic oligonucleotide
  Target: ATXN1; (+) strand; PAM type: NRG; PAM sequence: GAG
ttgcctcacaatttccttgg

SEQ ID NO: 125518 - DNA, 20 bp, Artificial Sequence
  Description of Artificial Sequence: Synthetic oligonucleotide
  Target: ATXN1; (+) strand; PAM type: NRG; PAM sequence: TGG
ctcacaatttccttgggaga

SEQ ID NO: 125519 - DNA, 20 bp, Artificial Sequence
  Description of Artificial Sequence: Synthetic oligonucleotide
  Target: ATXN1; (+) strand; PAM type: NRG; PAM sequence: GAG
cacaatttccttgggagatg

SEQ ID NO: 125520 - DNA, 20 bp, Artificial Sequence
  Description of Artificial Sequence: Synthetic oligonucleotide
  Target: ATXN1; (+) strand; PAM type: NRG; PAM sequence: GAG
atttccttgggagatggagt

SEQ ID NO: 125521 - DNA, 20 bp, Artificial Sequence
  Description of Artificial Sequence: Synthetic oligonucleotide
  Target: ATXN1; (+) strand; PAM type: NRG; PAM sequence: TGG
gtgaacaaatattaatgtca

SEQ ID NO: 125522 - DNA, 20 bp, Artificial Sequence
  Description of Artificial Sequence: Synthetic oligonucleotide
  Target: ATXN1; (+) strand; PAM type: NRG; PAM sequence: CAG
aatgtcatggttactatctg

SEQ ID NO: 125523 - DNA, 20 bp, Artificial Sequence
  Description of Artificial Sequence: Synthetic oligonucleotide
  Target: ATXN1; (+) strand; PAM type: NRG; PAM sequence: CAG
tggttactatctgcagaact

SEQ ID NO: 125524 - DNA, 20 bp, Artificial Sequence
  Description of Artificial Sequence: Synthetic oligonucleotide
  Target: ATXN1; (+) strand; PAM type: NRG; PAM sequence: GAG
tatctgcagaactcagttgt

SEQ ID NO: 125525 - DNA, 20 bp, Artificial Sequence
  Description of Artificial Sequence: Synthetic oligonucleotide
  Target: ATXN1; (+) strand; PAM type: NRG; PAM sequence: TAG
cagaactcagttgtgagcat

SEQ ID NO: 125526 - DNA, 20 bp, Artificial Sequence
  Description of Artificial Sequence: Synthetic oligonucleotide
  Target: ATXN1; (+) strand; PAM type: NRG; PAM sequence: GAG
gaactcagttgtgagcatta

SEQ ID NO: 125527 - DNA, 20 bp, Artificial Sequence
  Description of Artificial Sequence: Synthetic oligonucleotide
  Target: ATXN1; (+) strand; PAM type: NRG; PAM sequence: AAG
agcattagagaaattttttt

SEQ ID NO: 125528 - DNA, 20 bp, Artificial Sequence
  Description of Artificial Sequence: Synthetic oligonucleotide
  Target: ATXN1; (+) strand; PAM type: NRG; PAM sequence: GAG
cattagagaaatttttttaa

SEQ ID NO: 125529 - DNA, 20 bp, Artificial Sequence
  Description of Artificial Sequence: Synthetic oligonucleotide
  Target: ATXN1; (+) strand; PAM type: NRG; PAM sequence: AGG
attagagaaatttttttaag

SEQ ID NO: 125530 - DNA, 20 bp, Artificial Sequence
  Description of Artificial Sequence: Synthetic oligonucleotide
  Target: ATXN1; (+) strand; PAM type: NRG; PAM sequence: AAG
agagaaatttttttaagagg

SEQ ID NO: 125531 - DNA, 20 bp, Artificial Sequence
  Description of Artificial Sequence: Synthetic oligonucleotide
  Target: ATXN1; (+) strand; PAM type: NRG; PAM sequence: AAG
gaaatttttttaagaggaag

SEQ ID NO: 125532 - DNA, 20 bp, Artificial Sequence
  Description of Artificial Sequence: Synthetic oligonucleotide
  Target: ATXN1; (+) strand; PAM type: NRG; PAM sequence: AAG
atttttttaagaggaagaag

SEQ ID NO: 125533 - DNA, 20 bp, Artificial Sequence
  Description of Artificial Sequence: Synthetic oligonucleotide
  Target: ATXN1; (+) strand; PAM type: NRG; PAM sequence: AAG
atacatgtttcgtatccttg

SEQ ID NO: 125534 - DNA, 20 bp, Artificial Sequence
  Description of Artificial Sequence: Synthetic oligonucleotide
  Target: ATXN1; (+) strand; PAM type: NRG; PAM sequence: AGG
tacatgtttcgtatccttga

SEQ ID NO: 125535 - DNA, 20 bp, Artificial Sequence
  Description of Artificial Sequence: Synthetic oligonucleotide
  Target: ATXN1; (+) strand; PAM type: NRG; PAM sequence: GGG
acatgtttcgtatccttgaa

SEQ ID NO: 125536 - DNA, 20 bp, Artificial Sequence
  Description of Artificial Sequence: Synthetic oligonucleotide
  Target: ATXN1; (+) strand; PAM type: NRG; PAM sequence: TAG
tttcgtatccttgaagggct

SEQ ID NO: 125537 - DNA, 20 bp, Artificial Sequence
  Description of Artificial Sequence: Synthetic oligonucleotide
  Target: ATXN1; (+) strand; PAM type: NRG; PAM sequence: TAG
tgaagggcttagcctcgacc

SEQ ID NO: 125538 - DNA, 20 bp, Artificial Sequence
  Description of Artificial Sequence: Synthetic oligonucleotide
  Target: ATXN1; (+) strand; PAM type: NRG; PAM sequence: CAG
gcctcgacctagaaaacact

SEQ ID NO: 125539 - DNA, 20 bp, Artificial Sequence
  Description of Artificial Sequence: Synthetic oligonucleotide
  Target: ATXN1; (+) strand; PAM type: NRG; PAM sequence: AGG
cctcgacctagaaaacactc

SEQ ID NO: 125540 - DNA, 20 bp, Artificial Sequence
  Description of Artificial Sequence: Synthetic oligonucleotide
  Target: ATXN1; (+) strand; PAM type: NRG; PAM sequence: AAG
agaaaacactcaggccccca

SEQ ID NO: 125541 - DNA, 20 bp, Artificial Sequence
  Description of Artificial Sequence: Synthetic oligonucleotide
  Target: ATXN1; (+) strand; PAM type: NRG; PAM sequence: AAG
caaagcaatatatatgaaaa

SEQ ID NO: 125542 - DNA, 20 bp, Artificial Sequence
  Description of Artificial Sequence: Synthetic oligonucleotide
  Target: ATXN1; (+) strand; PAM type: NRG; PAM sequence: AGG
aaagcaatatatatgaaaaa

SEQ ID NO: 125543 - DNA, 20 bp, Artificial Sequence
  Description of Artificial Sequence: Synthetic oligonucleotide
  Target: ATXN1; (+) strand; PAM type: NRG; PAM sequence: AAG
tatatgaaaaaaggaaatac

SEQ ID NO: 125544 - DNA, 20 bp, Artificial Sequence
  Description of Artificial Sequence: Synthetic oligonucleotide
  Target: ATXN1; (+) strand; PAM type: NRG; PAM sequence: GAG
tatgaaaaaaggaaatacaa

SEQ ID NO: 125545 - DNA, 20 bp, Artificial Sequence
  Description of Artificial Sequence: Synthetic oligonucleotide
  Target: ATXN1; (+) strand; PAM type: NRG; PAM sequence: TGG
aatacaagagcaatgtcaaa

SEQ ID NO: 125546 - DNA, 20 bp, Artificial Sequence
  Description of Artificial Sequence: Synthetic oligonucleotide
  Target: ATXN1; (+) strand; PAM type: NRG; PAM sequence: TGG
caagagcaatgtcaaatgga

SEQ ID NO: 125547 - DNA, 20 bp, Artificial Sequence
  Description of Artificial Sequence: Synthetic oligonucleotide
  Target: ATXN1; (+) strand; PAM type: NRG; PAM sequence: AAG
gcaatgtcaaatggatggta

SEQ ID NO: 125548 - DNA, 20 bp, Artificial Sequence
  Description of Artificial Sequence: Synthetic oligonucleotide
  Target: ATXN1; (+) strand; PAM type: NRG; PAM sequence: CAG
aaagatttttaaaaatgctt

SEQ ID NO: 125549 - DNA, 20 bp, Artificial Sequence
  Description of Artificial Sequence: Synthetic oligonucleotide
  Target: ATXN1; (+) strand; PAM type: NRG; PAM sequence: AGG
aagatttttaaaaatgcttc

SEQ ID NO: 125550 - DNA, 20 bp, Artificial Sequence
  Description of Artificial Sequence: Synthetic oligonucleotide
  Target: ATXN1; (+) strand; PAM type: NRG; PAM sequence: GAG
gatttttaaaaatgcttcag

SEQ ID NO: 125551 - DNA, 20 bp, Artificial Sequence
  Description of Artificial Sequence: Synthetic oligonucleotide
  Target: ATXN1; (+) strand; PAM type: NRG; PAM sequence: CAG
ttaaaaatgcttcaggagtt

SEQ ID NO: 125552 - DNA, 20 bp, Artificial Sequence
  Description of Artificial Sequence: Synthetic oligonucleotide
  Target: ATXN1; (+) strand; PAM type: NRG; PAM sequence: GAG
aaaaatgcttcaggagttca

SEQ ID NO: 125553 - DNA, 20 bp, Artificial Sequence
  Description of Artificial Sequence: Synthetic oligonucleotide
  Target: ATXN1; (+) strand; PAM type: NRG; PAM sequence: AGG
aaaatgcttcaggagttcag

SEQ ID NO: 125554 - DNA, 20 bp, Artificial Sequence
  Description of Artificial Sequence: Synthetic oligonucleotide
  Target: ATXN1; (+) strand; PAM type: NRG; PAM sequence: GGG
aaatgcttcaggagttcaga

SEQ ID NO: 125555 - DNA, 20 bp, Artificial Sequence
  Description of Artificial Sequence: Synthetic oligonucleotide
  Target: ATXN1; (+) strand; PAM type: NRG; PAM sequence: GGG
aatgcttcaggagttcagag

SEQ ID NO: 125556 - DNA, 20 bp, Artificial Sequence
  Description of Artificial Sequence: Synthetic oligonucleotide
  Target: ATXN1; (+) strand; PAM type: NRG; PAM sequence: AAG
aggagttcagaggggaaaaa

SEQ ID NO: 125557 - DNA, 20 bp, Artificial Sequence
  Description of Artificial Sequence: Synthetic oligonucleotide
  Target: ATXN1; (+) strand; PAM type: NRG; PAM sequence: TGG
aggggaaaaaaagtatccgt

SEQ ID NO: 125558 - DNA, 20 bp, Artificial Sequence
  Description of Artificial Sequence: Synthetic oligonucleotide
  Target: ATXN1; (+) strand; PAM type: NRG; PAM sequence: AAG
aaaaagtatccgttggaact

SEQ ID NO: 125559 - DNA, 20 bp, Artificial Sequence
  Description of Artificial Sequence: Synthetic oligonucleotide
  Target: ATXN1; (+) strand; PAM type: NRG; PAM sequence: GAG
aaagtatccgttggaactaa

SEQ ID NO: 125560 - DNA, 20 bp, Artificial Sequence
  Description of Artificial Sequence: Synthetic oligonucleotide
  Target: ATXN1; (+) strand; PAM type: NRG; PAM sequence: AAG
gttcttacaattctttcatc

SEQ ID NO: 125561 - DNA, 20 bp, Artificial Sequence
  Description of Artificial Sequence: Synthetic oligonucleotide
  Target: ATXN1; (+) strand; PAM type: NRG; PAM sequence: AGG
ttcttacaattctttcatca

SEQ ID NO: 125562 - DNA, 20 bp, Artificial Sequence
  Description of Artificial Sequence: Synthetic oligonucleotide
  Target: ATXN1; (+) strand; PAM type: NRG; PAM sequence: TAG
ttctttcatcaaggattata

SEQ ID NO: 125563 - DNA, 20 bp, Artificial Sequence
  Description of Artificial Sequence: Synthetic oligonucleotide
  Target: ATXN1; (+) strand; PAM type: NRG; PAM sequence: GAG
tcatcaaggattatatagat

SEQ ID NO: 125564 - DNA, 20 bp, Artificial Sequence
  Description of Artificial Sequence: Synthetic oligonucleotide
  Target: ATXN1; (+) strand; PAM type: NRG; PAM sequence: AGG
catcaaggattatatagatg

SEQ ID NO: 125565 - DNA, 20 bp, Artificial Sequence
  Description of Artificial Sequence: Synthetic oligonucleotide
  Target: ATXN1; (+) strand; PAM type: NRG; PAM sequence: TAG
ttatatagatgaggaaacat

SEQ ID NO: 125566 - DNA, 20 bp, Artificial Sequence
  Description of Artificial Sequence: Synthetic oligonucleotide
  Target: ATXN1; (+) strand; PAM type: NRG; PAM sequence: GAG
atatagatgaggaaacatta

SEQ ID NO: 125567 - DNA, 20 bp, Artificial Sequence
  Description of Artificial Sequence: Synthetic oligonucleotide
  Target: ATXN1; (+) strand; PAM type: NRG; PAM sequence: AAG
gaaacattagagaaatgtga

SEQ ID NO: 125568 - DNA, 20 bp, Artificial Sequence
  Description of Artificial Sequence: Synthetic oligonucleotide
  Target: ATXN1; (+) strand; PAM type: NRG; PAM sequence: CAG
tgaaagccccaaccacacat

SEQ ID NO: 125569 - DNA, 20 bp, Artificial Sequence
  Description of Artificial Sequence: Synthetic oligonucleotide
  Target: ATXN1; (+) strand; PAM type: NRG; PAM sequence: TAG
aagccccaaccacacatcag

SEQ ID NO: 125570 - DNA, 20 bp, Artificial Sequence
  Description of Artificial Sequence: Synthetic oligonucleotide
  Target: ATXN1; (+) strand; PAM type: NRG; PAM sequence: GAG
gccccaaccacacatcagta

SEQ ID NO: 125571 - DNA, 20 bp, Artificial Sequence
  Description of Artificial Sequence: Synthetic oligonucleotide
  Target: ATXN1; (+) strand; PAM type: NRG; PAM sequence: TAG
atcagtagagaaactgcaat

SEQ ID NO: 125572 - DNA, 20 bp, Artificial Sequence
  Description of Artificial Sequence: Synthetic oligonucleotide
  Target: ATXN1; (+) strand; PAM type: NRG; PAM sequence: TGG
gcaattagaaactgcctctc

SEQ ID NO: 125573 - DNA, 20 bp, Artificial Sequence
  Description of Artificial Sequence: Synthetic oligonucleotide
  Target: ATXN1; (+) strand; PAM type: NRG; PAM sequence: AAG
ttagaaactgcctctctggt

SEQ ID NO: 125574 - DNA, 20 bp, Artificial Sequence
  Description of Artificial Sequence: Synthetic oligonucleotide
  Target: ATXN1; (+) strand; PAM type: NRG; PAM sequence: GAG
agaaactgcctctctggtaa

SEQ ID NO: 125575 - DNA, 20 bp, Artificial Sequence
  Description of Artificial Sequence: Synthetic oligonucleotide
  Target: ATXN1; (+) strand; PAM type: NRG; PAM sequence: CAG
gcctctctggtaagagctcc

SEQ ID NO: 125576 - DNA, 20 bp, Artificial Sequence
  Description of Artificial Sequence: Synthetic oligonucleotide
  Target: ATXN1; (+) strand; PAM type: NRG; PAM sequence: AAG
tctctggtaagagctcccag

SEQ ID NO: 125577 - DNA, 20 bp, Artificial Sequence
  Description of Artificial Sequence: Synthetic oligonucleotide
  Target: ATXN1; (+) strand; PAM type: NRG; PAM sequence: GAG
ggtaagagctcccagaagat

SEQ ID NO: 125578 - DNA, 20 bp, Artificial Sequence
  Description of Artificial Sequence: Synthetic oligonucleotide
  Target: ATXN1; (+) strand; PAM type: NRG; PAM sequence: TGG
agctcccagaagatgagaaa

SEQ ID NO: 125579 - DNA, 20 bp, Artificial Sequence
  Description of Artificial Sequence: Synthetic oligonucleotide
  Target: ATXN1; (+) strand; PAM type: NRG; PAM sequence: GGG
gctcccagaagatgagaaat

SEQ ID NO: 125580 - DNA, 20 bp, Artificial Sequence
  Description of Artificial Sequence: Synthetic oligonucleotide
  Target: ATXN1; (+) strand; PAM type: NRG; PAM sequence: CAG
gggtattgcatttctctgtg

SEQ ID NO: 125581 - DNA, 20 bp, Artificial Sequence
  Description of Artificial Sequence: Synthetic oligonucleotide
  Target: ATXN1; (+) strand; PAM type: NRG; PAM sequence: TGG
atttctctgtgcagtcctac

SEQ ID NO: 125582 - DNA, 20 bp, Artificial Sequence
  Description of Artificial Sequence: Synthetic oligonucleotide
  Target: ATXN1; (+) strand; PAM type: NRG; PAM sequence: GGG
tttctctgtgcagtcctact

SEQ ID NO: 125583 - DNA, 20 bp, Artificial Sequence
  Description of Artificial Sequence: Synthetic oligonucleotide
  Target: ATXN1; (+) strand; PAM type: NRG; PAM sequence: TGG
ctgtgcagtcctactgggcc

SEQ ID NO: 125584 - DNA, 20 bp, Artificial Sequence
  Description of Artificial Sequence: Synthetic oligonucleotide
  Target: ATXN1; (+) strand; PAM type: NRG; PAM sequence: CAG
tcctactgggcctggcattg

SEQ ID NO: 125585 - DNA, 20 bp, Artificial Sequence
  Description of Artificial Sequence: Synthetic oligonucleotide
  Target: ATXN1; (+) strand; PAM type: NRG; PAM sequence: AGG
cctactgggcctggcattgc

SEQ ID NO: 125586 - DNA, 20 bp, Artificial Sequence
  Description of Artificial Sequence: Synthetic oligonucleotide
  Target: ATXN1; (+) strand; PAM type: NRG; PAM sequence: TGG
cctggcattgcaggctccac

SEQ ID NO: 125587 - DNA, 20 bp, Artificial Sequence
  Description of Artificial Sequence: Synthetic oligonucleotide
  Target: ATXN1; (+) strand; PAM type: NRG; PAM sequence: TAG
ggcattgcaggctccactgg

SEQ ID NO: 125588 - DNA, 20 bp, Artificial Sequence
  Description of Artificial Sequence: Synthetic oligonucleotide
  Target: ATXN1; (+) strand; PAM type: NRG; PAM sequence: AGG
gcattgcaggctccactggt

SEQ ID NO: 125589 - DNA, 20 bp, Artificial Sequence
  Description of Artificial Sequence: Synthetic oligonucleotide
  Target: ATXN1; (+) strand; PAM type: NRG; PAM sequence: CAG
gtaggtgtctcctcaatctg

SEQ ID NO: 125590 - DNA, 20 bp, Artificial Sequence
  Description of Artificial Sequence: Synthetic oligonucleotide
  Target: ATXN1; (+) strand; PAM type: NRG; PAM sequence: GAG
caatctgcagcatattaaat

SEQ ID NO: 125591 - DNA, 20 bp, Artificial Sequence
  Description of Artificial Sequence: Synthetic oligonucleotide
  Target: ATXN1; (+) strand; PAM type: NRG; PAM sequence: TGG
aaatgagcactctgtttccc

SEQ ID NO: 125592 - DNA, 20 bp, Artificial Sequence
  Description of Artificial Sequence: Synthetic oligonucleotide
  Target: ATXN1; (+) strand; PAM type: NRG; PAM sequence: CAG
atgtcactacccacacattt

SEQ ID NO: 125593 - DNA, 20 bp, Artificial Sequence
  Description of Artificial Sequence: Synthetic oligonucleotide
  Target: ATXN1; (+) strand; PAM type: NRG; PAM sequence: CAG
cactacccacacatttcagc

SEQ ID NO: 125594 - DNA, 20 bp, Artificial Sequence
  Description of Artificial Sequence: Synthetic oligonucleotide
  Target: ATXN1; (+) strand; PAM type: NRG; PAM sequence: AGG
actacccacacatttcagcc

SEQ ID NO: 125595 - DNA, 20 bp, Artificial Sequence
  Description of Artificial Sequence: Synthetic oligonucleotide
  Target: ATXN1; (+) strand; PAM type: NRG; PAM sequence: GAG
tacccacacatttcagccag

SEQ ID NO: 125596 - DNA, 20 bp, Artificial Sequence
  Description of Artificial Sequence: Synthetic oligonucleotide
  Target: ATXN1; (+) strand; PAM type: NRG; PAM sequence: CAG
ccacacatttcagccaggag

SEQ ID NO: 125597 - DNA, 20 bp, Artificial Sequence
  Description of Artificial Sequence: Synthetic oligonucleotide
  Target: ATXN1; (+) strand; PAM type: NRG; PAM sequence: CAG
gagcagctgaccacgatgcc

SEQ ID NO: 125598 - DNA, 20 bp, Artificial Sequence
  Description of Artificial Sequence: Synthetic oligonucleotide
  Target: ATXN1; (+) strand; PAM type: NRG; PAM sequence: AGG
agcagctgaccacgatgccc

SEQ ID NO: 125599 - DNA, 20 bp, Artificial Sequence
  Description of Artificial Sequence: Synthetic oligonucleotide
  Target: ATXN1; (+) strand; PAM type: NRG; PAM sequence: AAG
agctgaccacgatgcccagg

SEQ ID NO: 125600 - DNA, 20 bp, Artificial Sequence
  Description of Artificial Sequence: Synthetic oligonucleotide
  Target: ATXN1; (+) strand; PAM type: NRG; PAM sequence: CAG
ccaggaagtaccctccccac

SEQ ID NO: 125601 - DNA, 20 bp, Artificial Sequence
  Description of Artificial Sequence: Synthetic oligonucleotide
  Target: ATXN1; (+) strand; PAM type: NRG; PAM sequence: AGG
caggaagtaccctccccacc

SEQ ID NO: 125602 - DNA, 20 bp, Artificial Sequence
  Description of Artificial Sequence: Synthetic oligonucleotide
  Target: ATXN1; (+) strand; PAM type: NRG; PAM sequence: CAG
tccccaccaggtcattctga

SEQ ID NO: 125603 - DNA, 20 bp, Artificial Sequence
  Description of Artificial Sequence: Synthetic oligonucleotide
  Target: ATXN1; (+) strand; PAM type: NRG; PAM sequence: GAG
cccaccaggtcattctgaca

SEQ ID NO: 125604 - DNA, 20 bp, Artificial Sequence
  Description of Artificial Sequence: Synthetic oligonucleotide
  Target: ATXN1; (+) strand; PAM type: NRG; PAM sequence: CAG
cagagccgctgtgccacaca

SEQ ID NO: 125605 - DNA, 20 bp, Artificial Sequence
  Description of Artificial Sequence: Synthetic oligonucleotide
  Target: ATXN1; (+) strand; PAM type: NRG; PAM sequence: AGG
agagccgctgtgccacacac

SEQ ID NO: 125606 - DNA, 20 bp, Artificial Sequence
  Description of Artificial Sequence: Synthetic oligonucleotide
  Target: ATXN1; (+) strand; PAM type: NRG; PAM sequence: GGG
gagccgctgtgccacacaca

SEQ ID NO: 125607 - DNA, 20 bp, Artificial Sequence
  Description of Artificial Sequence: Synthetic oligonucleotide
  Target: ATXN1; (+) strand; PAM type: NRG; PAM sequence: GAG
gccgctgtgccacacacagg

SEQ ID NO: 125608 - DNA, 20 bp, Artificial Sequence
  Description of Artificial Sequence: Synthetic oligonucleotide
  Target: ATXN1; (+) strand; PAM type: NRG; PAM sequence: AGG
ccgctgtgccacacacaggg

SEQ ID NO: 125609 - DNA, 20 bp, Artificial Sequence
  Description of Artificial Sequence: Synthetic oligonucleotide
  Target: ATXN1; (+) strand; PAM type: NRG; PAM sequence: AAG
ccacacacagggaggatgaa

SEQ ID NO: 125610 - DNA, 20 bp, Artificial Sequence
  Description of Artificial Sequence: Synthetic oligonucleotide
  Target: ATXN1; (+) strand; PAM type: NRG; PAM sequence: CAG
cacagggaggatgaaaagca

SEQ ID NO: 125611 - DNA, 20 bp, Artificial Sequence
  Description of Artificial Sequence: Synthetic oligonucleotide
  Target: ATXN1; (+) strand; PAM type: NRG; PAM sequence: AAG
tccacctcctttcaattgct

SEQ ID NO: 125612 - DNA, 20 bp, Artificial Sequence
  Description of Artificial Sequence: Synthetic oligonucleotide
  Target: ATXN1; (+) strand; PAM type: NRG; PAM sequence: CAG
cctcctttcaattgctaaga

SEQ ID NO: 125613 - DNA, 20 bp, Artificial Sequence
  Description of Artificial Sequence: Synthetic oligonucleotide
  Target: ATXN1; (+) strand; PAM type: NRG; PAM sequence: AGG
ctcctttcaattgctaagac

SEQ ID NO: 125614 - DNA, 20 bp, Artificial Sequence
  Description of Artificial Sequence: Synthetic oligonucleotide
  Target: ATXN1; (+) strand; PAM type: NRG; PAM sequence: CAG
ctttcaattgctaagacagg

SEQ ID NO: 125615 - DNA, 20 bp, Artificial Sequence
  Description of Artificial Sequence: Synthetic oligonucleotide
  Target: ATXN1; (+) strand; PAM type: NRG; PAM sequence: AGG
tttcaattgctaagacaggc

SEQ ID NO: 125616 - DNA, 20 bp, Artificial Sequence
  Description of Artificial Sequence: Synthetic oligonucleotide
  Target: ATXN1; (+) strand; PAM type: NRG; PAM sequence: CAG
gccaaccctgctgacccatt

SEQ ID NO: 125617 - DNA, 20 bp, Artificial Sequence
  Description of Artificial Sequence: Synthetic oligonucleotide
  Target: ATXN1; (+) strand; PAM type: NRG; PAM sequence: GAG
caaccctgctgacccattca

SEQ ID NO: 125618 - DNA, 20 bp, Artificial Sequence
  Description of Artificial Sequence: Synthetic oligonucleotide
  Target: ATXN1; (+) strand; PAM type: NRG; PAM sequence: AGG
aaccctgctgacccattcag

SEQ ID NO: 125619 - DNA, 20 bp, Artificial Sequence
  Description of Artificial Sequence: Synthetic oligonucleotide
  Target: ATXN1; (+) strand; PAM type: NRG; PAM sequence: CAG
ctgacccattcagaggcctg

SEQ ID NO: 125620 - DNA, 20 bp, Artificial Sequence
  Description of Artificial Sequence: Synthetic oligonucleotide
  Target: ATXN1; (+) strand; PAM type: NRG; PAM sequence: CAG
aggcctgcagaacactccta

SEQ ID NO: 125621 - DNA, 20 bp, Artificial Sequence
  Description of Artificial Sequence: Synthetic oligonucleotide
  Target: ATXN1; (+) strand; PAM type: NRG; PAM sequence: AGG
ggcctgcagaacactcctac

SEQ ID NO: 125622 - DNA, 20 bp, Artificial Sequence
  Description of Artificial Sequence: Synthetic oligonucleotide
  Target: ATXN1; (+) strand; PAM type: NRG; PAM sequence: AAG
gcattgccttgtctctcatc

SEQ ID NO: 125623 - DNA, 20 bp, Artificial Sequence
  Description of Artificial Sequence: Synthetic oligonucleotide
  Target: ATXN1; (+) strand; PAM type: NRG; PAM sequence: AAG
cttgtctctcatcaagttcc

SEQ ID NO: 125624 - DNA, 20 bp, Artificial Sequence
  Description of Artificial Sequence: Synthetic oligonucleotide
  Target: ATXN1; (+) strand; PAM type: NRG; PAM sequence: TGG
tctctcatcaagttccaaga

SEQ ID NO: 125625 - DNA, 20 bp, Artificial Sequence
  Description of Artificial Sequence: Synthetic oligonucleotide
  Target: ATXN1; (+) strand; PAM type: NRG; PAM sequence: GAG
atcaagttccaagatggacc

SEQ ID NO: 125626 - DNA, 20 bp, Artificial Sequence
  Description of Artificial Sequence: Synthetic oligonucleotide
  Target: ATXN1; (+) strand; PAM type: NRG; PAM sequence: CAG
agttccaagatggaccgaga

SEQ ID NO: 125627 - DNA, 20 bp, Artificial Sequence
  Description of Artificial Sequence: Synthetic oligonucleotide
  Target: ATXN1; (+) strand; PAM type: NRG; PAM sequence: AGG
gttccaagatggaccgagac

SEQ ID NO: 125628 - DNA, 20 bp, Artificial Sequence
  Description of Artificial Sequence: Synthetic oligonucleotide
  Target: ATXN1; (+) strand; PAM type: NRG; PAM sequence: GAG
tccaagatggaccgagacag

SEQ ID NO: 125629 - DNA, 20 bp, Artificial Sequence
  Description of Artificial Sequence: Synthetic oligonucleotide
  Target: ATXN1; (+) strand; PAM type: NRG; PAM sequence: AGG
ccaagatggaccgagacagg

SEQ ID NO: 125630 - DNA, 20 bp, Artificial Sequence
  Description of Artificial Sequence: Synthetic oligonucleotide
  Target: ATXN1; (+) strand; PAM type: NRG; PAM sequence: AAG
gatggaccgagacaggaggc

SEQ ID NO: 125631 - DNA, 20 bp, Artificial Sequence
  Description of Artificial Sequence: Synthetic oligonucleotide
  Target: ATXN1; (+) strand; PAM type: NRG; PAM sequence: TAG
agacaggaggcaagtgttaa

SEQ ID NO: 125632 - DNA, 20 bp, Artificial Sequence
  Description of Artificial Sequence: Synthetic oligonucleotide
  Target: ATXN1; (+) strand; PAM type: NRG; PAM sequence: AAG
aggaggcaagtgttaatagc

SEQ ID NO: 125633 - DNA, 20 bp, Artificial Sequence
  Description of Artificial Sequence: Synthetic oligonucleotide
  Target: ATXN1; (+) strand; PAM type: NRG; PAM sequence: GAG
gaggcaagtgttaatagcaa

SEQ ID NO: 125634 - DNA, 20 bp, Artificial Sequence
  Description of Artificial Sequence: Synthetic oligonucleotide
  Target: ATXN1; (+) strand; PAM type: NRG; PAM sequence: TAG
gcaagtgttaatagcaagag

SEQ ID NO: 125635 - DNA, 20 bp, Artificial Sequence
  Description of Artificial Sequence: Synthetic oligonucleotide
  Target: ATXN1; (+) strand; PAM type: NRG; PAM sequence: TAG
gtgttaatagcaagagtaga

SEQ ID NO: 125636 - DNA, 20 bp, Artificial Sequence
  Description of Artificial Sequence: Synthetic oligonucleotide
  Target: ATXN1; (+) strand; PAM type: NRG; PAM sequence: CAG
accacattctccgcatatca

SEQ ID NO: 125637 - DNA, 20 bp, Artificial Sequence
  Description of Artificial Sequence: Synthetic oligonucleotide
  Target: ATXN1; (+) strand; PAM type: NRG; PAM sequence: AGG
ccacattctccgcatatcac

SEQ ID NO: 125638 - DNA, 20 bp, Artificial Sequence
  Description of Artificial Sequence: Synthetic oligonucleotide
  Target: ATXN1; (+) strand; PAM type: NRG; PAM sequence: CAG
tctccgcatatcacaggccc

SEQ ID NO: 125639 - DNA, 20 bp, Artificial Sequence
  Description of Artificial Sequence: Synthetic oligonucleotide
  Target: ATXN1; (+) strand; PAM type: NRG; PAM sequence: AGG
ctccgcatatcacaggcccc

SEQ ID NO: 125640 - DNA, 20 bp, Artificial Sequence
  Description of Artificial Sequence: Synthetic oligonucleotide
  Target: ATXN1; (+) strand; PAM type: NRG; PAM sequence: GAG
ccgcatatcacaggccccag

SEQ ID NO: 125641 - DNA, 20 bp, Artificial Sequence
  Description of Artificial Sequence: Synthetic oligonucleotide
  Target: ATXN1; (+) strand; PAM type: NRG; PAM sequence: AGG
cgcatatcacaggccccagg

SEQ ID NO: 125642 - DNA, 20 bp, Artificial Sequence
  Description of Artificial Sequence: Synthetic oligonucleotide
  Target: ATXN1; (+) strand; PAM type: NRG; PAM sequence: GGG
gcatatcacaggccccagga

SEQ ID NO: 125643 - DNA, 20 bp, Artificial Sequence
  Description of Artificial Sequence: Synthetic oligonucleotide
  Target: ATXN1; (+) strand; PAM type: NRG; PAM sequence: GGG
catatcacaggccccaggag

SEQ ID NO: 125644 - DNA, 20 bp, Artificial Sequence
  Description of Artificial Sequence: Synthetic oligonucleotide
  Target: ATXN1; (+) strand; PAM type: NRG; PAM sequence: AAG
tcacaggccccaggagggga

SEQ ID NO: 125645 - DNA, 20 bp, Artificial Sequence
  Description of Artificial Sequence: Synthetic oligonucleotide
  Target: ATXN1; (+) strand; PAM type: NRG; PAM sequence: AGG
cacaggccccaggaggggaa

SEQ ID NO: 125646 - DNA, 20 bp, Artificial Sequence
  Description of Artificial Sequence: Synthetic oligonucleotide
  Target: ATXN1; (+) strand; PAM type: NRG; PAM sequence: AAG
ggccccaggaggggaaaggc

SEQ ID NO: 125647 - DNA, 20 bp, Artificial Sequence
  Description of Artificial Sequence: Synthetic oligonucleotide
  Target: ATXN1; (+) strand; PAM type: NRG; PAM sequence: GAG
ccccaggaggggaaaggcaa

SEQ ID NO: 125648 - DNA, 20 bp, Artificial Sequence
  Description of Artificial Sequence: Synthetic oligonucleotide
  Target: ATXN1; (+) strand; PAM type: NRG; PAM sequence: GAG
ccaggaggggaaaggcaaga

SEQ ID NO: 125649 - DNA, 20 bp, Artificial Sequence
  Description of Artificial Sequence: Synthetic oligonucleotide
  Target: ATXN1; (+) strand; PAM type: NRG; PAM sequence: AGG
caggaggggaaaggcaagag

SEQ ID NO: 125650 - DNA, 20 bp, Artificial Sequence
  Description of Artificial Sequence: Synthetic oligonucleotide
  Target: ATXN1; (+) strand; PAM type: NRG; PAM sequence: AAG
ggggaaaggcaagagaggat

SEQ ID NO: 125651 - DNA, 20 bp, Artificial Sequence
  Description of Artificial Sequence: Synthetic oligonucleotide
  Target: ATXN1; (+) strand; PAM type: NRG; PAM sequence: AGG
gggaaaggcaagagaggata

SEQ ID NO: 125652 - DNA, 20 bp, Artificial Sequence
  Description of Artificial Sequence: Synthetic oligonucleotide
  Target: ATXN1; (+) strand; PAM type: NRG; PAM sequence: TGG
aaaggcaagagaggataagg

SEQ ID NO: 125653 - DNA, 20 bp, Artificial Sequence
  Description of Artificial Sequence: Synthetic oligonucleotide
  Target: ATXN1; (+) strand; PAM type: NRG; PAM sequence: GGG
aaggcaagagaggataaggt

SEQ ID NO: 125654 - DNA, 20 bp, Artificial Sequence
  Description of Artificial Sequence: Synthetic oligonucleotide
  Target: ATXN1; (+) strand; PAM type: NRG; PAM sequence: AAG
gaggataaggtgggaaataa

SEQ ID NO: 125655 - DNA, 20 bp, Artificial Sequence
  Description of Artificial Sequence: Synthetic oligonucleotide
  Target: ATXN1; (+) strand; PAM type: NRG; PAM sequence: GAG
ggataaggtgggaaataaaa

SEQ ID NO: 125656 - DNA, 20 bp, Artificial Sequence
  Description of Artificial Sequence: Synthetic oligonucleotide
  Target: ATXN1; (+) strand; PAM type: NRG; PAM sequence: AGG
gataaggtgggaaataaaag

SEQ ID NO: 125657 - DNA, 20 bp, Artificial Sequence
  Description of Artificial Sequence: Synthetic oligonucleotide
  Target: ATXN1; (+) strand; PAM type: NRG; PAM sequence: GGG
ataaggtgggaaataaaaga

SEQ ID NO: 125658 - DNA, 20 bp, Artificial Sequence
  Description of Artificial Sequence: Synthetic oligonucleotide
  Target: ATXN1; (+) strand; PAM type: NRG; PAM sequence: CAG
tgggaaataaaagagggtat

SEQ ID NO: 125659 - DNA, 20 bp, Artificial Sequence
  Description of Artificial Sequence: Synthetic oligonucleotide
  Target: ATXN1; (+) strand; PAM type: NRG; PAM sequence: AGG
gggaaataaaagagggtatc

SEQ ID NO: 125660 - DNA, 20 bp, Artificial Sequence
  Description of Artificial Sequence: Synthetic oligonucleotide
  Target: ATXN1; (+) strand; PAM type: NRG; PAM sequence: GGG
ggaaataaaagagggtatca

SEQ ID NO: 125661 - DNA, 20 bp, Artificial Sequence
  Description of Artificial Sequence: Synthetic oligonucleotide
  Target: ATXN1; (+) strand; PAM type: NRG; PAM sequence: CAG
agggctgccctcatcctgcc

SEQ ID NO: 125662 - DNA, 20 bp, Artificial Sequence
  Description of Artificial Sequence: Synthetic oligonucleotide
  Target: ATXN1; (+) strand; PAM type: NRG; PAM sequence: AGG
gggctgccctcatcctgccc

SEQ ID NO: 125663 - DNA, 20 bp, Artificial Sequence
  Description of Artificial Sequence: Synthetic oligonucleotide
  Target: ATXN1; (+) strand; PAM type: NRG; PAM sequence: TGG
tcatcctgcccaggatacac

SEQ ID NO: 125664 - DNA, 20 bp, Artificial Sequence
  Description of Artificial Sequence: Synthetic oligonucleotide
  Target: ATXN1; (+) strand; PAM type: NRG; PAM sequence: CAG
ccaggatacactggctgtca

SEQ ID NO: 125665 - DNA, 20 bp, Artificial Sequence
  Description of Artificial Sequence: Synthetic oligonucleotide
  Target: ATXN1; (+) strand; PAM type: NRG; PAM sequence: TGG
cacagtcattatatgttttc

SEQ ID NO: 125666 - DNA, 20 bp, Artificial Sequence
  Description of Artificial Sequence: Synthetic oligonucleotide
  Target: ATXN1; (+) strand; PAM type: NRG; PAM sequence: CAG
agtcattatatgttttctgg

SEQ ID NO: 125667 - DNA, 20 bp, Artificial Sequence
  Description of Artificial Sequence: Synthetic oligonucleotide
  Target: ATXN1; (+) strand; PAM type: NRG; PAM sequence: CAG
ttatatgttttctggcagca

SEQ ID NO: 125668 - DNA, 20 bp, Artificial Sequence
  Description of Artificial Sequence: Synthetic oligonucleotide
  Target: ATXN1; (+) strand; PAM type: NRG; PAM sequence: TGG
gcagcacagtcacgttgcta

SEQ ID NO: 125669 - DNA, 20 bp, Artificial Sequence
  Description of Artificial Sequence: Synthetic oligonucleotide
  Target: ATXN1; (+) strand; PAM type: NRG; PAM sequence: TGG
caatgcatgtcattgccacc

SEQ ID NO: 125670 - DNA, 20 bp, Artificial Sequence
  Description of Artificial Sequence: Synthetic oligonucleotide
  Target: ATXN1; (+) strand; PAM type: NRG; PAM sequence: TAG
tgtcattgccacctggcctc

SEQ ID NO: 125671 - DNA, 20 bp, Artificial Sequence
  Description of Artificial Sequence: Synthetic oligonucleotide
  Target: ATXN1; (+) strand; PAM type: NRG; PAM sequence: CAG
gcctctagcaaataaaatca

SEQ ID NO: 125672 - DNA, 20 bp, Artificial Sequence
  Description of Artificial Sequence: Synthetic oligonucleotide
  Target: ATXN1; (+) strand; PAM type: NRG; PAM sequence: TGG
agcaaataaaatcacagcgc

SEQ ID NO: 125673 - DNA, 20 bp, Artificial Sequence
  Description of Artificial Sequence: Synthetic oligonucleotide
  Target: ATXN1; (+) strand; PAM type: NRG; PAM sequence: AAG
aataaaatcacagcgctggc

SEQ ID NO: 125674 - DNA, 20 bp, Artificial Sequence
  Description of Artificial Sequence: Synthetic oligonucleotide
  Target: ATXN1; (+) strand; PAM type: NRG; PAM sequence: GAG
taaaatcacagcgctggcaa

SEQ ID NO: 125675 - DNA, 20 bp, Artificial Sequence
  Description of Artificial Sequence: Synthetic oligonucleotide
  Target: ATXN1; (+) strand; PAM type: NRG; PAM sequence: TGG
cgctggcaagagcatttccc

SEQ ID NO: 125676 - DNA, 20 bp, Artificial Sequence
  Description of Artificial Sequence: Synthetic oligonucleotide
  Target: ATXN1; (+) strand; PAM type: NRG; PAM sequence: AAG
atttccctggatttccctta

SEQ ID NO: 125677 - DNA, 20 bp, Artificial Sequence
  Description of Artificial Sequence: Synthetic oligonucleotide
  Target: ATXN1; (+) strand; PAM type: NRG; PAM sequence: GAG
ttccctggatttcccttaaa

SEQ ID NO: 125678 - DNA, 20 bp, Artificial Sequence
  Description of Artificial Sequence: Synthetic oligonucleotide
  Target: ATXN1; (+) strand; PAM type: NRG; PAM sequence: TGG
ccttaaagagataccattga

SEQ ID NO: 125679 - DNA, 20 bp, Artificial Sequence
  Description of Artificial Sequence: Synthetic oligonucleotide
  Target: ATXN1; (+) strand; PAM type: NRG; PAM sequence: GAG
aaagagataccattgatggt

SEQ ID NO: 125680 - DNA, 20 bp, Artificial Sequence
  Description of Artificial Sequence: Synthetic oligonucleotide
  Target: ATXN1; (+) strand; PAM type: NRG; PAM sequence: GAG
attgatggtgagtgctgttt

SEQ ID NO: 125681 - DNA, 20 bp, Artificial Sequence
  Description of Artificial Sequence: Synthetic oligonucleotide
  Target: ATXN1; (+) strand; PAM type: NRG; PAM sequence: TAG
tggtgagtgctgtttgagct

SEQ ID NO: 125682 - DNA, 20 bp, Artificial Sequence
  Description of Artificial Sequence: Synthetic oligonucleotide
  Target: ATXN1; (+) strand; PAM type: NRG; PAM sequence: CAG
ctgtttgagcttagaaacaa

SEQ ID NO: 125683 - DNA, 20 bp, Artificial Sequence
  Description of Artificial Sequence: Synthetic oligonucleotide
  Target: ATXN1; (+) strand; PAM type: NRG; PAM sequence: CAG
tttgagcttagaaacaacag

SEQ ID NO: 125684 - DNA, 20 bp, Artificial Sequence
  Description of Artificial Sequence: Synthetic oligonucleotide
  Target: ATXN1; (+) strand; PAM type: NRG; PAM sequence: AAG
acaacagcagcattgttccc

SEQ ID NO: 125685 - DNA, 20 bp, Artificial Sequence
  Description of Artificial Sequence: Synthetic oligonucleotide
  Target: ATXN1; (+) strand; PAM type: NRG; PAM sequence: CAG
gcagcattgttcccaagacc

SEQ ID NO: 125686 - DNA, 20 bp, Artificial Sequence
  Description of Artificial Sequence: Synthetic oligonucleotide
  Target: ATXN1; (+) strand; PAM type: NRG; PAM sequence: GAG
ccattgcataccatgaaact

SEQ ID NO: 125687 - DNA, 20 bp, Artificial Sequence
  Description of Artificial Sequence: Synthetic oligonucleotide
  Target: ATXN1; (+) strand; PAM type: NRG; PAM sequence: CAG
gcataccatgaaactgagcc

SEQ ID NO: 125688 - DNA, 20 bp, Artificial Sequence
  Description of Artificial Sequence: Synthetic oligonucleotide
  Target: ATXN1; (+) strand; PAM type: NRG; PAM sequence: AGG
cataccatgaaactgagccc

SEQ ID NO: 125689 - DNA, 20 bp, Artificial Sequence
  Description of Artificial Sequence: Synthetic oligonucleotide
  Target: ATXN1; (+) strand; PAM type: NRG; PAM sequence: GGG
ataccatgaaactgagccca

SEQ ID NO: 125690 - DNA, 20 bp, Artificial Sequence
  Description of Artificial Sequence: Synthetic oligonucleotide
  Target: ATXN1; (+) strand; PAM type: NRG; PAM sequence: AAG
cccagggactcacgttttac

SEQ ID NO: 125691 - DNA, 20 bp, Artificial Sequence
  Description of Artificial Sequence: Synthetic oligonucleotide
  Target: ATXN1; (+) strand; PAM type: NRG; PAM sequence: AGG
ccagggactcacgttttaca

SEQ ID NO: 125692 - DNA, 20 bp, Artificial Sequence
  Description of Artificial Sequence: Synthetic oligonucleotide
  Target: ATXN1; (+) strand; PAM type: NRG; PAM sequence: TGG
ttacaaggtatatatgcatg

SEQ ID NO: 125693 - DNA, 20 bp, Artificial Sequence
  Description of Artificial Sequence: Synthetic oligonucleotide
  Target: ATXN1; (+) strand; PAM type: NRG; PAM sequence: GGG
tacaaggtatatatgcatgt

SEQ ID NO: 125694 - DNA, 20 bp, Artificial Sequence
  Description of Artificial Sequence: Synthetic oligonucleotide
  Target: ATXN1; (+) strand; PAM type: NRG; PAM sequence: GGG
acaaggtatatatgcatgtg

SEQ ID NO: 125695 - DNA, 20 bp, Artificial Sequence
  Description of Artificial Sequence: Synthetic oligonucleotide
  Target: ATXN1; (+) strand; PAM type: NRG; PAM sequence: GGG
caaggtatatatgcatgtgg

SEQ ID NO: 125696 - DNA, 20 bp, Artificial Sequence
  Description of Artificial Sequence: Synthetic oligonucleotide
  Target: ATXN1; (+) strand; PAM type: NRG; PAM sequence: CAG
gtatatatgcatgtgggggc

SEQ ID NO: 125697 - DNA, 20 bp, Artificial Sequence
  Description of Artificial Sequence: Synthetic oligonucleotide
  Target: ATXN1; (+) strand; PAM type: NRG; PAM sequence: GAG
gcatgtgggggccagcttct

SEQ ID NO: 125698 - DNA, 20 bp, Artificial Sequence
  Description of Artificial Sequence: Synthetic oligonucleotide
  Target: ATXN1; (+) strand; PAM type: NRG; PAM sequence: TAG
ccagcttctgagcttctttt

SEQ ID NO: 125699 - DNA, 20 bp, Artificial Sequence
  Description of Artificial Sequence: Synthetic oligonucleotide
  Target: ATXN1; (+) strand; PAM type: NRG; PAM sequence: AGG
cagcttctgagcttcttttt

SEQ ID NO: 125700 - DNA, 20 bp, Artificial Sequence
  Description of Artificial Sequence: Synthetic oligonucleotide
  Target: ATXN1; (+) strand; PAM type: NRG; PAM sequence: GGG
agcttctgagcttcttttta

SEQ ID NO: 125701 - DNA, 20 bp, Artificial Sequence
  Description of Artificial Sequence: Synthetic oligonucleotide
  Target: ATXN1; (+) strand; PAM type: NRG; PAM sequence: GAG
cttctgagcttctttttagg

SEQ ID NO: 125702 - DNA, 20 bp, Artificial Sequence
  Description of Artificial Sequence: Synthetic oligonucleotide
  Target: ATXN1; (+) strand; PAM type: NRG; PAM sequence: TGG
tttagggagaaaaatactca

SEQ ID NO: 125703 - DNA, 20 bp, Artificial Sequence
  Description of Artificial Sequence: Synthetic oligonucleotide
  Target: ATXN1; (+) strand; PAM type: NRG; PAM sequence: TAG
tcatggcttctatctgtgtt

SEQ ID NO: 125704 - DNA, 20 bp, Artificial Sequence
  Description of Artificial Sequence: Synthetic oligonucleotide
  Target: ATXN1; (+) strand; PAM type: NRG; PAM sequence: TGG
gtgtttagttttttctcatt

SEQ ID NO: 125705 - DNA, 20 bp, Artificial Sequence
  Description of Artificial Sequence: Synthetic oligonucleotide
  Target: ATXN1; (+) strand; PAM type: NRG; PAM sequence: CGG
ttggtaaaataaaaaaatta

SEQ ID NO: 125706 - DNA, 20 bp, Artificial Sequence
  Description of Artificial Sequence: Synthetic oligonucleotide
  Target: ATXN1; (+) strand; PAM type: NRG; PAM sequence: TGG
aattacggcttgtaatattt

SEQ ID NO: 125707 - DNA, 20 bp, Artificial Sequence
  Description of Artificial Sequence: Synthetic oligonucleotide
  Target: ATXN1; (+) strand; PAM type: NRG; PAM sequence: AAG
cctcttgaatgtcaacatca

SEQ ID NO: 125708 - DNA, 20 bp, Artificial Sequence
  Description of Artificial Sequence: Synthetic oligonucleotide
  Target: ATXN1; (+) strand; PAM type: NRG; PAM sequence: CAG
catcaaagtgctcatgaccc

SEQ ID NO: 125709 - DNA, 20 bp, Artificial Sequence
  Description of Artificial Sequence: Synthetic oligonucleotide
  Target: ATXN1; (+) strand; PAM type: NRG; PAM sequence: AAG
caaagtgctcatgaccccag

SEQ ID NO: 125710 - DNA, 20 bp, Artificial Sequence
  Description of Artificial Sequence: Synthetic oligonucleotide
  Target: ATXN1; (+) strand; PAM type: NRG; PAM sequence: AGG
aaagtgctcatgaccccaga

SEQ ID NO: 125711 - DNA, 20 bp, Artificial Sequence
  Description of Artificial Sequence: Synthetic oligonucleotide
  Target: ATXN1; (+) strand; PAM type: NRG; PAM sequence: AAG
atgaccccagaaggaaacca

SEQ ID NO: 125712 - DNA, 20 bp, Artificial Sequence
  Description of Artificial Sequence: Synthetic oligonucleotide
  Target: ATXN1; (+) strand; PAM type: NRG; PAM sequence: TAG
accccagaaggaaaccaaag

SEQ ID NO: 125713 - DNA, 20 bp, Artificial Sequence
  Description of Artificial Sequence: Synthetic oligonucleotide
  Target: ATXN1; (+) strand; PAM type: NRG; PAM sequence: AAG
aaggaaaccaaagtagccac

SEQ ID NO: 125714 - DNA, 20 bp, Artificial Sequence
  Description of Artificial Sequence: Synthetic oligonucleotide
  Target: ATXN1; (+) strand; PAM type: NRG; PAM sequence: TGG
gaaaccaaagtagccacaag

SEQ ID NO: 125715 - DNA, 20 bp, Artificial Sequence
  Description of Artificial Sequence: Synthetic oligonucleotide
  Target: ATXN1; (+) strand; PAM type: NRG; PAM sequence: TGG
gtagccacaagtggtctaca

SEQ ID NO: 125716 - DNA, 20 bp, Artificial Sequence
  Description of Artificial Sequence: Synthetic oligonucleotide
  Target: ATXN1; (+) strand; PAM type: NRG; PAM sequence: GGG
tagccacaagtggtctacat

SEQ ID NO: 125717 - DNA, 20 bp, Artificial Sequence
  Description of Artificial Sequence: Synthetic oligonucleotide
  Target: ATXN1; (+) strand; PAM type: NRG; PAM sequence: CAG
acaagtggtctacatgggtt

SEQ ID NO: 125718 - DNA, 20 bp, Artificial Sequence
  Description of Artificial Sequence: Synthetic oligonucleotide
  Target: ATXN1; (+) strand; PAM type: NRG; PAM sequence: AGG
caagtggtctacatgggttc

SEQ ID NO: 125719 - DNA, 20 bp, Artificial Sequence
  Description of Artificial Sequence: Synthetic oligonucleotide
  Target: ATXN1; (+) strand; PAM type: NRG; PAM sequence: CAG
gtggtctacatgggttcagg

SEQ ID NO: 125720 - DNA, 20 bp, Artificial Sequence
  Description of Artificial Sequence: Synthetic oligonucleotide
  Target: ATXN1; (+) strand; PAM type: NRG; PAM sequence: CAG
tccttcaccatttcttgcct

SEQ ID NO: 125721 - DNA, 20 bp, Artificial Sequence
  Description of Artificial Sequence: Synthetic oligonucleotide
  Target: ATXN1; (+) strand; PAM type: NRG; PAM sequence: CAG
tgcctcagacccttctctac

SEQ ID NO: 125722 - DNA, 20 bp, Artificial Sequence
  Description of Artificial Sequence: Synthetic oligonucleotide
  Target: ATXN1; (+) strand; PAM type: NRG; PAM sequence: AAG
accagtttattctttaccca

SEQ ID NO: 125723 - DNA, 20 bp, Artificial Sequence
  Description of Artificial Sequence: Synthetic oligonucleotide
  Target: ATXN1; (+) strand; PAM type: NRG; PAM sequence: AAG
cccaaagaatcctatgatgt

SEQ ID NO: 125724 - DNA, 20 bp, Artificial Sequence
  Description of Artificial Sequence: Synthetic oligonucleotide
  Target: ATXN1; (+) strand; PAM type: NRG; PAM sequence: TGG
agaatcctatgatgtaagca

SEQ ID NO: 125725 - DNA, 20 bp, Artificial Sequence
  Description of Artificial Sequence: Synthetic oligonucleotide
  Target: ATXN1; (+) strand; PAM type: NRG; PAM sequence: TGG
ctatgatgtaagcatggaaa

SEQ ID NO: 125726 - DNA, 20 bp, Artificial Sequence
  Description of Artificial Sequence: Synthetic oligonucleotide
  Target: ATXN1; (+) strand; PAM type: NRG; PAM sequence: AAG
ggacatttcttcactttctc

SEQ ID NO: 125727 - DNA, 20 bp, Artificial Sequence
  Description of Artificial Sequence: Synthetic oligonucleotide
  Target: ATXN1; (+) strand; PAM type: NRG; PAM sequence: AGG
gacatttcttcactttctca

SEQ ID NO: 125728 - DNA, 20 bp, Artificial Sequence
  Description of Artificial Sequence: Synthetic oligonucleotide
  Target: ATXN1; (+) strand; PAM type: NRG; PAM sequence: TAG
ccttaattgcccccttcttt

SEQ ID NO: 125729 - DNA, 20 bp, Artificial Sequence
  Description of Artificial Sequence: Synthetic oligonucleotide
  Target: ATXN1; (+) strand; PAM type: NRG; PAM sequence: AAG
taattaatctcttgactcta

SEQ ID NO: 125730 - DNA, 20 bp, Artificial Sequence
  Description of Artificial Sequence: Synthetic oligonucleotide
  Target: ATXN1; (+) strand; PAM type: NRG; PAM sequence: GAG
attaatctcttgactctaaa

SEQ ID NO: 125731 - DNA, 20 bp, Artificial Sequence
  Description of Artificial Sequence: Synthetic oligonucleotide
  Target: ATXN1; (+) strand; PAM type: NRG; PAM sequence: CAG
tgactctaaagagaccttta

SEQ ID NO: 125732 - DNA, 20 bp, Artificial Sequence
  Description of Artificial Sequence: Synthetic oligonucleotide
  Target: ATXN1; (+) strand; PAM type: NRG; PAM sequence: CAG
aaagagacctttacagtccc

SEQ ID NO: 125733 - DNA, 20 bp, Artificial Sequence
  Description of Artificial Sequence: Synthetic oligonucleotide
  Target: ATXN1; (+) strand; PAM type: NRG; PAM sequence: GAG
agagacctttacagtcccca

SEQ ID NO: 125734 - DNA, 20 bp, Artificial Sequence
  Description of Artificial Sequence: Synthetic oligonucleotide
  Target: ATXN1; (+) strand; PAM type: NRG; PAM sequence: GAG
agacctttacagtccccaga

SEQ ID NO: 125735 - DNA, 20 bp, Artificial Sequence
  Description of Artificial Sequence: Synthetic oligonucleotide
  Target: ATXN1; (+) strand; PAM type: NRG; PAM sequence: CAG
ttacagtccccagagagcaa

SEQ ID NO: 125736 - DNA, 20 bp, Artificial Sequence
  Description of Artificial Sequence: Synthetic oligonucleotide
  Target: ATXN1; (+) strand; PAM type: NRG; PAM sequence: AGG
tacagtccccagagagcaac

SEQ ID NO: 125737 - DNA, 20 bp, Artificial Sequence
  Description of Artificial Sequence: Synthetic oligonucleotide
  Target: ATXN1; (+) strand; PAM type: NRG; PAM sequence: CAG
ccccagagagcaacaggtgt

SEQ ID NO: 125738 - DNA, 20 bp, Artificial Sequence
  Description of Artificial Sequence: Synthetic oligonucleotide
  Target: ATXN1; (+) strand; PAM type: NRG; PAM sequence: TGG
cagtgacccacattgtactg

SEQ ID NO: 125739 - DNA, 20 bp, Artificial Sequence
  Description of Artificial Sequence: Synthetic oligonucleotide
  Target: ATXN1; (+) strand; PAM type: NRG; PAM sequence: GAG
attgtactgtggtgtgctct

SEQ ID NO: 125740 - DNA, 20 bp, Artificial Sequence
  Description of Artificial Sequence: Synthetic oligonucleotide
  Target: ATXN1; (+) strand; PAM type: NRG; PAM sequence: TGG
tgctctgagaataaactttt

SEQ ID NO: 125741 - DNA, 20 bp, Artificial Sequence
  Description of Artificial Sequence: Synthetic oligonucleotide
  Target: ATXN1; (+) strand; PAM type: NRG; PAM sequence: GGG
gctctgagaataaacttttt

SEQ ID NO: 125742 - DNA, 20 bp, Artificial Sequence
  Description of Artificial Sequence: Synthetic oligonucleotide
  Target: ATXN1; (+) strand; PAM type: NRG; PAM sequence: CAG
taaactttttgggcttttct

SEQ ID NO: 125743 - DNA, 20 bp, Artificial Sequence
  Description of Artificial Sequence: Synthetic oligonucleotide
  Target: ATXN1; (+) strand; PAM type: NRG; PAM sequence: AAG
tttttgggcttttctcagat

SEQ ID NO: 125744 - DNA, 20 bp, Artificial Sequence
  Description of Artificial Sequence: Synthetic oligonucleotide
  Target: ATXN1; (+) strand; PAM type: NRG; PAM sequence: CAG
tgggcttttctcagataaga

SEQ ID NO: 125745 - DNA, 20 bp, Artificial Sequence
  Description of Artificial Sequence: Synthetic oligonucleotide
  Target: ATXN1; (+) strand; PAM type: NRG; PAM sequence: AGG
gggcttttctcagataagac

SEQ ID NO: 125746 - DNA, 20 bp, Artificial Sequence
  Description of Artificial Sequence: Synthetic oligonucleotide
  Target: ATXN1; (+) strand; PAM type: NRG; PAM sequence: TGG
tctcagataagacaggaaaa

SEQ ID NO: 125747 - DNA, 20 bp, Artificial Sequence
  Description of Artificial Sequence: Synthetic oligonucleotide
  Target: ATXN1; (+) strand; PAM type: NRG; PAM sequence: CAG
caggaaaatggaaaccttca

SEQ ID NO: 125748 - DNA, 20 bp, Artificial Sequence
  Description of Artificial Sequence: Synthetic oligonucleotide
  Target: ATXN1; (+) strand; PAM type: NRG; PAM sequence: TAG
ctaatgaatgctaactcgtg

SEQ ID NO: 125749 - DNA, 20 bp, Artificial Sequence
  Description of Artificial Sequence: Synthetic oligonucleotide
  Target: ATXN1; (+) strand; PAM type: NRG; PAM sequence: CAG
aatgctaactcgtgtagacc

SEQ ID NO: 125750 - DNA, 20 bp, Artificial Sequence
  Description of Artificial Sequence: Synthetic oligonucleotide
  Target: ATXN1; (+) strand; PAM type: NRG; PAM sequence: TGG
ctcgtgtagacccagctctg

SEQ ID NO: 125751 - DNA, 20 bp, Artificial Sequence
  Description of Artificial Sequence: Synthetic oligonucleotide
  Target: ATXN1; (+) strand; PAM type: NRG; PAM sequence: CAG
tgtagacccagctctgtgga

SEQ ID NO: 125752 - DNA, 20 bp, Artificial Sequence
  Description of Artificial Sequence: Synthetic oligonucleotide
  Target: ATXN1; (+) strand; PAM type: NRG; PAM sequence: AGG
gtagacccagctctgtggac

SEQ ID NO: 125753 - DNA, 20 bp, Artificial Sequence
  Description of Artificial Sequence: Synthetic oligonucleotide
  Target: ATXN1; (+) strand; PAM type: NRG; PAM sequence: GAG
agacccagctctgtggacag

SEQ ID NO: 125754 - DNA, 20 bp, Artificial Sequence
  Description of Artificial Sequence: Synthetic oligonucleotide
  Target: ATXN1; (+) strand; PAM type: NRG; PAM sequence: TAG
tggacaggagcgatcaatgt

SEQ ID NO: 125755 - DNA, 20 bp, Artificial Sequence
  Description of Artificial Sequence: Synthetic oligonucleotide
  Target: ATXN1; (+) strand; PAM type: NRG; PAM sequence: AGG
ggacaggagcgatcaatgtt

SEQ ID NO: 125756 - DNA, 20 bp, Artificial Sequence
  Description of Artificial Sequence: Synthetic oligonucleotide
  Target: ATXN1; (+) strand; PAM type: NRG; PAM sequence: GGG
gacaggagcgatcaatgtta

SEQ ID NO: 125757 - DNA, 20 bp, Artificial Sequence
  Description of Artificial Sequence: Synthetic oligonucleotide
  Target: ATXN1; (+) strand; PAM type: NRG; PAM sequence: CAG
cgatcaatgttagggtaact

SEQ ID NO: 125758 - DNA, 20 bp, Artificial Sequence
  Description of Artificial Sequence: Synthetic oligonucleotide
  Target: ATXN1; (+) strand; PAM type: NRG; PAM sequence: CAG
tcaatgttagggtaactcag

SEQ ID NO: 125759 - DNA, 20 bp, Artificial Sequence
  Description of Artificial Sequence: Synthetic oligonucleotide
  Target: ATXN1; (+) strand; PAM type: NRG; PAM sequence: CAG
gcagatgatccctcacaaat

SEQ ID NO: 125760 - DNA, 20 bp, Artificial Sequence
  Description of Artificial Sequence: Synthetic oligonucleotide
  Target: ATXN1; (+) strand; PAM type: NRG; PAM sequence: CAG
tctatgttctacattccatt

SEQ ID NO: 125761 - DNA, 20 bp, Artificial Sequence
  Description of Artificial Sequence: Synthetic oligonucleotide
  Target: ATXN1; (+) strand; PAM type: NRG; PAM sequence: TGG
ctacattccattcagtatgt

SEQ ID NO: 125762 - DNA, 20 bp, Artificial Sequence
  Description of Artificial Sequence: Synthetic oligonucleotide
  Target: ATXN1; (+) strand; PAM type: NRG; PAM sequence: TAG
cattccattcagtatgttgg

SEQ ID NO: 125763 - DNA, 20 bp, Artificial Sequence
  Description of Artificial Sequence: Synthetic oligonucleotide
  Target: ATXN1; (+) strand; PAM type: NRG; PAM sequence: AAG
aattacgtctgtatgtacat

SEQ ID NO: 125764 - DNA, 20 bp, Artificial Sequence
  Description of Artificial Sequence: Synthetic oligonucleotide
  Target: ATXN1; (+) strand; PAM type: NRG; PAM sequence: AGG
attacgtctgtatgtacata

SEQ ID NO: 125765 - DNA, 20 bp, Artificial Sequence
  Description of Artificial Sequence: Synthetic oligonucleotide
  Target: ATXN1; (+) strand; PAM type: NRG; PAM sequence: GAG
tacgtctgtatgtacataag

SEQ ID NO: 125766 - DNA, 20 bp, Artificial Sequence
  Description of Artificial Sequence: Synthetic oligonucleotide
  Target: ATXN1; (+) strand; PAM type: NRG; PAM sequence: AAG
atgtacataaggagatgatc

SEQ ID NO: 125767 - DNA, 20 bp, Artificial Sequence
  Description of Artificial Sequence: Synthetic oligonucleotide
  Target: ATXN1; (+) strand; PAM type: NRG; PAM sequence: TAG
aagttccgcaataatgactc

SEQ ID NO: 125768 - DNA, 20 bp, Artificial Sequence
  Description of Artificial Sequence: Synthetic oligonucleotide
  Target: ATXN1; (+) strand; PAM type: NRG; PAM sequence: TAG
tccgcaataatgactctagt

SEQ ID NO: 125769 - DNA, 20 bp, Artificial Sequence
  Description of Artificial Sequence: Synthetic oligonucleotide
  Target: ATXN1; (+) strand; PAM type: NRG; PAM sequence: AGG
ccgcaataatgactctagtt

SEQ ID NO: 125770 - DNA, 20 bp, Artificial Sequence
  Description of Artificial Sequence: Synthetic oligonucleotide
  Target: ATXN1; (+) strand; PAM type: NRG; PAM sequence: GGG
cgcaataatgactctagtta

SEQ ID NO: 125771 - DNA, 20 bp, Artificial Sequence
  Description of Artificial Sequence: Synthetic oligonucleotide
  Target: ATXN1; (+) strand; PAM type: NRG; PAM sequence: AAG
aataatgactctagttaggg

SEQ ID NO: 125772 - DNA, 20 bp, Artificial Sequence
  Description of Artificial Sequence: Synthetic oligonucleotide
  Target: ATXN1; (+) strand; PAM type: NRG; PAM sequence: AAG
aatgactctagttagggaag

SEQ ID NO: 125773 - DNA, 20 bp, Artificial Sequence
  Description of Artificial Sequence: Synthetic oligonucleotide
  Target: ATXN1; (+) strand; PAM type: NRG; PAM sequence: AAG
tctagttagggaagaagaca

SEQ ID NO: 125774 - DNA, 20 bp, Artificial Sequence
  Description of Artificial Sequence: Synthetic oligonucleotide
  Target: ATXN1; (+) strand; PAM type: NRG; PAM sequence: AAG
gggaagaagacaaagtgatt

SEQ ID NO: 125775 - DNA, 20 bp, Artificial Sequence
  Description of Artificial Sequence: Synthetic oligonucleotide
  Target: ATXN1; (+) strand; PAM type: NRG; PAM sequence: AAG
gacaaagtgattaagctgac

SEQ ID NO: 125776 - DNA, 20 bp, Artificial Sequence
  Description of Artificial Sequence: Synthetic oligonucleotide
  Target: ATXN1; (+) strand; PAM type: NRG; PAM sequence: TGG
aagtgattaagctgacaagt

SEQ ID NO: 125777 - DNA, 20 bp, Artificial Sequence
  Description of Artificial Sequence: Synthetic oligonucleotide
  Target: ATXN1; (+) strand; PAM type: NRG; PAM sequence: AAG
ttggataaaataataaacac

SEQ ID NO: 125778 - DNA, 20 bp, Artificial Sequence
  Description of Artificial Sequence: Synthetic oligonucleotide
  Target: ATXN1; (+) strand; PAM type: NRG; PAM sequence: TAG
actaccctttgaccactccc

SEQ ID NO: 125779 - DNA, 20 bp, Artificial Sequence
  Description of Artificial Sequence: Synthetic oligonucleotide
  Target: ATXN1; (+) strand; PAM type: NRG; PAM sequence: AGG
ctaccctttgaccactccct

SEQ ID NO: 125780 - DNA, 20 bp, Artificial Sequence
  Description of Artificial Sequence: Synthetic oligonucleotide
  Target: ATXN1; (+) strand; PAM type: NRG; PAM sequence: GAG
cctttgaccactccctaggt

SEQ ID NO: 125781 - DNA, 20 bp, Artificial Sequence
  Description of Artificial Sequence: Synthetic oligonucleotide
  Target: ATXN1; (+) strand; PAM type: NRG; PAM sequence: TGG
ctaggtgagatgaaatgttt

SEQ ID NO: 125782 - DNA, 20 bp, Artificial Sequence
  Description of Artificial Sequence: Synthetic oligonucleotide
  Target: ATXN1; (+) strand; PAM type: NRG; PAM sequence: AAG
agatgaaatgttttggaaat

SEQ ID NO: 125783 - DNA, 20 bp, Artificial Sequence
  Description of Artificial Sequence: Synthetic oligonucleotide
  Target: ATXN1; (+) strand; PAM type: NRG; PAM sequence: TAG
gttttggaaataagtgcact

SEQ ID NO: 125784 - DNA, 20 bp, Artificial Sequence
  Description of Artificial Sequence: Synthetic oligonucleotide
  Target: ATXN1; (+) strand; PAM type: NRG; PAM sequence: AAG
acctaaatgaacacaatttg

SEQ ID NO: 125785 - DNA, 20 bp, Artificial Sequence
  Description of Artificial Sequence: Synthetic oligonucleotide
  Target: ATXN1; (+) strand; PAM type: NRG; PAM sequence: CAG
aaatgaacacaatttgaagc

SEQ ID NO: 125786 - DNA, 20 bp, Artificial Sequence
  Description of Artificial Sequence: Synthetic oligonucleotide
  Target: ATXN1; (+) strand; PAM type: NRG; PAM sequence: TAG
atttgaagccagatttaacc

SEQ ID NO: 125787 - DNA, 20 bp, Artificial Sequence
  Description of Artificial Sequence: Synthetic oligonucleotide
  Target: ATXN1; (+) strand; PAM type: NRG; PAM sequence: AGG
tttgaagccagatttaacct

SEQ ID NO: 125788 - DNA, 20 bp, Artificial Sequence
  Description of Artificial Sequence: Synthetic oligonucleotide
  Target: ATXN1; (+) strand; PAM type: NRG; PAM sequence: CAG
aaacaaacaaaccacacaca

SEQ ID NO: 125789 - DNA, 20 bp, Artificial Sequence
  Description of Artificial Sequence: Synthetic oligonucleotide
  Target: ATXN1; (+) strand; PAM type: NRG; PAM sequence: AAG
aacaaaccacacacacagtc

SEQ ID NO: 125790 - DNA, 20 bp, Artificial Sequence
  Description of Artificial Sequence: Synthetic oligonucleotide
  Target: ATXN1; (+) strand; PAM type: NRG; PAM sequence: TGG
acacagtcaagtttaccttc

SEQ ID NO: 125791 - DNA, 20 bp, Artificial Sequence
  Description of Artificial Sequence: Synthetic oligonucleotide
  Target: ATXN1; (+) strand; PAM type: NRG; PAM sequence: GGG
cacagtcaagtttaccttct

SEQ ID NO: 125792 - DNA, 20 bp, Artificial Sequence
  Description of Artificial Sequence: Synthetic oligonucleotide
  Target: ATXN1; (+) strand; PAM type: NRG; PAM sequence: GAG
taccttctgggattctaact

SEQ ID NO: 125793 - DNA, 20 bp, Artificial Sequence
  Description of Artificial Sequence: Synthetic oligonucleotide
  Target: ATXN1; (+) strand; PAM type: NRG; PAM sequence: TGG
ctttaaaaaaaacgaataaa

SEQ ID NO: 125794 - DNA, 20 bp, Artificial Sequence
  Description of Artificial Sequence: Synthetic oligonucleotide
  Target: ATXN1; (+) strand; PAM type: NRG; PAM sequence: GGG
tttaaaaaaaacgaataaat

SEQ ID NO: 125795 - DNA, 20 bp, Artificial Sequence
  Description of Artificial Sequence: Synthetic oligonucleotide
  Target: ATXN1; (+) strand; PAM type: NRG; PAM sequence: GGG
ttaaaaaaaacgaataaatg

SEQ ID NO: 125796 - DNA, 20 bp, Artificial Sequence
  Description of Artificial Sequence: Synthetic oligonucleotide
  Target: ATXN1; (+) strand; PAM type: NRG; PAM sequence: CGG
aaaaaacgaataaatggggc

SEQ ID NO: 125797 - DNA, 20 bp, Artificial Sequence
  Description of Artificial Sequence: Synthetic oligonucleotide
  Target: ATXN1; (+) strand; PAM type: NRG; PAM sequence: GGG
aaaaacgaataaatggggcc

SEQ ID NO: 125798 - DNA, 20 bp, Artificial Sequence
  Description of Artificial Sequence: Synthetic oligonucleotide
  Target: ATXN1; (+) strand; PAM type: NRG; PAM sequence: CGG
cgaataaatggggccgggcg

SEQ ID NO: 125799 - DNA, 20 bp, Artificial Sequence
  Description of Artificial Sequence: Synthetic oligonucleotide
  Target: ATXN1; (+) strand; PAM type: NRG; PAM sequence: TGG
ataaatggggccgggcgcgg

SEQ ID NO: 125800 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctgtaatcc

SEQ ID NO: 125801 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagcactt

SEQ ID NO: 125802 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 125803 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 125804 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 125805 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggcc

SEQ ID NO: 125806 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggccg

SEQ ID NO: 125807 - DNA, 20 bp, Artificial Sequence
  Description of Artificial Sequence: Synthetic oligonucleotide
  Target: ATXN1; (+) strand; PAM type: NRG; PAM sequence: CGG
agcactttgggaggccgagg

SEQ ID NO: 125808 - DNA, 20 bp, Artificial Sequence
  Description of Artificial Sequence: Synthetic oligonucleotide
  Target: ATXN1; (+) strand; PAM type: NRG; PAM sequence: GAG
gggaggccgaggcggatcac

SEQ ID NO: 125809 - DNA, 20 bp, Artificial Sequence
  Description of Artificial Sequence: Synthetic oligonucleotide
  Target: ATXN1; (+) strand; PAM type: NRG; PAM sequence: AGG
ggaggccgaggcggatcacg

SEQ ID NO: 125810 - DNA, 20 bp, Artificial Sequence
  Description of Artificial Sequence: Synthetic oligonucleotide
  Target: ATXN1; (+) strand; PAM type: NRG; PAM sequence: CAG
gccgaggcggatcacgaggt

SEQ ID NO: 125811 - DNA, 20 bp, Artificial Sequence
  Description of Artificial Sequence: Synthetic oligonucleotide
  Target: ATXN1; (+) strand; PAM type: NRG; PAM sequence: AGG
ccgaggcggatcacgaggtc

SEQ ID NO: 125812 - DNA, 20 bp, Artificial Sequence
  Description of Artificial Sequence: Synthetic oligonucleotide
  Target: ATXN1; (+) strand; PAM type: NRG; PAM sequence: GAG
gaggcggatcacgaggtcag

SEQ ID NO: 125813 - DNA, 20 bp, Artificial Sequence
  Description of Artificial Sequence: Synthetic oligonucleotide
  Target: ATXN1; (+) strand; PAM type: NRG; PAM sequence: TGG
cggatcacgaggtcaggaga

SEQ ID NO: 125814 - DNA, 20 bp, Artificial Sequence
  Description of Artificial Sequence: Synthetic oligonucleotide
  Target: ATXN1; (+) strand; PAM type: NRG; PAM sequence: GAG
gatcacgaggtcaggagatg

SEQ ID NO: 125815 - DNA, 20 bp, Artificial Sequence
  Description of Artificial Sequence: Synthetic oligonucleotide
  Target: ATXN1; (+) strand; PAM type: NRG; PAM sequence: TGG
caggagatggagaccatcct

SEQ ID NO: 125816 - DNA, 20 bp, Artificial Sequence
  Description of Artificial Sequence: Synthetic oligonucleotide
  Target: ATXN1; (+) strand; PAM type: NRG; PAM sequence: CAG
ggagaccatccttggtaaca

SEQ ID NO: 125817 - DNA, 20 bp, Artificial Sequence
  Description of Artificial Sequence: Synthetic oligonucleotide
  Target: ATXN1; (+) strand; PAM type: NRG; PAM sequence: TAG
ctactaaaaatacaaaaaat

SEQ ID NO: 125818 - DNA, 20 bp, Artificial Sequence
  Description of Artificial Sequence: Synthetic oligonucleotide
  Target: ATXN1; (+) strand; PAM type: NRG; PAM sequence: CAG
taaaaatacaaaaaattagc

SEQ ID NO: 125819 - DNA, 20 bp, Artificial Sequence
  Description of Artificial Sequence: Synthetic oligonucleotide
  Target: ATXN1; (+) strand; PAM type: NRG; PAM sequence: AGG
aaaaatacaaaaaattagcc

SEQ ID NO: 125820 - DNA, 20 bp, Artificial Sequence
  Description of Artificial Sequence: Synthetic oligonucleotide
  Target: ATXN1; (+) strand; PAM type: NRG; PAM sequence: TGG
tacaaaaaattagccaggca

SEQ ID NO: 125821 - DNA, 20 bp, Artificial Sequence
  Description of Artificial Sequence: Synthetic oligonucleotide
  Target: ATXN1; (+) strand; PAM type: NRG; PAM sequence: TGG
aaaaaattagccaggcatgg

SEQ ID NO: 125822 - DNA, 20 bp, Artificial Sequence
  Description of Artificial Sequence: Synthetic oligonucleotide
  Target: ATXN1; (+) strand; PAM type: NRG; PAM sequence: CAG
aaattagccaggcatggtgg

SEQ ID NO: 125823 - DNA, 20 bp, Artificial Sequence
  Description of Artificial Sequence: Synthetic oligonucleotide
  Target: ATXN1; (+) strand; PAM type: NRG; PAM sequence: AGG
aattagccaggcatggtggc

SEQ ID NO: 125824 - DNA, 20 bp, Artificial Sequence
  Description of Artificial Sequence: Synthetic oligonucleotide
  Target: ATXN1; (+) strand; PAM type: NRG; PAM sequence: TAG
ggcatggtggcaggcacctg

SEQ ID NO: 125825 - DNA, 20 bp, Artificial Sequence
  Description of Artificial Sequence: Synthetic oligonucleotide
  Target: ATXN1; (+) strand; PAM type: NRG; PAM sequence: CAG
gtggcaggcacctgtagtcc

SEQ ID NO: 125826 - DNA, 20 bp, Artificial Sequence
  Description of Artificial Sequence: Synthetic oligonucleotide
  Target: ATXN1; (+) strand; PAM type: NRG; PAM sequence: CAG
cacctgtagtcccagctact

SEQ ID NO: 125827 - DNA, 20 bp, Artificial Sequence
  Description of Artificial Sequence: Synthetic oligonucleotide
  Target: ATXN1; (+) strand; PAM type: NRG; PAM sequence: AGG
acctgtagtcccagctactc

SEQ ID NO: 125828 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagctactcag

SEQ ID NO: 125829 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagctactcagg

SEQ ID NO: 125830 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcaggaggct

SEQ ID NO: 125831 - DNA, 20 bp, Artificial Sequence
  Description of Artificial Sequence: Synthetic oligonucleotide
  Target: ATXN1; (+) strand; PAM type: NRG; PAM sequence: AGG
cccagctactcaggaggctg

SEQ ID NO: 125832 - DNA, 20 bp, Artificial Sequence
  Description of Artificial Sequence: Synthetic oligonucleotide
  Target: ATXN1; (+) strand; PAM type: NRG; PAM sequence: CAG
agctactcaggaggctgagg

SEQ ID NO: 125833 - DNA, 20 bp, Artificial Sequence
  Description of Artificial Sequence: Synthetic oligonucleotide
  Target: ATXN1; (+) strand; PAM type: NRG; PAM sequence: AGG
gctactcaggaggctgaggc

SEQ ID NO: 125834 - DNA, 20 bp, Artificial Sequence
  Description of Artificial Sequence: Synthetic oligonucleotide
  Target: ATXN1; (+) strand; PAM type: NRG; PAM sequence: GAG
tactcaggaggctgaggcag

SEQ ID NO: 125835 - DNA, 20 bp, Artificial Sequence
  Description of Artificial Sequence: Synthetic oligonucleotide
  Target: ATXN1; (+) strand; PAM type: NRG; PAM sequence: TGG
aggaggctgaggcaggagaa

SEQ ID NO: 125836 - DNA, 20 bp, Artificial Sequence
  Description of Artificial Sequence: Synthetic oligonucleotide
  Target: ATXN1; (+) strand; PAM type: NRG; PAM sequence: CGG
gcaggagaatggcgtgaacc

SEQ ID NO: 125837 - DNA, 20 bp, Artificial Sequence
  Description of Artificial Sequence: Synthetic oligonucleotide
  Target: ATXN1; (+) strand; PAM type: NRG; PAM sequence: GGG
caggagaatggcgtgaaccc

SEQ ID NO: 125838 - DNA, 20 bp, Artificial Sequence
  Description of Artificial Sequence: Synthetic oligonucleotide
  Target: ATXN1; (+) strand; PAM type: NRG; PAM sequence: GAG
ggagaatggcgtgaacccgg

SEQ ID NO: 125839 - DNA, 20 bp, Artificial Sequence
  Description of Artificial Sequence: Synthetic oligonucleotide
  Target: ATXN1; (+) strand; PAM type: NRG; PAM sequence: AGG
gagaatggcgtgaacccggg

SEQ ID NO: 125840 - DNA, 20 bp, Artificial Sequence
  Description of Artificial Sequence: Synthetic oligonucleotide
  Target: ATXN1; (+) strand; PAM type: NRG; PAM sequence: CGG
aatggcgtgaacccgggagg

SEQ ID NO: 125841 - DNA, 20 bp, Artificial Sequence
  Description of Artificial Sequence: Synthetic oligonucleotide
  Target: ATXN1; (+) strand; PAM type: NRG; PAM sequence: GAG
tggcgtgaacccgggaggcg

SEQ ID NO: 125842 - DNA, 20 bp, Artificial Sequence
  Description of Artificial Sequence: Synthetic oligonucleotide
  Target: ATXN1; (+) strand; PAM type: NRG; PAM sequence: CAG
aacccgggaggcggagcttg

SEQ ID NO: 125843 - DNA, 20 bp, Artificial Sequence
  Description of Artificial Sequence: Synthetic oligonucleotide
  Target: ATXN1; (+) strand; PAM type: NRG; PAM sequence: GAG
cgggaggcggagcttgcagt

SEQ ID NO: 125844 - DNA, 20 bp, Artificial Sequence
  Description of Artificial Sequence: Synthetic oligonucleotide
  Target: ATXN1; (+) strand; PAM type: NRG; PAM sequence: GAG
ggcggagcttgcagtgagcc

SEQ ID NO: 125845 - DNA, 20 bp, Artificial Sequence
  Description of Artificial Sequence: Synthetic oligonucleotide
  Target: ATXN1; (+) strand; PAM type: NRG; PAM sequence: CAG
gagatcgtgccactgcactc

SEQ ID NO: 125846 - DNA, 20 bp, Artificial Sequence
  Description of Artificial Sequence: Synthetic oligonucleotide
  Target: ATXN1; (+) strand; PAM type: NRG; PAM sequence: TGG
cgtgccactgcactccagcc

SEQ ID NO: 125847 - DNA, 20 bp, Artificial Sequence
  Description of Artificial Sequence: Synthetic oligonucleotide
  Target: ATXN1; (+) strand; PAM type: NRG; PAM sequence: GGG
gtgccactgcactccagcct

SEQ ID NO: 125848 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggcga

SEQ ID NO: 125849 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggcgaca

SEQ ID NO: 125850 - DNA, 20 bp, Artificial Sequence
  Description of Artificial Sequence: Synthetic oligonucleotide
  Target: ATXN1; (+) strand; PAM type: NRG; PAM sequence: AGG
cactccagcctgggcgacag

SEQ ID NO: 125851 - DNA, 20 bp, Artificial Sequence
  Description of Artificial Sequence: Synthetic oligonucleotide
  Target: ATXN1; (+) strand; PAM type: NRG; PAM sequence: GGG
actccagcctgggcgacaga

SEQ ID NO: 125852 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggcgacagagg

SEQ ID NO: 125853 - DNA, 20 bp, Artificial Sequence
  Description of Artificial Sequence: Synthetic oligonucleotide
  Target: ATXN1; (+) strand; PAM type: NRG; PAM sequence: AAG
acagagggagatccgtctca

SEQ ID NO: 125854 - DNA, 20 bp, Artificial Sequence
  Description of Artificial Sequence: Synthetic oligonucleotide
  Target: ATXN1; (+) strand; PAM type: NRG; PAM sequence: AAG
taaataaacaaataaaataa

SEQ ID NO: 125855 - DNA, 20 bp, Artificial Sequence
  Description of Artificial Sequence: Synthetic oligonucleotide
  Target: ATXN1; (+) strand; PAM type: NRG; PAM sequence: AAG
aaagaataaatgtttctcaa

SEQ ID NO: 125856 - DNA, 20 bp, Artificial Sequence
  Description of Artificial Sequence: Synthetic oligonucleotide
  Target: ATXN1; (+) strand; PAM type: NRG; PAM sequence: AAG
gtttctcaaaagtctctatg

SEQ ID NO: 125857 - DNA, 20 bp, Artificial Sequence
  Description of Artificial Sequence: Synthetic oligonucleotide
  Target: ATXN1; (+) strand; PAM type: NRG; PAM sequence: AGG
tttctcaaaagtctctatga

SEQ ID NO: 125858 - DNA, 20 bp, Artificial Sequence
  Description of Artificial Sequence: Synthetic oligonucleotide
  Target: ATXN1; (+) strand; PAM type: NRG; PAM sequence: CAG
tcaaaagtctctatgaaggt

SEQ ID NO: 125859 - DNA, 20 bp, Artificial Sequence
  Description of Artificial Sequence: Synthetic oligonucleotide
  Target: ATXN1; (+) strand; PAM type: NRG; PAM sequence: TAG
gtcagatttgtacttcaata

SEQ ID NO: 125860 - DNA, 20 bp, Artificial Sequence
  Description of Artificial Sequence: Synthetic oligonucleotide
  Target: ATXN1; (+) strand; PAM type: NRG; PAM sequence: AGG
tcagatttgtacttcaatat

SEQ ID NO: 125861 - DNA, 20 bp, Artificial Sequence
  Description of Artificial Sequence: Synthetic oligonucleotide
  Target: ATXN1; (+) strand; PAM type: NRG; PAM sequence: TAG
cttcaatataggaaccctgt

SEQ ID NO: 125862 - DNA, 20 bp, Artificial Sequence
  Description of Artificial Sequence: Synthetic oligonucleotide
  Target: ATXN1; (+) strand; PAM type: NRG; PAM sequence: CAG
ccctgttagccattcttctg

SEQ ID NO: 125863 - DNA, 20 bp, Artificial Sequence
  Description of Artificial Sequence: Synthetic oligonucleotide
  Target: ATXN1; (+) strand; PAM type: NRG; PAM sequence: AGG
cctgttagccattcttctgc

SEQ ID NO: 125864 - DNA, 20 bp, Artificial Sequence
  Description of Artificial Sequence: Synthetic oligonucleotide
  Target: ATXN1; (+) strand; PAM type: NRG; PAM sequence: CAG
tagccattcttctgcaggtg

SEQ ID NO: 125865 - DNA, 20 bp, Artificial Sequence
  Description of Artificial Sequence: Synthetic oligonucleotide
  Target: ATXN1; (+) strand; PAM type: NRG; PAM sequence: GAG
ctgcaggtgcagacaaccgc

SEQ ID NO: 125866 - DNA, 20 bp, Artificial Sequence
  Description of Artificial Sequence: Synthetic oligonucleotide
  Target: ATXN1; (+) strand; PAM type: NRG; PAM sequence: CGG
aggtgcagacaaccgcgagt

SEQ ID NO: 125867 - DNA, 20 bp, Artificial Sequence
  Description of Artificial Sequence: Synthetic oligonucleotide
  Target: ATXN1; (+) strand; PAM type: NRG; PAM sequence: GGG
ggtgcagacaaccgcgagtc

SEQ ID NO: 125868 - DNA, 20 bp, Artificial Sequence
  Description of Artificial Sequence: Synthetic oligonucleotide
  Target: ATXN1; (+) strand; PAM type: NRG; PAM sequence: TGG
acaaccgcgagtcgggtgtg

SEQ ID NO: 125869 - DNA, 20 bp, Artificial Sequence
  Description of Artificial Sequence: Synthetic oligonucleotide
  Target: ATXN1; (+) strand; PAM type: NRG; PAM sequence: GGG
caaccgcgagtcgggtgtgt

SEQ ID NO: 125870 - DNA, 20 bp, Artificial Sequence
  Description of Artificial Sequence: Synthetic oligonucleotide
  Target: ATXN1; (+) strand; PAM type: NRG; PAM sequence: CAG
gagtcgggtgtgtgggtctg

SEQ ID NO: 125871 - DNA, 20 bp, Artificial Sequence
  Description of Artificial Sequence: Synthetic oligonucleotide
  Target: ATXN1; (+) strand; PAM type: NRG; PAM sequence: TGG
cgggtgtgtgggtctgcagc

SEQ ID NO: 125872 - DNA, 20 bp, Artificial Sequence
  Description of Artificial Sequence: Synthetic oligonucleotide
  Target: ATXN1; (+) strand; PAM type: NRG; PAM sequence: CAG
agctggactgcacacacctg

SEQ ID NO: 125873 - DNA, 20 bp, Artificial Sequence
  Description of Artificial Sequence: Synthetic oligonucleotide
  Target: ATXN1; (+) strand; PAM type: NRG; PAM sequence: AGG
gctggactgcacacacctgc

SEQ ID NO: 125874 - DNA, 20 bp, Artificial Sequence
  Description of Artificial Sequence: Synthetic oligonucleotide
  Target: ATXN1; (+) strand; PAM type: NRG; PAM sequence: TAG
tgcaggtgtaccatgacttc

SEQ ID NO: 125875 - DNA, 20 bp, Artificial Sequence
  Description of Artificial Sequence: Synthetic oligonucleotide
  Target: ATXN1; (+) strand; PAM type: NRG; PAM sequence: AAG
taccatgacttctagctgca

SEQ ID NO: 125876 - DNA, 20 bp, Artificial Sequence
  Description of Artificial Sequence: Synthetic oligonucleotide
  Target: ATXN1; (+) strand; PAM type: NRG; PAM sequence: CAG
catgacttctagctgcaaag

SEQ ID NO: 125877 - DNA, 20 bp, Artificial Sequence
  Description of Artificial Sequence: Synthetic oligonucleotide
  Target: ATXN1; (+) strand; PAM type: NRG; PAM sequence: AAG
tgcaaagcagatgtaccacc

SEQ ID NO: 125878 - DNA, 20 bp, Artificial Sequence
  Description of Artificial Sequence: Synthetic oligonucleotide
  Target: ATXN1; (+) strand; PAM type: NRG; PAM sequence: CAG
gcagatgtaccaccaagtct

SEQ ID NO: 125879 - DNA, 20 bp, Artificial Sequence
  Description of Artificial Sequence: Synthetic oligonucleotide
  Target: ATXN1; (+) strand; PAM type: NRG; PAM sequence: TGG
agtctcagcacatgacaacg

SEQ ID NO: 125880 - DNA, 20 bp, Artificial Sequence
  Description of Artificial Sequence: Synthetic oligonucleotide
  Target: ATXN1; (+) strand; PAM type: NRG; PAM sequence: CAG
cacatgacaacgtggcattg

SEQ ID NO: 125881 - DNA, 20 bp, Artificial Sequence
  Description of Artificial Sequence: Synthetic oligonucleotide
  Target: ATXN1; (+) strand; PAM type: NRG; PAM sequence: CAG
acaacgtggcattgcagatg

SEQ ID NO: 125882 - DNA, 20 bp, Artificial Sequence
  Description of Artificial Sequence: Synthetic oligonucleotide
  Target: ATXN1; (+) strand; PAM type: NRG; PAM sequence: TGG
acgtggcattgcagatgcag

SEQ ID NO: 125883 - DNA, 20 bp, Artificial Sequence
  Description of Artificial Sequence: Synthetic oligonucleotide
  Target: ATXN1; (+) strand; PAM type: NRG; PAM sequence: TGG
gcattgcagatgcagtggtt

SEQ ID NO: 125884 - DNA, 20 bp, Artificial Sequence
  Description of Artificial Sequence: Synthetic oligonucleotide
  Target: ATXN1; (+) strand; PAM type: NRG; PAM sequence: AAG
tgcagatgcagtggtttgga

SEQ ID NO: 125885 - DNA, 20 bp, Artificial Sequence
  Description of Artificial Sequence: Synthetic oligonucleotide
  Target: ATXN1; (+) strand; PAM type: NRG; PAM sequence: AGG
gcagatgcagtggtttggaa

SEQ ID NO: 125886 - DNA, 20 bp, Artificial Sequence
  Description of Artificial Sequence: Synthetic oligonucleotide
  Target: ATXN1; (+) strand; PAM type: NRG; PAM sequence: GGG
cagatgcagtggtttggaaa

SEQ ID NO: 125887 - DNA, 20 bp, Artificial Sequence
  Description of Artificial Sequence: Synthetic oligonucleotide
  Target: ATXN1; (+) strand; PAM type: NRG; PAM sequence: CAG
gcagtggtttggaaagggcg

SEQ ID NO: 125888 - DNA, 20 bp, Artificial Sequence
  Description of Artificial Sequence: Synthetic oligonucleotide
  Target: ATXN1; (+) strand; PAM type: NRG; PAM sequence: AAG
gtggtttggaaagggcgcag

SEQ ID NO: 125889 - DNA, 20 bp, Artificial Sequence
  Description of Artificial Sequence: Synthetic oligonucleotide
  Target: ATXN1; (+) strand; PAM type: NRG; PAM sequence: AAG
gaaagggcgcagaagaaaat

SEQ ID NO: 125890 - DNA, 20 bp, Artificial Sequence
  Description of Artificial Sequence: Synthetic oligonucleotide
  Target: ATXN1; (+) strand; PAM type: NRG; PAM sequence: CAG
cagaagaaaataagctttct

SEQ ID NO: 125891 - DNA, 20 bp, Artificial Sequence
  Description of Artificial Sequence: Synthetic oligonucleotide
  Target: ATXN1; (+) strand; PAM type: NRG; PAM sequence: CAG
ttctcagatgacatccataa

SEQ ID NO: 125892 - DNA, 20 bp, Artificial Sequence
  Description of Artificial Sequence: Synthetic oligonucleotide
  Target: ATXN1; (+) strand; PAM type: NRG; PAM sequence: AAG
tcagatgacatccataacag

SEQ ID NO: 125893 - DNA, 20 bp, Artificial Sequence
  Description of Artificial Sequence: Synthetic oligonucleotide
  Target: ATXN1; (+) strand; PAM type: NRG; PAM sequence: TGG
catccataacagaagtgttc

SEQ ID NO: 125894 - DNA, 20 bp, Artificial Sequence
  Description of Artificial Sequence: Synthetic oligonucleotide
  Target: ATXN1; (+) strand; PAM type: NRG; PAM sequence: GGG
atccataacagaagtgttct

SEQ ID NO: 125895 - DNA, 20 bp, Artificial Sequence
  Description of Artificial Sequence: Synthetic oligonucleotide
  Target: ATXN1; (+) strand; PAM type: NRG; PAM sequence: TAG
actctgccaacccctttact

SEQ ID NO: 125896 - DNA, 20 bp, Artificial Sequence
  Description of Artificial Sequence: Synthetic oligonucleotide
  Target: ATXN1; (+) strand; PAM type: NRG; PAM sequence: TAG
ctgccaacccctttacttag

SEQ ID NO: 125897 - DNA, 20 bp, Artificial Sequence
  Description of Artificial Sequence: Synthetic oligonucleotide
  Target: ATXN1; (+) strand; PAM type: NRG; PAM sequence: TAG
ccctttacttagtagccaac

SEQ ID NO: 125898 - DNA, 20 bp, Artificial Sequence
  Description of Artificial Sequence: Synthetic oligonucleotide
  Target: ATXN1; (+) strand; PAM type: NRG; PAM sequence: AGG
cctttacttagtagccaact

SEQ ID NO: 125899 - DNA, 20 bp, Artificial Sequence
  Description of Artificial Sequence: Synthetic oligonucleotide
  Target: ATXN1; (+) strand; PAM type: NRG; PAM sequence: GAG
tagtagccaactaggattat

SEQ ID NO: 125900 - DNA, 20 bp, Artificial Sequence
  Description of Artificial Sequence: Synthetic oligonucleotide
  Target: ATXN1; (+) strand; PAM type: NRG; PAM sequence: AAG
agccaactaggattatgaga

SEQ ID NO: 125901 - DNA, 20 bp, Artificial Sequence
  Description of Artificial Sequence: Synthetic oligonucleotide
  Target: ATXN1; (+) strand; PAM type: NRG; PAM sequence: TAG
aggattatgagaaagtcaaa

SEQ ID NO: 125902 - DNA, 20 bp, Artificial Sequence
  Description of Artificial Sequence: Synthetic oligonucleotide
  Target: ATXN1; (+) strand; PAM type: NRG; PAM sequence: CAG
gagaaagtcaaatagtctat

SEQ ID NO: 125903 - DNA, 20 bp, Artificial Sequence
  Description of Artificial Sequence: Synthetic oligonucleotide
  Target: ATXN1; (+) strand; PAM type: NRG; PAM sequence: CAG
gtcaaatagtctatcagtat

SEQ ID NO: 125904 - DNA, 20 bp, Artificial Sequence
  Description of Artificial Sequence: Synthetic oligonucleotide
  Target: ATXN1; (+) strand; PAM type: NRG; PAM sequence: TAG
atcagtcttgacccttgcct

SEQ ID NO: 125905 - DNA, 20 bp, Artificial Sequence
  Description of Artificial Sequence: Synthetic oligonucleotide
  Target: ATXN1; (+) strand; PAM type: NRG; PAM sequence: AGG
tcagtcttgacccttgcctt

SEQ ID NO: 125906 - DNA, 20 bp, Artificial Sequence
  Description of Artificial Sequence: Synthetic oligonucleotide
  Target: ATXN1; (+) strand; PAM type: NRG; PAM sequence: GGG
cagtcttgacccttgcctta

SEQ ID NO: 125907 - DNA, 20 bp, Artificial Sequence
  Description of Artificial Sequence: Synthetic oligonucleotide
  Target: ATXN1; (+) strand; PAM type: NRG; PAM sequence: GGG
agtcttgacccttgccttag

SEQ ID NO: 125908 - DNA, 20 bp, Artificial Sequence
  Description of Artificial Sequence: Synthetic oligonucleotide
  Target: ATXN1; (+) strand; PAM type: NRG; PAM sequence: TAG
gccttaggggtgatcattat

SEQ ID NO: 125909 - DNA, 20 bp, Artificial Sequence
  Description of Artificial Sequence: Synthetic oligonucleotide
  Target: ATXN1; (+) strand; PAM type: NRG; PAM sequence: AAG
gtgatcattattagattacc

SEQ ID NO: 125910 - DNA, 20 bp, Artificial Sequence
  Description of Artificial Sequence: Synthetic oligonucleotide
  Target: ATXN1; (+) strand; PAM type: NRG; PAM sequence: AAG
tagattaccaagaccacatt

SEQ ID NO: 125911 - DNA, 20 bp, Artificial Sequence
  Description of Artificial Sequence: Synthetic oligonucleotide
  Target: ATXN1; (+) strand; PAM type: NRG; PAM sequence: CAG
ttaaactacctataactcta

SEQ ID NO: 125912 - DNA, 20 bp, Artificial Sequence
  Description of Artificial Sequence: Synthetic oligonucleotide
  Target: ATXN1; (+) strand; PAM type: NRG; PAM sequence: AAG
tataactctacagcctcaaa

SEQ ID NO: 125913 - DNA, 20 bp, Artificial Sequence
  Description of Artificial Sequence: Synthetic oligonucleotide
  Target: ATXN1; (+) strand; PAM type: NRG; PAM sequence: CAG
acagcctcaaaaagaatctg

SEQ ID NO: 125914 - DNA, 20 bp, Artificial Sequence
  Description of Artificial Sequence: Synthetic oligonucleotide
  Target: ATXN1; (+) strand; PAM type: NRG; PAM sequence: CAG
gaatctgcagattccaaaac

SEQ ID NO: 125915 - DNA, 20 bp, Artificial Sequence
  Description of Artificial Sequence: Synthetic oligonucleotide
  Target: ATXN1; (+) strand; PAM type: NRG; PAM sequence: CAG
attccaaaaccagacttgtg

SEQ ID NO: 125916 - DNA, 20 bp, Artificial Sequence
  Description of Artificial Sequence: Synthetic oligonucleotide
  Target: ATXN1; (+) strand; PAM type: NRG; PAM sequence: AGG
ttccaaaaccagacttgtgc

SEQ ID NO: 125917 - DNA, 20 bp, Artificial Sequence
  Description of Artificial Sequence: Synthetic oligonucleotide
  Target: ATXN1; (+) strand; PAM type: NRG; PAM sequence: GGG
tccaaaaccagacttgtgca

SEQ ID NO: 125918 - DNA, 20 bp, Artificial Sequence
  Description of Artificial Sequence: Synthetic oligonucleotide
  Target: ATXN1; (+) strand; PAM type: NRG; PAM sequence: CAG
tgtgcagggcaaacatcatg

SEQ ID NO: 125919 - DNA, 20 bp, Artificial Sequence
  Description of Artificial Sequence: Synthetic oligonucleotide
  Target: ATXN1; (+) strand; PAM type: NRG; PAM sequence: TAG
cagggcaaacatcatgcagc

SEQ ID NO: 125920 - DNA, 20 bp, Artificial Sequence
  Description of Artificial Sequence: Synthetic oligonucleotide
  Target: ATXN1; (+) strand; PAM type: NRG; PAM sequence: AGG
agggcaaacatcatgcagct

SEQ ID NO: 125921 - DNA, 20 bp, Artificial Sequence
  Description of Artificial Sequence: Synthetic oligonucleotide
  Target: ATXN1; (+) strand; PAM type: NRG; PAM sequence: GAG
ggcaaacatcatgcagctag

SEQ ID NO: 125922 - DNA, 20 bp, Artificial Sequence
  Description of Artificial Sequence: Synthetic oligonucleotide
  Target: ATXN1; (+) strand; PAM type: NRG; PAM sequence: CAG
cagctaggagccaaacacac

SEQ ID NO: 125923 - DNA, 20 bp, Artificial Sequence
  Description of Artificial Sequence: Synthetic oligonucleotide
  Target: ATXN1; (+) strand; PAM type: NRG; PAM sequence: TAG
acacaccagtatcaaaatcc

SEQ ID NO: 125924 - DNA, 20 bp, Artificial Sequence
  Description of Artificial Sequence: Synthetic oligonucleotide
  Target: ATXN1; (+) strand; PAM type: NRG; PAM sequence: AAG
tagctctgctactctccatg

SEQ ID NO: 125925 - DNA, 20 bp, Artificial Sequence
  Description of Artificial Sequence: Synthetic oligonucleotide
  Target: ATXN1; (+) strand; PAM type: NRG; PAM sequence: AAG
actctccatgaagccccata

SEQ ID NO: 125926 - DNA, 20 bp, Artificial Sequence
  Description of Artificial Sequence: Synthetic oligonucleotide
  Target: ATXN1; (+) strand; PAM type: NRG; PAM sequence: AGG
ctctccatgaagccccataa

SEQ ID NO: 125927 - DNA, 20 bp, Artificial Sequence
  Description of Artificial Sequence: Synthetic oligonucleotide
  Target: ATXN1; (+) strand; PAM type: NRG; PAM sequence: GAG
aagccccataaaggtgatgt

SEQ ID NO: 125928 - DNA, 20 bp, Artificial Sequence
  Description of Artificial Sequence: Synthetic oligonucleotide
  Target: ATXN1; (+) strand; PAM type: NRG; PAM sequence: TGG
ataaaggtgatgtgagcctc

SEQ ID NO: 125929 - DNA, 20 bp, Artificial Sequence
  Description of Artificial Sequence: Synthetic oligonucleotide
  Target: ATXN1; (+) strand; PAM type: NRG; PAM sequence: GGG
taaaggtgatgtgagcctct

SEQ ID NO: 125930 - DNA, 20 bp, Artificial Sequence
  Description of Artificial Sequence: Synthetic oligonucleotide
  Target: ATXN1; (+) strand; PAM type: NRG; PAM sequence: CAG
tgatgtgagcctctgggcct

SEQ ID NO: 125931 - DNA, 20 bp, Artificial Sequence
  Description of Artificial Sequence: Synthetic oligonucleotide
  Target: ATXN1; (+) strand; PAM type: NRG; PAM sequence: TAG
tcagatgccccatctgtaca

SEQ ID NO: 125932 - DNA, 20 bp, Artificial Sequence
  Description of Artificial Sequence: Synthetic oligonucleotide
  Target: ATXN1; (+) strand; PAM type: NRG; PAM sequence: AGG
cagatgccccatctgtacat

SEQ ID NO: 125933 - DNA, 20 bp, Artificial Sequence
  Description of Artificial Sequence: Synthetic oligonucleotide
  Target: ATXN1; (+) strand; PAM type: NRG; PAM sequence: GGG
agatgccccatctgtacata

SEQ ID NO: 125934 - DNA, 20 bp, Artificial Sequence
  Description of Artificial Sequence: Synthetic oligonucleotide
  Target: ATXN1; (+) strand; PAM type: NRG; PAM sequence: CAG
tctgtacatagggcctttgc

SEQ ID NO: 125935 - DNA, 20 bp, Artificial Sequence
  Description of Artificial Sequence: Synthetic oligonucleotide
  Target: ATXN1; (+) strand; PAM type: NRG; PAM sequence: AAG
acatagggcctttgccagac

SEQ ID NO: 125936 - DNA, 20 bp, Artificial Sequence
  Description of Artificial Sequence: Synthetic oligonucleotide
  Target: ATXN1; (+) strand; PAM type: NRG; PAM sequence: CAG
gcctttgccagacaagctct

SEQ ID NO: 125937 - DNA, 20 bp, Artificial Sequence
  Description of Artificial Sequence: Synthetic oligonucleotide
  Target: ATXN1; (+) strand; PAM type: NRG; PAM sequence: AGG
cctttgccagacaagctctc

SEQ ID NO: 125938 - DNA, 20 bp, Artificial Sequence
  Description of Artificial Sequence: Synthetic oligonucleotide
  Target: ATXN1; (+) strand; PAM type: NRG; PAM sequence: TGG
acaagctctcaggtctcatc

SEQ ID NO: 125939 - DNA, 20 bp, Artificial Sequence
  Description of Artificial Sequence: Synthetic oligonucleotide
  Target: ATXN1; (+) strand; PAM type: NRG; PAM sequence: TGG
tgctcatatcctgttattct

SEQ ID NO: 125940 - DNA, 20 bp, Artificial Sequence
  Description of Artificial Sequence: Synthetic oligonucleotide
  Target: ATXN1; (+) strand; PAM type: NRG; PAM sequence: TGG
tatcctgttattcttggtca

SEQ ID NO: 125941 - DNA, 20 bp, Artificial Sequence
  Description of Artificial Sequence: Synthetic oligonucleotide
  Target: ATXN1; (+) strand; PAM type: NRG; PAM sequence: AAG
ttcttggtcatggaattcaa

SEQ ID NO: 125942 - DNA, 20 bp, Artificial Sequence
  Description of Artificial Sequence: Synthetic oligonucleotide
  Target: ATXN1; (+) strand; PAM type: NRG; PAM sequence: CAG
atggaattcaaaagacatca

SEQ ID NO: 125943 - DNA, 20 bp, Artificial Sequence
  Description of Artificial Sequence: Synthetic oligonucleotide
  Target: ATXN1; (+) strand; PAM type: NRG; PAM sequence: TGG
acatcacagtcacttgaaac

SEQ ID NO: 125944 - DNA, 20 bp, Artificial Sequence
  Description of Artificial Sequence: Synthetic oligonucleotide
  Target: ATXN1; (+) strand; PAM type: NRG; PAM sequence: TGG
cacagtcacttgaaactgga

SEQ ID NO: 125945 - DNA, 20 bp, Artificial Sequence
  Description of Artificial Sequence: Synthetic oligonucleotide
  Target: ATXN1; (+) strand; PAM type: NRG; PAM sequence: CAG
ggatggttcccccttgccta

SEQ ID NO: 125946 - DNA, 20 bp, Artificial Sequence
  Description of Artificial Sequence: Synthetic oligonucleotide
  Target: ATXN1; (+) strand; PAM type: NRG; PAM sequence: CAG
acagctgtatctctgtgcac

SEQ ID NO: 125947 - DNA, 20 bp, Artificial Sequence
  Description of Artificial Sequence: Synthetic oligonucleotide
  Target: ATXN1; (+) strand; PAM type: NRG; PAM sequence: GAG
atctctgtgcaccagttgct

SEQ ID NO: 125948 - DNA, 20 bp, Artificial Sequence
  Description of Artificial Sequence: Synthetic oligonucleotide
  Target: ATXN1; (+) strand; PAM type: NRG; PAM sequence: AGG
tctctgtgcaccagttgctg

SEQ ID NO: 125949 - DNA, 20 bp, Artificial Sequence
  Description of Artificial Sequence: Synthetic oligonucleotide
  Target: ATXN1; (+) strand; PAM type: NRG; PAM sequence: GGG
ctctgtgcaccagttgctga

SEQ ID NO: 125950 - DNA, 20 bp, Artificial Sequence
  Description of Artificial Sequence: Synthetic oligonucleotide
  Target: ATXN1; (+) strand; PAM type: NRG; PAM sequence: AAG
gtgcaccagttgctgaggga

SEQ ID NO: 125951 - DNA, 20 bp, Artificial Sequence
  Description of Artificial Sequence: Synthetic oligonucleotide
  Target: ATXN1; (+) strand; PAM type: NRG; PAM sequence: GAG
gaaagaaacttcctttctgt

SEQ ID NO: 125952 - DNA, 20 bp, Artificial Sequence
  Description of Artificial Sequence: Synthetic oligonucleotide
  Target: ATXN1; (+) strand; PAM type: NRG; PAM sequence: TGG
gaaacttcctttctgtgagc

SEQ ID NO: 125953 - DNA, 20 bp, Artificial Sequence
  Description of Artificial Sequence: Synthetic oligonucleotide
  Target: ATXN1; (+) strand; PAM type: NRG; PAM sequence: AAG
ttcctttctgtgagctggac

SEQ ID NO: 125954 - DNA, 20 bp, Artificial Sequence
  Description of Artificial Sequence: Synthetic oligonucleotide
  Target: ATXN1; (+) strand; PAM type: NRG; PAM sequence: AGG
tcctttctgtgagctggaca

SEQ ID NO: 125955 - DNA, 20 bp, Artificial Sequence
  Description of Artificial Sequence: Synthetic oligonucleotide
  Target: ATXN1; (+) strand; PAM type: NRG; PAM sequence: TAG
ctgtgagctggacaaggtaa

SEQ ID NO: 125956 - DNA, 20 bp, Artificial Sequence
  Description of Artificial Sequence: Synthetic oligonucleotide
  Target: ATXN1; (+) strand; PAM type: NRG; PAM sequence: GAG
caacaatgatgacctcgcac

SEQ ID NO: 125957 - DNA, 20 bp, Artificial Sequence
  Description of Artificial Sequence: Synthetic oligonucleotide
  Target: ATXN1; (+) strand; PAM type: NRG; PAM sequence: AGG
aacaatgatgacctcgcacg

SEQ ID NO: 125958 - DNA, 20 bp, Artificial Sequence
  Description of Artificial Sequence: Synthetic oligonucleotide
  Target: ATXN1; (+) strand; PAM type: NRG; PAM sequence: AAG
tgatgacctcgcacgaggca

SEQ ID NO: 125959 - DNA, 20 bp, Artificial Sequence
  Description of Artificial Sequence: Synthetic oligonucleotide
  Target: ATXN1; (+) strand; PAM type: NRG; PAM sequence: CGG
cacgaggcaaagcatgtgaa

SEQ ID NO: 125960 - DNA, 20 bp, Artificial Sequence
  Description of Artificial Sequence: Synthetic oligonucleotide
  Target: ATXN1; (+) strand; PAM type: NRG; PAM sequence: AAG
aaagcatgtgaacggcaaaa

SEQ ID NO: 125961 - DNA, 20 bp, Artificial Sequence
  Description of Artificial Sequence: Synthetic oligonucleotide
  Target: ATXN1; (+) strand; PAM type: NRG; PAM sequence: CAG
gaacggcaaaaaagaaatcg

SEQ ID NO: 125962 - DNA, 20 bp, Artificial Sequence
  Description of Artificial Sequence: Synthetic oligonucleotide
  Target: ATXN1; (+) strand; PAM type: NRG; PAM sequence: AAG
gaaatcgcagaaaaatctac

SEQ ID NO: 125963 - DNA, 20 bp, Artificial Sequence
  Description of Artificial Sequence: Synthetic oligonucleotide
  Target: ATXN1; (+) strand; PAM type: NRG; PAM sequence: AGG
aaatcgcagaaaaatctaca

SEQ ID NO: 125964 - DNA, 20 bp, Artificial Sequence
  Description of Artificial Sequence: Synthetic oligonucleotide
  Target: ATXN1; (+) strand; PAM type: NRG; PAM sequence: GGG
aatcgcagaaaaatctacaa

SEQ ID NO: 125965 - DNA, 20 bp, Artificial Sequence
  Description of Artificial Sequence: Synthetic oligonucleotide
  Target: ATXN1; (+) strand; PAM type: NRG; PAM sequence: AAG
aagggaaaccatcctctcca

SEQ ID NO: 125966 - DNA, 20 bp, Artificial Sequence
  Description of Artificial Sequence: Synthetic oligonucleotide
  Target: ATXN1; (+) strand; PAM type: NRG; PAM sequence: AGG
agggaaaccatcctctccaa

SEQ ID NO: 125967 - DNA, 20 bp, Artificial Sequence
  Description of Artificial Sequence: Synthetic oligonucleotide
  Target: ATXN1; (+) strand; PAM type: NRG; PAM sequence: CAG
accatcctctccaaaggacc

SEQ ID NO: 125968 - DNA, 20 bp, Artificial Sequence
  Description of Artificial Sequence: Synthetic oligonucleotide
  Target: ATXN1; (+) strand; PAM type: NRG; PAM sequence: GAG
tctccaaaggacccagtgat

SEQ ID NO: 125969 - DNA, 20 bp, Artificial Sequence
  Description of Artificial Sequence: Synthetic oligonucleotide
  Target: ATXN1; (+) strand; PAM type: NRG; PAM sequence: AGG
ctccaaaggacccagtgatg

SEQ ID NO: 125970 - DNA, 20 bp, Artificial Sequence
  Description of Artificial Sequence: Synthetic oligonucleotide
  Target: ATXN1; (+) strand; PAM type: NRG; PAM sequence: GAG
ccaaaggacccagtgatgag

SEQ ID NO: 125971 - DNA, 20 bp, Artificial Sequence
  Description of Artificial Sequence: Synthetic oligonucleotide
  Target: ATXN1; (+) strand; PAM type: NRG; PAM sequence: GAG
aaaggacccagtgatgagga

SEQ ID NO: 125972 - DNA, 20 bp, Artificial Sequence
  Description of Artificial Sequence: Synthetic oligonucleotide
  Target: ATXN1; (+) strand; PAM type: NRG; PAM sequence: AAG
cccagtgatgaggagagtca

SEQ ID NO: 125973 - DNA, 20 bp, Artificial Sequence
  Description of Artificial Sequence: Synthetic oligonucleotide
  Target: ATXN1; (+) strand; PAM type: NRG; PAM sequence: TAG
tgatgaggagagtcaaagaa

SEQ ID NO: 125974 - DNA, 20 bp, Artificial Sequence
  Description of Artificial Sequence: Synthetic oligonucleotide
  Target: ATXN1; (+) strand; PAM type: NRG; PAM sequence: AGG
gatgaggagagtcaaagaat

SEQ ID NO: 125975 - DNA, 20 bp, Artificial Sequence
  Description of Artificial Sequence: Synthetic oligonucleotide
  Target: ATXN1; (+) strand; PAM type: NRG; PAM sequence: TGG
aaagaataggaaaaatacct

SEQ ID NO: 125976 - DNA, 20 bp, Artificial Sequence
  Description of Artificial Sequence: Synthetic oligonucleotide
  Target: ATXN1; (+) strand; PAM type: NRG; PAM sequence: AAG
aggaaaaataccttggttcc

SEQ ID NO: 125977 - DNA, 20 bp, Artificial Sequence
  Description of Artificial Sequence: Synthetic oligonucleotide
  Target: ATXN1; (+) strand; PAM type: NRG; PAM sequence: CAG
aaaaataccttggttccaag

SEQ ID NO: 125978 - DNA, 20 bp, Artificial Sequence
  Description of Artificial Sequence: Synthetic oligonucleotide
  Target: ATXN1; (+) strand; PAM type: NRG; PAM sequence: AGG
aaaataccttggttccaagc

SEQ ID NO: 125979 - DNA, 20 bp, Artificial Sequence
  Description of Artificial Sequence: Synthetic oligonucleotide
  Target: ATXN1; (+) strand; PAM type: NRG; PAM sequence: GAG
aataccttggttccaagcag

SEQ ID NO: 125980 - DNA, 20 bp, Artificial Sequence
  Description of Artificial Sequence: Synthetic oligonucleotide
  Target: ATXN1; (+) strand; PAM type: NRG; PAM sequence: TAG
ggttccaagcaggagaaaac

SEQ ID NO: 125981 - DNA, 20 bp, Artificial Sequence
  Description of Artificial Sequence: Synthetic oligonucleotide
  Target: ATXN1; (+) strand; PAM type: NRG; PAM sequence: GAG
ttccaagcaggagaaaacta

SEQ ID NO: 125982 - DNA, 20 bp, Artificial Sequence
  Description of Artificial Sequence: Synthetic oligonucleotide
  Target: ATXN1; (+) strand; PAM type: NRG; PAM sequence: GAG
ccaagcaggagaaaactaga

SEQ ID NO: 125983 - DNA, 20 bp, Artificial Sequence
  Description of Artificial Sequence: Synthetic oligonucleotide
  Target: ATXN1; (+) strand; PAM type: NRG; PAM sequence: TGG
tgctgtcacacactttttct

SEQ ID NO: 125984 - DNA, 20 bp, Artificial Sequence
  Description of Artificial Sequence: Synthetic oligonucleotide
  Target: ATXN1; (+) strand; PAM type: NRG; PAM sequence: TAG
cactttttcttggtgcatca

SEQ ID NO: 125985 - DNA, 20 bp, Artificial Sequence
  Description of Artificial Sequence: Synthetic oligonucleotide
  Target: ATXN1; (+) strand; PAM type: NRG; PAM sequence: TGG
tcttggtgcatcatagtaat

SEQ ID NO: 125986 - DNA, 20 bp, Artificial Sequence
  Description of Artificial Sequence: Synthetic oligonucleotide
  Target: ATXN1; (+) strand; PAM type: NRG; PAM sequence: TGG
aattggataatattttgatg

SEQ ID NO: 125987 - DNA, 20 bp, Artificial Sequence
  Description of Artificial Sequence: Synthetic oligonucleotide
  Target: ATXN1; (+) strand; PAM type: NRG; PAM sequence: GGG
attggataatattttgatgt

SEQ ID NO: 125988 - DNA, 20 bp, Artificial Sequence
  Description of Artificial Sequence: Synthetic oligonucleotide
  Target: ATXN1; (+) strand; PAM type: NRG; PAM sequence: AAG
atgtgggtaaaaatacatga

SEQ ID NO: 125989 - DNA, 20 bp, Artificial Sequence
  Description of Artificial Sequence: Synthetic oligonucleotide
  Target: ATXN1; (+) strand; PAM type: NRG; PAM sequence: AAG
aaaaatacatgaaagattca

SEQ ID NO: 125990 - DNA, 20 bp, Artificial Sequence
  Description of Artificial Sequence: Synthetic oligonucleotide
  Target: ATXN1; (+) strand; PAM type: NRG; PAM sequence: AGG
aaaatacatgaaagattcaa

SEQ ID NO: 125991 - DNA, 20 bp, Artificial Sequence
  Description of Artificial Sequence: Synthetic oligonucleotide
  Target: ATXN1; (+) strand; PAM type: NRG; PAM sequence: CAG
gatcactcaccctatgaaaa

SEQ ID NO: 125992 - DNA, 20 bp, Artificial Sequence
  Description of Artificial Sequence: Synthetic oligonucleotide
  Target: ATXN1; (+) strand; PAM type: NRG; PAM sequence: AAG
acgtcgatttctttctcacg

SEQ ID NO: 125993 - DNA, 20 bp, Artificial Sequence
  Description of Artificial Sequence: Synthetic oligonucleotide
  Target: ATXN1; (+) strand; PAM type: NRG; PAM sequence: TGG
tttctttctcacgaagaaaa

SEQ ID NO: 125994 - DNA, 20 bp, Artificial Sequence
  Description of Artificial Sequence: Synthetic oligonucleotide
  Target: ATXN1; (+) strand; PAM type: NRG; PAM sequence: TGG
agaaaatggtctaatttctt

SEQ ID NO: 125995 - DNA, 20 bp, Artificial Sequence
  Description of Artificial Sequence: Synthetic oligonucleotide
  Target: ATXN1; (+) strand; PAM type: NRG; PAM sequence: TGG
gtctaatttctttggaaaac

SEQ ID NO: 125996 - DNA, 20 bp, Artificial Sequence
  Description of Artificial Sequence: Synthetic oligonucleotide
  Target: ATXN1; (+) strand; PAM type: NRG; PAM sequence: TAG
atttctttggaaaactggaa

SEQ ID NO: 125997 - DNA, 20 bp, Artificial Sequence
  Description of Artificial Sequence: Synthetic oligonucleotide
  Target: ATXN1; (+) strand; PAM type: NRG; PAM sequence: AAG
ggaaaactggaatagaaaaa

SEQ ID NO: 125998 - DNA, 20 bp, Artificial Sequence
  Description of Artificial Sequence: Synthetic oligonucleotide
  Target: ATXN1; (+) strand; PAM type: NRG; PAM sequence: CAG
aataactccattctctaaat

SEQ ID NO: 125999 - DNA, 20 bp, Artificial Sequence
  Description of Artificial Sequence: Synthetic oligonucleotide
  Target: ATXN1; (+) strand; PAM type: NRG; PAM sequence: GAG
ttctctaaatcagtccaaat

SEQ ID NO: 126000 - DNA, 20 bp, Artificial Sequence
  Description of Artificial Sequence: Synthetic oligonucleotide
  Target: ATXN1; (+) strand; PAM type: NRG; PAM sequence: CAG
tctaaatcagtccaaatgag

SEQ ID NO: 126001 - DNA, 20 bp, Artificial Sequence
  Description of Artificial Sequence: Synthetic oligonucleotide
  Target: ATXN1; (+) strand; PAM type: NRG; PAM sequence: AGG
ctaaatcagtccaaatgagc

SEQ ID NO: 126002 - DNA, 20 bp, Artificial Sequence
  Description of Artificial Sequence: Synthetic oligonucleotide
  Target: ATXN1; (+) strand; PAM type: NRG; PAM sequence: TAG
tcagtccaaatgagcaggcc

SEQ ID NO: 126003 - DNA, 20 bp, Artificial Sequence
  Description of Artificial Sequence: Synthetic oligonucleotide
  Target: ATXN1; (+) strand; PAM type: NRG; PAM sequence: GAG
agtccaaatgagcaggccta

SEQ ID NO: 126004 - DNA, 20 bp, Artificial Sequence
  Description of Artificial Sequence: Synthetic oligonucleotide
  Target: ATXN1; (+) strand; PAM type: NRG; PAM sequence: AGG
gtccaaatgagcaggcctag

SEQ ID NO: 126005 - DNA, 20 bp, Artificial Sequence
  Description of Artificial Sequence: Synthetic oligonucleotide
  Target: ATXN1; (+) strand; PAM type: NRG; PAM sequence: AAG
tgagcaggcctagaggtgat

SEQ ID NO: 126006 - DNA, 20 bp, Artificial Sequence
  Description of Artificial Sequence: Synthetic oligonucleotide
  Target: ATXN1; (+) strand; PAM type: NRG; PAM sequence: CAG
ctagaggtgataagaaattc

SEQ ID NO: 126007 - DNA, 20 bp, Artificial Sequence
  Description of Artificial Sequence: Synthetic oligonucleotide
  Target: ATXN1; (+) strand; PAM type: NRG; PAM sequence: TAG
tgataagaaattccagcccc

SEQ ID NO: 126008 - DNA, 20 bp, Artificial Sequence
  Description of Artificial Sequence: Synthetic oligonucleotide
  Target: ATXN1; (+) strand; PAM type: NRG; PAM sequence: TGG
aattccagcccctagcactt

SEQ ID NO: 126009 - DNA, 20 bp, Artificial Sequence
  Description of Artificial Sequence: Synthetic oligonucleotide
  Target: ATXN1; (+) strand; PAM type: NRG; PAM sequence: TAG
cctagcactttggcctttat

SEQ ID NO: 126010 - DNA, 20 bp, Artificial Sequence
  Description of Artificial Sequence: Synthetic oligonucleotide
  Target: ATXN1; (+) strand; PAM type: NRG; PAM sequence: AGG
ctagcactttggcctttatt

SEQ ID NO: 126011 - DNA, 20 bp, Artificial Sequence
  Description of Artificial Sequence: Synthetic oligonucleotide
  Target: ATXN1; (+) strand; PAM type: NRG; PAM sequence: AAG
aggtgcacaataaatgtctg

SEQ ID NO: 126012 - DNA, 20 bp, Artificial Sequence
  Description of Artificial Sequence: Synthetic oligonucleotide
  Target: ATXN1; (+) strand; PAM type: NRG; PAM sequence: TAG
aataaatgtctgaagaacaa

SEQ ID NO: 126013 - DNA, 20 bp, Artificial Sequence
  Description of Artificial Sequence: Synthetic oligonucleotide
  Target: ATXN1; (+) strand; PAM type: NRG; PAM sequence: TGG
acaatagatgcgtgattatt

SEQ ID NO: 126014 - DNA, 20 bp, Artificial Sequence
  Description of Artificial Sequence: Synthetic oligonucleotide
  Target: ATXN1; (+) strand; PAM type: NRG; PAM sequence: AAG
gctgactatatgaattttaa

SEQ ID NO: 126015 - DNA, 20 bp, Artificial Sequence
  Description of Artificial Sequence: Synthetic oligonucleotide
  Target: ATXN1; (+) strand; PAM type: NRG; PAM sequence: CAG
gactatatgaattttaaaag

SEQ ID NO: 126016 - DNA, 20 bp, Artificial Sequence
  Description of Artificial Sequence: Synthetic oligonucleotide
  Target: ATXN1; (+) strand; PAM type: NRG; PAM sequence: GAG
ctatatgaattttaaaagca

SEQ ID NO: 126017 - DNA, 20 bp, Artificial Sequence
  Description of Artificial Sequence: Synthetic oligonucleotide
  Target: ATXN1; (+) strand; PAM type: NRG; PAM sequence: TAG
agctttgaacaatcaatatg

SEQ ID NO: 126018 - DNA, 20 bp, Artificial Sequence
  Description of Artificial Sequence: Synthetic oligonucleotide
  Target: ATXN1; (+) strand; PAM type: NRG; PAM sequence: GAG
ctttgaacaatcaatatgta

SEQ ID NO: 126019 - DNA, 20 bp, Artificial Sequence
  Description of Artificial Sequence: Synthetic oligonucleotide
  Target: ATXN1; (+) strand; PAM type: NRG; PAM sequence: CAG
caatatgtagagaacaatca

SEQ ID NO: 126020 - DNA, 20 bp, Artificial Sequence
  Description of Artificial Sequence: Synthetic oligonucleotide
  Target: ATXN1; (+) strand; PAM type: NRG; PAM sequence: AGG
aatatgtagagaacaatcac

SEQ ID NO: 126021 - DNA, 20 bp, Artificial Sequence
  Description of Artificial Sequence: Synthetic oligonucleotide
  Target: ATXN1; (+) strand; PAM type: NRG; PAM sequence: GAG
aggcatgattcatttatcat

SEQ ID NO: 126022 - DNA, 20 bp, Artificial Sequence
  Description of Artificial Sequence: Synthetic oligonucleotide
  Target: ATXN1; (+) strand; PAM type: NRG; PAM sequence: TGG
ttcatttatcatgagatgta

SEQ ID NO: 126023 - DNA, 20 bp, Artificial Sequence
  Description of Artificial Sequence: Synthetic oligonucleotide
  Target: ATXN1; (+) strand; PAM type: NRG; PAM sequence: AAG
agatgtatggtccttgtgac

SEQ ID NO: 126024 - DNA, 20 bp, Artificial Sequence
  Description of Artificial Sequence: Synthetic oligonucleotide
  Target: ATXN1; (+) strand; PAM type: NRG; PAM sequence: AGG
gatgtatggtccttgtgaca

SEQ ID NO: 126025 - DNA, 20 bp, Artificial Sequence
  Description of Artificial Sequence: Synthetic oligonucleotide
  Target: ATXN1; (+) strand; PAM type: NRG; PAM sequence: GAG
tgtatggtccttgtgacaag

SEQ ID NO: 126026 - DNA, 20 bp, Artificial Sequence
  Description of Artificial Sequence: Synthetic oligonucleotide
  Target: ATXN1; (+) strand; PAM type: NRG; PAM sequence: TGG
gtgacaaggagtccatattg

SEQ ID NO: 126027 - DNA, 20 bp, Artificial Sequence
  Description of Artificial Sequence: Synthetic oligonucleotide
  Target: ATXN1; (+) strand; PAM type: NRG; PAM sequence: AAG
gagtccatattgtggtgccc

SEQ ID NO: 126028 - DNA, 20 bp, Artificial Sequence
  Description of Artificial Sequence: Synthetic oligonucleotide
  Target: ATXN1; (+) strand; PAM type: NRG; PAM sequence: TAG
tgcccaagaaatcaattttt

SEQ ID NO: 126029 - DNA, 20 bp, Artificial Sequence
  Description of Artificial Sequence: Synthetic oligonucleotide
  Target: ATXN1; (+) strand; PAM type: NRG; PAM sequence: AGG
gcccaagaaatcaatttttt

SEQ ID NO: 126030 - DNA, 20 bp, Artificial Sequence
  Description of Artificial Sequence: Synthetic oligonucleotide
  Target: ATXN1; (+) strand; PAM type: NRG; PAM sequence: AAG
gcccaccatgatgcttattg

SEQ ID NO: 126031 - DNA, 20 bp, Artificial Sequence
  Description of Artificial Sequence: Synthetic oligonucleotide
  Target: ATXN1; (+) strand; PAM type: NRG; PAM sequence: AAG
caccatgatgcttattgaag

SEQ ID NO: 126032 - DNA, 20 bp, Artificial Sequence
  Description of Artificial Sequence: Synthetic oligonucleotide
  Target: ATXN1; (+) strand; PAM type: NRG; PAM sequence: AAG
tctttttttgtatttttttg

SEQ ID NO: 126033 - DNA, 20 bp, Artificial Sequence
  Description of Artificial Sequence: Synthetic oligonucleotide
  Target: ATXN1; (+) strand; PAM type: NRG; PAM sequence: TAG
tttttgaagtaatgtttctg

SEQ ID NO: 126034 - DNA, 20 bp, Artificial Sequence
  Description of Artificial Sequence: Synthetic oligonucleotide
  Target: ATXN1; (+) strand; PAM type: NRG; PAM sequence: GAG
tttgaagtaatgtttctgta

SEQ ID NO: 126035 - DNA, 20 bp, Artificial Sequence
  Description of Artificial Sequence: Synthetic oligonucleotide
  Target: ATXN1; (+) strand; PAM type: NRG; PAM sequence: TGG
aagtaatgtttctgtagaga

SEQ ID NO: 126036 - DNA, 20 bp, Artificial Sequence
  Description of Artificial Sequence: Synthetic oligonucleotide
  Target: ATXN1; (+) strand; PAM type: NRG; PAM sequence: GGG
agtaatgtttctgtagagat

SEQ ID NO: 126037 - DNA, 20 bp, Artificial Sequence
  Description of Artificial Sequence: Synthetic oligonucleotide
  Target: ATXN1; (+) strand; PAM type: NRG; PAM sequence: GGG
gtaatgtttctgtagagatg

SEQ ID NO: 126038 - DNA, 20 bp, Artificial Sequence
  Description of Artificial Sequence: Synthetic oligonucleotide
  Target: ATXN1; (+) strand; PAM type: NRG; PAM sequence: CAG
tggggtctcactatgttgcc

SEQ ID NO: 126039 - DNA, 20 bp, Artificial Sequence
  Description of Artificial Sequence: Synthetic oligonucleotide
  Target: ATXN1; (+) strand; PAM type: NRG; PAM sequence: AGG
ggggtctcactatgttgccc

SEQ ID NO: 126040 - DNA, 20 bp, Artificial Sequence
  Description of Artificial Sequence: Synthetic oligonucleotide
  Target: ATXN1; (+) strand; PAM type: NRG; PAM sequence: TGG
tctcactatgttgcccaggc

SEQ ID NO: 126041 - DNA, 20 bp, Artificial Sequence
  Description of Artificial Sequence: Synthetic oligonucleotide
  Target: ATXN1; (+) strand; PAM type: NRG; PAM sequence: TGG
ccaggctggtcttgaactcc

SEQ ID NO: 126042 - DNA, 20 bp, Artificial Sequence
  Description of Artificial Sequence: Synthetic oligonucleotide
  Target: ATXN1; (+) strand; PAM type: NRG; PAM sequence: AAG
ggtcttgaactcctggcctc

SEQ ID NO: 126043 - DNA, 20 bp, Artificial Sequence
  Description of Artificial Sequence: Synthetic oligonucleotide
  Target: ATXN1; (+) strand; PAM type: NRG; PAM sequence: CAG
ctcaagcgctccttccacct

SEQ ID NO: 126044 - DNA, 20 bp, Artificial Sequence
  Description of Artificial Sequence: Synthetic oligonucleotide
  Target: ATXN1; (+) strand; PAM type: NRG; PAM sequence: AAG
ccttccacctcagcctccca

SEQ ID NO: 126045 - DNA, 20 bp, Artificial Sequence
  Description of Artificial Sequence: Synthetic oligonucleotide
  Target: ATXN1; (+) strand; PAM type: NRG; PAM sequence: TGG
acctcagcctcccaaagtgt

SEQ ID NO: 126046 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaaagtgtt

SEQ ID NO: 126047 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgttgggatta

SEQ ID NO: 126048 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgttgggattac

SEQ ID NO: 126049 - DNA, 20 bp, Artificial Sequence
  Description of Artificial Sequence: Synthetic oligonucleotide
  Target: ATXN1; (+) strand; PAM type: NRG; PAM sequence: GAG
agtgttgggattacaggttt

SEQ ID NO: 126050 - DNA, 20 bp, Artificial Sequence
  Description of Artificial Sequence: Synthetic oligonucleotide
  Target: ATXN1; (+) strand; PAM type: NRG; PAM sequence: CAG
caggtttgagccatcgtacc

SEQ ID NO: 126051 - DNA, 20 bp, Artificial Sequence
  Description of Artificial Sequence: Synthetic oligonucleotide
  Target: ATXN1; (+) strand; PAM type: NRG; PAM sequence: GAG
cagccgtgttttattttttt

SEQ ID NO: 126052 - DNA, 20 bp, Artificial Sequence
  Description of Artificial Sequence: Synthetic oligonucleotide
  Target: ATXN1; (+) strand; PAM type: NRG; PAM sequence: TAG
cgtgttttatttttttgaga

SEQ ID NO: 126053 - DNA, 20 bp, Artificial Sequence
  Description of Artificial Sequence: Synthetic oligonucleotide
  Target: ATXN1; (+) strand; PAM type: NRG; PAM sequence: AGG
gtgttttatttttttgagat

SEQ ID NO: 126054 - DNA, 20 bp, Artificial Sequence
  Description of Artificial Sequence: Synthetic oligonucleotide
  Target: ATXN1; (+) strand; PAM type: NRG; PAM sequence: GGG
tgttttatttttttgagata

SEQ ID NO: 126055 - DNA, 20 bp, Artificial Sequence
  Description of Artificial Sequence: Synthetic oligonucleotide
  Target: ATXN1; (+) strand; PAM type: NRG; PAM sequence: CGG
tagggtcttgctttgttacc

SEQ ID NO: 126056 - DNA, 20 bp, Artificial Sequence
  Description of Artificial Sequence: Synthetic oligonucleotide
  Target: ATXN1; (+) strand; PAM type: NRG; PAM sequence: GGG
agggtcttgctttgttaccc

SEQ ID NO: 126057 - DNA, 20 bp, Artificial Sequence
  Description of Artificial Sequence: Synthetic oligonucleotide
  Target: ATXN1; (+) strand; PAM type: NRG; PAM sequence: TAG
tttgttacccgggtttgtca

SEQ ID NO: 126058 - DNA, 20 bp, Artificial Sequence
  Description of Artificial Sequence: Synthetic oligonucleotide
  Target: ATXN1; (+) strand; PAM type: NRG; PAM sequence: TAG
atagatccgtgcccatttta

SEQ ID NO: 126059 - DNA, 20 bp, Artificial Sequence
  Description of Artificial Sequence: Synthetic oligonucleotide
  Target: ATXN1; (+) strand; PAM type: NRG; PAM sequence: TGG
atccgtgcccattttatagc

SEQ ID NO: 126060 - DNA, 20 bp, Artificial Sequence
  Description of Artificial Sequence: Synthetic oligonucleotide
  Target: ATXN1; (+) strand; PAM type: NRG; PAM sequence: GAG
attttatagctggaaaccct

SEQ ID NO: 126061 - DNA, 20 bp, Artificial Sequence
  Description of Artificial Sequence: Synthetic oligonucleotide
  Target: ATXN1; (+) strand; PAM type: NRG; PAM sequence: AGG
ttttatagctggaaaccctg

SEQ ID NO: 126062 - DNA, 20 bp, Artificial Sequence
  Description of Artificial Sequence: Synthetic oligonucleotide
  Target: ATXN1; (+) strand; PAM type: NRG; PAM sequence: CAG
tagctggaaaccctgaggcc

SEQ ID NO: 126063 - DNA, 20 bp, Artificial Sequence
  Description of Artificial Sequence: Synthetic oligonucleotide
  Target: ATXN1; (+) strand; PAM type: NRG; PAM sequence: AGG
agctggaaaccctgaggccc

SEQ ID NO: 126064 - DNA, 20 bp, Artificial Sequence
  Description of Artificial Sequence: Synthetic oligonucleotide
  Target: ATXN1; (+) strand; PAM type: NRG; PAM sequence: GGG
gctggaaaccctgaggccca

SEQ ID NO: 126065 - DNA, 20 bp, Artificial Sequence
  Description of Artificial Sequence: Synthetic oligonucleotide
  Target: ATXN1; (+) strand; PAM type: NRG; PAM sequence: GGG
ctggaaaccctgaggcccag

SEQ ID NO: 126066 - DNA, 20 bp, Artificial Sequence
  Description of Artificial Sequence: Synthetic oligonucleotide
  Target: ATXN1; (+) strand; PAM type: NRG; PAM sequence: GAG
accctgaggcccaggggact

SEQ ID NO: 126067 - DNA, 20 bp, Artificial Sequence
  Description of Artificial Sequence: Synthetic oligonucleotide
  Target: ATXN1; (+) strand; PAM type: NRG; PAM sequence: TGG
gccacttgctcacgtgcaca

SEQ ID NO: 126068 - DNA, 20 bp, Artificial Sequence
  Description of Artificial Sequence: Synthetic oligonucleotide
  Target: ATXN1; (+) strand; PAM type: NRG; PAM sequence: GAG
gctcacgtgcacatggctgt

SEQ ID NO: 126069 - DNA, 20 bp, Artificial Sequence
  Description of Artificial Sequence: Synthetic oligonucleotide
  Target: ATXN1; (+) strand; PAM type: NRG; PAM sequence: TGG
cacgtgcacatggctgtgag

SEQ ID NO: 126070 - DNA, 20 bp, Artificial Sequence
  Description of Artificial Sequence: Synthetic oligonucleotide
  Target: ATXN1; (+) strand; PAM type: NRG; PAM sequence: CAG
gtgcacatggctgtgagtgg

SEQ ID NO: 126071 - DNA, 20 bp, Artificial Sequence
  Description of Artificial Sequence: Synthetic oligonucleotide
  Target: ATXN1; (+) strand; PAM type: NRG; PAM sequence: GAG
gcacatggctgtgagtggca

SEQ ID NO: 126072 - DNA, 20 bp, Artificial Sequence
  Description of Artificial Sequence: Synthetic oligonucleotide
  Target: ATXN1; (+) strand; PAM type: NRG; PAM sequence: GAG
tggctgtgagtggcagagct

SEQ ID NO: 126073 - DNA, 20 bp, Artificial Sequence
  Description of Artificial Sequence: Synthetic oligonucleotide
  Target: ATXN1; (+) strand; PAM type: NRG; PAM sequence: CAG
gtgagtggcagagctgagct

SEQ ID NO: 126074 - DNA, 20 bp, Artificial Sequence
  Description of Artificial Sequence: Synthetic oligonucleotide
  Target: ATXN1; (+) strand; PAM type: NRG; PAM sequence: TGG
gcagagctgagctcagaccc

SEQ ID NO: 126075 - DNA, 20 bp, Artificial Sequence
  Description of Artificial Sequence: Synthetic oligonucleotide
  Target: ATXN1; (+) strand; PAM type: NRG; PAM sequence: GGG
cagagctgagctcagaccct

SEQ ID NO: 126076 - DNA, 20 bp, Artificial Sequence
  Description of Artificial Sequence: Synthetic oligonucleotide
  Target: ATXN1; (+) strand; PAM type: NRG; PAM sequence: AAG
accctgggatcctccctcca

SEQ ID NO: 126077 - DNA, 20 bp, Artificial Sequence
  Description of Artificial Sequence: Synthetic oligonucleotide
  Target: ATXN1; (+) strand; PAM type: NRG; PAM sequence: TGG
tccctccaaagtccctctca

SEQ ID NO: 126078 - DNA, 20 bp, Artificial Sequence
  Description of Artificial Sequence: Synthetic oligonucleotide
  Target: ATXN1; (+) strand; PAM type: NRG; PAM sequence: GGG
ccctccaaagtccctctcat

SEQ ID NO: 126079 - DNA, 20 bp, Artificial Sequence
  Description of Artificial Sequence: Synthetic oligonucleotide
  Target: ATXN1; (+) strand; PAM type: NRG; PAM sequence: GGG
cctccaaagtccctctcatg

SEQ ID NO: 126080 - DNA, 20 bp, Artificial Sequence
  Description of Artificial Sequence: Synthetic oligonucleotide
  Target: ATXN1; (+) strand; PAM type: NRG; PAM sequence: GGG
ctccaaagtccctctcatgg

SEQ ID NO: 126081 - DNA, 20 bp, Artificial Sequence
  Description of Artificial Sequence: Synthetic oligonucleotide
  Target: ATXN1; (+) strand; PAM type: NRG; PAM sequence: CAG
gtccctctcatgggggaatt

SEQ ID NO: 126082 - DNA, 20 bp, Artificial Sequence
  Description of Artificial Sequence: Synthetic oligonucleotide
  Target: ATXN1; (+) strand; PAM type: NRG; PAM sequence: TGG
atgggggaattcagtgaccg

SEQ ID NO: 126083 - DNA, 20 bp, Artificial Sequence
  Description of Artificial Sequence: Synthetic oligonucleotide
  Target: ATXN1; (+) strand; PAM type: NRG; PAM sequence: TGG
gggaattcagtgaccgtgga

SEQ ID NO: 126084 - DNA, 20 bp, Artificial Sequence
  Description of Artificial Sequence: Synthetic oligonucleotide
  Target: ATXN1; (+) strand; PAM type: NRG; PAM sequence: GGG
ggaattcagtgaccgtggat

SEQ ID NO: 126085 - DNA, 20 bp, Artificial Sequence
  Description of Artificial Sequence: Synthetic oligonucleotide
  Target: ATXN1; (+) strand; PAM type: NRG; PAM sequence: GGG
gaattcagtgaccgtggatg

SEQ ID NO: 126086 - DNA, 20 bp, Artificial Sequence
  Description of Artificial Sequence: Synthetic oligonucleotide
  Target: ATXN1; (+) strand; PAM type: NRG; PAM sequence: TAG
cgtggatggggatgccatca

SEQ ID NO: 126087 - DNA, 20 bp, Artificial Sequence
  Description of Artificial Sequence: Synthetic oligonucleotide
  Target: ATXN1; (+) strand; PAM type: NRG; PAM sequence: CAG
gatgccatcatagctcactg

SEQ ID NO: 126088 - DNA, 20 bp, Artificial Sequence
  Description of Artificial Sequence: Synthetic oligonucleotide
  Target: ATXN1; (+) strand; PAM type: NRG; PAM sequence: TAG
tcactgcagcctccaactcc

SEQ ID NO: 126089 - DNA, 20 bp, Artificial Sequence
  Description of Artificial Sequence: Synthetic oligonucleotide
  Target: ATXN1; (+) strand; PAM type: NRG; PAM sequence: TAG
ctagactcaaactcctgcct

SEQ ID NO: 126090 - DNA, 20 bp, Artificial Sequence
  Description of Artificial Sequence: Synthetic oligonucleotide
  Target: ATXN1; (+) strand; PAM type: NRG; PAM sequence: AAG
aaactcctgccttagccgcc

SEQ ID NO: 126091 - DNA, 20 bp, Artificial Sequence
  Description of Artificial Sequence: Synthetic oligonucleotide
  Target: ATXN1; (+) strand; PAM type: NRG; PAM sequence: TAG
ctcctgccttagccgccaag

SEQ ID NO: 126092 - DNA, 20 bp, Artificial Sequence
  Description of Artificial Sequence: Synthetic oligonucleotide
  Target: ATXN1; (+) strand; PAM type: NRG; PAM sequence: TGG
tgccttagccgccaagtagc

SEQ ID NO: 126093 - DNA, 20 bp, Artificial Sequence
  Description of Artificial Sequence: Synthetic oligonucleotide
  Target: ATXN1; (+) strand; PAM type: NRG; PAM sequence: GGG
gccttagccgccaagtagct

SEQ ID NO: 126094 - DNA, 20 bp, Artificial Sequence
  Description of Artificial Sequence: Synthetic oligonucleotide
  Target: ATXN1; (+) strand; PAM type: NRG; PAM sequence: CAG
ccgccaagtagctgggacta

SEQ ID NO: 126095 - DNA, 20 bp, Artificial Sequence
  Description of Artificial Sequence: Synthetic oligonucleotide
  Target: ATXN1; (+) strand; PAM type: NRG; PAM sequence: AGG
cgccaagtagctgggactac

SEQ ID NO: 126096 - DNA, 20 bp, Artificial Sequence
  Description of Artificial Sequence: Synthetic oligonucleotide
  Target: ATXN1; (+) strand; PAM type: NRG; PAM sequence: TGG
caggcatgtgccaccacacc

SEQ ID NO: 126097 - DNA, 20 bp, Artificial Sequence
  Description of Artificial Sequence: Synthetic oligonucleotide
  Target: ATXN1; (+) strand; PAM type: NRG; PAM sequence: CGG
ttgtgttttttctttatttg

SEQ ID NO: 126098 - DNA, 20 bp, Artificial Sequence
  Description of Artificial Sequence: Synthetic oligonucleotide
  Target: ATXN1; (+) strand; PAM type: NRG; PAM sequence: GAG
gtgttttttctttatttgcg

SEQ ID NO: 126099 - DNA, 20 bp, Artificial Sequence
  Description of Artificial Sequence: Synthetic oligonucleotide
  Target: ATXN1; (+) strand; PAM type: NRG; PAM sequence: TGG
tttttctttatttgcggaga

SEQ ID NO: 126100 - DNA, 20 bp, Artificial Sequence
  Description of Artificial Sequence: Synthetic oligonucleotide
  Target: ATXN1; (+) strand; PAM type: NRG; PAM sequence: GAG
tttctttatttgcggagatg

SEQ ID NO: 126101 - DNA, 20 bp, Artificial Sequence
  Description of Artificial Sequence: Synthetic oligonucleotide
  Target: ATXN1; (+) strand; PAM type: NRG; PAM sequence: CAG
atggagttttgctacattgc

SEQ ID NO: 126102 - DNA, 20 bp, Artificial Sequence
  Description of Artificial Sequence: Synthetic oligonucleotide
  Target: ATXN1; (+) strand; PAM type: NRG; PAM sequence: AGG
tggagttttgctacattgcc

SEQ ID NO: 126103 - DNA, 20 bp, Artificial Sequence
  Description of Artificial Sequence: Synthetic oligonucleotide
  Target: ATXN1; (+) strand; PAM type: NRG; PAM sequence: AAG
tgctacattgccaggctgtg

SEQ ID NO: 126104 - DNA, 20 bp, Artificial Sequence
  Description of Artificial Sequence: Synthetic oligonucleotide
  Target: ATXN1; (+) strand; PAM type: NRG; PAM sequence: AAG
tacattgccaggctgtgaag

SEQ ID NO: 126105 - DNA, 20 bp, Artificial Sequence
  Description of Artificial Sequence: Synthetic oligonucleotide
  Target: ATXN1; (+) strand; PAM type: NRG; PAM sequence: AAG
gaagtcttaataaataacca

SEQ ID NO: 126106 - DNA, 20 bp, Artificial Sequence
  Description of Artificial Sequence: Synthetic oligonucleotide
  Target: ATXN1; (+) strand; PAM type: NRG; PAM sequence: TGG
cactttgctctttcccaaaa

SEQ ID NO: 126107 - DNA, 20 bp, Artificial Sequence
  Description of Artificial Sequence: Synthetic oligonucleotide
  Target: ATXN1; (+) strand; PAM type: NRG; PAM sequence: CAG
ttcccaaaatggtataccca

SEQ ID NO: 126108 - DNA, 20 bp, Artificial Sequence
  Description of Artificial Sequence: Synthetic oligonucleotide
  Target: ATXN1; (+) strand; PAM type: NRG; PAM sequence: CAG
acccacagcttcactccctg

SEQ ID NO: 126109 - DNA, 20 bp, Artificial Sequence
  Description of Artificial Sequence: Synthetic oligonucleotide
  Target: ATXN1; (+) strand; PAM type: NRG; PAM sequence: TAG
tgcagtgatctgtatgtaat

SEQ ID NO: 126110 - DNA, 20 bp, Artificial Sequence
  Description of Artificial Sequence: Synthetic oligonucleotide
  Target: ATXN1; (+) strand; PAM type: NRG; PAM sequence: AGG
gcagtgatctgtatgtaatt

SEQ ID NO: 126111 - DNA, 20 bp, Artificial Sequence
  Description of Artificial Sequence: Synthetic oligonucleotide
  Target: ATXN1; (+) strand; PAM type: NRG; PAM sequence: TGG
tgtatgtaattaggctcata

SEQ ID NO: 126112 - DNA, 20 bp, Artificial Sequence
  Description of Artificial Sequence: Synthetic oligonucleotide
  Target: ATXN1; (+) strand; PAM type: NRG; PAM sequence: GGG
gtatgtaattaggctcatat

SEQ ID NO: 126113 - DNA, 20 bp, Artificial Sequence
  Description of Artificial Sequence: Synthetic oligonucleotide
  Target: ATXN1; (+) strand; PAM type: NRG; PAM sequence: TGG
attaggctcatatgggaatg

SEQ ID NO: 126114 - DNA, 20 bp, Artificial Sequence
  Description of Artificial Sequence: Synthetic oligonucleotide
  Target: ATXN1; (+) strand; PAM type: NRG; PAM sequence: TGG
ctcatatgggaatgtggact

SEQ ID NO: 126115 - DNA, 20 bp, Artificial Sequence
  Description of Artificial Sequence: Synthetic oligonucleotide
  Target: ATXN1; (+) strand; PAM type: NRG; PAM sequence: CAG
atatgggaatgtggacttgg

SEQ ID NO: 126116 - DNA, 20 bp, Artificial Sequence
  Description of Artificial Sequence: Synthetic oligonucleotide
  Target: ATXN1; (+) strand; PAM type: NRG; PAM sequence: GAG
atgggaatgtggacttggca

SEQ ID NO: 126117 - DNA, 20 bp, Artificial Sequence
  Description of Artificial Sequence: Synthetic oligonucleotide
  Target: ATXN1; (+) strand; PAM type: NRG; PAM sequence: AGG
tgggaatgtggacttggcag

SEQ ID NO: 126118 - DNA, 20 bp, Artificial Sequence
  Description of Artificial Sequence: Synthetic oligonucleotide
  Target: ATXN1; (+) strand; PAM type: NRG; PAM sequence: GGG
gggaatgtggacttggcaga

SEQ ID NO: 126119 - DNA, 20 bp, Artificial Sequence
  Description of Artificial Sequence: Synthetic oligonucleotide
  Target: ATXN1; (+) strand; PAM type: NRG; PAM sequence: GGG
ggaatgtggacttggcagag

SEQ ID NO: 126120 - DNA, 20 bp, Artificial Sequence
  Description of Artificial Sequence: Synthetic oligonucleotide
  Target: ATXN1; (+) strand; PAM type: NRG; PAM sequence: TGG
tggacttggcagaggggcgc

SEQ ID NO: 126121 - DNA, 20 bp, Artificial Sequence
  Description of Artificial Sequence: Synthetic oligonucleotide
  Target: ATXN1; (+) strand; PAM type: NRG; PAM sequence: GAG
gacttggcagaggggcgctg

SEQ ID NO: 126122 - DNA, 20 bp, Artificial Sequence
  Description of Artificial Sequence: Synthetic oligonucleotide
  Target: ATXN1; (+) strand; PAM type: NRG; PAM sequence: AGG
acttggcagaggggcgctgg

SEQ ID NO: 126123 - DNA, 20 bp, Artificial Sequence
  Description of Artificial Sequence: Synthetic oligonucleotide
  Target: ATXN1; (+) strand; PAM type: NRG; PAM sequence: CAG
gggcgctggaggccacatat

SEQ ID NO: 126124 - DNA, 20 bp, Artificial Sequence
  Description of Artificial Sequence: Synthetic oligonucleotide
  Target: ATXN1; (+) strand; PAM type: NRG; PAM sequence: AGG
ggcgctggaggccacatatc

SEQ ID NO: 126125 - DNA, 20 bp, Artificial Sequence
  Description of Artificial Sequence: Synthetic oligonucleotide
  Target: ATXN1; (+) strand; PAM type: NRG; PAM sequence: GAG
ggccacatatcaggctgact

SEQ ID NO: 126126 - DNA, 20 bp, Artificial Sequence
  Description of Artificial Sequence: Synthetic oligonucleotide
  Target: ATXN1; (+) strand; PAM type: NRG; PAM sequence: GAG
ggctgactgagtaatcccgt

SEQ ID NO: 126127 - DNA, 20 bp, Artificial Sequence
  Description of Artificial Sequence: Synthetic oligonucleotide
  Target: ATXN1; (+) strand; PAM type: NRG; PAM sequence: AGG
gctgactgagtaatcccgtg

SEQ ID NO: 126128 - DNA, 20 bp, Artificial Sequence
  Description of Artificial Sequence: Synthetic oligonucleotide
  Target: ATXN1; (+) strand; PAM type: NRG; PAM sequence: AAG
gactgagtaatcccgtgagg

SEQ ID NO: 126129 - DNA, 20 bp, Artificial Sequence
  Description of Artificial Sequence: Synthetic oligonucleotide
  Target: ATXN1; (+) strand; PAM type: NRG; PAM sequence: CAG
gtaatcccgtgaggaagcca

SEQ ID NO: 126130 - DNA, 20 bp, Artificial Sequence
  Description of Artificial Sequence: Synthetic oligonucleotide
  Target: ATXN1; (+) strand; PAM type: NRG; PAM sequence: GAG
gtgaggaagccacagtgtct

SEQ ID NO: 126131 - DNA, 20 bp, Artificial Sequence
  Description of Artificial Sequence: Synthetic oligonucleotide
  Target: ATXN1; (+) strand; PAM type: NRG; PAM sequence: CGG
cacagtgtctgagatactga

SEQ ID NO: 126132 - DNA, 20 bp, Artificial Sequence
  Description of Artificial Sequence: Synthetic oligonucleotide
  Target: ATXN1; (+) strand; PAM type: NRG; PAM sequence: GGG
acagtgtctgagatactgac

SEQ ID NO: 126133 - DNA, 20 bp, Artificial Sequence
  Description of Artificial Sequence: Synthetic oligonucleotide
  Target: ATXN1; (+) strand; PAM type: NRG; PAM sequence: AAG
agatactgacgggccaaaca

SEQ ID NO: 126134 - DNA, 20 bp, Artificial Sequence
  Description of Artificial Sequence: Synthetic oligonucleotide
  Target: ATXN1; (+) strand; PAM type: NRG; PAM sequence: TGG
ctgacgggccaaacaaagtg

SEQ ID NO: 126135 - DNA, 20 bp, Artificial Sequence
  Description of Artificial Sequence: Synthetic oligonucleotide
  Target: ATXN1; (+) strand; PAM type: NRG; PAM sequence: GGG
tgacgggccaaacaaagtgt

SEQ ID NO: 126136 - DNA, 20 bp, Artificial Sequence
  Description of Artificial Sequence: Synthetic oligonucleotide
  Target: ATXN1; (+) strand; PAM type: NRG; PAM sequence: AAG
gggccaaacaaagtgtggga

SEQ ID NO: 126137 - DNA, 20 bp, Artificial Sequence
  Description of Artificial Sequence: Synthetic oligonucleotide
  Target: ATXN1; (+) strand; PAM type: NRG; PAM sequence: CAG
aaacaaagtgtgggaaagaa

SEQ ID NO: 126138 - DNA, 20 bp, Artificial Sequence
  Description of Artificial Sequence: Synthetic oligonucleotide
  Target: ATXN1; (+) strand; PAM type: NRG; PAM sequence: GAG
acaaagtgtgggaaagaaca

SEQ ID NO: 126139 - DNA, 20 bp, Artificial Sequence
  Description of Artificial Sequence: Synthetic oligonucleotide
  Target: ATXN1; (+) strand; PAM type: NRG; PAM sequence: TGG
aacagagatgatgtgaatgt

SEQ ID NO: 126140 - DNA, 20 bp, Artificial Sequence
  Description of Artificial Sequence: Synthetic oligonucleotide
  Target: ATXN1; (+) strand; PAM type: NRG; PAM sequence: CAG
gagatgatgtgaatgttgga

SEQ ID NO: 126141 - DNA, 20 bp, Artificial Sequence
  Description of Artificial Sequence: Synthetic oligonucleotide
  Target: ATXN1; (+) strand; PAM type: NRG; PAM sequence: GAG
gatgatgtgaatgttggaca

SEQ ID NO: 126142 - DNA, 20 bp, Artificial Sequence
  Description of Artificial Sequence: Synthetic oligonucleotide
  Target: ATXN1; (+) strand; PAM type: NRG; PAM sequence: AGG
atgatgtgaatgttggacag

SEQ ID NO: 126143 - DNA, 20 bp, Artificial Sequence
  Description of Artificial Sequence: Synthetic oligonucleotide
  Target: ATXN1; (+) strand; PAM type: NRG; PAM sequence: AAG
atgtgaatgttggacagagg

SEQ ID NO: 126144 - DNA, 20 bp, Artificial Sequence
  Description of Artificial Sequence: Synthetic oligonucleotide
  Target: ATXN1; (+) strand; PAM type: NRG; PAM sequence: AAG
gttggacagaggaagcctga

SEQ ID NO: 126145 - DNA, 20 bp, Artificial Sequence
  Description of Artificial Sequence: Synthetic oligonucleotide
  Target: ATXN1; (+) strand; PAM type: NRG; PAM sequence: AAG
gacagaggaagcctgaaaga

SEQ ID NO: 126146 - DNA, 20 bp, Artificial Sequence
  Description of Artificial Sequence: Synthetic oligonucleotide
  Target: ATXN1; (+) strand; PAM type: NRG; PAM sequence: AGG
acagaggaagcctgaaagaa

SEQ ID NO: 126147 - DNA, 20 bp, Artificial Sequence
  Description of Artificial Sequence: Synthetic oligonucleotide
  Target: ATXN1; (+) strand; PAM type: NRG; PAM sequence: GGG
cagaggaagcctgaaagaaa

SEQ ID NO: 126148 - DNA, 20 bp, Artificial Sequence
  Description of Artificial Sequence: Synthetic oligonucleotide
  Target: ATXN1; (+) strand; PAM type: NRG; PAM sequence: GAG
gaggaagcctgaaagaaagg

SEQ ID NO: 126149 - DNA, 20 bp, Artificial Sequence
  Description of Artificial Sequence: Synthetic oligonucleotide
  Target: ATXN1; (+) strand; PAM type: NRG; PAM sequence: AAG
agcctgaaagaaagggagat

SEQ ID NO: 126150 - DNA, 20 bp, Artificial Sequence
  Description of Artificial Sequence: Synthetic oligonucleotide
  Target: ATXN1; (+) strand; PAM type: NRG; PAM sequence: AGG
gcctgaaagaaagggagata

SEQ ID NO: 126151 - DNA, 20 bp, Artificial Sequence
  Description of Artificial Sequence: Synthetic oligonucleotide
  Target: ATXN1; (+) strand; PAM type: NRG; PAM sequence: GGG
cctgaaagaaagggagataa

SEQ ID NO: 126152 - DNA, 20 bp, Artificial Sequence
  Description of Artificial Sequence: Synthetic oligonucleotide
  Target: ATXN1; (+) strand; PAM type: NRG; PAM sequence: GAG
tgaaagaaagggagataagg

SEQ ID NO: 126153 - DNA, 20 bp, Artificial Sequence
  Description of Artificial Sequence: Synthetic oligonucleotide
  Target: ATXN1; (+) strand; PAM type: NRG; PAM sequence: CGG
aaagggagataagggagcga

SEQ ID NO: 126154 - DNA, 20 bp, Artificial Sequence
  Description of Artificial Sequence: Synthetic oligonucleotide
  Target: ATXN1; (+) strand; PAM type: NRG; PAM sequence: CAG
agataagggagcgacggcaa

SEQ ID NO: 126155 - DNA, 20 bp, Artificial Sequence
  Description of Artificial Sequence: Synthetic oligonucleotide
  Target: ATXN1; (+) strand; PAM type: NRG; PAM sequence: AAG
ctatttaatctacaccacac

SEQ ID NO: 126156 - DNA, 20 bp, Artificial Sequence
  Description of Artificial Sequence: Synthetic oligonucleotide
  Target: ATXN1; (+) strand; PAM type: NRG; PAM sequence: AGG
tatttaatctacaccacaca

SEQ ID NO: 126157 - DNA, 20 bp, Artificial Sequence
  Description of Artificial Sequence: Synthetic oligonucleotide
  Target: ATXN1; (+) strand; PAM type: NRG; PAM sequence: AAG
tctacaccacacaaggaact

SEQ ID NO: 126158 - DNA, 20 bp, Artificial Sequence
  Description of Artificial Sequence: Synthetic oligonucleotide
  Target: ATXN1; (+) strand; PAM type: NRG; PAM sequence: AAG
ccacacaaggaactaagttc

SEQ ID NO: 126159 - DNA, 20 bp, Artificial Sequence
  Description of Artificial Sequence: Synthetic oligonucleotide
  Target: ATXN1; (+) strand; PAM type: NRG; PAM sequence: CAG
tccaactcaacaataatctc

SEQ ID NO: 126160 - DNA, 20 bp, Artificial Sequence
  Description of Artificial Sequence: Synthetic oligonucleotide
  Target: ATXN1; (+) strand; PAM type: NRG; PAM sequence: GAG
caactcaacaataatctcca

SEQ ID NO: 126161 - DNA, 20 bp, Artificial Sequence
  Description of Artificial Sequence: Synthetic oligonucleotide
  Target: ATXN1; (+) strand; PAM type: NRG; PAM sequence: AAG
aatctccagagactatttta

SEQ ID NO: 126162 - DNA, 20 bp, Artificial Sequence
  Description of Artificial Sequence: Synthetic oligonucleotide
  Target: ATXN1; (+) strand; PAM type: NRG; PAM sequence: CAG
ctattttaaagacgcctttg

SEQ ID NO: 126163 - DNA, 20 bp, Artificial Sequence
  Description of Artificial Sequence: Synthetic oligonucleotide
  Target: ATXN1; (+) strand; PAM type: NRG; PAM sequence: AGG
tattttaaagacgcctttgc

SEQ ID NO: 126164 - DNA, 20 bp, Artificial Sequence
  Description of Artificial Sequence: Synthetic oligonucleotide
  Target: ATXN1; (+) strand; PAM type: NRG; PAM sequence: AAG
aaagacgcctttgcaggttt

SEQ ID NO: 126165 - DNA, 20 bp, Artificial Sequence
  Description of Artificial Sequence: Synthetic oligonucleotide
  Target: ATXN1; (+) strand; PAM type: NRG; PAM sequence: GAG
agacgcctttgcaggtttaa

SEQ ID NO: 126166 - DNA, 20 bp, Artificial Sequence
  Description of Artificial Sequence: Synthetic oligonucleotide
  Target: ATXN1; (+) strand; PAM type: NRG; PAM sequence: GAG
acgcctttgcaggtttaaga

SEQ ID NO: 126167 - DNA, 20 bp, Artificial Sequence
  Description of Artificial Sequence: Synthetic oligonucleotide
  Target: ATXN1; (+) strand; PAM type: NRG; PAM sequence: AGG
cgcctttgcaggtttaagag

SEQ ID NO: 126168 - DNA, 20 bp, Artificial Sequence
  Description of Artificial Sequence: Synthetic oligonucleotide
  Target: ATXN1; (+) strand; PAM type: NRG; PAM sequence: GAG
gcaggtttaagagaggctgt

SEQ ID NO: 126169 - DNA, 20 bp, Artificial Sequence
  Description of Artificial Sequence: Synthetic oligonucleotide
  Target: ATXN1; (+) strand; PAM type: NRG; PAM sequence: AGG
caggtttaagagaggctgtg

SEQ ID NO: 126170 - DNA, 20 bp, Artificial Sequence
  Description of Artificial Sequence: Synthetic oligonucleotide
  Target: ATXN1; (+) strand; PAM type: NRG; PAM sequence: AAG
ttaagagaggctgtgaggca

SEQ ID NO: 126171 - DNA, 20 bp, Artificial Sequence
  Description of Artificial Sequence: Synthetic oligonucleotide
  Target: ATXN1; (+) strand; PAM type: NRG; PAM sequence: CAG
gctgtgaggcaaagctattc

SEQ ID NO: 126172 - DNA, 20 bp, Artificial Sequence
  Description of Artificial Sequence: Synthetic oligonucleotide
  Target: ATXN1; (+) strand; PAM type: NRG; PAM sequence: TGG
ttccagctcctgatgttctg

SEQ ID NO: 126173 - DNA, 20 bp, Artificial Sequence
  Description of Artificial Sequence: Synthetic oligonucleotide
  Target: ATXN1; (+) strand; PAM type: NRG; PAM sequence: GGG
tccagctcctgatgttctgt

SEQ ID NO: 126174 - DNA, 20 bp, Artificial Sequence
  Description of Artificial Sequence: Synthetic oligonucleotide
  Target: ATXN1; (+) strand; PAM type: NRG; PAM sequence: AAG
gctcctgatgttctgtgggc

SEQ ID NO: 126175 - DNA, 20 bp, Artificial Sequence
  Description of Artificial Sequence: Synthetic oligonucleotide
  Target: ATXN1; (+) strand; PAM type: NRG; PAM sequence: CAG
tgttctgtgggcaagtttcc

SEQ ID NO: 126176 - DNA, 20 bp, Artificial Sequence
  Description of Artificial Sequence: Synthetic oligonucleotide
  Target: ATXN1; (+) strand; PAM type: NRG; PAM sequence: AGG
gttctgtgggcaagtttccc

SEQ ID NO: 126177 - DNA, 20 bp, Artificial Sequence
  Description of Artificial Sequence: Synthetic oligonucleotide
  Target: ATXN1; (+) strand; PAM type: NRG; PAM sequence: CAG
gggcaagtttcccaggattc

SEQ ID NO: 126178 - DNA, 20 bp, Artificial Sequence
  Description of Artificial Sequence: Synthetic oligonucleotide
  Target: ATXN1; (+) strand; PAM type: NRG; PAM sequence: TGG
tcccaggattccagcatctt

SEQ ID NO: 126179 - DNA, 20 bp, Artificial Sequence
  Description of Artificial Sequence: Synthetic oligonucleotide
  Target: ATXN1; (+) strand; PAM type: NRG; PAM sequence: GGG
cccaggattccagcatcttt

SEQ ID NO: 126180 - DNA, 20 bp, Artificial Sequence
  Description of Artificial Sequence: Synthetic oligonucleotide
  Target: ATXN1; (+) strand; PAM type: NRG; PAM sequence: GAG
atctttgggattcattctat

SEQ ID NO: 126181 - DNA, 20 bp, Artificial Sequence
  Description of Artificial Sequence: Synthetic oligonucleotide
  Target: ATXN1; (+) strand; PAM type: NRG; PAM sequence: TGG
gggattcattctatgagctg

SEQ ID NO: 126182 - DNA, 20 bp, Artificial Sequence
  Description of Artificial Sequence: Synthetic oligonucleotide
  Target: ATXN1; (+) strand; PAM type: NRG; PAM sequence: AAG
attcattctatgagctgtgg

SEQ ID NO: 126183 - DNA, 20 bp, Artificial Sequence
  Description of Artificial Sequence: Synthetic oligonucleotide
  Target: ATXN1; (+) strand; PAM type: NRG; PAM sequence: AGG
ttcattctatgagctgtgga

SEQ ID NO: 126184 - DNA, 20 bp, Artificial Sequence
  Description of Artificial Sequence: Synthetic oligonucleotide
  Target: ATXN1; (+) strand; PAM type: NRG; PAM sequence: CAG
ctatgagctgtggaaggcca

SEQ ID NO: 126185 - DNA, 20 bp, Artificial Sequence
  Description of Artificial Sequence: Synthetic oligonucleotide
  Target: ATXN1; (+) strand; PAM type: NRG; PAM sequence: CAG
agctttcccgcccttttcat

SEQ ID NO: 126186 - DNA, 20 bp, Artificial Sequence
  Description of Artificial Sequence: Synthetic oligonucleotide
  Target: ATXN1; (+) strand; PAM type: NRG; PAM sequence: GAG
ctttcccgcccttttcatca

SEQ ID NO: 126187 - DNA, 20 bp, Artificial Sequence
  Description of Artificial Sequence: Synthetic oligonucleotide
  Target: ATXN1; (+) strand; PAM type: NRG; PAM sequence: AGG
tttcccgcccttttcatcag

SEQ ID NO: 126188 - DNA, 20 bp, Artificial Sequence
  Description of Artificial Sequence: Synthetic oligonucleotide
  Target: ATXN1; (+) strand; PAM type: NRG; PAM sequence: TGG
gcccttttcatcagaggacg

SEQ ID NO: 126189 - DNA, 20 bp, Artificial Sequence
  Description of Artificial Sequence: Synthetic oligonucleotide
  Target: ATXN1; (+) strand; PAM type: NRG; PAM sequence: CGG
ttttcatcagaggacgtgga

SEQ ID NO: 126190 - DNA, 20 bp, Artificial Sequence
  Description of Artificial Sequence: Synthetic oligonucleotide
  Target: ATXN1; (+) strand; PAM type: NRG; PAM sequence: TGG
cagaggacgtggacggcatg

SEQ ID NO: 126191 - DNA, 20 bp, Artificial Sequence
  Description of Artificial Sequence: Synthetic oligonucleotide
  Target: ATXN1; (+) strand; PAM type: NRG; PAM sequence: CGG
ggacgtggacggcatgtggc

SEQ ID NO: 126192 - DNA, 20 bp, Artificial Sequence
  Description of Artificial Sequence: Synthetic oligonucleotide
  Target: ATXN1; (+) strand; PAM type: NRG; PAM sequence: CAG
gacggcatgtggccggccac

SEQ ID NO: 126193 - DNA, 20 bp, Artificial Sequence
  Description of Artificial Sequence: Synthetic oligonucleotide
  Target: ATXN1; (+) strand; PAM type: NRG; PAM sequence: AGG
acggcatgtggccggccacc

SEQ ID NO: 126194 - DNA, 20 bp, Artificial Sequence
  Description of Artificial Sequence: Synthetic oligonucleotide
  Target: ATXN1; (+) strand; PAM type: NRG; PAM sequence: GGG
cggcatgtggccggccacca

SEQ ID NO: 126195 - DNA, 20 bp, Artificial Sequence
  Description of Artificial Sequence: Synthetic oligonucleotide
  Target: ATXN1; (+) strand; PAM type: NRG; PAM sequence: CAG
catgtggccggccaccaggg

SEQ ID NO: 126196 - DNA, 20 bp, Artificial Sequence
  Description of Artificial Sequence: Synthetic oligonucleotide
  Target: ATXN1; (+) strand; PAM type: NRG; PAM sequence: AGG
atgtggccggccaccagggc

SEQ ID NO: 126197 - DNA, 20 bp, Artificial Sequence
  Description of Artificial Sequence: Synthetic oligonucleotide
  Target: ATXN1; (+) strand; PAM type: NRG; PAM sequence: TAG
ggccggccaccagggcagga

SEQ ID NO: 126198 - DNA, 20 bp, Artificial Sequence
  Description of Artificial Sequence: Synthetic oligonucleotide
  Target: ATXN1; (+) strand; PAM type: NRG; PAM sequence: GAG
ccggccaccagggcaggata

SEQ ID NO: 126199 - DNA, 20 bp, Artificial Sequence
  Description of Artificial Sequence: Synthetic oligonucleotide
  Target: ATXN1; (+) strand; PAM type: NRG; PAM sequence: CAG
agggcaggatagagcttttt

SEQ ID NO: 126200 - DNA, 20 bp, Artificial Sequence
  Description of Artificial Sequence: Synthetic oligonucleotide
  Target: ATXN1; (+) strand; PAM type: NRG; PAM sequence: AGG
gggcaggatagagctttttc

SEQ ID NO: 126201 - DNA, 20 bp, Artificial Sequence
  Description of Artificial Sequence: Synthetic oligonucleotide
  Target: ATXN1; (+) strand; PAM type: NRG; PAM sequence: TGG
aggatagagctttttcagga

SEQ ID NO: 126202 - DNA, 20 bp, Artificial Sequence
  Description of Artificial Sequence: Synthetic oligonucleotide
  Target: ATXN1; (+) strand; PAM type: NRG; PAM sequence: CAG
gctttttcaggatggcccac

SEQ ID NO: 126203 - DNA, 20 bp, Artificial Sequence
  Description of Artificial Sequence: Synthetic oligonucleotide
  Target: ATXN1; (+) strand; PAM type: NRG; PAM sequence: CAG
caggatggcccaccagcctg

SEQ ID NO: 126204 - DNA, 20 bp, Artificial Sequence
  Description of Artificial Sequence: Synthetic oligonucleotide
  Target: ATXN1; (+) strand; PAM type: NRG; PAM sequence: AGG
aggatggcccaccagcctgc

SEQ ID NO: 126205 - DNA, 20 bp, Artificial Sequence
  Description of Artificial Sequence: Synthetic oligonucleotide
  Target: ATXN1; (+) strand; PAM type: NRG; PAM sequence: AAG
atggcccaccagcctgcagg

SEQ ID NO: 126206 - DNA, 20 bp, Artificial Sequence
  Description of Artificial Sequence: Synthetic oligonucleotide
  Target: ATXN1; (+) strand; PAM type: NRG; PAM sequence: CAG
ccagcctgcaggaagattcc

SEQ ID NO: 126207 - DNA, 20 bp, Artificial Sequence
  Description of Artificial Sequence: Synthetic oligonucleotide
  Target: ATXN1; (+) strand; PAM type: NRG; PAM sequence: CAG
tgcaggaagattcccagact

SEQ ID NO: 126208 - DNA, 20 bp, Artificial Sequence
  Description of Artificial Sequence: Synthetic oligonucleotide
  Target: ATXN1; (+) strand; PAM type: NRG; PAM sequence: CAG
gattcccagactcagttcct

SEQ ID NO: 126209 - DNA, 20 bp, Artificial Sequence
  Description of Artificial Sequence: Synthetic oligonucleotide
  Target: ATXN1; (+) strand; PAM type: NRG; PAM sequence: AAG
actcagttcctcagaatctg

SEQ ID NO: 126210 - DNA, 20 bp, Artificial Sequence
  Description of Artificial Sequence: Synthetic oligonucleotide
  Target: ATXN1; (+) strand; PAM type: NRG; PAM sequence: AGG
ctcagttcctcagaatctga

SEQ ID NO: 126211 - DNA, 20 bp, Artificial Sequence
  Description of Artificial Sequence: Synthetic oligonucleotide
  Target: ATXN1; (+) strand; PAM type: NRG; PAM sequence: GGG
tcagttcctcagaatctgaa

SEQ ID NO: 126212 - DNA, 20 bp, Artificial Sequence
  Description of Artificial Sequence: Synthetic oligonucleotide
  Target: ATXN1; (+) strand; PAM type: NRG; PAM sequence: AAG
aatctgaagggcactcctcc

SEQ ID NO: 126213 - DNA, 20 bp, Artificial Sequence
  Description of Artificial Sequence: Synthetic oligonucleotide
  Target: ATXN1; (+) strand; PAM type: NRG; PAM sequence: CAG
gggcactcctccaagtccca

SEQ ID NO: 126214 - DNA, 20 bp, Artificial Sequence
  Description of Artificial Sequence: Synthetic oligonucleotide
  Target: ATXN1; (+) strand; PAM type: NRG; PAM sequence: GAG
gcactcctccaagtcccaca

SEQ ID NO: 126215 - DNA, 20 bp, Artificial Sequence
  Description of Artificial Sequence: Synthetic oligonucleotide
  Target: ATXN1; (+) strand; PAM type: NRG; PAM sequence: CAG
ctcctccaagtcccacagag

SEQ ID NO: 126216 - DNA, 20 bp, Artificial Sequence
  Description of Artificial Sequence: Synthetic oligonucleotide
  Target: ATXN1; (+) strand; PAM type: NRG; PAM sequence: AAG
agtcccacagagcagcccac

SEQ ID NO: 126217 - DNA, 20 bp, Artificial Sequence
  Description of Artificial Sequence: Synthetic oligonucleotide
  Target: ATXN1; (+) strand; PAM type: NRG; PAM sequence: CAG
ttaacatgacacttactatg

SEQ ID NO: 126218 - DNA, 20 bp, Artificial Sequence
  Description of Artificial Sequence: Synthetic oligonucleotide
  Target: ATXN1; (+) strand; PAM type: NRG; PAM sequence: CAG
catgacacttactatgcagt

SEQ ID NO: 126219 - DNA, 20 bp, Artificial Sequence
  Description of Artificial Sequence: Synthetic oligonucleotide
  Target: ATXN1; (+) strand; PAM type: NRG; PAM sequence: TAG
actatgcagtcagactatcc

SEQ ID NO: 126220 - DNA, 20 bp, Artificial Sequence
  Description of Artificial Sequence: Synthetic oligonucleotide
  Target: ATXN1; (+) strand; PAM type: NRG; PAM sequence: AGG
ctatgcagtcagactatcct

SEQ ID NO: 126221 - DNA, 20 bp, Artificial Sequence
  Description of Artificial Sequence: Synthetic oligonucleotide
  Target: ATXN1; (+) strand; PAM type: NRG; PAM sequence: TAG
gcagtcagactatcctaggc

SEQ ID NO: 126222 - DNA, 20 bp, Artificial Sequence
  Description of Artificial Sequence: Synthetic oligonucleotide
  Target: ATXN1; (+) strand; PAM type: NRG; PAM sequence: AGG
cagtcagactatcctaggct

SEQ ID NO: 126223 - DNA, 20 bp, Artificial Sequence
  Description of Artificial Sequence: Synthetic oligonucleotide
  Target: ATXN1; (+) strand; PAM type: NRG; PAM sequence: TGG
tcagactatcctaggctagg

SEQ ID NO: 126224 - DNA, 20 bp, Artificial Sequence
  Description of Artificial Sequence: Synthetic oligonucleotide
  Target: ATXN1; (+) strand; PAM type: NRG; PAM sequence: GGG
cagactatcctaggctaggt

SEQ ID NO: 126225 - DNA, 20 bp, Artificial Sequence
  Description of Artificial Sequence: Synthetic oligonucleotide
  Target: ATXN1; (+) strand; PAM type: NRG; PAM sequence: GGG
agactatcctaggctaggtg

SEQ ID NO: 126226 - DNA, 20 bp, Artificial Sequence
  Description of Artificial Sequence: Synthetic oligonucleotide
  Target: ATXN1; (+) strand; PAM type: NRG; PAM sequence: AAG
ctaggctaggtggggctgca

SEQ ID NO: 126227 - DNA, 20 bp, Artificial Sequence
  Description of Artificial Sequence: Synthetic oligonucleotide
  Target: ATXN1; (+) strand; PAM type: NRG; PAM sequence: AAG
taggtggggctgcaaagaca

SEQ ID NO: 126228 - DNA, 20 bp, Artificial Sequence
  Description of Artificial Sequence: Synthetic oligonucleotide
  Target: ATXN1; (+) strand; PAM type: NRG; PAM sequence: AGG
aggtggggctgcaaagacaa

SEQ ID NO: 126229 - DNA, 20 bp, Artificial Sequence
  Description of Artificial Sequence: Synthetic oligonucleotide
  Target: ATXN1; (+) strand; PAM type: NRG; PAM sequence: CAG
ctccaattgaaaaaaactgc

SEQ ID NO: 126230 - DNA, 20 bp, Artificial Sequence
  Description of Artificial Sequence: Synthetic oligonucleotide
  Target: ATXN1; (+) strand; PAM type: NRG; PAM sequence: AAG
aattgaaaaaaactgccaga

SEQ ID NO: 126231 - DNA, 20 bp, Artificial Sequence
  Description of Artificial Sequence: Synthetic oligonucleotide
  Target: ATXN1; (+) strand; PAM type: NRG; PAM sequence: TGG
gccatgcaaacattgaaaaa

SEQ ID NO: 126232 - DNA, 20 bp, Artificial Sequence
  Description of Artificial Sequence: Synthetic oligonucleotide
  Target: ATXN1; (+) strand; PAM type: NRG; PAM sequence: TAG
atgcaaacattgaaaaatgg

SEQ ID NO: 126233 - DNA, 20 bp, Artificial Sequence
  Description of Artificial Sequence: Synthetic oligonucleotide
  Target: ATXN1; (+) strand; PAM type: NRG; PAM sequence: TGG
cattgaaaaatggtagatac

SEQ ID NO: 126234 - DNA, 20 bp, Artificial Sequence
  Description of Artificial Sequence: Synthetic oligonucleotide
  Target: ATXN1; (+) strand; PAM type: NRG; PAM sequence: GAG
tagatactggcaaaatctct

SEQ ID NO: 126235 - DNA, 20 bp, Artificial Sequence
  Description of Artificial Sequence: Synthetic oligonucleotide
  Target: ATXN1; (+) strand; PAM type: NRG; PAM sequence: AAG
tgagtatcttcttcgtttta

SEQ ID NO: 126236 - DNA, 20 bp, Artificial Sequence
  Description of Artificial Sequence: Synthetic oligonucleotide
  Target: ATXN1; (+) strand; PAM type: NRG; PAM sequence: CAG
tgaccttttcatcctaacaa

SEQ ID NO: 126237 - DNA, 20 bp, Artificial Sequence
  Description of Artificial Sequence: Synthetic oligonucleotide
  Target: ATXN1; (+) strand; PAM type: NRG; PAM sequence: GAG
ttttcatcctaacaacagac

SEQ ID NO: 126238 - DNA, 20 bp, Artificial Sequence
  Description of Artificial Sequence: Synthetic oligonucleotide
  Target: ATXN1; (+) strand; PAM type: NRG; PAM sequence: CAG
aacaacagacgagacgtcta

SEQ ID NO: 126239 - DNA, 20 bp, Artificial Sequence
  Description of Artificial Sequence: Synthetic oligonucleotide
  Target: ATXN1; (+) strand; PAM type: NRG; PAM sequence: GAG
cgtctacagtacgaattctt

SEQ ID NO: 126240 - DNA, 20 bp, Artificial Sequence
  Description of Artificial Sequence: Synthetic oligonucleotide
  Target: ATXN1; (+) strand; PAM type: NRG; PAM sequence: AAG
gaccacgaaaactgatttca

SEQ ID NO: 126241 - DNA, 20 bp, Artificial Sequence
  Description of Artificial Sequence: Synthetic oligonucleotide
  Target: ATXN1; (+) strand; PAM type: NRG; PAM sequence: CAG
acgaaaactgatttcaaagt

SEQ ID NO: 126242 - DNA, 20 bp, Artificial Sequence
  Description of Artificial Sequence: Synthetic oligonucleotide
  Target: ATXN1; (+) strand; PAM type: NRG; PAM sequence: CAG
ctgatttcaaagtcagacct

SEQ ID NO: 126243 - DNA, 20 bp, Artificial Sequence
  Description of Artificial Sequence: Synthetic oligonucleotide
  Target: ATXN1; (+) strand; PAM type: NRG; PAM sequence: GAG
tcaaagtcagacctcagtct

SEQ ID NO: 126244 - DNA, 20 bp, Artificial Sequence
  Description of Artificial Sequence: Synthetic oligonucleotide
  Target: ATXN1; (+) strand; PAM type: NRG; PAM sequence: CAG
tcagacctcagtctgagcct

SEQ ID NO: 126245 - DNA, 20 bp, Artificial Sequence
  Description of Artificial Sequence: Synthetic oligonucleotide
  Target: ATXN1; (+) strand; PAM type: NRG; PAM sequence: GAG
cctcagtctgagcctcagct

SEQ ID NO: 126246 - DNA, 20 bp, Artificial Sequence
  Description of Artificial Sequence: Synthetic oligonucleotide
  Target: ATXN1; (+) strand; PAM type: NRG; PAM sequence: CAG
tctgagcctcagctgagtca

SEQ ID NO: 126247 - DNA, 20 bp, Artificial Sequence
  Description of Artificial Sequence: Synthetic oligonucleotide
  Target: ATXN1; (+) strand; PAM type: NRG; PAM sequence: GAG
tgagcctcagctgagtcaca

SEQ ID NO: 126248 - DNA, 20 bp, Artificial Sequence
  Description of Artificial Sequence: Synthetic oligonucleotide
  Target: ATXN1; (+) strand; PAM type: NRG; PAM sequence: AGG
gagcctcagctgagtcacag

SEQ ID NO: 126249 - DNA, 20 bp, Artificial Sequence
  Description of Artificial Sequence: Synthetic oligonucleotide
  Target: ATXN1; (+) strand; PAM type: NRG; PAM sequence: GAG
gcctcagctgagtcacagag

SEQ ID NO: 126250 - DNA, 20 bp, Artificial Sequence
  Description of Artificial Sequence: Synthetic oligonucleotide
  Target: ATXN1; (+) strand; PAM type: NRG; PAM sequence: TGG
tgagtcacagaggagctgtg

SEQ ID NO: 126251 - DNA, 20 bp, Artificial Sequence
  Description of Artificial Sequence: Synthetic oligonucleotide
  Target: ATXN1; (+) strand; PAM type: NRG; PAM sequence: CAG
acagaggagctgtgtggttc

SEQ ID NO: 126252 - DNA, 20 bp, Artificial Sequence
  Description of Artificial Sequence: Synthetic oligonucleotide
  Target: ATXN1; (+) strand; PAM type: NRG; PAM sequence: TGG
ccctttcctcatttgtataa

SEQ ID NO: 126253 - DNA, 20 bp, Artificial Sequence
  Description of Artificial Sequence: Synthetic oligonucleotide
  Target: ATXN1; (+) strand; PAM type: NRG; PAM sequence: TAG
caataacaatatcgacttca

SEQ ID NO: 126254 - DNA, 20 bp, Artificial Sequence
  Description of Artificial Sequence: Synthetic oligonucleotide
  Target: ATXN1; (+) strand; PAM type: NRG; PAM sequence: TAG
tcgacttcatagaatgtttc

SEQ ID NO: 126255 - DNA, 20 bp, Artificial Sequence
  Description of Artificial Sequence: Synthetic oligonucleotide
  Target: ATXN1; (+) strand; PAM type: NRG; PAM sequence: TAG
catagaatgtttctagtttt

SEQ ID NO: 126256 - DNA, 20 bp, Artificial Sequence
  Description of Artificial Sequence: Synthetic oligonucleotide
  Target: ATXN1; (+) strand; PAM type: NRG; PAM sequence: TGG
aatgtttctagtttttagtg

SEQ ID NO: 126257 - DNA, 20 bp, Artificial Sequence
  Description of Artificial Sequence: Synthetic oligonucleotide
  Target: ATXN1; (+) strand; PAM type: NRG; PAM sequence: TGG
ctagtttttagtgtggcgct

SEQ ID NO: 126258 - DNA, 20 bp, Artificial Sequence
  Description of Artificial Sequence: Synthetic oligonucleotide
  Target: ATXN1; (+) strand; PAM type: NRG; PAM sequence: CAG
ttagtgtggcgcttggtaca

SEQ ID NO: 126259 - DNA, 20 bp, Artificial Sequence
  Description of Artificial Sequence: Synthetic oligonucleotide
  Target: ATXN1; (+) strand; PAM type: NRG; PAM sequence: AAG
gtgtggcgcttggtacacag

SEQ ID NO: 126260 - DNA, 20 bp, Artificial Sequence
  Description of Artificial Sequence: Synthetic oligonucleotide
  Target: ATXN1; (+) strand; PAM type: NRG; PAM sequence: GAG
gtggcgcttggtacacagaa

SEQ ID NO: 126261 - DNA, 20 bp, Artificial Sequence
  Description of Artificial Sequence: Synthetic oligonucleotide
  Target: ATXN1; (+) strand; PAM type: NRG; PAM sequence: AAG
aagagactgaataaaacaaa

SEQ ID NO: 126262 - DNA, 20 bp, Artificial Sequence
  Description of Artificial Sequence: Synthetic oligonucleotide
  Target: ATXN1; (+) strand; PAM type: NRG; PAM sequence: AGG
agagactgaataaaacaaaa

SEQ ID NO: 126263 - DNA, 20 bp, Artificial Sequence
  Description of Artificial Sequence: Synthetic oligonucleotide
  Target: ATXN1; (+) strand; PAM type: NRG; PAM sequence: TGG
aaaaaggcattatcaccatt

SEQ ID NO: 126264 - DNA, 20 bp, Artificial Sequence
  Description of Artificial Sequence: Synthetic oligonucleotide
  Target: ATXN1; (+) strand; PAM type: NRG; PAM sequence: TGG
tgttcatatatctgtaacaa

SEQ ID NO: 126265 - DNA, 20 bp, Artificial Sequence
  Description of Artificial Sequence: Synthetic oligonucleotide
  Target: ATXN1; (+) strand; PAM type: NRG; PAM sequence: GAG
ttcatatatctgtaacaatg

SEQ ID NO: 126266 - DNA, 20 bp, Artificial Sequence
  Description of Artificial Sequence: Synthetic oligonucleotide
  Target: ATXN1; (+) strand; PAM type: NRG; PAM sequence: AGG
tcatatatctgtaacaatgg

SEQ ID NO: 126267 - DNA, 20 bp, Artificial Sequence
  Description of Artificial Sequence: Synthetic oligonucleotide
  Target: ATXN1; (+) strand; PAM type: NRG; PAM sequence: AAG
atatctgtaacaatggagga

SEQ ID NO: 126268 - DNA, 20 bp, Artificial Sequence
  Description of Artificial Sequence: Synthetic oligonucleotide
  Target: ATXN1; (+) strand; PAM type: NRG; PAM sequence: CAG
gtaacaatggaggaaagaca

SEQ ID NO: 126269 - DNA, 20 bp, Artificial Sequence
  Description of Artificial Sequence: Synthetic oligonucleotide
  Target: ATXN1; (+) strand; PAM type: NRG; PAM sequence: AGG
taacaatggaggaaagacac

SEQ ID NO: 126270 - DNA, 20 bp, Artificial Sequence
  Description of Artificial Sequence: Synthetic oligonucleotide
  Target: ATXN1; (+) strand; PAM type: NRG; PAM sequence: GAG
acaatggaggaaagacacag

SEQ ID NO: 126271 - DNA, 20 bp, Artificial Sequence
  Description of Artificial Sequence: Synthetic oligonucleotide
  Target: ATXN1; (+) strand; PAM type: NRG; PAM sequence: GAG
aatggaggaaagacacagga

SEQ ID NO: 126272 - DNA, 20 bp, Artificial Sequence
  Description of Artificial Sequence: Synthetic oligonucleotide
  Target: ATXN1; (+) strand; PAM type: NRG; PAM sequence: TGG
gaaagacacaggagagactt

SEQ ID NO: 126273 - DNA, 20 bp, Artificial Sequence
  Description of Artificial Sequence: Synthetic oligonucleotide
  Target: ATXN1; (+) strand; PAM type: NRG; PAM sequence: CAG
ttggtgacttaataatttgc

SEQ ID NO: 126274 - DNA, 20 bp, Artificial Sequence
  Description of Artificial Sequence: Synthetic oligonucleotide
  Target: ATXN1; (+) strand; PAM type: NRG; PAM sequence: TGG
ataatttgccagaatgtgac

SEQ ID NO: 126275 - DNA, 20 bp, Artificial Sequence
  Description of Artificial Sequence: Synthetic oligonucleotide
  Target: ATXN1; (+) strand; PAM type: NRG; PAM sequence: GGG
taatttgccagaatgtgact

SEQ ID NO: 126276 - DNA, 20 bp, Artificial Sequence
  Description of Artificial Sequence: Synthetic oligonucleotide
  Target: ATXN1; (+) strand; PAM type: NRG; PAM sequence: TGG
tgccagaatgtgactgggcg

SEQ ID NO: 126277 - DNA, 20 bp, Artificial Sequence
  Description of Artificial Sequence: Synthetic oligonucleotide
  Target: ATXN1; (+) strand; PAM type: NRG; PAM sequence: TGG
cagaatgtgactgggcgtgg

SEQ ID NO: 126278 - DNA, 20 bp, Artificial Sequence
  Description of Artificial Sequence: Synthetic oligonucleotide
  Target: ATXN1; (+) strand; PAM type: NRG; PAM sequence: CAG
gtggctcactcctataatcc

SEQ ID NO: 126279 - DNA, 20 bp, Artificial Sequence
  Description of Artificial Sequence: Synthetic oligonucleotide
  Target: ATXN1; (+) strand; PAM type: NRG; PAM sequence: TGG
ctcctataatcccagcactt

SEQ ID NO: 126280 - DNA, 20 bp, Artificial Sequence
  Description of Artificial Sequence: Synthetic oligonucleotide
  Target: ATXN1; (+) strand; PAM type: NRG; PAM sequence: GGG
tcctataatcccagcacttt

SEQ ID NO: 126281 - DNA, 20 bp, Artificial Sequence
  Description of Artificial Sequence: Synthetic oligonucleotide
  Target: ATXN1; (+) strand; PAM type: NRG; PAM sequence: GAG
ctataatcccagcactttgg

SEQ ID NO: 126282 - DNA, 20 bp, Artificial Sequence
  Description of Artificial Sequence: Synthetic oligonucleotide
  Target: ATXN1; (+) strand; PAM type: NRG; PAM sequence: AGG
tataatcccagcactttggg

SEQ ID NO: 126283 - DNA, 20 bp, Artificial Sequence
  Description of Artificial Sequence: Synthetic oligonucleotide
  Target: ATXN1; (+) strand; PAM type: NRG; PAM sequence: AAG
tcccagcactttgggaggcc

SEQ ID NO: 126284 - DNA, 20 bp, Artificial Sequence
  Description of Artificial Sequence: Synthetic oligonucleotide
  Target: ATXN1; (+) strand; PAM type: NRG; PAM sequence: CAG
agcactttgggaggccaagc

SEQ ID NO: 126285 - DNA, 20 bp, Artificial Sequence
  Description of Artificial Sequence: Synthetic oligonucleotide
  Target: ATXN1; (+) strand; PAM type: NRG; PAM sequence: AGG
gcactttgggaggccaagcc

SEQ ID NO: 126286 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccaagccagg

SEQ ID NO: 126287 - DNA, 20 bp, Artificial Sequence
  Description of Artificial Sequence: Synthetic oligonucleotide
  Target: ATXN1; (+) strand; PAM type: NRG; PAM sequence: AAG
caagccaggtggatcacctg

SEQ ID NO: 126288 - DNA, 20 bp, Artificial Sequence
  Description of Artificial Sequence: Synthetic oligonucleotide
  Target: ATXN1; (+) strand; PAM type: NRG; PAM sequence: CAG
ccaggtggatcacctgaagt

SEQ ID NO: 126289 - DNA, 20 bp, Artificial Sequence
  Description of Artificial Sequence: Synthetic oligonucleotide
  Target: ATXN1; (+) strand; PAM type: NRG; PAM sequence: AGG
caggtggatcacctgaagtc

SEQ ID NO: 126290 - DNA, 20 bp, Artificial Sequence
  Description of Artificial Sequence: Synthetic oligonucleotide
  Target: ATXN1; (+) strand; PAM type: NRG; PAM sequence: GAG
ggtggatcacctgaagtcag

SEQ ID NO: 126291 - DNA, 20 bp, Artificial Sequence
  Description of Artificial Sequence: Synthetic oligonucleotide
  Target: ATXN1; (+) strand; PAM type: NRG; PAM sequence: AAG
tcacctgaagtcaggagttc

SEQ ID NO: 126292 - DNA, 20 bp, Artificial Sequence
  Description of Artificial Sequence: Synthetic oligonucleotide
  Target: ATXN1; (+) strand; PAM type: NRG; PAM sequence: CAG
tgaagtcaggagttcaagac

SEQ ID NO: 126293 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcaagaccagcc

SEQ ID NO: 126294 - DNA, 20 bp, Artificial Sequence
  Description of Artificial Sequence: Synthetic oligonucleotide
  Target: ATXN1; (+) strand; PAM type: NRG; PAM sequence: TGG
caagaccagcctggccacca

SEQ ID NO: 126295 - DNA, 20 bp, Artificial Sequence
  Description of Artificial Sequence: Synthetic oligonucleotide
  Target: ATXN1; (+) strand; PAM type: NRG; PAM sequence: TAG
ctctactaaaaatacaaaat

SEQ ID NO: 126296 - DNA, 20 bp, Artificial Sequence
  Description of Artificial Sequence: Synthetic oligonucleotide
  Target: ATXN1; (+) strand; PAM type: NRG; PAM sequence: CGG
actaaaaatacaaaattagc

SEQ ID NO: 126297 - DNA, 20 bp, Artificial Sequence
  Description of Artificial Sequence: Synthetic oligonucleotide
  Target: ATXN1; (+) strand; PAM type: NRG; PAM sequence: GGG
ctaaaaatacaaaattagcc

SEQ ID NO: 126298 - DNA, 20 bp, Artificial Sequence
  Description of Artificial Sequence: Synthetic oligonucleotide
  Target: ATXN1; (+) strand; PAM type: NRG; PAM sequence: TGG
aatacaaaattagccgggca

SEQ ID NO: 126299 - DNA, 20 bp, Artificial Sequence
  Description of Artificial Sequence: Synthetic oligonucleotide
  Target: ATXN1; (+) strand; PAM type: NRG; PAM sequence: TGG
acaaaattagccgggcatgg

SEQ ID NO: 126300 - DNA, 20 bp, Artificial Sequence
  Description of Artificial Sequence: Synthetic oligonucleotide
  Target: ATXN1; (+) strand; PAM type: NRG; PAM sequence: CAG
gtggcatgcacctgtaatcc

SEQ ID NO: 126301 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatcccagctatt

SEQ ID NO: 126302 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccagctattt

SEQ ID NO: 126303 - DNA, 20 bp, Artificial Sequence
  Description of Artificial Sequence: Synthetic oligonucleotide
  Target: ATXN1; (+) strand; PAM type: NRG; PAM sequence: AAG
tgtaatcccagctatttggg

SEQ ID NO: 126304 - DNA, 20 bp, Artificial Sequence
  Description of Artificial Sequence: Synthetic oligonucleotide
  Target: ATXN1; (+) strand; PAM type: NRG; PAM sequence: GAG
tcccagctatttgggaagct

SEQ ID NO: 126305 - DNA, 20 bp, Artificial Sequence
  Description of Artificial Sequence: Synthetic oligonucleotide
  Target: ATXN1; (+) strand; PAM type: NRG; PAM sequence: AGG
cccagctatttgggaagctg

SEQ ID NO: 126306 - DNA, 20 bp, Artificial Sequence
  Description of Artificial Sequence: Synthetic oligonucleotide
  Target: ATXN1; (+) strand; PAM type: NRG; PAM sequence: CAG
agctatttgggaagctgagg

SEQ ID NO: 126307 - DNA, 20 bp, Artificial Sequence
  Description of Artificial Sequence: Synthetic oligonucleotide
  Target: ATXN1; (+) strand; PAM type: NRG; PAM sequence: AGG
gctatttgggaagctgaggc

SEQ ID NO: 126308 - DNA, 20 bp, Artificial Sequence
  Description of Artificial Sequence: Synthetic oligonucleotide
  Target: ATXN1; (+) strand; PAM type: NRG; PAM sequence: CGG
gcaggaaaattgcttgaact

SEQ ID NO: 126309 - DNA, 20 bp, Artificial Sequence
  Description of Artificial Sequence: Synthetic oligonucleotide
  Target: ATXN1; (+) strand; PAM type: NRG; PAM sequence: GGG
caggaaaattgcttgaactc

SEQ ID NO: 126310 - DNA, 20 bp, Artificial Sequence
  Description of Artificial Sequence: Synthetic oligonucleotide
  Target: ATXN1; (+) strand; PAM type: NRG; PAM sequence: GAG
ggaaaattgcttgaactcgg

SEQ ID NO: 126311 - DNA, 20 bp, Artificial Sequence
  Description of Artificial Sequence: Synthetic oligonucleotide
  Target: ATXN1; (+) strand; PAM type: NRG; PAM sequence: AGG
gaaaattgcttgaactcggg

SEQ ID NO: 126312 - DNA, 20 bp, Artificial Sequence
  Description of Artificial Sequence: Synthetic oligonucleotide
  Target: ATXN1; (+) strand; PAM type: NRG; PAM sequence: CAG
aattgcttgaactcgggagg

SEQ ID NO: 126313 - DNA, 20 bp, Artificial Sequence
  Description of Artificial Sequence: Synthetic oligonucleotide
  Target: ATXN1; (+) strand; PAM type: NRG; PAM sequence: AAG
tgcttgaactcgggaggcag

SEQ ID NO: 126314 - DNA, 20 bp, Artificial Sequence
  Description of Artificial Sequence: Synthetic oligonucleotide
  Target: ATXN1; (+) strand; PAM type: NRG; PAM sequence: CAG
aactcgggaggcagaagttg

SEQ ID NO: 126315 - DNA, 20 bp, Artificial Sequence
  Description of Artificial Sequence: Synthetic oligonucleotide
  Target: ATXN1; (+) strand; PAM type: NRG; PAM sequence: GAG
cgggaggcagaagttgcagt

SEQ ID NO: 126316 - DNA, 20 bp, Artificial Sequence
  Description of Artificial Sequence: Synthetic oligonucleotide
  Target: ATXN1; (+) strand; PAM type: NRG; PAM sequence: AAG
ggcagaagttgcagtgagcc

SEQ ID NO: 126317 - DNA, 20 bp, Artificial Sequence
  Description of Artificial Sequence: Synthetic oligonucleotide
  Target: ATXN1; (+) strand; PAM type: NRG; PAM sequence: CAG
aagatcatgccactgtactc

SEQ ID NO: 126318 - DNA, 20 bp, Artificial Sequence
  Description of Artificial Sequence: Synthetic oligonucleotide
  Target: ATXN1; (+) strand; PAM type: NRG; PAM sequence: TGG
catgccactgtactccagcc

SEQ ID NO: 126319 - DNA, 20 bp, Artificial Sequence
  Description of Artificial Sequence: Synthetic oligonucleotide
  Target: ATXN1; (+) strand; PAM type: NRG; PAM sequence: GGG
atgccactgtactccagcct

SEQ ID NO: 126320 - DNA, 20 bp, Artificial Sequence
  Description of Artificial Sequence: Synthetic oligonucleotide
  Target: ATXN1; (+) strand; PAM type: NRG; PAM sequence: AAG
tgtactccagcctgggcaac

SEQ ID NO: 126321 - DNA, 20 bp, Artificial Sequence
  Description of Artificial Sequence: Synthetic oligonucleotide
  Target: ATXN1; (+) strand; PAM type: NRG; PAM sequence: GAG
tactccagcctgggcaacaa

SEQ ID NO: 126322 - DNA, 20 bp, Artificial Sequence
  Description of Artificial Sequence: Synthetic oligonucleotide
  Target: ATXN1; (+) strand; PAM type: NRG; PAM sequence: CAG
acaacaacaacaaaaattac

SEQ ID NO: 126323 - DNA, 20 bp, Artificial Sequence
  Description of Artificial Sequence: Synthetic oligonucleotide
  Target: ATXN1; (+) strand; PAM type: NRG; PAM sequence: GAG
aacaaaaattaccagaatgt

SEQ ID NO: 126324 - DNA, 20 bp, Artificial Sequence
  Description of Artificial Sequence: Synthetic oligonucleotide
  Target: ATXN1; (+) strand; PAM type: NRG; PAM sequence: AAG
cctttttcctcacccctcac

SEQ ID NO: 126325 - DNA, 20 bp, Artificial Sequence
  Description of Artificial Sequence: Synthetic oligonucleotide
  Target: ATXN1; (+) strand; PAM type: NRG; PAM sequence: GAG
ctcacccctcacaagtaaat

SEQ ID NO: 126326 - DNA, 20 bp, Artificial Sequence
  Description of Artificial Sequence: Synthetic oligonucleotide
  Target: ATXN1; (+) strand; PAM type: NRG; PAM sequence: AAG
ccctcacaagtaaatgagac

SEQ ID NO: 126327 - DNA, 20 bp, Artificial Sequence
  Description of Artificial Sequence: Synthetic oligonucleotide
  Target: ATXN1; (+) strand; PAM type: NRG; PAM sequence: CAG
agacaagttgccatatgatc

SEQ ID NO: 126328 - DNA, 20 bp, Artificial Sequence
  Description of Artificial Sequence: Synthetic oligonucleotide
  Target: ATXN1; (+) strand; PAM type: NRG; PAM sequence: TGG
tgatccagaaatcccacgac

SEQ ID NO: 126329 - DNA, 20 bp, Artificial Sequence
  Description of Artificial Sequence: Synthetic oligonucleotide
  Target: ATXN1; (+) strand; PAM type: NRG; PAM sequence: GGG
gatccagaaatcccacgact

SEQ ID NO: 126330 - DNA, 20 bp, Artificial Sequence
  Description of Artificial Sequence: Synthetic oligonucleotide
  Target: ATXN1; (+) strand; PAM type: NRG; PAM sequence: AAG
acgactgggtatatactcaa

SEQ ID NO: 126331 - DNA, 20 bp, Artificial Sequence
  Description of Artificial Sequence: Synthetic oligonucleotide
  Target: ATXN1; (+) strand; PAM type: NRG; PAM sequence: AAG
ctgggtatatactcaaaaga

SEQ ID NO: 126332 - DNA, 20 bp, Artificial Sequence
  Description of Artificial Sequence: Synthetic oligonucleotide
  Target: ATXN1; (+) strand; PAM type: NRG; PAM sequence: AGG
tgggtatatactcaaaagaa

SEQ ID NO: 126333 - DNA, 20 bp, Artificial Sequence
  Description of Artificial Sequence: Synthetic oligonucleotide
  Target: ATXN1; (+) strand; PAM type: NRG; PAM sequence: CAG
atactcaaaagaaaggaaat

SEQ ID NO: 126334 - DNA, 20 bp, Artificial Sequence
  Description of Artificial Sequence: Synthetic oligonucleotide
  Target: ATXN1; (+) strand; PAM type: NRG; PAM sequence: GAG
agaaaggaaatcagtatatt

SEQ ID NO: 126335 - DNA, 20 bp, Artificial Sequence
  Description of Artificial Sequence: Synthetic oligonucleotide
  Target: ATXN1; (+) strand; PAM type: NRG; PAM sequence: AGG
gaaaggaaatcagtatattg

SEQ ID NO: 126336 - DNA, 20 bp, Artificial Sequence
  Description of Artificial Sequence: Synthetic oligonucleotide
  Target: ATXN1; (+) strand; PAM type: NRG; PAM sequence: CAG
tgcacttcctctgtttgtta

SEQ ID NO: 126337 - DNA, 20 bp, Artificial Sequence
  Description of Artificial Sequence: Synthetic oligonucleotide
  Target: ATXN1; (+) strand; PAM type: NRG; PAM sequence: TAG
tgttacagcactgtttacaa

SEQ ID NO: 126338 - DNA, 20 bp, Artificial Sequence
  Description of Artificial Sequence: Synthetic oligonucleotide
  Target: ATXN1; (+) strand; PAM type: NRG; PAM sequence: AAG
cagcactgtttacaatagct

SEQ ID NO: 126339 - DNA, 20 bp, Artificial Sequence
  Description of Artificial Sequence: Synthetic oligonucleotide
  Target: ATXN1; (+) strand; PAM type: NRG; PAM sequence: TGG
tgtttacaatagctaagatt

SEQ ID NO: 126340 - DNA, 20 bp, Artificial Sequence
  Description of Artificial Sequence: Synthetic oligonucleotide
  Target: ATXN1; (+) strand; PAM type: NRG; PAM sequence: AAG
ttacaatagctaagatttgg

SEQ ID NO: 126341 - DNA, 20 bp, Artificial Sequence
  Description of Artificial Sequence: Synthetic oligonucleotide
  Target: ATXN1; (+) strand; PAM type: NRG; PAM sequence: CAG
gcaatctaaatgtctaccaa

SEQ ID NO: 126342 - DNA, 20 bp, Artificial Sequence
  Description of Artificial Sequence: Synthetic oligonucleotide
  Target: ATXN1; (+) strand; PAM type: NRG; PAM sequence: TGG
aatgtctaccaacagatgaa

SEQ ID NO: 126343 - DNA, 20 bp, Artificial Sequence
  Description of Artificial Sequence: Synthetic oligonucleotide
  Target: ATXN1; (+) strand; PAM type: NRG; PAM sequence: AAG
taccaacagatgaatggata

SEQ ID NO: 126344 - DNA, 20 bp, Artificial Sequence
  Description of Artificial Sequence: Synthetic oligonucleotide
  Target: ATXN1; (+) strand; PAM type: NRG; PAM sequence: AAG
aacagatgaatggataaaga

SEQ ID NO: 126345 - DNA, 20 bp, Artificial Sequence
  Description of Artificial Sequence: Synthetic oligonucleotide
  Target: ATXN1; (+) strand; PAM type: NRG; PAM sequence: TAG
atgaatggataaagaaagta

SEQ ID NO: 126346 - DNA, 20 bp, Artificial Sequence
  Description of Artificial Sequence: Synthetic oligonucleotide
  Target: ATXN1; (+) strand; PAM type: NRG; PAM sequence: TGG
agtatagtatatacacacaa

SEQ ID NO: 126347 - DNA, 20 bp, Artificial Sequence
  Description of Artificial Sequence: Synthetic oligonucleotide
  Target: ATXN1; (+) strand; PAM type: NRG; PAM sequence: CAG
acacacaatggaatattatt

SEQ ID NO: 126348 - DNA, 20 bp, Artificial Sequence
  Description of Artificial Sequence: Synthetic oligonucleotide
  Target: ATXN1; (+) strand; PAM type: NRG; PAM sequence: AAG
aatattattcagccataaaa

SEQ ID NO: 126349 - DNA, 20 bp, Artificial Sequence
  Description of Artificial Sequence: Synthetic oligonucleotide
  Target: ATXN1; (+) strand; PAM type: NRG; PAM sequence: GAG
attcagccataaaaaagaat

SEQ ID NO: 126350 - DNA, 20 bp, Artificial Sequence
  Description of Artificial Sequence: Synthetic oligonucleotide
  Target: ATXN1; (+) strand; PAM type: NRG; PAM sequence: CAG
ccataaaaaagaatgagatc

SEQ ID NO: 126351 - DNA, 20 bp, Artificial Sequence
  Description of Artificial Sequence: Synthetic oligonucleotide
  Target: ATXN1; (+) strand; PAM type: NRG; PAM sequence: TGG
tccagtcatttgcaacaaca

SEQ ID NO: 126352 - DNA, 20 bp, Artificial Sequence
  Description of Artificial Sequence: Synthetic oligonucleotide
  Target: ATXN1; (+) strand; PAM type: NRG; PAM sequence: TGG
gtcatttgcaacaacatgga

SEQ ID NO: 126353 - DNA, 20 bp, Artificial Sequence
  Description of Artificial Sequence: Synthetic oligonucleotide
  Target: ATXN1; (+) strand; PAM type: NRG; PAM sequence: GAG
tgcaacaacatggatggaac

SEQ ID NO: 126354 - DNA, 20 bp, Artificial Sequence
  Description of Artificial Sequence: Synthetic oligonucleotide
  Target: ATXN1; (+) strand; PAM type: NRG; PAM sequence: GAG
caacaacatggatggaacga

SEQ ID NO: 126355 - DNA, 20 bp, Artificial Sequence
  Description of Artificial Sequence: Synthetic oligonucleotide
  Target: ATXN1; (+) strand; PAM type: NRG; PAM sequence: AAG
gaacgagagatcattatgtt

SEQ ID NO: 126356 - DNA, 20 bp, Artificial Sequence
  Description of Artificial Sequence: Synthetic oligonucleotide
  Target: ATXN1; (+) strand; PAM type: NRG; PAM sequence: AAG
atcattatgttaagtgaaaa

SEQ ID NO: 126357 - DNA, 20 bp, Artificial Sequence
  Description of Artificial Sequence: Synthetic oligonucleotide
  Target: ATXN1; (+) strand; PAM type: NRG; PAM sequence: CAG
ttatgttaagtgaaaaaagc

SEQ ID NO: 126358 - DNA, 20 bp, Artificial Sequence
  Description of Artificial Sequence: Synthetic oligonucleotide
  Target: ATXN1; (+) strand; PAM type: NRG; PAM sequence: AGG
tatgttaagtgaaaaaagcc

SEQ ID NO: 126359 - DNA, 20 bp, Artificial Sequence
  Description of Artificial Sequence: Synthetic oligonucleotide
  Target: ATXN1; (+) strand; PAM type: NRG; PAM sequence: CAG
taagtgaaaaaagccaggca

SEQ ID NO: 126360 - DNA, 20 bp, Artificial Sequence
  Description of Artificial Sequence: Synthetic oligonucleotide
  Target: ATXN1; (+) strand; PAM type: NRG; PAM sequence: AAG
tgaaaaaagccaggcacaga

SEQ ID NO: 126361 - DNA, 20 bp, Artificial Sequence
  Description of Artificial Sequence: Synthetic oligonucleotide
  Target: ATXN1; (+) strand; PAM type: NRG; PAM sequence: TAG
caggcacagaaagacaaact

SEQ ID NO: 126362 - DNA, 20 bp, Artificial Sequence
  Description of Artificial Sequence: Synthetic oligonucleotide
  Target: ATXN1; (+) strand; PAM type: NRG; PAM sequence: TGG
agcatgttctcacttatctg

SEQ ID NO: 126363 - DNA, 20 bp, Artificial Sequence
  Description of Artificial Sequence: Synthetic oligonucleotide
  Target: ATXN1; (+) strand; PAM type: NRG; PAM sequence: GGG
gcatgttctcacttatctgt

SEQ ID NO: 126364 - DNA, 20 bp, Artificial Sequence
  Description of Artificial Sequence: Synthetic oligonucleotide
  Target: ATXN1; (+) strand; PAM type: NRG; PAM sequence: TGG
aatcaaacctactgaactca

SEQ ID NO: 126365 - DNA, 20 bp, Artificial Sequence
  Description of Artificial Sequence: Synthetic oligonucleotide
  Target: ATXN1; (+) strand; PAM type: NRG; PAM sequence: CAG
acctactgaactcatggaca

SEQ ID NO: 126366 - DNA, 20 bp, Artificial Sequence
  Description of Artificial Sequence: Synthetic oligonucleotide
  Target: ATXN1; (+) strand; PAM type: NRG; PAM sequence: GAG
ctactgaactcatggacaca

SEQ ID NO: 126367 - DNA, 20 bp, Artificial Sequence
  Description of Artificial Sequence: Synthetic oligonucleotide
  Target: ATXN1; (+) strand; PAM type: NRG; PAM sequence: GAG
actgaactcatggacacaga

SEQ ID NO: 126368 - DNA, 20 bp, Artificial Sequence
  Description of Artificial Sequence: Synthetic oligonucleotide
  Target: ATXN1; (+) strand; PAM type: NRG; PAM sequence: TAG
gaactcatggacacagagag

SEQ ID NO: 126369 - DNA, 20 bp, Artificial Sequence
  Description of Artificial Sequence: Synthetic oligonucleotide
  Target: ATXN1; (+) strand; PAM type: NRG; PAM sequence: AGG
aactcatggacacagagagt

SEQ ID NO: 126370 - DNA, 20 bp, Artificial Sequence
  Description of Artificial Sequence: Synthetic oligonucleotide
  Target: ATXN1; (+) strand; PAM type: NRG; PAM sequence: GAG
ctcatggacacagagagtag

SEQ ID NO: 126371 - DNA, 20 bp, Artificial Sequence
  Description of Artificial Sequence: Synthetic oligonucleotide
  Target: ATXN1; (+) strand; PAM type: NRG; PAM sequence: AGG
tcatggacacagagagtagg

SEQ ID NO: 126372 - DNA, 20 bp, Artificial Sequence
  Description of Artificial Sequence: Synthetic oligonucleotide
  Target: ATXN1; (+) strand; PAM type: NRG; PAM sequence: TGG
ggacacagagagtaggagga

SEQ ID NO: 126373 - DNA, 20 bp, Artificial Sequence
  Description of Artificial Sequence: Synthetic oligonucleotide
  Target: ATXN1; (+) strand; PAM type: NRG; PAM sequence: AAG
gagtaggaggatggctacca

SEQ ID NO: 126374 - DNA, 20 bp, Artificial Sequence
  Description of Artificial Sequence: Synthetic oligonucleotide
  Target: ATXN1; (+) strand; PAM type: NRG; PAM sequence: AGG
agtaggaggatggctaccaa

SEQ ID NO: 126375 - DNA, 20 bp, Artificial Sequence
  Description of Artificial Sequence: Synthetic oligonucleotide
  Target: ATXN1; (+) strand; PAM type: NRG; PAM sequence: TGG
ggaggatggctaccaaaggc

SEQ ID NO: 126376 - DNA, 20 bp, Artificial Sequence
  Description of Artificial Sequence: Synthetic oligonucleotide
  Target: ATXN1; (+) strand; PAM type: NRG; PAM sequence: GGG
gaggatggctaccaaaggct

SEQ ID NO: 126377 - DNA, 20 bp, Artificial Sequence
  Description of Artificial Sequence: Synthetic oligonucleotide
  Target: ATXN1; (+) strand; PAM type: NRG; PAM sequence: AAG
gatggctaccaaaggctggg

SEQ ID NO: 126378 - DNA, 20 bp, Artificial Sequence
  Description of Artificial Sequence: Synthetic oligonucleotide
  Target: ATXN1; (+) strand; PAM type: NRG; PAM sequence: AGG
atggctaccaaaggctggga

SEQ ID NO: 126379 - DNA, 20 bp, Artificial Sequence
  Description of Artificial Sequence: Synthetic oligonucleotide
  Target: ATXN1; (+) strand; PAM type: NRG; PAM sequence: GGG
tggctaccaaaggctgggaa

SEQ ID NO: 126380 - DNA, 20 bp, Artificial Sequence
  Description of Artificial Sequence: Synthetic oligonucleotide
  Target: ATXN1; (+) strand; PAM type: NRG; PAM sequence: TAG
ctaccaaaggctgggaaggg

SEQ ID NO: 126381 - DNA, 20 bp, Artificial Sequence
  Description of Artificial Sequence: Synthetic oligonucleotide
  Target: ATXN1; (+) strand; PAM type: NRG; PAM sequence: TAG
ccaaaggctgggaagggtag

SEQ ID NO: 126382 - DNA, 20 bp, Artificial Sequence
  Description of Artificial Sequence: Synthetic oligonucleotide
  Target: ATXN1; (+) strand; PAM type: NRG; PAM sequence: AGG
caaaggctgggaagggtagt

SEQ ID NO: 126383 - DNA, 20 bp, Artificial Sequence
  Description of Artificial Sequence: Synthetic oligonucleotide
  Target: ATXN1; (+) strand; PAM type: NRG; PAM sequence: GGG
aaaggctgggaagggtagta

SEQ ID NO: 126384 - DNA, 20 bp, Artificial Sequence
  Description of Artificial Sequence: Synthetic oligonucleotide
  Target: ATXN1; (+) strand; PAM type: NRG; PAM sequence: GGG
aaggctgggaagggtagtag

SEQ ID NO: 126385 - DNA, 20 bp, Artificial Sequence
  Description of Artificial Sequence: Synthetic oligonucleotide
  Target: ATXN1; (+) strand; PAM type: NRG; PAM sequence: GGG
aggctgggaagggtagtagg

SEQ ID NO: 126386 - DNA, 20 bp, Artificial Sequence
  Description of Artificial Sequence: Synthetic oligonucleotide
  Target: ATXN1; (+) strand; PAM type: NRG; PAM sequence: TGG
tgggaagggtagtagggggc

SEQ ID NO: 126387 - DNA, 20 bp, Artificial Sequence
  Description of Artificial Sequence: Synthetic oligonucleotide
  Target: ATXN1; (+) strand; PAM type: NRG; PAM sequence: GAG
ggaagggtagtagggggctg

SEQ ID NO: 126388 - DNA, 20 bp, Artificial Sequence
  Description of Artificial Sequence: Synthetic oligonucleotide
  Target: ATXN1; (+) strand; PAM type: NRG; PAM sequence: AGG
gaagggtagtagggggctgg

SEQ ID NO: 126389 - DNA, 20 bp, Artificial Sequence
  Description of Artificial Sequence: Synthetic oligonucleotide
  Target: ATXN1; (+) strand; PAM type: NRG; PAM sequence: GGG
aagggtagtagggggctgga

SEQ ID NO: 126390 - DNA, 20 bp, Artificial Sequence
  Description of Artificial Sequence: Synthetic oligonucleotide
  Target: ATXN1; (+) strand; PAM type: NRG; PAM sequence: GGG
agggtagtagggggctggag

SEQ ID NO: 126391 - DNA, 20 bp, Artificial Sequence
  Description of Artificial Sequence: Synthetic oligonucleotide
  Target: ATXN1; (+) strand; PAM type: NRG; PAM sequence: GAG
ggtagtagggggctggaggg

SEQ ID NO: 126392 - DNA, 20 bp, Artificial Sequence
  Description of Artificial Sequence: Synthetic oligonucleotide
  Target: ATXN1; (+) strand; PAM type: NRG; PAM sequence: AGG
gtagtagggggctggagggg

SEQ ID NO: 126393 - DNA, 20 bp, Artificial Sequence
  Description of Artificial Sequence: Synthetic oligonucleotide
  Target: ATXN1; (+) strand; PAM type: NRG; PAM sequence: TGG
gtagggggctggaggggagg

SEQ ID NO: 126394 - DNA, 20 bp, Artificial Sequence
  Description of Artificial Sequence: Synthetic oligonucleotide
  Target: ATXN1; (+) strand; PAM type: NRG; PAM sequence: GGG
tagggggctggaggggaggt

SEQ ID NO: 126395 - DNA, 20 bp, Artificial Sequence
  Description of Artificial Sequence: Synthetic oligonucleotide
  Target: ATXN1; (+) strand; PAM type: NRG; PAM sequence: GGG
agggggctggaggggaggtg

SEQ ID NO: 126396 - DNA, 20 bp, Artificial Sequence
  Description of Artificial Sequence: Synthetic oligonucleotide
  Target: ATXN1; (+) strand; PAM type: NRG; PAM sequence: TGG
ggctggaggggaggtgggga

SEQ ID NO: 126397 - DNA, 20 bp, Artificial Sequence
  Description of Artificial Sequence: Synthetic oligonucleotide
  Target: ATXN1; (+) strand; PAM type: NRG; PAM sequence: TGG
ggggaggtggggatggttaa

SEQ ID NO: 126398 - DNA, 20 bp, Artificial Sequence
  Description of Artificial Sequence: Synthetic oligonucleotide
  Target: ATXN1; (+) strand; PAM type: NRG; PAM sequence: GGG
gggaggtggggatggttaat

SEQ ID NO: 126399 - DNA, 20 bp, Artificial Sequence
  Description of Artificial Sequence: Synthetic oligonucleotide
  Target: ATXN1; (+) strand; PAM type: NRG; PAM sequence: AAG
atggttaatgggtacaaaaa

SEQ ID NO: 126400 - DNA, 20 bp, Artificial Sequence
  Description of Artificial Sequence: Synthetic oligonucleotide
  Target: ATXN1; (+) strand; PAM type: NRG; PAM sequence: TAG
gttaatgggtacaaaaaaag

SEQ ID NO: 126401 - DNA, 20 bp, Artificial Sequence
  Description of Artificial Sequence: Synthetic oligonucleotide
  Target: ATXN1; (+) strand; PAM type: NRG; PAM sequence: TAG
atgggtacaaaaaaagtagt

SEQ ID NO: 126402 - DNA, 20 bp, Artificial Sequence
  Description of Artificial Sequence: Synthetic oligonucleotide
  Target: ATXN1; (+) strand; PAM type: NRG; PAM sequence: AAG
aaaaagtagttagaataaat

SEQ ID NO: 126403 - DNA, 20 bp, Artificial Sequence
  Description of Artificial Sequence: Synthetic oligonucleotide
  Target: ATXN1; (+) strand; PAM type: NRG; PAM sequence: TAG
aaataagatctactatttga

SEQ ID NO: 126404 - DNA, 20 bp, Artificial Sequence
  Description of Artificial Sequence: Synthetic oligonucleotide
  Target: ATXN1; (+) strand; PAM type: NRG; PAM sequence: CAG
tctactatttgatagcacaa

SEQ ID NO: 126405 - DNA, 20 bp, Artificial Sequence
  Description of Artificial Sequence: Synthetic oligonucleotide
  Target: ATXN1; (+) strand; PAM type: NRG; PAM sequence: GAG
tactatttgatagcacaaca

SEQ ID NO: 126406 - DNA, 20 bp, Artificial Sequence
  Description of Artificial Sequence: Synthetic oligonucleotide
  Target: ATXN1; (+) strand; PAM type: NRG; PAM sequence: TAG
atagcacaacagagtgacta

SEQ ID NO: 126407 - DNA, 20 bp, Artificial Sequence
  Description of Artificial Sequence: Synthetic oligonucleotide
  Target: ATXN1; (+) strand; PAM type: NRG; PAM sequence: AAG
taactgtacattttaaaata

SEQ ID NO: 126408 - DNA, 20 bp, Artificial Sequence
  Description of Artificial Sequence: Synthetic oligonucleotide
  Target: ATXN1; (+) strand; PAM type: NRG; PAM sequence: GAG
actgtacattttaaaataaa

SEQ ID NO: 126409 - DNA, 20 bp, Artificial Sequence
  Description of Artificial Sequence: Synthetic oligonucleotide
  Target: ATXN1; (+) strand; PAM type: NRG; PAM sequence: TGG
tttaaaataaagagtataac

SEQ ID NO: 126410 - DNA, 20 bp, Artificial Sequence
  Description of Artificial Sequence: Synthetic oligonucleotide
  Target: ATXN1; (+) strand; PAM type: NRG; PAM sequence: GAG
taaaataaagagtataactg

SEQ ID NO: 126411 - DNA, 20 bp, Artificial Sequence
  Description of Artificial Sequence: Synthetic oligonucleotide
  Target: ATXN1; (+) strand; PAM type: NRG; PAM sequence: TGG
aactggagtgtttgttgtaa

SEQ ID NO: 126412 - DNA, 20 bp, Artificial Sequence
  Description of Artificial Sequence: Synthetic oligonucleotide
  Target: ATXN1; (+) strand; PAM type: NRG; PAM sequence: GAG
gttgtaatggataaatgctt

SEQ ID NO: 126413 - DNA, 20 bp, Artificial Sequence
  Description of Artificial Sequence: Synthetic oligonucleotide
  Target: ATXN1; (+) strand; PAM type: NRG; PAM sequence: TGG
gtaatggataaatgcttgag

SEQ ID NO: 126414 - DNA, 20 bp, Artificial Sequence
  Description of Artificial Sequence: Synthetic oligonucleotide
  Target: ATXN1; (+) strand; PAM type: NRG; PAM sequence: TGG
tggataaatgcttgagtgga

SEQ ID NO: 126415 - DNA, 20 bp, Artificial Sequence
  Description of Artificial Sequence: Synthetic oligonucleotide
  Target: ATXN1; (+) strand; PAM type: NRG; PAM sequence: CAG
taaaaattaaaaaaaaatta

SEQ ID NO: 126416 - DNA, 20 bp, Artificial Sequence
  Description of Artificial Sequence: Synthetic oligonucleotide
  Target: ATXN1; (+) strand; PAM type: NRG; PAM sequence: AGG
aaaaattaaaaaaaaattac

SEQ ID NO: 126417 - DNA, 20 bp, Artificial Sequence
  Description of Artificial Sequence: Synthetic oligonucleotide
  Target: ATXN1; (+) strand; PAM type: NRG; PAM sequence: CAG
aaaaaaattacaggactatg

SEQ ID NO: 126418 - DNA, 20 bp, Artificial Sequence
  Description of Artificial Sequence: Synthetic oligonucleotide
  Target: ATXN1; (+) strand; PAM type: NRG; PAM sequence: AAG
caggactatgcagtcaaaaa

SEQ ID NO: 126419 - DNA, 20 bp, Artificial Sequence
  Description of Artificial Sequence: Synthetic oligonucleotide
  Target: ATXN1; (+) strand; PAM type: NRG; PAM sequence: TGG
gactatgcagtcaaaaaaag

SEQ ID NO: 126420 - DNA, 20 bp, Artificial Sequence
  Description of Artificial Sequence: Synthetic oligonucleotide
  Target: ATXN1; (+) strand; PAM type: NRG; PAM sequence: GAG
tgcagtcaaaaaaagtggat

SEQ ID NO: 126421 - DNA, 20 bp, Artificial Sequence
  Description of Artificial Sequence: Synthetic oligonucleotide
  Target: ATXN1; (+) strand; PAM type: NRG; PAM sequence: GAG
aaaaagtggatgagacaaat

SEQ ID NO: 126422 - DNA, 20 bp, Artificial Sequence
  Description of Artificial Sequence: Synthetic oligonucleotide
  Target: ATXN1; (+) strand; PAM type: NRG; PAM sequence: TAG
actgttcactgtataataat

SEQ ID NO: 126423 - DNA, 20 bp, Artificial Sequence
  Description of Artificial Sequence: Synthetic oligonucleotide
  Target: ATXN1; (+) strand; PAM type: NRG; PAM sequence: TAG
ctgtataataattagataaa

SEQ ID NO: 126424 - DNA, 20 bp, Artificial Sequence
  Description of Artificial Sequence: Synthetic oligonucleotide
  Target: ATXN1; (+) strand; PAM type: NRG; PAM sequence: AAG
ttagataaatagaaaaaccc

SEQ ID NO: 126425 - DNA, 20 bp, Artificial Sequence
  Description of Artificial Sequence: Synthetic oligonucleotide
  Target: ATXN1; (+) strand; PAM type: NRG; PAM sequence: CAG
acccaagtaatacaaatcca

SEQ ID NO: 126426 - DNA, 20 bp, Artificial Sequence
  Description of Artificial Sequence: Synthetic oligonucleotide
  Target: ATXN1; (+) strand; PAM type: NRG; PAM sequence: AAG
caagtaatacaaatccacag

SEQ ID NO: 126427 - DNA, 20 bp, Artificial Sequence
  Description of Artificial Sequence: Synthetic oligonucleotide
  Target: ATXN1; (+) strand; PAM type: NRG; PAM sequence: CAG
ccactaataatcactattaa

SEQ ID NO: 126428 - DNA, 20 bp, Artificial Sequence
  Description of Artificial Sequence: Synthetic oligonucleotide
  Target: ATXN1; (+) strand; PAM type: NRG; PAM sequence: TGG
aataatcactattaacagtc

SEQ ID NO: 126429 - DNA, 20 bp, Artificial Sequence
  Description of Artificial Sequence: Synthetic oligonucleotide
  Target: ATXN1; (+) strand; PAM type: NRG; PAM sequence: CAG
acagtctggttatatgaccc

SEQ ID NO: 126430 - DNA, 20 bp, Artificial Sequence
  Description of Artificial Sequence: Synthetic oligonucleotide
  Target: ATXN1; (+) strand; PAM type: NRG; PAM sequence: AAG
ccagactctctcctatgccc

SEQ ID NO: 126431 - DNA, 20 bp, Artificial Sequence
  Description of Artificial Sequence: Synthetic oligonucleotide
  Target: ATXN1; (+) strand; PAM type: NRG; PAM sequence: CAG
ctctcctatgcccaagtata

SEQ ID NO: 126432 - DNA, 20 bp, Artificial Sequence
  Description of Artificial Sequence: Synthetic oligonucleotide
  Target: ATXN1; (+) strand; PAM type: NRG; PAM sequence: GAG
ctcctatgcccaagtataca

SEQ ID NO: 126433 - DNA, 20 bp, Artificial Sequence
  Description of Artificial Sequence: Synthetic oligonucleotide
  Target: ATXN1; (+) strand; PAM type: NRG; PAM sequence: TAG
gtatattgtacacatacata

SEQ ID NO: 126434 - DNA, 20 bp, Artificial Sequence
  Description of Artificial Sequence: Synthetic oligonucleotide
  Target: ATXN1; (+) strand; PAM type: NRG; PAM sequence: TAG
ctatttataatgtactatga

SEQ ID NO: 126435 - DNA, 20 bp, Artificial Sequence
  Description of Artificial Sequence: Synthetic oligonucleotide
  Target: ATXN1; (+) strand; PAM type: NRG; PAM sequence: TAG
atgtactatgatagtattca

SEQ ID NO: 126436 - DNA, 20 bp, Artificial Sequence
  Description of Artificial Sequence: Synthetic oligonucleotide
  Target: ATXN1; (+) strand; PAM type: NRG; PAM sequence: TAG
aaaacctcctttaacatcaa

SEQ ID NO: 126437 - DNA, 20 bp, Artificial Sequence
  Description of Artificial Sequence: Synthetic oligonucleotide
  Target: ATXN1; (+) strand; PAM type: NRG; PAM sequence: GAG
gtatcaacatcataacattt

SEQ ID NO: 126438 - DNA, 20 bp, Artificial Sequence
  Description of Artificial Sequence: Synthetic oligonucleotide
  Target: ATXN1; (+) strand; PAM type: NRG; PAM sequence: AGG
tatcaacatcataacatttg

SEQ ID NO: 126439 - DNA, 20 bp, Artificial Sequence
  Description of Artificial Sequence: Synthetic oligonucleotide
  Target: ATXN1; (+) strand; PAM type: NRG; PAM sequence: AAG
tcataacatttgaggactga

SEQ ID NO: 126440 - DNA, 20 bp, Artificial Sequence
  Description of Artificial Sequence: Synthetic oligonucleotide
  Target: ATXN1; (+) strand; PAM type: NRG; PAM sequence: GAG
ataacatttgaggactgaaa

SEQ ID NO: 126441 - DNA, 20 bp, Artificial Sequence
  Description of Artificial Sequence: Synthetic oligonucleotide
  Target: ATXN1; (+) strand; PAM type: NRG; PAM sequence: AAG
actgaaagagtattacattg

SEQ ID NO: 126442 - DNA, 20 bp, Artificial Sequence
  Description of Artificial Sequence: Synthetic oligonucleotide
  Target: ATXN1; (+) strand; PAM type: NRG; PAM sequence: AGG
ctgaaagagtattacattga

SEQ ID NO: 126443 - DNA, 20 bp, Artificial Sequence
  Description of Artificial Sequence: Synthetic oligonucleotide
  Target: ATXN1; (+) strand; PAM type: NRG; PAM sequence: CAG
atatttatttgttgaattta

SEQ ID NO: 126444 - DNA, 20 bp, Artificial Sequence
  Description of Artificial Sequence: Synthetic oligonucleotide
  Target: ATXN1; (+) strand; PAM type: NRG; PAM sequence: GAG
atttatttgttgaatttaca

SEQ ID NO: 126445 - DNA, 20 bp, Artificial Sequence
  Description of Artificial Sequence: Synthetic oligonucleotide
  Target: ATXN1; (+) strand; PAM type: NRG; PAM sequence: AAG
tgaatttacagagtctacca

SEQ ID NO: 126446 - DNA, 20 bp, Artificial Sequence
  Description of Artificial Sequence: Synthetic oligonucleotide
  Target: ATXN1; (+) strand; PAM type: NRG; PAM sequence: AAG
agagtctaccaaagtgtccc

SEQ ID NO: 126447 - DNA, 20 bp, Artificial Sequence
  Description of Artificial Sequence: Synthetic oligonucleotide
  Target: ATXN1; (+) strand; PAM type: NRG; PAM sequence: AAG
ccaaagtgtcccaagtttat

SEQ ID NO: 126448 - DNA, 20 bp, Artificial Sequence
  Description of Artificial Sequence: Synthetic oligonucleotide
  Target: ATXN1; (+) strand; PAM type: NRG; PAM sequence: AAG
aagtgtcccaagtttataag

SEQ ID NO: 126449 - DNA, 20 bp, Artificial Sequence
  Description of Artificial Sequence: Synthetic oligonucleotide
  Target: ATXN1; (+) strand; PAM type: NRG; PAM sequence: TGG
taagaagtgactacatattg

SEQ ID NO: 126450 - DNA, 20 bp, Artificial Sequence
  Description of Artificial Sequence: Synthetic oligonucleotide
  Target: ATXN1; (+) strand; PAM type: NRG; PAM sequence: TAG
gaagtgactacatattgtgg

SEQ ID NO: 126451 - DNA, 20 bp, Artificial Sequence
  Description of Artificial Sequence: Synthetic oligonucleotide
  Target: ATXN1; (+) strand; PAM type: NRG; PAM sequence: TGG
ctacatattgtggtagcatg

SEQ ID NO: 126452 - DNA, 20 bp, Artificial Sequence
  Description of Artificial Sequence: Synthetic oligonucleotide
  Target: ATXN1; (+) strand; PAM type: NRG; PAM sequence: AAG
ctttttcttctacatttttc

SEQ ID NO: 126453 - DNA, 20 bp, Artificial Sequence
  Description of Artificial Sequence: Synthetic oligonucleotide
  Target: ATXN1; (+) strand; PAM type: NRG; PAM sequence: GAG
cttctacatttttcaagatt

SEQ ID NO: 126454 - DNA, 20 bp, Artificial Sequence
  Description of Artificial Sequence: Synthetic oligonucleotide
  Target: ATXN1; (+) strand; PAM type: NRG; PAM sequence: AAG
tacatttttcaagattgaga

SEQ ID NO: 126455 - DNA, 20 bp, Artificial Sequence
  Description of Artificial Sequence: Synthetic oligonucleotide
  Target: ATXN1; (+) strand; PAM type: NRG; PAM sequence: AGG
acatttttcaagattgagaa

SEQ ID NO: 126456 - DNA, 20 bp, Artificial Sequence
  Description of Artificial Sequence: Synthetic oligonucleotide
  Target: ATXN1; (+) strand; PAM type: NRG; PAM sequence: CAG
tttttcaagattgagaaagg

SEQ ID NO: 126457 - DNA, 20 bp, Artificial Sequence
  Description of Artificial Sequence: Synthetic oligonucleotide
  Target: ATXN1; (+) strand; PAM type: NRG; PAM sequence: AGG
ttttcaagattgagaaaggc

SEQ ID NO: 126458 - DNA, 20 bp, Artificial Sequence
  Description of Artificial Sequence: Synthetic oligonucleotide
  Target: ATXN1; (+) strand; PAM type: NRG; PAM sequence: AAG
gcaggctgaataaatataaa

SEQ ID NO: 126459 - DNA, 20 bp, Artificial Sequence
  Description of Artificial Sequence: Synthetic oligonucleotide
  Target: ATXN1; (+) strand; PAM type: NRG; PAM sequence: CAG
ataaatataaaaagccttaa

SEQ ID NO: 126460 - DNA, 20 bp, Artificial Sequence
  Description of Artificial Sequence: Synthetic oligonucleotide
  Target: ATXN1; (+) strand; PAM type: NRG; PAM sequence: AAG
taaaaagccttaacagcaaa

SEQ ID NO: 126461 - DNA, 20 bp, Artificial Sequence
  Description of Artificial Sequence: Synthetic oligonucleotide
  Target: ATXN1; (+) strand; PAM type: NRG; PAM sequence: TGG
ttaacagcaaaaagttgttt

SEQ ID NO: 126462 - DNA, 20 bp, Artificial Sequence
  Description of Artificial Sequence: Synthetic oligonucleotide
  Target: ATXN1; (+) strand; PAM type: NRG; PAM sequence: GAG
gcaaaaagttgttttggttt

SEQ ID NO: 126463 - DNA, 20 bp, Artificial Sequence
  Description of Artificial Sequence: Synthetic oligonucleotide
  Target: ATXN1; (+) strand; PAM type: NRG; PAM sequence: TGG
aaaagttgttttggtttgag

SEQ ID NO: 126464 - DNA, 20 bp, Artificial Sequence
  Description of Artificial Sequence: Synthetic oligonucleotide
  Target: ATXN1; (+) strand; PAM type: NRG; PAM sequence: GGG
aaagttgttttggtttgagt

SEQ ID NO: 126465 - DNA, 20 bp, Artificial Sequence
  Description of Artificial Sequence: Synthetic oligonucleotide
  Target: ATXN1; (+) strand; PAM type: NRG; PAM sequence: TAG
tgttttggtttgagtgggtg

SEQ ID NO: 126466 - DNA, 20 bp, Artificial Sequence
  Description of Artificial Sequence: Synthetic oligonucleotide
  Target: ATXN1; (+) strand; PAM type: NRG; PAM sequence: TAG
tggtttgagtgggtgtagca

SEQ ID NO: 126467 - DNA, 20 bp, Artificial Sequence
  Description of Artificial Sequence: Synthetic oligonucleotide
  Target: ATXN1; (+) strand; PAM type: NRG; PAM sequence: AAG
tttgagtgggtgtagcatag

SEQ ID NO: 126468 - DNA, 20 bp, Artificial Sequence
  Description of Artificial Sequence: Synthetic oligonucleotide
  Target: ATXN1; (+) strand; PAM type: NRG; PAM sequence: CAG
acaaactaacacatatacca

SEQ ID NO: 126469 - DNA, 20 bp, Artificial Sequence
  Description of Artificial Sequence: Synthetic oligonucleotide
  Target: ATXN1; (+) strand; PAM type: NRG; PAM sequence: AGG
caaactaacacatataccac

SEQ ID NO: 126470 - DNA, 20 bp, Artificial Sequence
  Description of Artificial Sequence: Synthetic oligonucleotide
  Target: ATXN1; (+) strand; PAM type: NRG; PAM sequence: GGG
aaactaacacatataccaca

SEQ ID NO: 126471 - DNA, 20 bp, Artificial Sequence
  Description of Artificial Sequence: Synthetic oligonucleotide
  Target: ATXN1; (+) strand; PAM type: NRG; PAM sequence: TAG
aacacatataccacagggaa

SEQ ID NO: 126472 - DNA, 20 bp, Artificial Sequence
  Description of Artificial Sequence: Synthetic oligonucleotide
  Target: ATXN1; (+) strand; PAM type: NRG; PAM sequence: TAG
cagggaatagaatcacacat

SEQ ID NO: 126473 - DNA, 20 bp, Artificial Sequence
  Description of Artificial Sequence: Synthetic oligonucleotide
  Target: ATXN1; (+) strand; PAM type: NRG; PAM sequence: CAG
gaatcacacattagaatatt

SEQ ID NO: 126474 - DNA, 20 bp, Artificial Sequence
  Description of Artificial Sequence: Synthetic oligonucleotide
  Target: ATXN1; (+) strand; PAM type: NRG; PAM sequence: TAG
tcacacattagaatattcag

SEQ ID NO: 126475 - DNA, 20 bp, Artificial Sequence
  Description of Artificial Sequence: Synthetic oligonucleotide
  Target: ATXN1; (+) strand; PAM type: NRG; PAM sequence: AGG
cacacattagaatattcagt

SEQ ID NO: 126476 - DNA, 20 bp, Artificial Sequence
  Description of Artificial Sequence: Synthetic oligonucleotide
  Target: ATXN1; (+) strand; PAM type: NRG; PAM sequence: TGG
acattagaatattcagtagg

SEQ ID NO: 126477 - DNA, 20 bp, Artificial Sequence
  Description of Artificial Sequence: Synthetic oligonucleotide
  Target: ATXN1; (+) strand; PAM type: NRG; PAM sequence: CGG
tagaatattcagtaggtggc

SEQ ID NO: 126478 - DNA, 20 bp, Artificial Sequence
  Description of Artificial Sequence: Synthetic oligonucleotide
  Target: ATXN1; (+) strand; PAM type: NRG; PAM sequence: CGG
attcagtaggtggccggacg

SEQ ID NO: 126479 - DNA, 20 bp, Artificial Sequence
  Description of Artificial Sequence: Synthetic oligonucleotide
  Target: ATXN1; (+) strand; PAM type: NRG; PAM sequence: TGG
cagtaggtggccggacgcgg

SEQ ID NO: 126480 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctgtaatcc

SEQ ID NO: 126481 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagcactt

SEQ ID NO: 126482 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 126483 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 126484 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 126485 - DNA, 20 bp, Artificial Sequence
  Description of Artificial Sequence: Synthetic oligonucleotide
  Target: ATXN1; (+) strand; PAM type: NRG; PAM sequence: AAG
tcccagcactttgggaggcc

SEQ ID NO: 126486 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggcca

SEQ ID NO: 126487 - DNA, 20 bp, Artificial Sequence
  Description of Artificial Sequence: Synthetic oligonucleotide
  Target: ATXN1; (+) strand; PAM type: NRG; PAM sequence: CGG
agcactttgggaggccaagg

SEQ ID NO: 126488 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccaaggc

SEQ ID NO: 126489 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccaaggcggg

SEQ ID NO: 126490 - DNA, 20 bp, Artificial Sequence
  Description of Artificial Sequence: Synthetic oligonucleotide
  Target: ATXN1; (+) strand; PAM type: NRG; PAM sequence: GAG
ccaaggcgggtggattacct

SEQ ID NO: 126491 - DNA, 20 bp, Artificial Sequence
  Description of Artificial Sequence: Synthetic oligonucleotide
  Target: ATXN1; (+) strand; PAM type: NRG; PAM sequence: AGG
caaggcgggtggattacctg

SEQ ID NO: 126492 - DNA, 20 bp, Artificial Sequence
  Description of Artificial Sequence: Synthetic oligonucleotide
  Target: ATXN1; (+) strand; PAM type: NRG; PAM sequence: CAG
gcgggtggattacctgaggt

SEQ ID NO: 126493 - DNA, 20 bp, Artificial Sequence
  Description of Artificial Sequence: Synthetic oligonucleotide
  Target: ATXN1; (+) strand; PAM type: NRG; PAM sequence: AGG
cgggtggattacctgaggtc

SEQ ID NO: 126494 - DNA, 20 bp, Artificial Sequence
  Description of Artificial Sequence: Synthetic oligonucleotide
  Target: ATXN1; (+) strand; PAM type: NRG; PAM sequence: GAG
ggtggattacctgaggtcag

SEQ ID NO: 126495 - DNA, 20 bp, Artificial Sequence
  Description of Artificial Sequence: Synthetic oligonucleotide
  Target: ATXN1; (+) strand; PAM type: NRG; PAM sequence: AGG
gtggattacctgaggtcagg

SEQ ID NO: 126496 - DNA, 20 bp, Artificial Sequence
  Description of Artificial Sequence: Synthetic oligonucleotide
  Target: ATXN1; (+) strand; PAM type: NRG; PAM sequence: AAG
ttacctgaggtcaggaggtc

SEQ ID NO: 126497 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggaggtcaagac

SEQ ID NO: 126498 - DNA, 20 bp, Artificial Sequence
  Description of Artificial Sequence: Synthetic oligonucleotide
  Target: ATXN1; (+) strand; PAM type: NRG; PAM sequence: TGG
tcaggaggtcaagaccagcc

SEQ ID NO: 126499 - DNA, 20 bp, Artificial Sequence
  Description of Artificial Sequence: Synthetic oligonucleotide
  Target: ATXN1; (+) strand; PAM type: NRG; PAM sequence: TGG
caagaccagcctggccaaaa

SEQ ID NO: 126500 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 126501 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatacaaaaattagc

SEQ ID NO: 126502 - DNA, 20 bp, Artificial Sequence
  Description of Artificial Sequence: Synthetic oligonucleotide
  Target: ATXN1; (+) strand; PAM type: NRG; PAM sequence: GGG
taaaaatacaaaaattagct

SEQ ID NO: 126503 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagctgggct

SEQ ID NO: 126504 - DNA, 20 bp, Artificial Sequence
  Description of Artificial Sequence: Synthetic oligonucleotide
  Target: ATXN1; (+) strand; PAM type: NRG; PAM sequence: TGG
caaaaattagctgggcttgg

SEQ ID NO: 126505 - DNA, 20 bp, Artificial Sequence
  Description of Artificial Sequence: Synthetic oligonucleotide
  Target: ATXN1; (+) strand; PAM type: NRG; PAM sequence: CAG
aaattagctgggcttggtgg

SEQ ID NO: 126506 - DNA, 20 bp, Artificial Sequence
  Description of Artificial Sequence: Synthetic oligonucleotide
  Target: ATXN1; (+) strand; PAM type: NRG; PAM sequence: AGG
aattagctgggcttggtggc

SEQ ID NO: 126507 - DNA, 20 bp, Artificial Sequence
  Description of Artificial Sequence: Synthetic oligonucleotide
  Target: ATXN1; (+) strand; PAM type: NRG; PAM sequence: CAG
gtggcaggtgcctgtaatcc

SEQ ID NO: 126508 - DNA, 20 bp, Artificial Sequence
  Description of Artificial Sequence: Synthetic oligonucleotide
  Target: ATXN1; (+) strand; PAM type: NRG; PAM sequence: CGG
tgcctgtaatcccagctact

SEQ ID NO: 126509 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagctactc

SEQ ID NO: 126510 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctactcgg

SEQ ID NO: 126511 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctactcggg

SEQ ID NO: 126512 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcgggaggct

SEQ ID NO: 126513 - DNA, 20 bp, Artificial Sequence
  Description of Artificial Sequence: Synthetic oligonucleotide
  Target: ATXN1; (+) strand; PAM type: NRG; PAM sequence: AGG
cccagctactcgggaggctg

SEQ ID NO: 126514 - DNA, 20 bp, Artificial Sequence
  Description of Artificial Sequence: Synthetic oligonucleotide
  Target: ATXN1; (+) strand; PAM type: NRG; PAM sequence: CAG
agctactcgggaggctgagg

SEQ ID NO: 126515 - DNA, 20 bp, Artificial Sequence
  Description of Artificial Sequence: Synthetic oligonucleotide
  Target: ATXN1; (+) strand; PAM type: NRG; PAM sequence: AGG
gctactcgggaggctgaggc

SEQ ID NO: 126516 - DNA, 20 bp, Artificial Sequence
  Description of Artificial Sequence: Synthetic oligonucleotide
  Target: ATXN1; (+) strand; PAM type: NRG; PAM sequence: GAG
tactcgggaggctgaggcag

SEQ ID NO: 126517 - DNA, 20 bp, Artificial Sequence
  Description of Artificial Sequence: Synthetic oligonucleotide
  Target: ATXN1; (+) strand; PAM type: NRG; PAM sequence: AGG
actcgggaggctgaggcagg

SEQ ID NO: 126518 - DNA, 20 bp, Artificial Sequence
  Description of Artificial Sequence: Synthetic oligonucleotide
  Target: ATXN1; (+) strand; PAM type: NRG; PAM sequence: CGG
gcaggaggatcacttgaacc

SEQ ID NO: 126519 - DNA, 20 bp, Artificial Sequence
  Description of Artificial Sequence: Synthetic oligonucleotide
  Target: ATXN1; (+) strand; PAM type: NRG; PAM sequence: GGG
caggaggatcacttgaaccc

SEQ ID NO: 126520 - DNA, 20 bp, Artificial Sequence
  Description of Artificial Sequence: Synthetic oligonucleotide
  Target: ATXN1; (+) strand; PAM type: NRG; PAM sequence: GAG
ggaggatcacttgaacccgg

SEQ ID NO: 126521 - DNA, 20 bp, Artificial Sequence
  Description of Artificial Sequence: Synthetic oligonucleotide
  Target: ATXN1; (+) strand; PAM type: NRG; PAM sequence: AGG
gaggatcacttgaacccggg

SEQ ID NO: 126522 - DNA, 20 bp, Artificial Sequence
  Description of Artificial Sequence: Synthetic oligonucleotide
  Target: ATXN1; (+) strand; PAM type: NRG; PAM sequence: TGG
gatcacttgaacccgggagg

SEQ ID NO: 126523 - DNA, 20 bp, Artificial Sequence
  Description of Artificial Sequence: Synthetic oligonucleotide
  Target: ATXN1; (+) strand; PAM type: NRG; PAM sequence: AAG
cacttgaacccgggaggtgg

SEQ ID NO: 126524 - DNA, 20 bp, Artificial Sequence
  Description of Artificial Sequence: Synthetic oligonucleotide
  Target: ATXN1; (+) strand; PAM type: NRG; PAM sequence: CAG
aacccgggaggtggaagctg

SEQ ID NO: 126525 - DNA, 20 bp, Artificial Sequence
  Description of Artificial Sequence: Synthetic oligonucleotide
  Target: ATXN1; (+) strand; PAM type: NRG; PAM sequence: GAG
cgggaggtggaagctgcagt

SEQ ID NO: 126526 - DNA, 20 bp, Artificial Sequence
  Description of Artificial Sequence: Synthetic oligonucleotide
  Target: ATXN1; (+) strand; PAM type: NRG; PAM sequence: GAG
ggtggaagctgcagtgagtc

SEQ ID NO: 126527 - DNA, 20 bp, Artificial Sequence
  Description of Artificial Sequence: Synthetic oligonucleotide
  Target: ATXN1; (+) strand; PAM type: NRG; PAM sequence: CAG
gagaatgcaccactgcactc

SEQ ID NO: 126528 - DNA, 20 bp, Artificial Sequence
  Description of Artificial Sequence: Synthetic oligonucleotide
  Target: ATXN1; (+) strand; PAM type: NRG; PAM sequence: TGG
tgcaccactgcactccagcc

SEQ ID NO: 126529 - DNA, 20 bp, Artificial Sequence
  Description of Artificial Sequence: Synthetic oligonucleotide
  Target: ATXN1; (+) strand; PAM type: NRG; PAM sequence: GGG
gcaccactgcactccagcct

SEQ ID NO: 126530 - DNA, 20 bp, Artificial Sequence
  Description of Artificial Sequence: Synthetic oligonucleotide
  Target: ATXN1; (+) strand; PAM type: NRG; PAM sequence: AAG
tgcactccagcctgggcaac

SEQ ID NO: 126531 - DNA, 20 bp, Artificial Sequence
  Description of Artificial Sequence: Synthetic oligonucleotide
  Target: ATXN1; (+) strand; PAM type: NRG; PAM sequence: GAG
cactccagcctgggcaacaa

SEQ ID NO: 126532 - DNA, 20 bp, Artificial Sequence
  Description of Artificial Sequence: Synthetic oligonucleotide
  Target: ATXN1; (+) strand; PAM type: NRG; PAM sequence: AAG
catctcaaaaaaaaaaaaaa

SEQ ID NO: 126533 - DNA, 20 bp, Artificial Sequence
  Description of Artificial Sequence: Synthetic oligonucleotide
  Target: ATXN1; (+) strand; PAM type: NRG; PAM sequence: CAG
aaaaaaaaaaaaagaatatt

SEQ ID NO: 126534 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaaaagaatattcag

SEQ ID NO: 126535 - DNA, 20 bp, Artificial Sequence
  Description of Artificial Sequence: Synthetic oligonucleotide
  Target: ATXN1; (+) strand; PAM type: NRG; PAM sequence: GGG
aaaaaaaaagaatattcagt

SEQ ID NO: 126536 - DNA, 20 bp, Artificial Sequence
  Description of Artificial Sequence: Synthetic oligonucleotide
  Target: ATXN1; (+) strand; PAM type: NRG; PAM sequence: AAG
gggtgttcaacatatcgaaa

SEQ ID NO: 126537 - DNA, 20 bp, Artificial Sequence
  Description of Artificial Sequence: Synthetic oligonucleotide
  Target: ATXN1; (+) strand; PAM type: NRG; PAM sequence: AGG
ggtgttcaacatatcgaaaa

SEQ ID NO: 126538 - DNA, 20 bp, Artificial Sequence
  Description of Artificial Sequence: Synthetic oligonucleotide
  Target: ATXN1; (+) strand; PAM type: NRG; PAM sequence: AAG
cgaaaaaggactcaatttta

SEQ ID NO: 126539 - DNA, 20 bp, Artificial Sequence
  Description of Artificial Sequence: Synthetic oligonucleotide
  Target: ATXN1; (+) strand; PAM type: NRG; PAM sequence: CGG
aggactcaattttaaagact

SEQ ID NO: 126540 - DNA, 20 bp, Artificial Sequence
  Description of Artificial Sequence: Synthetic oligonucleotide
  Target: ATXN1; (+) strand; PAM type: NRG; PAM sequence: GGG
ggactcaattttaaagactc

SEQ ID NO: 126541 - DNA, 20 bp, Artificial Sequence
  Description of Artificial Sequence: Synthetic oligonucleotide
  Target: ATXN1; (+) strand; PAM type: NRG; PAM sequence: TGG
attttaaagactcgggataa

SEQ ID NO: 126542 - DNA, 20 bp, Artificial Sequence
  Description of Artificial Sequence: Synthetic oligonucleotide
  Target: ATXN1; (+) strand; PAM type: NRG; PAM sequence: GGG
ttttaaagactcgggataat

SEQ ID NO: 126543 - DNA, 20 bp, Artificial Sequence
  Description of Artificial Sequence: Synthetic oligonucleotide
  Target: ATXN1; (+) strand; PAM type: NRG; PAM sequence: TAG
gactcgggataatgggtgaa

SEQ ID NO: 126544 - DNA, 20 bp, Artificial Sequence
  Description of Artificial Sequence: Synthetic oligonucleotide
  Target: ATXN1; (+) strand; PAM type: NRG; PAM sequence: AGG
actcgggataatgggtgaat

SEQ ID NO: 126545 - DNA, 20 bp, Artificial Sequence
  Description of Artificial Sequence: Synthetic oligonucleotide
  Target: ATXN1; (+) strand; PAM type: NRG; PAM sequence: GGG
ctcgggataatgggtgaata

SEQ ID NO: 126546 - DNA, 20 bp, Artificial Sequence
  Description of Artificial Sequence: Synthetic oligonucleotide
  Target: ATXN1; (+) strand; PAM type: NRG; PAM sequence: TGG
ggataatgggtgaataggga

SEQ ID NO: 126547 - DNA, 20 bp, Artificial Sequence
  Description of Artificial Sequence: Synthetic oligonucleotide
  Target: ATXN1; (+) strand; PAM type: NRG; PAM sequence: TAG
aatgggtgaatagggatggc

SEQ ID NO: 126548 - DNA, 20 bp, Artificial Sequence
  Description of Artificial Sequence: Synthetic oligonucleotide
  Target: ATXN1; (+) strand; PAM type: NRG; PAM sequence: AAG
tgaatagggatggctagatc

SEQ ID NO: 126549 - DNA, 20 bp, Artificial Sequence
  Description of Artificial Sequence: Synthetic oligonucleotide
  Target: ATXN1; (+) strand; PAM type: NRG; PAM sequence: AAG
agatcaagtattaaatcgct

SEQ ID NO: 126550 - DNA, 20 bp, Artificial Sequence
  Description of Artificial Sequence: Synthetic oligonucleotide
  Target: ATXN1; (+) strand; PAM type: NRG; PAM sequence: AAG
gtattaaatcgctaagtctg

SEQ ID NO: 126551 - DNA, 20 bp, Artificial Sequence
  Description of Artificial Sequence: Synthetic oligonucleotide
  Target: ATXN1; (+) strand; PAM type: NRG; PAM sequence: AAG
aaatcgctaagtctgaagtc

SEQ ID NO: 126552 - DNA, 20 bp, Artificial Sequence
  Description of Artificial Sequence: Synthetic oligonucleotide
  Target: ATXN1; (+) strand; PAM type: NRG; PAM sequence: CAG
tcaagcaaatgtccttgttt

SEQ ID NO: 126553 - DNA, 20 bp, Artificial Sequence
  Description of Artificial Sequence: Synthetic oligonucleotide
  Target: ATXN1; (+) strand; PAM type: NRG; PAM sequence: TGG
tccttgtttcagcccaatca

SEQ ID NO: 126554 - DNA, 20 bp, Artificial Sequence
  Description of Artificial Sequence: Synthetic oligonucleotide
  Target: ATXN1; (+) strand; PAM type: NRG; PAM sequence: TAG
ttgtttcagcccaatcatgg

SEQ ID NO: 126555 - DNA, 20 bp, Artificial Sequence
  Description of Artificial Sequence: Synthetic oligonucleotide
  Target: ATXN1; (+) strand; PAM type: NRG; PAM sequence: GAG
gtttcagcccaatcatggta

SEQ ID NO: 126556 - DNA, 20 bp, Artificial Sequence
  Description of Artificial Sequence: Synthetic oligonucleotide
  Target: ATXN1; (+) strand; PAM type: NRG; PAM sequence: CAG
ggtagagttacttaatgata

SEQ ID NO: 126557 - DNA, 20 bp, Artificial Sequence
  Description of Artificial Sequence: Synthetic oligonucleotide
  Target: ATXN1; (+) strand; PAM type: NRG; PAM sequence: GAG
tagagttacttaatgataca

SEQ ID NO: 126558 - DNA, 20 bp, Artificial Sequence
  Description of Artificial Sequence: Synthetic oligonucleotide
  Target: ATXN1; (+) strand; PAM type: NRG; PAM sequence: AGG
agagttacttaatgatacag

SEQ ID NO: 126559 - DNA, 20 bp, Artificial Sequence
  Description of Artificial Sequence: Synthetic oligonucleotide
  Target: ATXN1; (+) strand; PAM type: NRG; PAM sequence: AAG
ttacttaatgatacagagga

SEQ ID NO: 126560 - DNA, 20 bp, Artificial Sequence
  Description of Artificial Sequence: Synthetic oligonucleotide
  Target: ATXN1; (+) strand; PAM type: NRG; PAM sequence: GAG
tgaaaaaactgtatgatctt

SEQ ID NO: 126561 - DNA, 20 bp, Artificial Sequence
  Description of Artificial Sequence: Synthetic oligonucleotide
  Target: ATXN1; (+) strand; PAM type: NRG; PAM sequence: TAG
tgtatgatcttgagtgatcc

SEQ ID NO: 126562 - DNA, 20 bp, Artificial Sequence
  Description of Artificial Sequence: Synthetic oligonucleotide
  Target: ATXN1; (+) strand; PAM type: NRG; PAM sequence: AAG
agaaattaaatcactatttg

SEQ ID NO: 126563 - DNA, 20 bp, Artificial Sequence
  Description of Artificial Sequence: Synthetic oligonucleotide
  Target: ATXN1; (+) strand; PAM type: NRG; PAM sequence: AGG
gaaattaaatcactatttga

SEQ ID NO: 126564 - DNA, 20 bp, Artificial Sequence
  Description of Artificial Sequence: Synthetic oligonucleotide
  Target: ATXN1; (+) strand; PAM type: NRG; PAM sequence: CAG
taaaaaaaaaaaaaaaaaat

SEQ ID NO: 126565 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaaaaaaaaaaatc

SEQ ID NO: 126566 - DNA, 20 bp, Artificial Sequence
  Description of Artificial Sequence: Synthetic oligonucleotide
  Target: ATXN1; (+) strand; PAM type: NRG; PAM sequence: TAG
caggacttaccatatttctt

SEQ ID NO: 126567 - DNA, 20 bp, Artificial Sequence
  Description of Artificial Sequence: Synthetic oligonucleotide
  Target: ATXN1; (+) strand; PAM type: NRG; PAM sequence: AAG
gacttaccatatttctttag

SEQ ID NO: 126568 - DNA, 20 bp, Artificial Sequence
  Description of Artificial Sequence: Synthetic oligonucleotide
  Target: ATXN1; (+) strand; PAM type: NRG; PAM sequence: AGG
acttaccatatttctttaga

SEQ ID NO: 126569 - DNA, 20 bp, Artificial Sequence
  Description of Artificial Sequence: Synthetic oligonucleotide
  Target: ATXN1; (+) strand; PAM type: NRG; PAM sequence: CAG
caaaaattaaaatattcatt

SEQ ID NO: 126570 - DNA, 20 bp, Artificial Sequence
  Description of Artificial Sequence: Synthetic oligonucleotide
  Target: ATXN1; (+) strand; PAM type: NRG; PAM sequence: AAG
agtgttaatatttctaatct

SEQ ID NO: 126571 - DNA, 20 bp, Artificial Sequence
  Description of Artificial Sequence: Synthetic oligonucleotide
  Target: ATXN1; (+) strand; PAM type: NRG; PAM sequence: AAG
ctaatctaagttccttctca

SEQ ID NO: 126572 - DNA, 20 bp, Artificial Sequence
  Description of Artificial Sequence: Synthetic oligonucleotide
  Target: ATXN1; (+) strand; PAM type: NRG; PAM sequence: GAG
aatctaagttccttctcaaa

SEQ ID NO: 126573 - DNA, 20 bp, Artificial Sequence
  Description of Artificial Sequence: Synthetic oligonucleotide
  Target: ATXN1; (+) strand; PAM type: NRG; PAM sequence: TGG
aagttccttctcaaagagaa

SEQ ID NO: 126574 - DNA, 20 bp, Artificial Sequence
  Description of Artificial Sequence: Synthetic oligonucleotide
  Target: ATXN1; (+) strand; PAM type: NRG; PAM sequence: TGG
tccttctcaaagagaatggt

SEQ ID NO: 126575 - DNA, 20 bp, Artificial Sequence
  Description of Artificial Sequence: Synthetic oligonucleotide
  Target: ATXN1; (+) strand; PAM type: NRG; PAM sequence: TGG
ctcaaagagaatggttggtt

SEQ ID NO: 126576 - DNA, 20 bp, Artificial Sequence
  Description of Artificial Sequence: Synthetic oligonucleotide
  Target: ATXN1; (+) strand; PAM type: NRG; PAM sequence: TAG
tttggtaaaaatatatgtga

SEQ ID NO: 126577 - DNA, 20 bp, Artificial Sequence
  Description of Artificial Sequence: Synthetic oligonucleotide
  Target: ATXN1; (+) strand; PAM type: NRG; PAM sequence: AGG
ttggtaaaaatatatgtgat

SEQ ID NO: 126578 - DNA, 20 bp, Artificial Sequence
  Description of Artificial Sequence: Synthetic oligonucleotide
  Target: ATXN1; (+) strand; PAM type: NRG; PAM sequence: AAG
atatgtgataggatttgctg

SEQ ID NO: 126579 - DNA, 20 bp, Artificial Sequence
  Description of Artificial Sequence: Synthetic oligonucleotide
  Target: ATXN1; (+) strand; PAM type: NRG; PAM sequence: AAG
acacatccttgccctcaatt

SEQ ID NO: 126580 - DNA, 20 bp, Artificial Sequence
  Description of Artificial Sequence: Synthetic oligonucleotide
  Target: ATXN1; (+) strand; PAM type: NRG; PAM sequence: AGG
cacatccttgccctcaatta

SEQ ID NO: 126581 - DNA, 20 bp, Artificial Sequence
  Description of Artificial Sequence: Synthetic oligonucleotide
  Target: ATXN1; (+) strand; PAM type: NRG; PAM sequence: GGG
acatccttgccctcaattaa

SEQ ID NO: 126582 - DNA, 20 bp, Artificial Sequence
  Description of Artificial Sequence: Synthetic oligonucleotide
  Target: ATXN1; (+) strand; PAM type: NRG; PAM sequence: TAG
gccatacctccccccgcgac

SEQ ID NO: 126583 - DNA, 20 bp, Artificial Sequence
  Description of Artificial Sequence: Synthetic oligonucleotide
  Target: ATXN1; (+) strand; PAM type: NRG; PAM sequence: CAG
ccccgcgactagtgacattc

SEQ ID NO: 126584 - DNA, 20 bp, Artificial Sequence
  Description of Artificial Sequence: Synthetic oligonucleotide
  Target: ATXN1; (+) strand; PAM type: NRG; PAM sequence: AGG
cccgcgactagtgacattcc

SEQ ID NO: 126585 - DNA, 20 bp, Artificial Sequence
  Description of Artificial Sequence: Synthetic oligonucleotide
  Target: ATXN1; (+) strand; PAM type: NRG; PAM sequence: GAG
tccaggaaaatctcactttt

SEQ ID NO: 126586 - DNA, 20 bp, Artificial Sequence
  Description of Artificial Sequence: Synthetic oligonucleotide
  Target: ATXN1; (+) strand; PAM type: NRG; PAM sequence: AGG
ccaggaaaatctcacttttg

SEQ ID NO: 126587 - DNA, 20 bp, Artificial Sequence
  Description of Artificial Sequence: Synthetic oligonucleotide
  Target: ATXN1; (+) strand; PAM type: NRG; PAM sequence: GGG
caggaaaatctcacttttga

SEQ ID NO: 126588 - DNA, 20 bp, Artificial Sequence
  Description of Artificial Sequence: Synthetic oligonucleotide
  Target: ATXN1; (+) strand; PAM type: NRG; PAM sequence: GGG
aggaaaatctcacttttgag

SEQ ID NO: 126589 - DNA, 20 bp, Artificial Sequence
  Description of Artificial Sequence: Synthetic oligonucleotide
  Target: ATXN1; (+) strand; PAM type: NRG; PAM sequence: GAG
gaaaatctcacttttgaggg

SEQ ID NO: 126590 - DNA, 20 bp, Artificial Sequence
  Description of Artificial Sequence: Synthetic oligonucleotide
  Target: ATXN1; (+) strand; PAM type: NRG; PAM sequence: AGG
aaaatctcacttttgagggg

SEQ ID NO: 126591 - DNA, 20 bp, Artificial Sequence
  Description of Artificial Sequence: Synthetic oligonucleotide
  Target: ATXN1; (+) strand; PAM type: NRG; PAM sequence: TGG
tctcacttttgaggggaggc

SEQ ID NO: 126592 - DNA, 20 bp, Artificial Sequence
  Description of Artificial Sequence: Synthetic oligonucleotide
  Target: ATXN1; (+) strand; PAM type: NRG; PAM sequence: GGG
ctcacttttgaggggaggct

SEQ ID NO: 126593 - DNA, 20 bp, Artificial Sequence
  Description of Artificial Sequence: Synthetic oligonucleotide
  Target: ATXN1; (+) strand; PAM type: NRG; PAM sequence: GGG
tcacttttgaggggaggctg

SEQ ID NO: 126594 - DNA, 20 bp, Artificial Sequence
  Description of Artificial Sequence: Synthetic oligonucleotide
  Target: ATXN1; (+) strand; PAM type: NRG; PAM sequence: AAG
cttttgaggggaggctgggg

SEQ ID NO: 126595 - DNA, 20 bp, Artificial Sequence
  Description of Artificial Sequence: Synthetic oligonucleotide
  Target: ATXN1; (+) strand; PAM type: NRG; PAM sequence: GAG
tgaggggaggctggggaagt

SEQ ID NO: 126596 - DNA, 20 bp, Artificial Sequence
  Description of Artificial Sequence: Synthetic oligonucleotide
  Target: ATXN1; (+) strand; PAM type: NRG; PAM sequence: TGG
aagtgagcatatccccgcaa

SEQ ID NO: 126597 - DNA, 20 bp, Artificial Sequence
  Description of Artificial Sequence: Synthetic oligonucleotide
  Target: ATXN1; (+) strand; PAM type: NRG; PAM sequence: GGG
agtgagcatatccccgcaat

SEQ ID NO: 126598 - DNA, 20 bp, Artificial Sequence
  Description of Artificial Sequence: Synthetic oligonucleotide
  Target: ATXN1; (+) strand; PAM type: NRG; PAM sequence: CAG
gagcatatccccgcaatggg

SEQ ID NO: 126599 - DNA, 20 bp, Artificial Sequence
  Description of Artificial Sequence: Synthetic oligonucleotide
  Target: ATXN1; (+) strand; PAM type: NRG; PAM sequence: GAG
gcatatccccgcaatgggca

SEQ ID NO: 126600 - DNA, 20 bp, Artificial Sequence
  Description of Artificial Sequence: Synthetic oligonucleotide
  Target: ATXN1; (+) strand; PAM type: NRG; PAM sequence: TGG
cccgcaatgggcagagtgtg

SEQ ID NO: 126601 - DNA, 20 bp, Artificial Sequence
  Description of Artificial Sequence: Synthetic oligonucleotide
  Target: ATXN1; (+) strand; PAM type: NRG; PAM sequence: CAG
gtgtgtggaaatcgtgtctc

SEQ ID NO: 126602 - DNA, 20 bp, Artificial Sequence
  Description of Artificial Sequence: Synthetic oligonucleotide
  Target: ATXN1; (+) strand; PAM type: NRG; PAM sequence: TGG
ggaaatcgtgtctccagcca

SEQ ID NO: 126603 - DNA, 20 bp, Artificial Sequence
  Description of Artificial Sequence: Synthetic oligonucleotide
  Target: ATXN1; (+) strand; PAM type: NRG; PAM sequence: GAG
aaatcgtgtctccagccatg

SEQ ID NO: 126604 - DNA, 20 bp, Artificial Sequence
  Description of Artificial Sequence: Synthetic oligonucleotide
  Target: ATXN1; (+) strand; PAM type: NRG; PAM sequence: CAG
cagccatggagacacgaatg

SEQ ID NO: 126605 - DNA, 20 bp, Artificial Sequence
  Description of Artificial Sequence: Synthetic oligonucleotide
  Target: ATXN1; (+) strand; PAM type: NRG; PAM sequence: AAG
gaatgcagttaaccttttct

SEQ ID NO: 126606 - DNA, 20 bp, Artificial Sequence
  Description of Artificial Sequence: Synthetic oligonucleotide
  Target: ATXN1; (+) strand; PAM type: NRG; PAM sequence: CAG
tccaacactgctccatgaat

SEQ ID NO: 126607 - DNA, 20 bp, Artificial Sequence
  Description of Artificial Sequence: Synthetic oligonucleotide
  Target: ATXN1; (+) strand; PAM type: NRG; PAM sequence: AGG
ccaacactgctccatgaatc

SEQ ID NO: 126608 - DNA, 20 bp, Artificial Sequence
  Description of Artificial Sequence: Synthetic oligonucleotide
  Target: ATXN1; (+) strand; PAM type: NRG; PAM sequence: CAG
acactgctccatgaatcagg

SEQ ID NO: 126609 - DNA, 20 bp, Artificial Sequence
  Description of Artificial Sequence: Synthetic oligonucleotide
  Target: ATXN1; (+) strand; PAM type: NRG; PAM sequence: AGG
cactgctccatgaatcaggc

SEQ ID NO: 126610 - DNA, 20 bp, Artificial Sequence
  Description of Artificial Sequence: Synthetic oligonucleotide
  Target: ATXN1; (+) strand; PAM type: NRG; PAM sequence: GAG
ctgctccatgaatcaggcag

SEQ ID NO: 126611 - DNA, 20 bp, Artificial Sequence
  Description of Artificial Sequence: Synthetic oligonucleotide
  Target: ATXN1; (+) strand; PAM type: NRG; PAM sequence: TGG
tccatgaatcaggcaggaga

SEQ ID NO: 126612 - DNA, 20 bp, Artificial Sequence
  Description of Artificial Sequence: Synthetic oligonucleotide
  Target: ATXN1; (+) strand; PAM type: NRG; PAM sequence: GGG
ccatgaatcaggcaggagat

SEQ ID NO: 126613 - DNA, 20 bp, Artificial Sequence
  Description of Artificial Sequence: Synthetic oligonucleotide
  Target: ATXN1; (+) strand; PAM type: NRG; PAM sequence: GGG
catgaatcaggcaggagatg

SEQ ID NO: 126614 - DNA, 20 bp, Artificial Sequence
  Description of Artificial Sequence: Synthetic oligonucleotide
  Target: ATXN1; (+) strand; PAM type: NRG; PAM sequence: TGG
aatcaggcaggagatggggc

SEQ ID NO: 126615 - DNA, 20 bp, Artificial Sequence
  Description of Artificial Sequence: Synthetic oligonucleotide
  Target: ATXN1; (+) strand; PAM type: NRG; PAM sequence: CAG
caggcaggagatggggctgg

SEQ ID NO: 126616 - DNA, 20 bp, Artificial Sequence
  Description of Artificial Sequence: Synthetic oligonucleotide
  Target: ATXN1; (+) strand; PAM type: NRG; PAM sequence: GAG
ggcaggagatggggctggca

SEQ ID NO: 126617 - DNA, 20 bp, Artificial Sequence
  Description of Artificial Sequence: Synthetic oligonucleotide
  Target: ATXN1; (+) strand; PAM type: NRG; PAM sequence: GAG
caggagatggggctggcaga

SEQ ID NO: 126618 - DNA, 20 bp, Artificial Sequence
  Description of Artificial Sequence: Synthetic oligonucleotide
  Target: ATXN1; (+) strand; PAM type: NRG; PAM sequence: CAG
gagatggggctggcagagag

SEQ ID NO: 126619 - DNA, 20 bp, Artificial Sequence
  Description of Artificial Sequence: Synthetic oligonucleotide
  Target: ATXN1; (+) strand; PAM type: NRG; PAM sequence: CAG
atggggctggcagagagcag

SEQ ID NO: 126620 - DNA, 20 bp, Artificial Sequence
  Description of Artificial Sequence: Synthetic oligonucleotide
  Target: ATXN1; (+) strand; PAM type: NRG; PAM sequence: GAG
ggggctggcagagagcagca

SEQ ID NO: 126621 - DNA, 20 bp, Artificial Sequence
  Description of Artificial Sequence: Synthetic oligonucleotide
  Target: ATXN1; (+) strand; PAM type: NRG; PAM sequence: AGG
gggctggcagagagcagcag

SEQ ID NO: 126622 - DNA, 20 bp, Artificial Sequence
  Description of Artificial Sequence: Synthetic oligonucleotide
  Target: ATXN1; (+) strand; PAM type: NRG; PAM sequence: GGG
ggctggcagagagcagcaga

SEQ ID NO: 126623 - DNA, 20 bp, Artificial Sequence
  Description of Artificial Sequence: Synthetic oligonucleotide
  Target: ATXN1; (+) strand; PAM type: NRG; PAM sequence: GAG
ctggcagagagcagcagagg

SEQ ID NO: 126624 - DNA, 20 bp, Artificial Sequence
  Description of Artificial Sequence: Synthetic oligonucleotide
  Target: ATXN1; (+) strand; PAM type: NRG; PAM sequence: AAG
cagagagcagcagagggaga

SEQ ID NO: 126625 - DNA, 20 bp, Artificial Sequence
  Description of Artificial Sequence: Synthetic oligonucleotide
  Target: ATXN1; (+) strand; PAM type: NRG; PAM sequence: TAG
gcagagggagaaagaacaca

SEQ ID NO: 126626 - DNA, 20 bp, Artificial Sequence
  Description of Artificial Sequence: Synthetic oligonucleotide
  Target: ATXN1; (+) strand; PAM type: NRG; PAM sequence: CAG
gagggagaaagaacacatag

SEQ ID NO: 126627 - DNA, 20 bp, Artificial Sequence
  Description of Artificial Sequence: Synthetic oligonucleotide
  Target: ATXN1; (+) strand; PAM type: NRG; PAM sequence: CAG
ggagaaagaacacatagcag

SEQ ID NO: 126628 - DNA, 20 bp, Artificial Sequence
  Description of Artificial Sequence: Synthetic oligonucleotide
  Target: ATXN1; (+) strand; PAM type: NRG; PAM sequence: AAG
aagaacacatagcagcagca

SEQ ID NO: 126629 - DNA, 20 bp, Artificial Sequence
  Description of Artificial Sequence: Synthetic oligonucleotide
  Target: ATXN1; (+) strand; PAM type: NRG; PAM sequence: AAG
gcagcagcaaagaaatgcca

SEQ ID NO: 126630 - DNA, 20 bp, Artificial Sequence
  Description of Artificial Sequence: Synthetic oligonucleotide
  Target: ATXN1; (+) strand; PAM type: NRG; PAM sequence: AGG
cagcagcaaagaaatgccaa

SEQ ID NO: 126631 - DNA, 20 bp, Artificial Sequence
  Description of Artificial Sequence: Synthetic oligonucleotide
  Target: ATXN1; (+) strand; PAM type: NRG; PAM sequence: GAG
gcagcaaagaaatgccaaag

SEQ ID NO: 126632 - DNA, 20 bp, Artificial Sequence
  Description of Artificial Sequence: Synthetic oligonucleotide
  Target: ATXN1; (+) strand; PAM type: NRG; PAM sequence: TAG
caaagaaatgccaaaggaga

SEQ ID NO: 126633 - DNA, 20 bp, Artificial Sequence
  Description of Artificial Sequence: Synthetic oligonucleotide
  Target: ATXN1; (+) strand; PAM type: NRG; PAM sequence: TGG
atgccaaaggagatagatac

SEQ ID NO: 126634 - DNA, 20 bp, Artificial Sequence
  Description of Artificial Sequence: Synthetic oligonucleotide
  Target: ATXN1; (+) strand; PAM type: NRG; PAM sequence: CAG
agatactggctgcaaaatcc

SEQ ID NO: 126635 - DNA, 20 bp, Artificial Sequence
  Description of Artificial Sequence: Synthetic oligonucleotide
  Target: ATXN1; (+) strand; PAM type: NRG; PAM sequence: GAG
actggctgcaaaatcccagc

SEQ ID NO: 126636 - DNA, 20 bp, Artificial Sequence
  Description of Artificial Sequence: Synthetic oligonucleotide
  Target: ATXN1; (+) strand; PAM type: NRG; PAM sequence: AAG
gcaaaatcccagcgagatca

SEQ ID NO: 126637 - DNA, 20 bp, Artificial Sequence
  Description of Artificial Sequence: Synthetic oligonucleotide
  Target: ATXN1; (+) strand; PAM type: NRG; PAM sequence: AGG
caaaatcccagcgagatcaa

SEQ ID NO: 126638 - DNA, 20 bp, Artificial Sequence
  Description of Artificial Sequence: Synthetic oligonucleotide
  Target: ATXN1; (+) strand; PAM type: NRG; PAM sequence: CGG
aatcccagcgagatcaaagg

SEQ ID NO: 126639 - DNA, 20 bp, Artificial Sequence
  Description of Artificial Sequence: Synthetic oligonucleotide
  Target: ATXN1; (+) strand; PAM type: NRG; PAM sequence: GAG
tcccagcgagatcaaaggcg

SEQ ID NO: 126640 - DNA, 20 bp, Artificial Sequence
  Description of Artificial Sequence: Synthetic oligonucleotide
  Target: ATXN1; (+) strand; PAM type: NRG; PAM sequence: AAG
agatcaaaggcggagatgca

SEQ ID NO: 126641 - DNA, 20 bp, Artificial Sequence
  Description of Artificial Sequence: Synthetic oligonucleotide
  Target: ATXN1; (+) strand; PAM type: NRG; PAM sequence: TAG
tcaaaggcggagatgcaaag

SEQ ID NO: 126642 - DNA, 20 bp, Artificial Sequence
  Description of Artificial Sequence: Synthetic oligonucleotide
  Target: ATXN1; (+) strand; PAM type: NRG; PAM sequence: GAG
aaaggcggagatgcaaagta

SEQ ID NO: 126643 - DNA, 20 bp, Artificial Sequence
  Description of Artificial Sequence: Synthetic oligonucleotide
  Target: ATXN1; (+) strand; PAM type: NRG; PAM sequence: CAG
agatgcaaagtagagcaaca

SEQ ID NO: 126644 - DNA, 20 bp, Artificial Sequence
  Description of Artificial Sequence: Synthetic oligonucleotide
  Target: ATXN1; (+) strand; PAM type: NRG; PAM sequence: GAG
atgcaaagtagagcaacaca

SEQ ID NO: 126645 - DNA, 20 bp, Artificial Sequence
  Description of Artificial Sequence: Synthetic oligonucleotide
  Target: ATXN1; (+) strand; PAM type: NRG; PAM sequence: AAG
agagtctgatctgtgaaacc

SEQ ID NO: 126646 - DNA, 20 bp, Artificial Sequence
  Description of Artificial Sequence: Synthetic oligonucleotide
  Target: ATXN1; (+) strand; PAM type: NRG; PAM sequence: AGG
gagtctgatctgtgaaacca

SEQ ID NO: 126647 - DNA, 20 bp, Artificial Sequence
  Description of Artificial Sequence: Synthetic oligonucleotide
  Target: ATXN1; (+) strand; PAM type: NRG; PAM sequence: TGG
aaaccaaggtccataaccaa

SEQ ID NO: 126648 - DNA, 20 bp, Artificial Sequence
  Description of Artificial Sequence: Synthetic oligonucleotide
  Target: ATXN1; (+) strand; PAM type: NRG; PAM sequence: CAG
ccaaggtccataaccaatgg

SEQ ID NO: 126649 - DNA, 20 bp, Artificial Sequence
  Description of Artificial Sequence: Synthetic oligonucleotide
  Target: ATXN1; (+) strand; PAM type: NRG; PAM sequence: AGG
caaggtccataaccaatggc

SEQ ID NO: 126650 - DNA, 20 bp, Artificial Sequence
  Description of Artificial Sequence: Synthetic oligonucleotide
  Target: ATXN1; (+) strand; PAM type: NRG; PAM sequence: CAG
ccataaccaatggcaggtga

SEQ ID NO: 126651 - DNA, 20 bp, Artificial Sequence
  Description of Artificial Sequence: Synthetic oligonucleotide
  Target: ATXN1; (+) strand; PAM type: NRG; PAM sequence: TGG
ctccctaaatgcttcatccc

SEQ ID NO: 126652 - DNA, 20 bp, Artificial Sequence
  Description of Artificial Sequence: Synthetic oligonucleotide
  Target: ATXN1; (+) strand; PAM type: NRG; PAM sequence: CAG
taaatgcttcatccctggtc

SEQ ID NO: 126653 - DNA, 20 bp, Artificial Sequence
  Description of Artificial Sequence: Synthetic oligonucleotide
  Target: ATXN1; (+) strand; PAM type: NRG; PAM sequence: AAG
gtccagccgatgcaattttt

SEQ ID NO: 126654 - DNA, 20 bp, Artificial Sequence
  Description of Artificial Sequence: Synthetic oligonucleotide
  Target: ATXN1; (+) strand; PAM type: NRG; PAM sequence: AGG
tccagccgatgcaattttta

SEQ ID NO: 126655 - DNA, 20 bp, Artificial Sequence
  Description of Artificial Sequence: Synthetic oligonucleotide
  Target: ATXN1; (+) strand; PAM type: NRG; PAM sequence: GGG
ccagccgatgcaatttttaa

SEQ ID NO: 126656 - DNA, 20 bp, Artificial Sequence
  Description of Artificial Sequence: Synthetic oligonucleotide
  Target: ATXN1; (+) strand; PAM type: NRG; PAM sequence: GGG
cagccgatgcaatttttaag

SEQ ID NO: 126657 - DNA, 20 bp, Artificial Sequence
  Description of Artificial Sequence: Synthetic oligonucleotide
  Target: ATXN1; (+) strand; PAM type: NRG; PAM sequence: GAG
gccgatgcaatttttaaggg

SEQ ID NO: 126658 - DNA, 20 bp, Artificial Sequence
  Description of Artificial Sequence: Synthetic oligonucleotide
  Target: ATXN1; (+) strand; PAM type: NRG; PAM sequence: TGG
gatgcaatttttaaggggag

SEQ ID NO: 126659 - DNA, 20 bp, Artificial Sequence
  Description of Artificial Sequence: Synthetic oligonucleotide
  Target: ATXN1; (+) strand; PAM type: NRG; PAM sequence: TGG
ttaaggggagtggtaatttg

SEQ ID NO: 126660 - DNA, 20 bp, Artificial Sequence
  Description of Artificial Sequence: Synthetic oligonucleotide
  Target: ATXN1; (+) strand; PAM type: NRG; PAM sequence: TGG
aggggagtggtaatttgtgg

SEQ ID NO: 126661 - DNA, 20 bp, Artificial Sequence
  Description of Artificial Sequence: Synthetic oligonucleotide
  Target: ATXN1; (+) strand; PAM type: NRG; PAM sequence: GGG
ggggagtggtaatttgtggt

SEQ ID NO: 126662 - DNA, 20 bp, Artificial Sequence
  Description of Artificial Sequence: Synthetic oligonucleotide
  Target: ATXN1; (+) strand; PAM type: NRG; PAM sequence: GGG
gggagtggtaatttgtggtg

SEQ ID NO: 126663 - DNA, 20 bp, Artificial Sequence
  Description of Artificial Sequence: Synthetic oligonucleotide
  Target: ATXN1; (+) strand; PAM type: NRG; PAM sequence: GGG
ggagtggtaatttgtggtgg

SEQ ID NO: 126664 - DNA, 20 bp, Artificial Sequence
  Description of Artificial Sequence: Synthetic oligonucleotide
  Target: ATXN1; (+) strand; PAM type: NRG; PAM sequence: TAG
tgtggtgggggtcatgctct

SEQ ID NO: 126665 - DNA, 20 bp, Artificial Sequence
  Description of Artificial Sequence: Synthetic oligonucleotide
  Target: ATXN1; (+) strand; PAM type: NRG; PAM sequence: TAG
tacattttgaccatgtgaaa

SEQ ID NO: 126666 - DNA, 20 bp, Artificial Sequence
  Description of Artificial Sequence: Synthetic oligonucleotide
  Target: ATXN1; (+) strand; PAM type: NRG; PAM sequence: TGG
atgtgaaatagaatcaatgt

SEQ ID NO: 126667 - DNA, 20 bp, Artificial Sequence
  Description of Artificial Sequence: Synthetic oligonucleotide
  Target: ATXN1; (+) strand; PAM type: NRG; PAM sequence: GGG
tgtgaaatagaatcaatgtt

SEQ ID NO: 126668 - DNA, 20 bp, Artificial Sequence
  Description of Artificial Sequence: Synthetic oligonucleotide
  Target: ATXN1; (+) strand; PAM type: NRG; PAM sequence: AAG
tagaatcaatgttgggaact

SEQ ID NO: 126669 - DNA, 20 bp, Artificial Sequence
  Description of Artificial Sequence: Synthetic oligonucleotide
  Target: ATXN1; (+) strand; PAM type: NRG; PAM sequence: CAG
aatgttgggaactaagaaca

SEQ ID NO: 126670 - DNA, 20 bp, Artificial Sequence
  Description of Artificial Sequence: Synthetic oligonucleotide
  Target: ATXN1; (+) strand; PAM type: NRG; PAM sequence: CAG
agaacacagaccttaaatgt

SEQ ID NO: 126671 - DNA, 20 bp, Artificial Sequence
  Description of Artificial Sequence: Synthetic oligonucleotide
  Target: ATXN1; (+) strand; PAM type: NRG; PAM sequence: CAG
acacagaccttaaatgtcag

SEQ ID NO: 126672 - DNA, 20 bp, Artificial Sequence
  Description of Artificial Sequence: Synthetic oligonucleotide
  Target: ATXN1; (+) strand; PAM type: NRG; PAM sequence: TGG
cagaccttaaatgtcagcag

SEQ ID NO: 126673 - DNA, 20 bp, Artificial Sequence
  Description of Artificial Sequence: Synthetic oligonucleotide
  Target: ATXN1; (+) strand; PAM type: NRG; PAM sequence: TGG
ccttaaatgtcagcagtgga

SEQ ID NO: 126674 - DNA, 20 bp, Artificial Sequence
  Description of Artificial Sequence: Synthetic oligonucleotide
  Target: ATXN1; (+) strand; PAM type: NRG; PAM sequence: GAG
ttaaatgtcagcagtggatg

SEQ ID NO: 126675 - DNA, 20 bp, Artificial Sequence
  Description of Artificial Sequence: Synthetic oligonucleotide
  Target: ATXN1; (+) strand; PAM type: NRG; PAM sequence: CAG
atgtcagcagtggatggagt

SEQ ID NO: 126676 - DNA, 20 bp, Artificial Sequence
  Description of Artificial Sequence: Synthetic oligonucleotide
  Target: ATXN1; (+) strand; PAM type: NRG; PAM sequence: GAG
gtcagcagtggatggagtca

SEQ ID NO: 126677 - DNA, 20 bp, Artificial Sequence
  Description of Artificial Sequence: Synthetic oligonucleotide
  Target: ATXN1; (+) strand; PAM type: NRG; PAM sequence: GAG
cagcagtggatggagtcaga

SEQ ID NO: 126678 - DNA, 20 bp, Artificial Sequence
  Description of Artificial Sequence: Synthetic oligonucleotide
  Target: ATXN1; (+) strand; PAM type: NRG; PAM sequence: GAG
gcagtggatggagtcagaga

SEQ ID NO: 126679 - DNA, 20 bp, Artificial Sequence
  Description of Artificial Sequence: Synthetic oligonucleotide
  Target: ATXN1; (+) strand; PAM type: NRG; PAM sequence: TAG
atttctttgacaattcactc

SEQ ID NO: 126680 - DNA, 20 bp, Artificial Sequence
  Description of Artificial Sequence: Synthetic oligonucleotide
  Target: ATXN1; (+) strand; PAM type: NRG; PAM sequence: AGG
tttctttgacaattcactct

SEQ ID NO: 126681 - DNA, 20 bp, Artificial Sequence
  Description of Artificial Sequence: Synthetic oligonucleotide
  Target: ATXN1; (+) strand; PAM type: NRG; PAM sequence: TGG
tctaggcatttgcaatatca

SEQ ID NO: 126682 - DNA, 20 bp, Artificial Sequence
  Description of Artificial Sequence: Synthetic oligonucleotide
  Target: ATXN1; (+) strand; PAM type: NRG; PAM sequence: GAG
aatatcatggaatatgaact

SEQ ID NO: 126683 - DNA, 20 bp, Artificial Sequence
  Description of Artificial Sequence: Synthetic oligonucleotide
  Target: ATXN1; (+) strand; PAM type: NRG; PAM sequence: TAG
ttttaacaaatctcttttca

SEQ ID NO: 126684 - DNA, 20 bp, Artificial Sequence
  Description of Artificial Sequence: Synthetic oligonucleotide
  Target: ATXN1; (+) strand; PAM type: NRG; PAM sequence: CAG
tctcttttcatagtacaatt

SEQ ID NO: 126685 - DNA, 20 bp, Artificial Sequence
  Description of Artificial Sequence: Synthetic oligonucleotide
  Target: ATXN1; (+) strand; PAM type: NRG; PAM sequence: AGG
ctcttttcatagtacaattc

SEQ ID NO: 126686 - DNA, 20 bp, Artificial Sequence
  Description of Artificial Sequence: Synthetic oligonucleotide
  Target: ATXN1; (+) strand; PAM type: NRG; PAM sequence: TGG
tcatagtacaattcaggacc

SEQ ID NO: 126687 - DNA, 20 bp, Artificial Sequence
  Description of Artificial Sequence: Synthetic oligonucleotide
  Target: ATXN1; (+) strand; PAM type: NRG; PAM sequence: GAG
agtacaattcaggacctggt

SEQ ID NO: 126688 - DNA, 20 bp, Artificial Sequence
  Description of Artificial Sequence: Synthetic oligonucleotide
  Target: ATXN1; (+) strand; PAM type: NRG; PAM sequence: CAG
aggacctggtgagatgtttc

SEQ ID NO: 126689 - DNA, 20 bp, Artificial Sequence
  Description of Artificial Sequence: Synthetic oligonucleotide
  Target: ATXN1; (+) strand; PAM type: NRG; PAM sequence: TAG
atctaacaatgcacttctta

SEQ ID NO: 126690 - DNA, 20 bp, Artificial Sequence
  Description of Artificial Sequence: Synthetic oligonucleotide
  Target: ATXN1; (+) strand; PAM type: NRG; PAM sequence: AGG
tctaacaatgcacttcttat

SEQ ID NO: 126691 - DNA, 20 bp, Artificial Sequence
  Description of Artificial Sequence: Synthetic oligonucleotide
  Target: ATXN1; (+) strand; PAM type: NRG; PAM sequence: GGG
ctaacaatgcacttcttata

SEQ ID NO: 126692 - DNA, 20 bp, Artificial Sequence
  Description of Artificial Sequence: Synthetic oligonucleotide
  Target: ATXN1; (+) strand; PAM type: NRG; PAM sequence: CAG
caatgcacttcttataggga

SEQ ID NO: 126693 - DNA, 20 bp, Artificial Sequence
  Description of Artificial Sequence: Synthetic oligonucleotide
  Target: ATXN1; (+) strand; PAM type: NRG; PAM sequence: GAG
atgcacttcttatagggaca

SEQ ID NO: 126694 - DNA, 20 bp, Artificial Sequence
  Description of Artificial Sequence: Synthetic oligonucleotide
  Target: ATXN1; (+) strand; PAM type: NRG; PAM sequence: TGG
tgctttgcccaactctctcg

SEQ ID NO: 126695 - DNA, 20 bp, Artificial Sequence
  Description of Artificial Sequence: Synthetic oligonucleotide
  Target: ATXN1; (+) strand; PAM type: NRG; PAM sequence: GAG
cgtggtcaccgcttttacat

SEQ ID NO: 126696 - DNA, 20 bp, Artificial Sequence
  Description of Artificial Sequence: Synthetic oligonucleotide
  Target: ATXN1; (+) strand; PAM type: NRG; PAM sequence: GAG
gtcaccgcttttacatgagt

SEQ ID NO: 126697 - DNA, 20 bp, Artificial Sequence
  Description of Artificial Sequence: Synthetic oligonucleotide
  Target: ATXN1; (+) strand; PAM type: NRG; PAM sequence: TAG
gcttttacatgagtgagcat

SEQ ID NO: 126698 - DNA, 20 bp, Artificial Sequence
  Description of Artificial Sequence: Synthetic oligonucleotide
  Target: ATXN1; (+) strand; PAM type: NRG; PAM sequence: TGG
ttacatgagtgagcattaga

SEQ ID NO: 126699 - DNA, 20 bp, Artificial Sequence
  Description of Artificial Sequence: Synthetic oligonucleotide
  Target: ATXN1; (+) strand; PAM type: NRG; PAM sequence: CAG
atgagtgagcattagatggt

SEQ ID NO: 126700 - DNA, 20 bp, Artificial Sequence
  Description of Artificial Sequence: Synthetic oligonucleotide
  Target: ATXN1; (+) strand; PAM type: NRG; PAM sequence: AGG
tgagtgagcattagatggtc

SEQ ID NO: 126701 - DNA, 20 bp, Artificial Sequence
  Description of Artificial Sequence: Synthetic oligonucleotide
  Target: ATXN1; (+) strand; PAM type: NRG; PAM sequence: TGG
ctgtgttgtgtgctatacaa

SEQ ID NO: 126702 - DNA, 20 bp, Artificial Sequence
  Description of Artificial Sequence: Synthetic oligonucleotide
  Target: ATXN1; (+) strand; PAM type: NRG; PAM sequence: AAG
aatggcttttttacaccatc

SEQ ID NO: 126703 - DNA, 20 bp, Artificial Sequence
  Description of Artificial Sequence: Synthetic oligonucleotide
  Target: ATXN1; (+) strand; PAM type: NRG; PAM sequence: TGG
accatcaagactaaatctgc

SEQ ID NO: 126704 - DNA, 20 bp, Artificial Sequence
  Description of Artificial Sequence: Synthetic oligonucleotide
  Target: ATXN1; (+) strand; PAM type: NRG; PAM sequence: GGG
ccatcaagactaaatctgct

SEQ ID NO: 126705 - DNA, 20 bp, Artificial Sequence
  Description of Artificial Sequence: Synthetic oligonucleotide
  Target: ATXN1; (+) strand; PAM type: NRG; PAM sequence: TGG
actaaatctgctgggtgctg

SEQ ID NO: 126706 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgtaatcc

SEQ ID NO: 126707 - DNA, 20 bp, Artificial Sequence
  Description of Artificial Sequence: Synthetic oligonucleotide
  Target: ATXN1; (+) strand; PAM type: NRG; PAM sequence: CGG
gcctgtaatcccagcacttt

SEQ ID NO: 126708 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttcg

SEQ ID NO: 126709 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttcgg

SEQ ID NO: 126710 - DNA, 20 bp, Artificial Sequence
  Description of Artificial Sequence: Synthetic oligonucleotide
  Target: ATXN1; (+) strand; PAM type: NRG; PAM sequence: AAG
tcccagcactttcggaggcc

SEQ ID NO: 126711 - DNA, 20 bp, Artificial Sequence
  Description of Artificial Sequence: Synthetic oligonucleotide
  Target: ATXN1; (+) strand; PAM type: NRG; PAM sequence: AGG
cccagcactttcggaggcca

SEQ ID NO: 126712 - DNA, 20 bp, Artificial Sequence
  Description of Artificial Sequence: Synthetic oligonucleotide
  Target: ATXN1; (+) strand; PAM type: NRG; PAM sequence: CAG
agcactttcggaggccaagg

SEQ ID NO: 126713 - DNA, 20 bp, Artificial Sequence
  Description of Artificial Sequence: Synthetic oligonucleotide
  Target: ATXN1; (+) strand; PAM type: NRG; PAM sequence: AGG
gcactttcggaggccaaggc

SEQ ID NO: 126714 - DNA, 20 bp, Artificial Sequence
  Description of Artificial Sequence: Synthetic oligonucleotide
  Target: ATXN1; (+) strand; PAM type: NRG; PAM sequence: AAG
ctttcggaggccaaggcagg

SEQ ID NO: 126715 - DNA, 20 bp, Artificial Sequence
  Description of Artificial Sequence: Synthetic oligonucleotide
  Target: ATXN1; (+) strand; PAM type: NRG; PAM sequence: GAG
ccaaggcaggaagatcactt

SEQ ID NO: 126716 - DNA, 20 bp, Artificial Sequence
  Description of Artificial Sequence: Synthetic oligonucleotide
  Target: ATXN1; (+) strand; PAM type: NRG; PAM sequence: AGG
caaggcaggaagatcacttg

SEQ ID NO: 126717 - DNA, 20 bp, Artificial Sequence
  Description of Artificial Sequence: Synthetic oligonucleotide
  Target: ATXN1; (+) strand; PAM type: NRG; PAM sequence: CAG
gcaggaagatcacttgaggt

SEQ ID NO: 126718 - DNA, 20 bp, Artificial Sequence
  Description of Artificial Sequence: Synthetic oligonucleotide
  Target: ATXN1; (+) strand; PAM type: NRG; PAM sequence: AGG
caggaagatcacttgaggtc

SEQ ID NO: 126719 - DNA, 20 bp, Artificial Sequence
  Description of Artificial Sequence: Synthetic oligonucleotide
  Target: ATXN1; (+) strand; PAM type: NRG; PAM sequence: GAG
ggaagatcacttgaggtcag

SEQ ID NO: 126720 - DNA, 20 bp, Artificial Sequence
  Description of Artificial Sequence: Synthetic oligonucleotide
  Target: ATXN1; (+) strand; PAM type: NRG; PAM sequence: AAG
tcacttgaggtcaggagttc

SEQ ID NO: 126721 - DNA, 20 bp, Artificial Sequence
  Description of Artificial Sequence: Synthetic oligonucleotide
  Target: ATXN1; (+) strand; PAM type: NRG; PAM sequence: AAG
tgaggtcaggagttcaagac

SEQ ID NO: 126722 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcaagacaagcc

SEQ ID NO: 126723 - DNA, 20 bp, Artificial Sequence
  Description of Artificial Sequence: Synthetic oligonucleotide
  Target: ATXN1; (+) strand; PAM type: NRG; PAM sequence: GGG
caggagttcaagacaagcct

SEQ ID NO: 126724 - DNA, 20 bp, Artificial Sequence
  Description of Artificial Sequence: Synthetic oligonucleotide
  Target: ATXN1; (+) strand; PAM type: NRG; PAM sequence: TGG
caagacaagcctgggcaaca

SEQ ID NO: 126725 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 126726 - DNA, 20 bp, Artificial Sequence
  Description of Artificial Sequence: Synthetic oligonucleotide
  Target: ATXN1; (+) strand; PAM type: NRG; PAM sequence: CAG
ctaaaaatacaaaaattagc

SEQ ID NO: 126727 - DNA, 20 bp, Artificial Sequence
  Description of Artificial Sequence: Synthetic oligonucleotide
  Target: ATXN1; (+) strand; PAM type: NRG; PAM sequence: AGG
taaaaatacaaaaattagcc

SEQ ID NO: 126728 - DNA, 20 bp, Artificial Sequence
  Description of Artificial Sequence: Synthetic oligonucleotide
  Target: ATXN1; (+) strand; PAM type: NRG; PAM sequence: TGG
caaaaattagccaggtgtcc

SEQ ID NO: 126729 - DNA, 20 bp, Artificial Sequence
  Description of Artificial Sequence: Synthetic oligonucleotide
  Target: ATXN1; (+) strand; PAM type: NRG; PAM sequence: CAG
ctggtgcacgcctgtaatcc

SEQ ID NO: 126730 - DNA, 20 bp, Artificial Sequence
  Description of Artificial Sequence: Synthetic oligonucleotide
  Target: ATXN1; (+) strand; PAM type: NRG; PAM sequence: CGG
cgcctgtaatcccagctact

SEQ ID NO: 126731 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagctactc

SEQ ID NO: 126732 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctactcgg

SEQ ID NO: 126733 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctactcggg

SEQ ID NO: 126734 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcgggaggct

SEQ ID NO: 126735 - DNA, 20 bp, Artificial Sequence
  Description of Artificial Sequence: Synthetic oligonucleotide
  Target: ATXN1; (+) strand; PAM type: NRG; PAM sequence: AGG
cccagctactcgggaggctg

SEQ ID NO: 126736 - DNA, 20 bp, Artificial Sequence
  Description of Artificial Sequence: Synthetic oligonucleotide
  Target: ATXN1; (+) strand; PAM type: NRG; PAM sequence: CAG
agctactcgggaggctgagg

SEQ ID NO: 126737 - DNA, 20 bp, Artificial Sequence
  Description of Artificial Sequence: Synthetic oligonucleotide
  Target: ATXN1; (+) strand; PAM type: NRG; PAM sequence: CAG
tactcgggaggctgaggcag

SEQ ID NO: 126738 - DNA, 20 bp, Artificial Sequence
  Description of Artificial Sequence: Synthetic oligonucleotide
  Target: ATXN1; (+) strand; PAM type: NRG; PAM sequence: CGG
gcagcagaatctctttaacc

SEQ ID NO: 126739 - DNA, 20 bp, Artificial Sequence
  Description of Artificial Sequence: Synthetic oligonucleotide
  Target: ATXN1; (+) strand; PAM type: NRG; PAM sequence: GGG
cagcagaatctctttaaccc

SEQ ID NO: 126740 - DNA, 20 bp, Artificial Sequence
  Description of Artificial Sequence: Synthetic oligonucleotide
  Target: ATXN1; (+) strand; PAM type: NRG; PAM sequence: GAG
gcagaatctctttaacccgg

SEQ ID NO: 126741 - DNA, 20 bp, Artificial Sequence
  Description of Artificial Sequence: Synthetic oligonucleotide
  Target: ATXN1; (+) strand; PAM type: NRG; PAM sequence: AGG
cagaatctctttaacccggg

SEQ ID NO: 126742 - DNA, 20 bp, Artificial Sequence
  Description of Artificial Sequence: Synthetic oligonucleotide
  Target: ATXN1; (+) strand; PAM type: NRG; PAM sequence: TGG
aatctctttaacccgggagg

SEQ ID NO: 126743 - DNA, 20 bp, Artificial Sequence
  Description of Artificial Sequence: Synthetic oligonucleotide
  Target: ATXN1; (+) strand; PAM type: NRG; PAM sequence: GAG
tctctttaacccgggaggtg

SEQ ID NO: 126744 - DNA, 20 bp, Artificial Sequence
  Description of Artificial Sequence: Synthetic oligonucleotide
  Target: ATXN1; (+) strand; PAM type: NRG; PAM sequence: AGG
ctctttaacccgggaggtgg

SEQ ID NO: 126745 - DNA, 20 bp, Artificial Sequence
  Description of Artificial Sequence: Synthetic oligonucleotide
  Target: ATXN1; (+) strand; PAM type: NRG; PAM sequence: CAG
aacccgggaggtggaggttg

SEQ ID NO: 126746 - DNA, 20 bp, Artificial Sequence
  Description of Artificial Sequence: Synthetic oligonucleotide
  Target: ATXN1; (+) strand; PAM type: NRG; PAM sequence: TAG
cgggaggtggaggttgcaga

SEQ ID NO: 126747 - DNA, 20 bp, Artificial Sequence
  Description of Artificial Sequence: Synthetic oligonucleotide
  Target: ATXN1; (+) strand; PAM type: NRG; PAM sequence: GAG
ggtggaggttgcagatagct

SEQ ID NO: 126748 - DNA, 20 bp, Artificial Sequence
  Description of Artificial Sequence: Synthetic oligonucleotide
  Target: ATXN1; (+) strand; PAM type: NRG; PAM sequence: TGG
cgcaccactgcactccaacc

SEQ ID NO: 126749 - DNA, 20 bp, Artificial Sequence
  Description of Artificial Sequence: Synthetic oligonucleotide
  Target: ATXN1; (+) strand; PAM type: NRG; PAM sequence: GGG
gcaccactgcactccaacct

SEQ ID NO: 126750 - DNA, 20 bp, Artificial Sequence
  Description of Artificial Sequence: Synthetic oligonucleotide
  Target: ATXN1; (+) strand; PAM type: NRG; PAM sequence: CAG
ctgcactccaacctgggcaa

SEQ ID NO: 126751 - DNA, 20 bp, Artificial Sequence
  Description of Artificial Sequence: Synthetic oligonucleotide
  Target: ATXN1; (+) strand; PAM type: NRG; PAM sequence: GAG
gcactccaacctgggcaaca

SEQ ID NO: 126752 - DNA, 20 bp, Artificial Sequence
  Description of Artificial Sequence: Synthetic oligonucleotide
  Target: ATXN1; (+) strand; PAM type: NRG; PAM sequence: GAG
tccaacctgggcaacagagt

SEQ ID NO: 126753 - DNA, 20 bp, Artificial Sequence
  Description of Artificial Sequence: Synthetic oligonucleotide
  Target: ATXN1; (+) strand; PAM type: NRG; PAM sequence: AAG
ctctcaaaaaaaaaaaaaaa

SEQ ID NO: 126754 - DNA, 20 bp, Artificial Sequence
  Description of Artificial Sequence: Synthetic oligonucleotide
  Target: ATXN1; (+) strand; PAM type: NRG; PAM sequence: AAG
taaatcatacattgcttcca

SEQ ID NO: 126755 - DNA, 20 bp, Artificial Sequence
  Description of Artificial Sequence: Synthetic oligonucleotide
  Target: ATXN1; (+) strand; PAM type: NRG; PAM sequence: AGG
aaatcatacattgcttccaa

SEQ ID NO: 126756 - DNA, 20 bp, Artificial Sequence
  Description of Artificial Sequence: Synthetic oligonucleotide
  Target: ATXN1; (+) strand; PAM type: NRG; PAM sequence: TAG
tcatacattgcttccaaagg

SEQ ID NO: 126757 - DNA, 20 bp, Artificial Sequence
  Description of Artificial Sequence: Synthetic oligonucleotide
  Target: ATXN1; (+) strand; PAM type: NRG; PAM sequence: AAG
aggtagctccatatcctctg

SEQ ID NO: 126758 - DNA, 20 bp, Artificial Sequence
  Description of Artificial Sequence: Synthetic oligonucleotide
  Target: ATXN1; (+) strand; PAM type: NRG; PAM sequence: AGG
ggtagctccatatcctctga

SEQ ID NO: 126759 - DNA, 20 bp, Artificial Sequence
  Description of Artificial Sequence: Synthetic oligonucleotide
  Target: ATXN1; (+) strand; PAM type: NRG; PAM sequence: TGG
atatcctctgaaggtataca

SEQ ID NO: 126760 - DNA, 20 bp, Artificial Sequence
  Description of Artificial Sequence: Synthetic oligonucleotide
  Target: ATXN1; (+) strand; PAM type: NRG; PAM sequence: GGG
tatcctctgaaggtatacat

SEQ ID NO: 126761 - DNA, 20 bp, Artificial Sequence
  Description of Artificial Sequence: Synthetic oligonucleotide
  Target: ATXN1; (+) strand; PAM type: NRG; PAM sequence: GAG
tcctctgaaggtatacatgg

SEQ ID NO: 126762 - DNA, 20 bp, Artificial Sequence
  Description of Artificial Sequence: Synthetic oligonucleotide
  Target: ATXN1; (+) strand; PAM type: NRG; PAM sequence: AGG
cctctgaaggtatacatggg

SEQ ID NO: 126763 - DNA, 20 bp, Artificial Sequence
  Description of Artificial Sequence: Synthetic oligonucleotide
  Target: ATXN1; (+) strand; PAM type: NRG; PAM sequence: GGG
ctctgaaggtatacatggga

SEQ ID NO: 126764 - DNA, 20 bp, Artificial Sequence
  Description of Artificial Sequence: Synthetic oligonucleotide
  Target: ATXN1; (+) strand; PAM type: NRG; PAM sequence: CAG
ccataacatatcatgtattc

SEQ ID NO: 126765 - DNA, 20 bp, Artificial Sequence
  Description of Artificial Sequence: Synthetic oligonucleotide
  Target: ATXN1; (+) strand; PAM type: NRG; PAM sequence: TAG
catatcatgtattccagatc

SEQ ID NO: 126766 - DNA, 20 bp, Artificial Sequence
  Description of Artificial Sequence: Synthetic oligonucleotide
  Target: ATXN1; (+) strand; PAM type: NRG; PAM sequence: CGG
gatctagccataaaaccatg

SEQ ID NO: 126767 - DNA, 20 bp, Artificial Sequence
  Description of Artificial Sequence: Synthetic oligonucleotide
  Target: ATXN1; (+) strand; PAM type: NRG; PAM sequence: TAG
agccataaaaccatgcggtt

SEQ ID NO: 126768 - DNA, 20 bp, Artificial Sequence
  Description of Artificial Sequence: Synthetic oligonucleotide
  Target: ATXN1; (+) strand; PAM type: NRG; PAM sequence: TGG
caaatccaattgtgtgtctc

SEQ ID NO: 126769 - DNA, 20 bp, Artificial Sequence
  Description of Artificial Sequence: Synthetic oligonucleotide
  Target: ATXN1; (+) strand; PAM type: NRG; PAM sequence: CAG
tctggtaaacatgacttgcc

SEQ ID NO: 126770 - DNA, 20 bp, Artificial Sequence
  Description of Artificial Sequence: Synthetic oligonucleotide
  Target: ATXN1; (+) strand; PAM type: NRG; PAM sequence: CAG
tgctgatactacatgttcca

SEQ ID NO: 126771 - DNA, 20 bp, Artificial Sequence
  Description of Artificial Sequence: Synthetic oligonucleotide
  Target: ATXN1; (+) strand; PAM type: NRG; PAM sequence: CGG
ttacgttatcattatatttt

SEQ ID NO: 126772 - DNA, 20 bp, Artificial Sequence
  Description of Artificial Sequence: Synthetic oligonucleotide
  Target: ATXN1; (+) strand; PAM type: NRG; PAM sequence: TGG
tatattttcggactaacttt

SEQ ID NO: 126773 - DNA, 20 bp, Artificial Sequence
  Description of Artificial Sequence: Synthetic oligonucleotide
  Target: ATXN1; (+) strand; PAM type: NRG; PAM sequence: GAG
tcgttgtattgtatcatcct

SEQ ID NO: 126774 - DNA, 20 bp, Artificial Sequence
  Description of Artificial Sequence: Synthetic oligonucleotide
  Target: ATXN1; (+) strand; PAM type: NRG; PAM sequence: AAG
tgtattgtatcatcctgagt

SEQ ID NO: 126775 - DNA, 20 bp, Artificial Sequence
  Description of Artificial Sequence: Synthetic oligonucleotide
  Target: ATXN1; (+) strand; PAM type: NRG; PAM sequence: GAG
atttgccacaaccatttgct

SEQ ID NO: 126776 - DNA, 20 bp, Artificial Sequence
  Description of Artificial Sequence: Synthetic oligonucleotide
  Target: ATXN1; (+) strand; PAM type: NRG; PAM sequence: TGG
tgccacaaccatttgctgag

SEQ ID NO: 126777 - DNA, 20 bp, Artificial Sequence
  Description of Artificial Sequence: Synthetic oligonucleotide
  Target: ATXN1; (+) strand; PAM type: NRG; PAM sequence: TGG
tgctgagtggctaatttgta

SEQ ID NO: 126778 - DNA, 20 bp, Artificial Sequence
  Description of Artificial Sequence: Synthetic oligonucleotide
  Target: ATXN1; (+) strand; PAM type: NRG; PAM sequence: TAG
ctgacaaaatctctgtaaaa

SEQ ID NO: 126779 - DNA, 20 bp, Artificial Sequence
  Description of Artificial Sequence: Synthetic oligonucleotide
  Target: ATXN1; (+) strand; PAM type: NRG; PAM sequence: AGG
tgacaaaatctctgtaaaat

SEQ ID NO: 126780 - DNA, 20 bp, Artificial Sequence
  Description of Artificial Sequence: Synthetic oligonucleotide
  Target: ATXN1; (+) strand; PAM type: NRG; PAM sequence: TGG
ctctgtaaaataggttttat

SEQ ID NO: 126781 - DNA, 20 bp, Artificial Sequence
  Description of Artificial Sequence: Synthetic oligonucleotide
  Target: ATXN1; (+) strand; PAM type: NRG; PAM sequence: CAG
gttttattggcctcattgta

SEQ ID NO: 126782 - DNA, 20 bp, Artificial Sequence
  Description of Artificial Sequence: Synthetic oligonucleotide
  Target: ATXN1; (+) strand; PAM type: NRG; PAM sequence: GAG
attggcctcattgtacagat

SEQ ID NO: 126783 - DNA, 20 bp, Artificial Sequence
  Description of Artificial Sequence: Synthetic oligonucleotide
  Target: ATXN1; (+) strand; PAM type: NRG; PAM sequence: AGG
ttggcctcattgtacagatg

SEQ ID NO: 126784 - DNA, 20 bp, Artificial Sequence
  Description of Artificial Sequence: Synthetic oligonucleotide
  Target: ATXN1; (+) strand; PAM type: NRG; PAM sequence: AAG
attgtacagatgaggaaaat

SEQ ID NO: 126785 - DNA, 20 bp, Artificial Sequence
  Description of Artificial Sequence: Synthetic oligonucleotide
  Target: ATXN1; (+) strand; PAM type: NRG; PAM sequence: AGG
ttgtacagatgaggaaaata

SEQ ID NO: 126786 - DNA, 20 bp, Artificial Sequence
  Description of Artificial Sequence: Synthetic oligonucleotide
  Target: ATXN1; (+) strand; PAM type: NRG; PAM sequence: AAG
agatgaggaaaataaggctc

SEQ ID NO: 126787 - DNA, 20 bp, Artificial Sequence
  Description of Artificial Sequence: Synthetic oligonucleotide
  Target: ATXN1; (+) strand; PAM type: NRG; PAM sequence: AAG
aggaaaataaggctcaagaa

SEQ ID NO: 126788 - DNA, 20 bp, Artificial Sequence
  Description of Artificial Sequence: Synthetic oligonucleotide
  Target: ATXN1; (+) strand; PAM type: NRG; PAM sequence: AAG
tcaagaaaagtaacctaacc

SEQ ID NO: 126789 - DNA, 20 bp, Artificial Sequence
  Description of Artificial Sequence: Synthetic oligonucleotide
  Target: ATXN1; (+) strand; PAM type: NRG; PAM sequence: AGG
caagaaaagtaacctaacca

SEQ ID NO: 126790 - DNA, 20 bp, Artificial Sequence
  Description of Artificial Sequence: Synthetic oligonucleotide
  Target: ATXN1; (+) strand; PAM type: NRG; PAM sequence: CAG
agtaacctaaccaaggtcac

SEQ ID NO: 126791 - DNA, 20 bp, Artificial Sequence
  Description of Artificial Sequence: Synthetic oligonucleotide
  Target: ATXN1; (+) strand; PAM type: NRG; PAM sequence: AAG
acctaaccaaggtcaccagt

SEQ ID NO: 126792 - DNA, 20 bp, Artificial Sequence
  Description of Artificial Sequence: Synthetic oligonucleotide
  Target: ATXN1; (+) strand; PAM type: NRG; PAM sequence: AAG
aaggtcaccagtaagtgaca

SEQ ID NO: 126793 - DNA, 20 bp, Artificial Sequence
  Description of Artificial Sequence: Synthetic oligonucleotide
  Target: ATXN1; (+) strand; PAM type: NRG; PAM sequence: TAG
tcaccagtaagtgacaaagc

SEQ ID NO: 126794 - DNA, 20 bp, Artificial Sequence
  Description of Artificial Sequence: Synthetic oligonucleotide
  Target: ATXN1; (+) strand; PAM type: NRG; PAM sequence: AGG
caccagtaagtgacaaagct

SEQ ID NO: 126795 - DNA, 20 bp, Artificial Sequence
  Description of Artificial Sequence: Synthetic oligonucleotide
  Target: ATXN1; (+) strand; PAM type: NRG; PAM sequence: TGG
gtgacaaagctaggtttgtc

SEQ ID NO: 126796 - DNA, 20 bp, Artificial Sequence
  Description of Artificial Sequence: Synthetic oligonucleotide
  Target: ATXN1; (+) strand; PAM type: NRG; PAM sequence: GGG
tgacaaagctaggtttgtct

SEQ ID NO: 126797 - DNA, 20 bp, Artificial Sequence
  Description of Artificial Sequence: Synthetic oligonucleotide
  Target: ATXN1; (+) strand; PAM type: NRG; PAM sequence: CGG
ctaggtttgtctgggtttca

SEQ ID NO: 126798 - DNA, 20 bp, Artificial Sequence
  Description of Artificial Sequence: Synthetic oligonucleotide
  Target: ATXN1; (+) strand; PAM type: NRG; PAM sequence: AAG
ttgtctgggtttcacggtca

SEQ ID NO: 126799 - DNA, 20 bp, Artificial Sequence
  Description of Artificial Sequence: Synthetic oligonucleotide
  Target: ATXN1; (+) strand; PAM type: NRG; PAM sequence: GAG
gtctgggtttcacggtcaaa

SEQ ID NO: 126800 - DNA, 20 bp, Artificial Sequence
  Description of Artificial Sequence: Synthetic oligonucleotide
  Target: ATXN1; (+) strand; PAM type: NRG; PAM sequence: AAG
ggtttcacggtcaaagagaa

SEQ ID NO: 126801 - DNA, 20 bp, Artificial Sequence
  Description of Artificial Sequence: Synthetic oligonucleotide
  Target: ATXN1; (+) strand; PAM type: NRG; PAM sequence: GAG
cacggtcaaagagaaaagat

SEQ ID NO: 126802 - DNA, 20 bp, Artificial Sequence
  Description of Artificial Sequence: Synthetic oligonucleotide
  Target: ATXN1; (+) strand; PAM type: NRG; PAM sequence: TGG
aagagaaaagatgagctccc

SEQ ID NO: 126803 - DNA, 20 bp, Artificial Sequence
  Description of Artificial Sequence: Synthetic oligonucleotide
  Target: ATXN1; (+) strand; PAM type: NRG; PAM sequence: GAG
agctccctggcaacatgcac

SEQ ID NO: 126804 - DNA, 20 bp, Artificial Sequence
  Description of Artificial Sequence: Synthetic oligonucleotide
  Target: ATXN1; (+) strand; PAM type: NRG; PAM sequence: GAG
ctccctggcaacatgcacga

SEQ ID NO: 126805 - DNA, 20 bp, Artificial Sequence
  Description of Artificial Sequence: Synthetic oligonucleotide
  Target: ATXN1; (+) strand; PAM type: NRG; PAM sequence: AAG
gcaacatgcacgagagatta

SEQ ID NO: 126806 - DNA, 20 bp, Artificial Sequence
  Description of Artificial Sequence: Synthetic oligonucleotide
  Target: ATXN1; (+) strand; PAM type: NRG; PAM sequence: AAG
agattaaagtctcaatacat

SEQ ID NO: 126807 - DNA, 20 bp, Artificial Sequence
  Description of Artificial Sequence: Synthetic oligonucleotide
  Target: ATXN1; (+) strand; PAM type: NRG; PAM sequence: AAG
cattctgacaaacaaaaaat

SEQ ID NO: 126808 - DNA, 20 bp, Artificial Sequence
  Description of Artificial Sequence: Synthetic oligonucleotide
  Target: ATXN1; (+) strand; PAM type: NRG; PAM sequence: CAG
aaacaaaaaataagcacttg

SEQ ID NO: 126809 - DNA, 20 bp, Artificial Sequence
  Description of Artificial Sequence: Synthetic oligonucleotide
  Target: ATXN1; (+) strand; PAM type: NRG; PAM sequence: CGG
aaaaaataagcacttgcagc

SEQ ID NO: 126810 - DNA, 20 bp, Artificial Sequence
  Description of Artificial Sequence: Synthetic oligonucleotide
  Target: ATXN1; (+) strand; PAM type: NRG; PAM sequence: GGG
aaaaataagcacttgcagcc

SEQ ID NO: 126811 - DNA, 20 bp, Artificial Sequence
  Description of Artificial Sequence: Synthetic oligonucleotide
  Target: ATXN1; (+) strand; PAM type: NRG; PAM sequence: CAG
taagcacttgcagccgggca

SEQ ID NO: 126812 - DNA, 20 bp, Artificial Sequence
  Description of Artificial Sequence: Synthetic oligonucleotide
  Target: ATXN1; (+) strand; PAM type: NRG; PAM sequence: TGG
gcacttgcagccgggcacag

SEQ ID NO: 126813 - DNA, 20 bp, Artificial Sequence
  Description of Artificial Sequence: Synthetic oligonucleotide
  Target: ATXN1; (+) strand; PAM type: NRG; PAM sequence: CAG
gtggctcacacctgtaatct

SEQ ID NO: 126814 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatctcagcactt

SEQ ID NO: 126815 - DNA, 20 bp, Artificial Sequence
  Description of Artificial Sequence: Synthetic oligonucleotide
  Target: ATXN1; (+) strand; PAM type: NRG; PAM sequence: GGG
acctgtaatctcagcacttt

SEQ ID NO: 126816 - DNA, 20 bp, Artificial Sequence
  Description of Artificial Sequence: Synthetic oligonucleotide
  Target: ATXN1; (+) strand; PAM type: NRG; PAM sequence: AAG
tgtaatctcagcactttggg

SEQ ID NO: 126817 - DNA, 20 bp, Artificial Sequence
  Description of Artificial Sequence: Synthetic oligonucleotide
  Target: ATXN1; (+) strand; PAM type: NRG; PAM sequence: GAG
tctcagcactttgggaagcc

SEQ ID NO: 126818 - DNA, 20 bp, Artificial Sequence
  Description of Artificial Sequence: Synthetic oligonucleotide
  Target: ATXN1; (+) strand; PAM type: NRG; PAM sequence: AGG
ctcagcactttgggaagccg

SEQ ID NO: 126819 - DNA, 20 bp, Artificial Sequence
  Description of Artificial Sequence: Synthetic oligonucleotide
  Target: ATXN1; (+) strand; PAM type: NRG; PAM sequence: GGG
tcagcactttgggaagccga

SEQ ID NO: 126820 - DNA, 20 bp, Artificial Sequence
  Description of Artificial Sequence: Synthetic oligonucleotide
  Target: ATXN1; (+) strand; PAM type: NRG; PAM sequence: GAG
agcactttgggaagccgagg

SEQ ID NO: 126821 - DNA, 20 bp, Artificial Sequence
  Description of Artificial Sequence: Synthetic oligonucleotide
  Target: ATXN1; (+) strand; PAM type: NRG; PAM sequence: AGG
gcactttgggaagccgaggg

SEQ ID NO: 126822 - DNA, 20 bp, Artificial Sequence
  Description of Artificial Sequence: Synthetic oligonucleotide
  Target: ATXN1; (+) strand; PAM type: NRG; PAM sequence: TGG
ctttgggaagccgagggagg

SEQ ID NO: 126823 - DNA, 20 bp, Artificial Sequence
  Description of Artificial Sequence: Synthetic oligonucleotide
  Target: ATXN1; (+) strand; PAM type: NRG; PAM sequence: GAG
ccgagggaggtggatcacct

SEQ ID NO: 126824 - DNA, 20 bp, Artificial Sequence
  Description of Artificial Sequence: Synthetic oligonucleotide
  Target: ATXN1; (+) strand; PAM type: NRG; PAM sequence: AGG
cgagggaggtggatcacctg

SEQ ID NO: 126825 - DNA, 20 bp, Artificial Sequence
  Description of Artificial Sequence: Synthetic oligonucleotide
  Target: ATXN1; (+) strand; PAM type: NRG; PAM sequence: CAG
ggaggtggatcacctgaggt

SEQ ID NO: 126826 - DNA, 20 bp, Artificial Sequence
  Description of Artificial Sequence: Synthetic oligonucleotide
  Target: ATXN1; (+) strand; PAM type: NRG; PAM sequence: AGG
gaggtggatcacctgaggtc

SEQ ID NO: 126827 - DNA, 20 bp, Artificial Sequence
  Description of Artificial Sequence: Synthetic oligonucleotide
  Target: ATXN1; (+) strand; PAM type: NRG; PAM sequence: GAG
ggtggatcacctgaggtcag

SEQ ID NO: 126828 - DNA, 20 bp, Artificial Sequence
  Description of Artificial Sequence: Synthetic oligonucleotide
  Target: ATXN1; (+) strand; PAM type: NRG; PAM sequence: GAG
tcacctgaggtcaggagttc

SEQ ID NO: 126829 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagttcgagac

SEQ ID NO: 126830 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcgagaccagcc

SEQ ID NO: 126831 - DNA, 20 bp, Artificial Sequence
  Description of Artificial Sequence: Synthetic oligonucleotide
  Target: ATXN1; (+) strand; PAM type: NRG; PAM sequence: GGG
caggagttcgagaccagcct

SEQ ID NO: 126832 - DNA, 20 bp, Artificial Sequence
  Description of Artificial Sequence: Synthetic oligonucleotide
  Target: ATXN1; (+) strand; PAM type: NRG; PAM sequence: TGG
cgagaccagcctgggcaaca

SEQ ID NO: 126833 - DNA, 20 bp, Artificial Sequence
  Description of Artificial Sequence: Synthetic oligonucleotide
  Target: ATXN1; (+) strand; PAM type: NRG; PAM sequence: CAG
ccccatctctactaaaaata

SEQ ID NO: 126834 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacagaaat

SEQ ID NO: 126835 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatacagaaattagc

SEQ ID NO: 126836 - DNA, 20 bp, Artificial Sequence
  Description of Artificial Sequence: Synthetic oligonucleotide
  Target: ATXN1; (+) strand; PAM type: NRG; PAM sequence: GGG
taaaaatacagaaattagct

SEQ ID NO: 126837 - DNA, 20 bp, Artificial Sequence
  Description of Artificial Sequence: Synthetic oligonucleotide
  Target: ATXN1; (+) strand; PAM type: NRG; PAM sequence: TGG
atacagaaattagctgggca

SEQ ID NO: 126838 - DNA, 20 bp, Artificial Sequence
  Description of Artificial Sequence: Synthetic oligonucleotide
  Target: ATXN1; (+) strand; PAM type: NRG; PAM sequence: CGG
cagaaattagctgggcatgg

SEQ ID NO: 126839 - DNA, 20 bp, Artificial Sequence
  Description of Artificial Sequence: Synthetic oligonucleotide
  Target: ATXN1; (+) strand; PAM type: NRG; PAM sequence: CAG
gcggtgtgtgcctgtaatcc

SEQ ID NO: 126840 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagctact

SEQ ID NO: 126841 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagctactt

SEQ ID NO: 126842 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctacttgg

SEQ ID NO: 126843 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctacttggg

SEQ ID NO: 126844 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttgggaggct

SEQ ID NO: 126845 - DNA, 20 bp, Artificial Sequence
  Description of Artificial Sequence: Synthetic oligonucleotide
  Target: ATXN1; (+) strand; PAM type: NRG; PAM sequence: AGG
cccagctacttgggaggctg

SEQ ID NO: 126846 - DNA, 20 bp, Artificial Sequence
  Description of Artificial Sequence: Synthetic oligonucleotide
  Target: ATXN1; (+) strand; PAM type: NRG; PAM sequence: CAG
agctacttgggaggctgagg

SEQ ID NO: 126847 - DNA, 20 bp, Artificial Sequence
  Description of Artificial Sequence: Synthetic oligonucleotide
  Target: ATXN1; (+) strand; PAM type: NRG; PAM sequence: AGG
gctacttgggaggctgaggc

SEQ ID NO: 126848 - DNA, 20 bp, Artificial Sequence
  Description of Artificial Sequence: Synthetic oligonucleotide
  Target: ATXN1; (+) strand; PAM type: NRG; PAM sequence: GAG
tacttgggaggctgaggcag

SEQ ID NO: 126849 - DNA, 20 bp, Artificial Sequence
  Description of Artificial Sequence: Synthetic oligonucleotide
  Target: ATXN1; (+) strand; PAM type: NRG; PAM sequence: TGG
gcaggagaattgcttaaacc

SEQ ID NO: 126850 - DNA, 20 bp, Artificial Sequence
  Description of Artificial Sequence: Synthetic oligonucleotide
  Target: ATXN1; (+) strand; PAM type: NRG; PAM sequence: GGG
caggagaattgcttaaacct

SEQ ID NO: 126851 - DNA, 20 bp, Artificial Sequence
  Description of Artificial Sequence: Synthetic oligonucleotide
  Target: ATXN1; (+) strand; PAM type: NRG; PAM sequence: GAG
ggagaattgcttaaacctgg

SEQ ID NO: 126852 - DNA, 20 bp, Artificial Sequence
  Description of Artificial Sequence: Synthetic oligonucleotide
  Target: ATXN1; (+) strand; PAM type: NRG; PAM sequence: AGG
gagaattgcttaaacctggg

SEQ ID NO: 126853 - DNA, 20 bp, Artificial Sequence
  Description of Artificial Sequence: Synthetic oligonucleotide
  Target: ATXN1; (+) strand; PAM type: NRG; PAM sequence: TGG
aattgcttaaacctgggagg

SEQ ID NO: 126854 - DNA, 20 bp, Artificial Sequence
  Description of Artificial Sequence: Synthetic oligonucleotide
  Target: ATXN1; (+) strand; PAM type: NRG; PAM sequence: GAG
ttgcttaaacctgggaggtg

SEQ ID NO: 126855 - DNA, 20 bp, Artificial Sequence
  Description of Artificial Sequence: Synthetic oligonucleotide
  Target: ATXN1; (+) strand; PAM type: NRG; PAM sequence: AGG
tgcttaaacctgggaggtgg

SEQ ID NO: 126856 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggtggaggttg

SEQ ID NO: 126857 - DNA, 20 bp, Artificial Sequence
  Description of Artificial Sequence: Synthetic oligonucleotide
  Target: ATXN1; (+) strand; PAM type: NRG; PAM sequence: AAG
tgggaggtggaggttgcagt

SEQ ID NO: 126858 - DNA, 20 bp, Artificial Sequence
  Description of Artificial Sequence: Synthetic oligonucleotide
  Target: ATXN1; (+) strand; PAM type: NRG; PAM sequence: GAG
ggtggaggttgcagtaagct

SEQ ID NO: 126859 - DNA, 20 bp, Artificial Sequence
  Description of Artificial Sequence: Synthetic oligonucleotide
  Target: ATXN1; (+) strand; PAM type: NRG; PAM sequence: CAG
gagactgtgccactgcactc

SEQ ID NO: 126860 - DNA, 20 bp, Artificial Sequence
  Description of Artificial Sequence: Synthetic oligonucleotide
  Target: ATXN1; (+) strand; PAM type: NRG; PAM sequence: TGG
tgtgccactgcactccagcc

SEQ ID NO: 126861 - DNA, 20 bp, Artificial Sequence
  Description of Artificial Sequence: Synthetic oligonucleotide
  Target: ATXN1; (+) strand; PAM type: NRG; PAM sequence: AAG
tccagcctggacaacacatc

SEQ ID NO: 126862 - DNA, 20 bp, Artificial Sequence
  Description of Artificial Sequence: Synthetic oligonucleotide
  Target: ATXN1; (+) strand; PAM type: NRG; PAM sequence: CAG
aaaaaaaaaaaaatctttgt

SEQ ID NO: 126863 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaaaaatctttgtc

SEQ ID NO: 126864 - DNA, 20 bp, Artificial Sequence
  Description of Artificial Sequence: Synthetic oligonucleotide
  Target: ATXN1; (+) strand; PAM type: NRG; PAM sequence: GGG
aaaaaaaaaaatctttgtca

SEQ ID NO: 126865 - DNA, 20 bp, Artificial Sequence
  Description of Artificial Sequence: Synthetic oligonucleotide
  Target: ATXN1; (+) strand; PAM type: NRG; PAM sequence: AAG
gttttttttttttttttgtg

SEQ ID NO: 126866 - DNA, 20 bp, Artificial Sequence
  Description of Artificial Sequence: Synthetic oligonucleotide
  Target: ATXN1; (+) strand; PAM type: NRG; PAM sequence: TAG
tttttttttttttgtgaaga

SEQ ID NO: 126867 - DNA, 20 bp, Artificial Sequence
  Description of Artificial Sequence: Synthetic oligonucleotide
  Target: ATXN1; (+) strand; PAM type: NRG; PAM sequence: AAG
tttttttttgtgaagatagc

SEQ ID NO: 126868 - DNA, 20 bp, Artificial Sequence
  Description of Artificial Sequence: Synthetic oligonucleotide
  Target: ATXN1; (+) strand; PAM type: NRG; PAM sequence: GAG
tttttgtgaagatagcaagc

SEQ ID NO: 126869 - DNA, 20 bp, Artificial Sequence
  Description of Artificial Sequence: Synthetic oligonucleotide
  Target: ATXN1; (+) strand; PAM type: NRG; PAM sequence: AGG
ttttgtgaagatagcaagcg

SEQ ID NO: 126870 - DNA, 20 bp, Artificial Sequence
  Description of Artificial Sequence: Synthetic oligonucleotide
  Target: ATXN1; (+) strand; PAM type: NRG; PAM sequence: GAG
aagatagcaagcgaggatat

SEQ ID NO: 126871 - DNA, 20 bp, Artificial Sequence
  Description of Artificial Sequence: Synthetic oligonucleotide
  Target: ATXN1; (+) strand; PAM type: NRG; PAM sequence: AAG
aagcgaggatatgagaacaa

SEQ ID NO: 126872 - DNA, 20 bp, Artificial Sequence
  Description of Artificial Sequence: Synthetic oligonucleotide
  Target: ATXN1; (+) strand; PAM type: NRG; PAM sequence: CAG
caaaagttacccatgacatt

SEQ ID NO: 126873 - DNA, 20 bp, Artificial Sequence
  Description of Artificial Sequence: Synthetic oligonucleotide
  Target: ATXN1; (+) strand; PAM type: NRG; PAM sequence: TGG
aagttacccatgacattcag

SEQ ID NO: 126874 - DNA, 20 bp, Artificial Sequence
  Description of Artificial Sequence: Synthetic oligonucleotide
  Target: ATXN1; (+) strand; PAM type: NRG; PAM sequence: AAG
tacccatgacattcagtgga

SEQ ID NO: 126875 - DNA, 20 bp, Artificial Sequence
  Description of Artificial Sequence: Synthetic oligonucleotide
  Target: ATXN1; (+) strand; PAM type: NRG; PAM sequence: TAG
ttcagtggaaagttgtgtat

SEQ ID NO: 126876 - DNA, 20 bp, Artificial Sequence
  Description of Artificial Sequence: Synthetic oligonucleotide
  Target: ATXN1; (+) strand; PAM type: NRG; PAM sequence: CAG
agttgtgtattagtgcccaa

SEQ ID NO: 126877 - DNA, 20 bp, Artificial Sequence
  Description of Artificial Sequence: Synthetic oligonucleotide
  Target: ATXN1; (+) strand; PAM type: NRG; PAM sequence: AGG
gttgtgtattagtgcccaac

SEQ ID NO: 126878 - DNA, 20 bp, Artificial Sequence
  Description of Artificial Sequence: Synthetic oligonucleotide
  Target: ATXN1; (+) strand; PAM type: NRG; PAM sequence: CAG
tattagtgcccaacaggtgc

SEQ ID NO: 126879 - DNA, 20 bp, Artificial Sequence
  Description of Artificial Sequence: Synthetic oligonucleotide
  Target: ATXN1; (+) strand; PAM type: NRG; PAM sequence: AGG
attagtgcccaacaggtgcc

SEQ ID NO: 126880 - DNA, 20 bp, Artificial Sequence
  Description of Artificial Sequence: Synthetic oligonucleotide
  Target: ATXN1; (+) strand; PAM type: NRG; PAM sequence: AAG
gtgcccaacaggtgccaggc

SEQ ID NO: 126881 - DNA, 20 bp, Artificial Sequence
  Description of Artificial Sequence: Synthetic oligonucleotide
  Target: ATXN1; (+) strand; PAM type: NRG; PAM sequence: CAG
ggtgccaggcaagcgttctt

SEQ ID NO: 126882 - DNA, 20 bp, Artificial Sequence
  Description of Artificial Sequence: Synthetic oligonucleotide
  Target: ATXN1; (+) strand; PAM type: NRG; PAM sequence: AGG
gtgccaggcaagcgttcttc

SEQ ID NO: 126883 - DNA, 20 bp, Artificial Sequence
  Description of Artificial Sequence: Synthetic oligonucleotide
  Target: ATXN1; (+) strand; PAM type: NRG; PAM sequence: CAG
ccaggcaagcgttcttcagg

SEQ ID NO: 126884 - DNA, 20 bp, Artificial Sequence
  Description of Artificial Sequence: Synthetic oligonucleotide
  Target: ATXN1; (+) strand; PAM type: NRG; PAM sequence: CAG
caagcgttcttcaggcagca

SEQ ID NO: 126885 - DNA, 20 bp, Artificial Sequence
  Description of Artificial Sequence: Synthetic oligonucleotide
  Target: ATXN1; (+) strand; PAM type: NRG; PAM sequence: CGG
gcgttcttcaggcagcacag

SEQ ID NO: 126886 - DNA, 20 bp, Artificial Sequence
  Description of Artificial Sequence: Synthetic oligonucleotide
  Target: ATXN1; (+) strand; PAM type: NRG; PAM sequence: GGG
cgttcttcaggcagcacagc

SEQ ID NO: 126887 - DNA, 20 bp, Artificial Sequence
  Description of Artificial Sequence: Synthetic oligonucleotide
  Target: ATXN1; (+) strand; PAM type: NRG; PAM sequence: AAG
caggcagcacagcgggacca

SEQ ID NO: 126888 - DNA, 20 bp, Artificial Sequence
  Description of Artificial Sequence: Synthetic oligonucleotide
  Target: ATXN1; (+) strand; PAM type: NRG; PAM sequence: CAG
cagcgggaccaaagtgctga

SEQ ID NO: 126889 - DNA, 20 bp, Artificial Sequence
  Description of Artificial Sequence: Synthetic oligonucleotide
  Target: ATXN1; (+) strand; PAM type: NRG; PAM sequence: TGG
cgggaccaaagtgctgacag

SEQ ID NO: 126890 - DNA, 20 bp, Artificial Sequence
  Description of Artificial Sequence: Synthetic oligonucleotide
  Target: ATXN1; (+) strand; PAM type: NRG; PAM sequence: TAG
agtggcaacgacacaaaatg

SEQ ID NO: 126891 - DNA, 20 bp, Artificial Sequence
  Description of Artificial Sequence: Synthetic oligonucleotide
  Target: ATXN1; (+) strand; PAM type: NRG; PAM sequence: TGG
aacgacacaaaatgtagcct

SEQ ID NO: 126892 - DNA, 20 bp, Artificial Sequence
  Description of Artificial Sequence: Synthetic oligonucleotide
  Target: ATXN1; (+) strand; PAM type: NRG; PAM sequence: AAG
acacaaaatgtagccttggc

SEQ ID NO: 126893 - DNA, 20 bp, Artificial Sequence
  Description of Artificial Sequence: Synthetic oligonucleotide
  Target: ATXN1; (+) strand; PAM type: NRG; PAM sequence: CAG
aaaatgtagccttggcaagt

SEQ ID NO: 126894 - DNA, 20 bp, Artificial Sequence
  Description of Artificial Sequence: Synthetic oligonucleotide
  Target: ATXN1; (+) strand; PAM type: NRG; PAM sequence: GAG
ctttgcatcattctgattat

SEQ ID NO: 126895 - DNA, 20 bp, Artificial Sequence
  Description of Artificial Sequence: Synthetic oligonucleotide
  Target: ATXN1; (+) strand; PAM type: NRG; PAM sequence: AAG
tcattctgattatgagccac

SEQ ID NO: 126896 - DNA, 20 bp, Artificial Sequence
  Description of Artificial Sequence: Synthetic oligonucleotide
  Target: ATXN1; (+) strand; PAM type: NRG; PAM sequence: CAG
agccacaagcatgcaatcaa

SEQ ID NO: 126897 - DNA, 20 bp, Artificial Sequence
  Description of Artificial Sequence: Synthetic oligonucleotide
  Target: ATXN1; (+) strand; PAM type: NRG; PAM sequence: TAG
caagcatgcaatcaacagca

SEQ ID NO: 126898 - DNA, 20 bp, Artificial Sequence
  Description of Artificial Sequence: Synthetic oligonucleotide
  Target: ATXN1; (+) strand; PAM type: NRG; PAM sequence: GAG
agcatgcaatcaacagcata

SEQ ID NO: 126899 - DNA, 20 bp, Artificial Sequence
  Description of Artificial Sequence: Synthetic oligonucleotide
  Target: ATXN1; (+) strand; PAM type: NRG; PAM sequence: CAG
tgcaatcaacagcatagaga

SEQ ID NO: 126900 - DNA, 20 bp, Artificial Sequence
  Description of Artificial Sequence: Synthetic oligonucleotide
  Target: ATXN1; (+) strand; PAM type: NRG; PAM sequence: CAG
cagtcttaaatgatctccat

SEQ ID NO: 126901 - DNA, 20 bp, Artificial Sequence
  Description of Artificial Sequence: Synthetic oligonucleotide
  Target: ATXN1; (+) strand; PAM type: NRG; PAM sequence: TAG
tctccatcagcattttactt

SEQ ID NO: 126902 - DNA, 20 bp, Artificial Sequence
  Description of Artificial Sequence: Synthetic oligonucleotide
  Target: ATXN1; (+) strand; PAM type: NRG; PAM sequence: AAG
gcattttactttagttatca

SEQ ID NO: 126903 - DNA, 20 bp, Artificial Sequence
  Description of Artificial Sequence: Synthetic oligonucleotide
  Target: ATXN1; (+) strand; PAM type: NRG; PAM sequence: TGG
ttactttagttatcaaagtg

SEQ ID NO: 126904 - DNA, 20 bp, Artificial Sequence
  Description of Artificial Sequence: Synthetic oligonucleotide
  Target: ATXN1; (+) strand; PAM type: NRG; PAM sequence: CAG
ctttagttatcaaagtgtgg

SEQ ID NO: 126905 - DNA, 20 bp, Artificial Sequence
  Description of Artificial Sequence: Synthetic oligonucleotide
  Target: ATXN1; (+) strand; PAM type: NRG; PAM sequence: AAG
aacacccgctcatctgacct

SEQ ID NO: 126906 - DNA, 20 bp, Artificial Sequence
  Description of Artificial Sequence: Synthetic oligonucleotide
  Target: ATXN1; (+) strand; PAM type: NRG; PAM sequence: AAG
atgttaataacccaaacaca

SEQ ID NO: 126907 - DNA, 20 bp, Artificial Sequence
  Description of Artificial Sequence: Synthetic oligonucleotide
  Target: ATXN1; (+) strand; PAM type: NRG; PAM sequence: CAG
acccaaacacaaagaatgtg

SEQ ID NO: 126908 - DNA, 20 bp, Artificial Sequence
  Description of Artificial Sequence: Synthetic oligonucleotide
  Target: ATXN1; (+) strand; PAM type: NRG; PAM sequence: AGG
cccaaacacaaagaatgtgc

SEQ ID NO: 126909 - DNA, 20 bp, Artificial Sequence
  Description of Artificial Sequence: Synthetic oligonucleotide
  Target: ATXN1; (+) strand; PAM type: NRG; PAM sequence: TGG
agaatgtgcaggaataataa

SEQ ID NO: 126910 - DNA, 20 bp, Artificial Sequence
  Description of Artificial Sequence: Synthetic oligonucleotide
  Target: ATXN1; (+) strand; PAM type: NRG; PAM sequence: AAG
tgcaggaataataatggctc

SEQ ID NO: 126911 - DNA, 20 bp, Artificial Sequence
  Description of Artificial Sequence: Synthetic oligonucleotide
  Target: ATXN1; (+) strand; PAM type: NRG; PAM sequence: GAG
caggaataataatggctcaa

SEQ ID NO: 126912 - DNA, 20 bp, Artificial Sequence
  Description of Artificial Sequence: Synthetic oligonucleotide
  Target: ATXN1; (+) strand; PAM type: NRG; PAM sequence: TGG
taataatggctcaagagcac

SEQ ID NO: 126913 - DNA, 20 bp, Artificial Sequence
  Description of Artificial Sequence: Synthetic oligonucleotide
  Target: ATXN1; (+) strand; PAM type: NRG; PAM sequence: TGG
ctcaagagcactggccttgc

SEQ ID NO: 126914 - DNA, 20 bp, Artificial Sequence
  Description of Artificial Sequence: Synthetic oligonucleotide
  Target: ATXN1; (+) strand; PAM type: NRG; PAM sequence: GGG
tcaagagcactggccttgct

SEQ ID NO: 126915 - DNA, 20 bp, Artificial Sequence
  Description of Artificial Sequence: Synthetic oligonucleotide
  Target: ATXN1; (+) strand; PAM type: NRG; PAM sequence: GGG
caagagcactggccttgctg

SEQ ID NO: 126916 - DNA, 20 bp, Artificial Sequence
  Description of Artificial Sequence: Synthetic oligonucleotide
  Target: ATXN1; (+) strand; PAM type: NRG; PAM sequence: GGG
aagagcactggccttgctgg

SEQ ID NO: 126917 - DNA, 20 bp, Artificial Sequence
  Description of Artificial Sequence: Synthetic oligonucleotide
  Target: ATXN1; (+) strand; PAM type: NRG; PAM sequence: TGG
ctggccttgctgggggccat

SEQ ID NO: 126918 - DNA, 20 bp, Artificial Sequence
  Description of Artificial Sequence: Synthetic oligonucleotide
  Target: ATXN1; (+) strand; PAM type: NRG; PAM sequence: CAG
ctgggggccattggttataa

SEQ ID NO: 126919 - DNA, 20 bp, Artificial Sequence
  Description of Artificial Sequence: Synthetic oligonucleotide
  Target: ATXN1; (+) strand; PAM type: NRG; PAM sequence: CAG
acttttttcatttattacct

SEQ ID NO: 126920 - DNA, 20 bp, Artificial Sequence
  Description of Artificial Sequence: Synthetic oligonucleotide
  Target: ATXN1; (+) strand; PAM type: NRG; PAM sequence: GAG
ttttttcatttattacctca

SEQ ID NO: 126921 - DNA, 20 bp, Artificial Sequence
  Description of Artificial Sequence: Synthetic oligonucleotide
  Target: ATXN1; (+) strand; PAM type: NRG; PAM sequence: TAG
tttcatttattacctcagag

SEQ ID NO: 126922 - DNA, 20 bp, Artificial Sequence
  Description of Artificial Sequence: Synthetic oligonucleotide
  Target: ATXN1; (+) strand; PAM type: NRG; PAM sequence: CGG
tattattatgtgtttctcgt

SEQ ID NO: 126923 - DNA, 20 bp, Artificial Sequence
  Description of Artificial Sequence: Synthetic oligonucleotide
  Target: ATXN1; (+) strand; PAM type: NRG; PAM sequence: CAG
tcgtcggataaatttatcca

SEQ ID NO: 126924 - DNA, 20 bp, Artificial Sequence
  Description of Artificial Sequence: Synthetic oligonucleotide
  Target: ATXN1; (+) strand; PAM type: NRG; PAM sequence: GAG
agtctaacacaatttaaatt

SEQ ID NO: 126925 - DNA, 20 bp, Artificial Sequence
  Description of Artificial Sequence: Synthetic oligonucleotide
  Target: ATXN1; (+) strand; PAM type: NRG; PAM sequence: TAG
taacacaatttaaattgagt

SEQ ID NO: 126926 - DNA, 20 bp, Artificial Sequence
  Description of Artificial Sequence: Synthetic oligonucleotide
  Target: ATXN1; (+) strand; PAM type: NRG; PAM sequence: AGG
aacacaatttaaattgagtt

SEQ ID NO: 126927 - DNA, 20 bp, Artificial Sequence
  Description of Artificial Sequence: Synthetic oligonucleotide
  Target: ATXN1; (+) strand; PAM type: NRG; PAM sequence: AAG
tttaaattgagttaggactt

SEQ ID NO: 126928 - DNA, 20 bp, Artificial Sequence
  Description of Artificial Sequence: Synthetic oligonucleotide
  Target: ATXN1; (+) strand; PAM type: NRG; PAM sequence: GAG
aattgagttaggacttaagt

SEQ ID NO: 126929 - DNA, 20 bp, Artificial Sequence
  Description of Artificial Sequence: Synthetic oligonucleotide
  Target: ATXN1; (+) strand; PAM type: NRG; PAM sequence: TGG
caaattccctaaacttacta

SEQ ID NO: 126930 - DNA, 20 bp, Artificial Sequence
  Description of Artificial Sequence: Synthetic oligonucleotide
  Target: ATXN1; (+) strand; PAM type: NRG; PAM sequence: GAG
catgatgtacatgtctctat

SEQ ID NO: 126931 - DNA, 20 bp, Artificial Sequence
  Description of Artificial Sequence: Synthetic oligonucleotide
  Target: ATXN1; (+) strand; PAM type: NRG; PAM sequence: AGG
atgatgtacatgtctctatg

SEQ ID NO: 126932 - DNA, 20 bp, Artificial Sequence
  Description of Artificial Sequence: Synthetic oligonucleotide
  Target: ATXN1; (+) strand; PAM type: NRG; PAM sequence: GAG
gatgtacatgtctctatgag

SEQ ID NO: 126933 - DNA, 20 bp, Artificial Sequence
  Description of Artificial Sequence: Synthetic oligonucleotide
  Target: ATXN1; (+) strand; PAM type: NRG; PAM sequence: TGG
ggagcacttttcacactcca

SEQ ID NO: 126934 - DNA, 20 bp, Artificial Sequence
  Description of Artificial Sequence: Synthetic oligonucleotide
  Target: ATXN1; (+) strand; PAM type: NRG; PAM sequence: CAG
ttctccactaaattgtgacc

SEQ ID NO: 126935 - DNA, 20 bp, Artificial Sequence
  Description of Artificial Sequence: Synthetic oligonucleotide
  Target: ATXN1; (+) strand; PAM type: NRG; PAM sequence: TAG
aaattgtgacccagctctga

SEQ ID NO: 126936 - DNA, 20 bp, Artificial Sequence
  Description of Artificial Sequence: Synthetic oligonucleotide
  Target: ATXN1; (+) strand; PAM type: NRG; PAM sequence: TGG
gtgacccagctctgatagcc

SEQ ID NO: 126937 - DNA, 20 bp, Artificial Sequence
  Description of Artificial Sequence: Synthetic oligonucleotide
  Target: ATXN1; (+) strand; PAM type: NRG; PAM sequence: TAG
ttacatcatttatctctgtg

SEQ ID NO: 126938 - DNA, 20 bp, Artificial Sequence
  Description of Artificial Sequence: Synthetic oligonucleotide
  Target: ATXN1; (+) strand; PAM type: NRG; PAM sequence: CAG
catcatttatctctgtgtag

SEQ ID NO: 126939 - DNA, 20 bp, Artificial Sequence
  Description of Artificial Sequence: Synthetic oligonucleotide
  Target: ATXN1; (+) strand; PAM type: NRG; PAM sequence: CAG
tagcagacattcaaaatatg

SEQ ID NO: 126940 - DNA, 20 bp, Artificial Sequence
  Description of Artificial Sequence: Synthetic oligonucleotide
  Target: ATXN1; (+) strand; PAM type: NRG; PAM sequence: CAG
tgcagaaatgaatgaatcct

SEQ ID NO: 126941 - DNA, 20 bp, Artificial Sequence
  Description of Artificial Sequence: Synthetic oligonucleotide
  Target: ATXN1; (+) strand; PAM type: NRG; PAM sequence: GAG
cagaaatgaatgaatcctca

SEQ ID NO: 126942 - DNA, 20 bp, Artificial Sequence
  Description of Artificial Sequence: Synthetic oligonucleotide
  Target: ATXN1; (+) strand; PAM type: NRG; PAM sequence: AAG
cctcagagaatcataaataa

SEQ ID NO: 126943 - DNA, 20 bp, Artificial Sequence
  Description of Artificial Sequence: Synthetic oligonucleotide
  Target: ATXN1; (+) strand; PAM type: NRG; PAM sequence: AGG
ctcagagaatcataaataaa

SEQ ID NO: 126944 - DNA, 20 bp, Artificial Sequence
  Description of Artificial Sequence: Synthetic oligonucleotide
  Target: ATXN1; (+) strand; PAM type: NRG; PAM sequence: GAG
aaataaaaggcatgcttatt

SEQ ID NO: 126945 - DNA, 20 bp, Artificial Sequence
  Description of Artificial Sequence: Synthetic oligonucleotide
  Target: ATXN1; (+) strand; PAM type: NRG; PAM sequence: AAG
ttgagtccgtgaatgtcccc

SEQ ID NO: 126946 - DNA, 20 bp, Artificial Sequence
  Description of Artificial Sequence: Synthetic oligonucleotide
  Target: ATXN1; (+) strand; PAM type: NRG; PAM sequence: TGG
gtccgtgaatgtccccaagt

SEQ ID NO: 126947 - DNA, 20 bp, Artificial Sequence
  Description of Artificial Sequence: Synthetic oligonucleotide
  Target: ATXN1; (+) strand; PAM type: NRG; PAM sequence: GAG
ccgtgaatgtccccaagttg

SEQ ID NO: 126948 - DNA, 20 bp, Artificial Sequence
  Description of Artificial Sequence: Synthetic oligonucleotide
  Target: ATXN1; (+) strand; PAM type: NRG; PAM sequence: AAG
tgaatgtccccaagttggag

SEQ ID NO: 126949 - DNA, 20 bp, Artificial Sequence
  Description of Artificial Sequence: Synthetic oligonucleotide
  Target: ATXN1; (+) strand; PAM type: NRG; PAM sequence: CAG
ccccaagttggagaagtcac

SEQ ID NO: 126950 - DNA, 20 bp, Artificial Sequence
  Description of Artificial Sequence: Synthetic oligonucleotide
  Target: ATXN1; (+) strand; PAM type: NRG; PAM sequence: AAG
gagaagtcaccagcatttca

SEQ ID NO: 126951 - DNA, 20 bp, Artificial Sequence
  Description of Artificial Sequence: Synthetic oligonucleotide
  Target: ATXN1; (+) strand; PAM type: NRG; PAM sequence: GAG
gaagtcaccagcatttcaaa

SEQ ID NO: 126952 - DNA, 20 bp, Artificial Sequence
  Description of Artificial Sequence: Synthetic oligonucleotide
  Target: ATXN1; (+) strand; PAM type: NRG; PAM sequence: AAG
aaaatttgtctaaaattgaa

SEQ ID NO: 126953 - DNA, 20 bp, Artificial Sequence
  Description of Artificial Sequence: Synthetic oligonucleotide
  Target: ATXN1; (+) strand; PAM type: NRG; PAM sequence: TGG
taaatctataccatgaaatt

SEQ ID NO: 126954 - DNA, 20 bp, Artificial Sequence
  Description of Artificial Sequence: Synthetic oligonucleotide
  Target: ATXN1; (+) strand; PAM type: NRG; PAM sequence: TAG
atctataccatgaaatttgg

SEQ ID NO: 126955 - DNA, 20 bp, Artificial Sequence
  Description of Artificial Sequence: Synthetic oligonucleotide
  Target: ATXN1; (+) strand; PAM type: NRG; PAM sequence: AAG
tttggtagatatctgttctt

SEQ ID NO: 126956 - DNA, 20 bp, Artificial Sequence
  Description of Artificial Sequence: Synthetic oligonucleotide
  Target: ATXN1; (+) strand; PAM type: NRG; PAM sequence: AGG
ttggtagatatctgttctta

SEQ ID NO: 126957 - DNA, 20 bp, Artificial Sequence
  Description of Artificial Sequence: Synthetic oligonucleotide
  Target: ATXN1; (+) strand; PAM type: NRG; PAM sequence: AAG
aaacatataaatataaaaat

SEQ ID NO: 126958 - DNA, 20 bp, Artificial Sequence
  Description of Artificial Sequence: Synthetic oligonucleotide
  Target: ATXN1; (+) strand; PAM type: NRG; PAM sequence: AGG
aacatataaatataaaaata

SEQ ID NO: 126959 - DNA, 20 bp, Artificial Sequence
  Description of Artificial Sequence: Synthetic oligonucleotide
  Target: ATXN1; (+) strand; PAM type: NRG; PAM sequence: TGG
aggaaatactcctctgatat

SEQ ID NO: 126960 - DNA, 20 bp, Artificial Sequence
  Description of Artificial Sequence: Synthetic oligonucleotide
  Target: ATXN1; (+) strand; PAM type: NRG; PAM sequence: AAG
tactcctctgatattggctg

SEQ ID NO: 126961 - DNA, 20 bp, Artificial Sequence
  Description of Artificial Sequence: Synthetic oligonucleotide
  Target: ATXN1; (+) strand; PAM type: NRG; PAM sequence: AAG
ggctgaagaaaatcattttc

SEQ ID NO: 126962 - DNA, 20 bp, Artificial Sequence
  Description of Artificial Sequence: Synthetic oligonucleotide
  Target: ATXN1; (+) strand; PAM type: NRG; PAM sequence: AGG
gctgaagaaaatcattttca

SEQ ID NO: 126963 - DNA, 20 bp, Artificial Sequence
  Description of Artificial Sequence: Synthetic oligonucleotide
  Target: ATXN1; (+) strand; PAM type: NRG; PAM sequence: GAG
tgaagaaaatcattttcaag

SEQ ID NO: 126964 - DNA, 20 bp, Artificial Sequence
  Description of Artificial Sequence: Synthetic oligonucleotide
  Target: ATXN1; (+) strand; PAM type: NRG; PAM sequence: AAG
tttcaaggagactcttacca

SEQ ID NO: 126965 - DNA, 20 bp, Artificial Sequence
  Description of Artificial Sequence: Synthetic oligonucleotide
  Target: ATXN1; (+) strand; PAM type: NRG; PAM sequence: AAG
aagctctattttcaacatta

SEQ ID NO: 126966 - DNA, 20 bp, Artificial Sequence
  Description of Artificial Sequence: Synthetic oligonucleotide
  Target: ATXN1; (+) strand; PAM type: NRG; PAM sequence: AAG
aacattaaagcttaaaatgt

SEQ ID NO: 126967 - DNA, 20 bp, Artificial Sequence
  Description of Artificial Sequence: Synthetic oligonucleotide
  Target: ATXN1; (+) strand; PAM type: NRG; PAM sequence: AGG
acattaaagcttaaaatgta

SEQ ID NO: 126968 - DNA, 20 bp, Artificial Sequence
  Description of Artificial Sequence: Synthetic oligonucleotide
  Target: ATXN1; (+) strand; PAM type: NRG; PAM sequence: GGG
cattaaagcttaaaatgtaa

SEQ ID NO: 126969 - DNA, 20 bp, Artificial Sequence
  Description of Artificial Sequence: Synthetic oligonucleotide
  Target: ATXN1; (+) strand; PAM type: NRG; PAM sequence: GGG
attaaagcttaaaatgtaag

SEQ ID NO: 126970 - DNA, 20 bp, Artificial Sequence
  Description of Artificial Sequence: Synthetic oligonucleotide
  Target: ATXN1; (+) strand; PAM type: NRG; PAM sequence: CAG
aaagcttaaaatgtaagggg

SEQ ID NO: 126971 - DNA, 20 bp, Artificial Sequence
  Description of Artificial Sequence: Synthetic oligonucleotide
  Target: ATXN1; (+) strand; PAM type: NRG; PAM sequence: GAG
agcttaaaatgtaaggggca

SEQ ID NO: 126972 - DNA, 20 bp, Artificial Sequence
  Description of Artificial Sequence: Synthetic oligonucleotide
  Target: ATXN1; (+) strand; PAM type: NRG; PAM sequence: GAG
cttaaaatgtaaggggcaga

SEQ ID NO: 126973 - DNA, 20 bp, Artificial Sequence
  Description of Artificial Sequence: Synthetic oligonucleotide
  Target: ATXN1; (+) strand; PAM type: NRG; PAM sequence: GAG
taaggggcagagagtatttt

SEQ ID NO: 126974 - DNA, 20 bp, Artificial Sequence
  Description of Artificial Sequence: Synthetic oligonucleotide
  Target: ATXN1; (+) strand; PAM type: NRG; PAM sequence: TGG
ggcagagagtattttgagaa

SEQ ID NO: 126975 - DNA, 20 bp, Artificial Sequence
  Description of Artificial Sequence: Synthetic oligonucleotide
  Target: ATXN1; (+) strand; PAM type: NRG; PAM sequence: AAG
gtattttgagaatggttttc

SEQ ID NO: 126976 - DNA, 20 bp, Artificial Sequence
  Description of Artificial Sequence: Synthetic oligonucleotide
  Target: ATXN1; (+) strand; PAM type: NRG; PAM sequence: AGG
tattttgagaatggttttca

SEQ ID NO: 126977 - DNA, 20 bp, Artificial Sequence
  Description of Artificial Sequence: Synthetic oligonucleotide
  Target: ATXN1; (+) strand; PAM type: NRG; PAM sequence: AAG
ttgagaatggttttcaagga

SEQ ID NO: 126978 - DNA, 20 bp, Artificial Sequence
  Description of Artificial Sequence: Synthetic oligonucleotide
  Target: ATXN1; (+) strand; PAM type: NRG; PAM sequence: TAG
gaaagtaattaaaatcaacg

SEQ ID NO: 126979 - DNA, 20 bp, Artificial Sequence
  Description of Artificial Sequence: Synthetic oligonucleotide
  Target: ATXN1; (+) strand; PAM type: NRG; PAM sequence: AGG
aaagtaattaaaatcaacgt

SEQ ID NO: 126980 - DNA, 20 bp, Artificial Sequence
  Description of Artificial Sequence: Synthetic oligonucleotide
  Target: ATXN1; (+) strand; PAM type: NRG; PAM sequence: TAG
attaaaatcaacgtaggttg

SEQ ID NO: 126981 - DNA, 20 bp, Artificial Sequence
  Description of Artificial Sequence: Synthetic oligonucleotide
  Target: ATXN1; (+) strand; PAM type: NRG; PAM sequence: CAG
atcaacgtaggttgtagaac

SEQ ID NO: 126982 - DNA, 20 bp, Artificial Sequence
  Description of Artificial Sequence: Synthetic oligonucleotide
  Target: ATXN1; (+) strand; PAM type: NRG; PAM sequence: CAG
gtaggttgtagaaccagatc

SEQ ID NO: 126983 - DNA, 20 bp, Artificial Sequence
  Description of Artificial Sequence: Synthetic oligonucleotide
  Target: ATXN1; (+) strand; PAM type: NRG; PAM sequence: AAG
ggttgtagaaccagatccag

SEQ ID NO: 126984 - DNA, 20 bp, Artificial Sequence
  Description of Artificial Sequence: Synthetic oligonucleotide
  Target: ATXN1; (+) strand; PAM type: NRG; PAM sequence: GAG
ttgtagaaccagatccagaa

SEQ ID NO: 126985 - DNA, 20 bp, Artificial Sequence
  Description of Artificial Sequence: Synthetic oligonucleotide
  Target: ATXN1; (+) strand; PAM type: NRG; PAM sequence: CAG
aaatactgattgctatattt

SEQ ID NO: 126986 - DNA, 20 bp, Artificial Sequence
  Description of Artificial Sequence: Synthetic oligonucleotide
  Target: ATXN1; (+) strand; PAM type: NRG; PAM sequence: AGG
aatactgattgctatatttc

SEQ ID NO: 126987 - DNA, 20 bp, Artificial Sequence
  Description of Artificial Sequence: Synthetic oligonucleotide
  Target: ATXN1; (+) strand; PAM type: NRG; PAM sequence: GGG
atactgattgctatatttca

SEQ ID NO: 126988 - DNA, 20 bp, Artificial Sequence
  Description of Artificial Sequence: Synthetic oligonucleotide
  Target: ATXN1; (+) strand; PAM type: NRG; PAM sequence: GGG
tactgattgctatatttcag

SEQ ID NO: 126989 - DNA, 20 bp, Artificial Sequence
  Description of Artificial Sequence: Synthetic oligonucleotide
  Target: ATXN1; (+) strand; PAM type: NRG; PAM sequence: AAG
ctatatttcaggggtgaaaa

SEQ ID NO: 126990 - DNA, 20 bp, Artificial Sequence
  Description of Artificial Sequence: Synthetic oligonucleotide
  Target: ATXN1; (+) strand; PAM type: NRG; PAM sequence: AGG
tatatttcaggggtgaaaaa

SEQ ID NO: 126991 - DNA, 20 bp, Artificial Sequence
  Description of Artificial Sequence: Synthetic oligonucleotide
  Target: ATXN1; (+) strand; PAM type: NRG; PAM sequence: AAG
aaaaaggtcaaattgtcaaa

SEQ ID NO: 126992 - DNA, 20 bp, Artificial Sequence
  Description of Artificial Sequence: Synthetic oligonucleotide
  Target: ATXN1; (+) strand; PAM type: NRG; PAM sequence: AAG
ggtcaaattgtcaaaaagta

SEQ ID NO: 126993 - DNA, 20 bp, Artificial Sequence
  Description of Artificial Sequence: Synthetic oligonucleotide
  Target: ATXN1; (+) strand; PAM type: NRG; PAM sequence: AAG
aattgtcaaaaagtaaagaa

SEQ ID NO: 126994 - DNA, 20 bp, Artificial Sequence
  Description of Artificial Sequence: Synthetic oligonucleotide
  Target: ATXN1; (+) strand; PAM type: NRG; PAM sequence: AGG
attgtcaaaaagtaaagaaa

SEQ ID NO: 126995 - DNA, 20 bp, Artificial Sequence
  Description of Artificial Sequence: Synthetic oligonucleotide
  Target: ATXN1; (+) strand; PAM type: NRG; PAM sequence: GGG
ttgtcaaaaagtaaagaaaa

SEQ ID NO: 126996 - DNA, 20 bp, Artificial Sequence
  Description of Artificial Sequence: Synthetic oligonucleotide
  Target: ATXN1; (+) strand; PAM type: NRG; PAM sequence: AAG
aagtaaagaaaagggcctga

SEQ ID NO: 126997 - DNA, 20 bp, Artificial Sequence
  Description of Artificial Sequence: Synthetic oligonucleotide
  Target: ATXN1; (+) strand; PAM type: NRG; PAM sequence: AAG
tgcccatcacttcactcaaa

SEQ ID NO: 126998 - DNA, 20 bp, Artificial Sequence
  Description of Artificial Sequence: Synthetic oligonucleotide
  Target: ATXN1; (+) strand; PAM type: NRG; PAM sequence: TAG
catcacttcactcaaaaagt

SEQ ID NO: 126999 - DNA, 20 bp, Artificial Sequence
  Description of Artificial Sequence: Synthetic oligonucleotide
  Target: ATXN1; (+) strand; PAM type: NRG; PAM sequence: AAG
cttcactcaaaaagttagtg

SEQ ID NO: 127000 - DNA, 20 bp, Artificial Sequence
  Description of Artificial Sequence: Synthetic oligonucleotide
  Target: ATXN1; (+) strand; PAM type: NRG; PAM sequence: CAG
cactcaaaaagttagtgaag

SEQ ID NO: 127001 - DNA, 20 bp, Artificial Sequence
  Description of Artificial Sequence: Synthetic oligonucleotide
  Target: ATXN1; (+) strand; PAM type: NRG; PAM sequence: TGG
agtgaagcagtacgattcca

SEQ ID NO: 127002 - DNA, 20 bp, Artificial Sequence
  Description of Artificial Sequence: Synthetic oligonucleotide
  Target: ATXN1; (+) strand; PAM type: NRG; PAM sequence: AAG
gaagcagtacgattccatgg

SEQ ID NO: 127003 - DNA, 20 bp, Artificial Sequence
  Description of Artificial Sequence: Synthetic oligonucleotide
  Target: ATXN1; (+) strand; PAM type: NRG; PAM sequence: AGG
aagcagtacgattccatgga

SEQ ID NO: 127004 - DNA, 20 bp, Artificial Sequence
  Description of Artificial Sequence: Synthetic oligonucleotide
  Target: ATXN1; (+) strand; PAM type: NRG; PAM sequence: GGG
agcagtacgattccatggaa

SEQ ID NO: 127005 - DNA, 20 bp, Artificial Sequence
  Description of Artificial Sequence: Synthetic oligonucleotide
  Target: ATXN1; (+) strand; PAM type: NRG; PAM sequence: AAG
tacgattccatggaagggtt

SEQ ID NO: 127006 - DNA, 20 bp, Artificial Sequence
  Description of Artificial Sequence: Synthetic oligonucleotide
  Target: ATXN1; (+) strand; PAM type: NRG; PAM sequence: AGG
acgattccatggaagggtta

SEQ ID NO: 127007 - DNA, 20 bp, Artificial Sequence
  Description of Artificial Sequence: Synthetic oligonucleotide
  Target: ATXN1; (+) strand; PAM type: NRG; PAM sequence: GGG
cgattccatggaagggttaa

SEQ ID NO: 127008 - DNA, 20 bp, Artificial Sequence
  Description of Artificial Sequence: Synthetic oligonucleotide
  Target: ATXN1; (+) strand; PAM type: NRG; PAM sequence: TAG
ttaagggttcattttccttt

SEQ ID NO: 127009 - DNA, 20 bp, Artificial Sequence
  Description of Artificial Sequence: Synthetic oligonucleotide
  Target: ATXN1; (+) strand; PAM type: NRG; PAM sequence: TGG
ttttagataaatattgtatc

SEQ ID NO: 127010 - DNA, 20 bp, Artificial Sequence
  Description of Artificial Sequence: Synthetic oligonucleotide
  Target: ATXN1; (+) strand; PAM type: NRG; PAM sequence: GAG
ttagataaatattgtatctg

SEQ ID NO: 127011 - DNA, 20 bp, Artificial Sequence
  Description of Artificial Sequence: Synthetic oligonucleotide
  Target: ATXN1; (+) strand; PAM type: NRG; PAM sequence: AAG
aaatattgtatctggagcaa

SEQ ID NO: 127012 - DNA, 20 bp, Artificial Sequence
  Description of Artificial Sequence: Synthetic oligonucleotide
  Target: ATXN1; (+) strand; PAM type: NRG; PAM sequence: AGG
aatattgtatctggagcaaa

SEQ ID NO: 127013 - DNA, 20 bp, Artificial Sequence
  Description of Artificial Sequence: Synthetic oligonucleotide
  Target: ATXN1; (+) strand; PAM type: NRG; PAM sequence: TAG
tggagcaaaaggtaacctct

SEQ ID NO: 127014 - DNA, 20 bp, Artificial Sequence
  Description of Artificial Sequence: Synthetic oligonucleotide
  Target: ATXN1; (+) strand; PAM type: NRG; PAM sequence: CAG
agcaaaaggtaacctcttag

SEQ ID NO: 127015 - DNA, 20 bp, Artificial Sequence
  Description of Artificial Sequence: Synthetic oligonucleotide
  Target: ATXN1; (+) strand; PAM type: NRG; PAM sequence: CGG
ttagcagattcatccattgt

SEQ ID NO: 127016 - DNA, 20 bp, Artificial Sequence
  Description of Artificial Sequence: Synthetic oligonucleotide
  Target: ATXN1; (+) strand; PAM type: NRG; PAM sequence: TGG
tccattgtcggaatcttatt

SEQ ID NO: 127017 - DNA, 20 bp, Artificial Sequence
  Description of Artificial Sequence: Synthetic oligonucleotide
  Target: ATXN1; (+) strand; PAM type: NRG; PAM sequence: AAG
actaccccatcgttttactt

SEQ ID NO: 127018 - DNA, 20 bp, Artificial Sequence
  Description of Artificial Sequence: Synthetic oligonucleotide
  Target: ATXN1; (+) strand; PAM type: NRG; PAM sequence: GAG
taccccatcgttttacttaa

SEQ ID NO: 127019 - DNA, 20 bp, Artificial Sequence
  Description of Artificial Sequence: Synthetic oligonucleotide
  Target: ATXN1; (+) strand; PAM type: NRG; PAM sequence: TGG
acttaagagaacatctacac

SEQ ID NO: 127020 - DNA, 20 bp, Artificial Sequence
  Description of Artificial Sequence: Synthetic oligonucleotide
  Target: ATXN1; (+) strand; PAM type: NRG; PAM sequence: TGG
acatctacactggaatctac

SEQ ID NO: 127021 - DNA, 20 bp, Artificial Sequence
  Description of Artificial Sequence: Synthetic oligonucleotide
  Target: ATXN1; (+) strand; PAM type: NRG; PAM sequence: GAG
atctacactggaatctactg

SEQ ID NO: 127022 - DNA, 20 bp, Artificial Sequence
  Description of Artificial Sequence: Synthetic oligonucleotide
  Target: ATXN1; (+) strand; PAM type: NRG; PAM sequence: AGG
tctacactggaatctactgg

SEQ ID NO: 127023 - DNA, 20 bp, Artificial Sequence
  Description of Artificial Sequence: Synthetic oligonucleotide
  Target: ATXN1; (+) strand; PAM type: NRG; PAM sequence: GGG
ctacactggaatctactgga

SEQ ID NO: 127024 - DNA, 20 bp, Artificial Sequence
  Description of Artificial Sequence: Synthetic oligonucleotide
  Target: ATXN1; (+) strand; PAM type: NRG; PAM sequence: TGG
cactggaatctactggaggg

SEQ ID NO: 127025 - DNA, 20 bp, Artificial Sequence
  Description of Artificial Sequence: Synthetic oligonucleotide
  Target: ATXN1; (+) strand; PAM type: NRG; PAM sequence: GAG
ctggaatctactggagggtg

SEQ ID NO: 127026 - DNA, 20 bp, Artificial Sequence
  Description of Artificial Sequence: Synthetic oligonucleotide
  Target: ATXN1; (+) strand; PAM type: NRG; PAM sequence: AGG
tggaatctactggagggtgg

SEQ ID NO: 127027 - DNA, 20 bp, Artificial Sequence
  Description of Artificial Sequence: Synthetic oligonucleotide
  Target: ATXN1; (+) strand; PAM type: NRG; PAM sequence: TGG
aatctactggagggtggagg

SEQ ID NO: 127028 - DNA, 20 bp, Artificial Sequence
  Description of Artificial Sequence: Synthetic oligonucleotide
  Target: ATXN1; (+) strand; PAM type: NRG; PAM sequence: GGG
atctactggagggtggaggt

SEQ ID NO: 127029 - DNA, 20 bp, Artificial Sequence
  Description of Artificial Sequence: Synthetic oligonucleotide
  Target: ATXN1; (+) strand; PAM type: NRG; PAM sequence: GAG
ctactggagggtggaggtgg

SEQ ID NO: 127030 - DNA, 20 bp, Artificial Sequence
  Description of Artificial Sequence: Synthetic oligonucleotide
  Target: ATXN1; (+) strand; PAM type: NRG; PAM sequence: AGG
tactggagggtggaggtggg

SEQ ID NO: 127031 - DNA, 20 bp, Artificial Sequence
  Description of Artificial Sequence: Synthetic oligonucleotide
  Target: ATXN1; (+) strand; PAM type: NRG; PAM sequence: AAG
agggtggaggtgggaggaca

SEQ ID NO: 127032 - DNA, 20 bp, Artificial Sequence
  Description of Artificial Sequence: Synthetic oligonucleotide
  Target: ATXN1; (+) strand; PAM type: NRG; PAM sequence: AAG
gtggaggtgggaggacaaag

SEQ ID NO: 127033 - DNA, 20 bp, Artificial Sequence
  Description of Artificial Sequence: Synthetic oligonucleotide
  Target: ATXN1; (+) strand; PAM type: NRG; PAM sequence: CGG
ggtgggaggacaaagaagat

SEQ ID NO: 127034 - DNA, 20 bp, Artificial Sequence
  Description of Artificial Sequence: Synthetic oligonucleotide
  Target: ATXN1; (+) strand; PAM type: NRG; PAM sequence: GGG
gtgggaggacaaagaagatc

SEQ ID NO: 127035 - DNA, 20 bp, Artificial Sequence
  Description of Artificial Sequence: Synthetic oligonucleotide
  Target: ATXN1; (+) strand; PAM type: NRG; PAM sequence: TGG
agatcgggaaaaataactaa

SEQ ID NO: 127036 - DNA, 20 bp, Artificial Sequence
  Description of Artificial Sequence: Synthetic oligonucleotide
  Target: ATXN1; (+) strand; PAM type: NRG; PAM sequence: TAG
gaaaaataactaatggttac

SEQ ID NO: 127037 - DNA, 20 bp, Artificial Sequence
  Description of Artificial Sequence: Synthetic oligonucleotide
  Target: ATXN1; (+) strand; PAM type: NRG; PAM sequence: AGG
aaaaataactaatggttact

SEQ ID NO: 127038 - DNA, 20 bp, Artificial Sequence
  Description of Artificial Sequence: Synthetic oligonucleotide
  Target: ATXN1; (+) strand; PAM type: NRG; PAM sequence: TAG
taactaatggttactaggct

SEQ ID NO: 127039 - DNA, 20 bp, Artificial Sequence
  Description of Artificial Sequence: Synthetic oligonucleotide
  Target: ATXN1; (+) strand; PAM type: NRG; PAM sequence: TGG
tggttactaggcttagtacc

SEQ ID NO: 127040 - DNA, 20 bp, Artificial Sequence
  Description of Artificial Sequence: Synthetic oligonucleotide
  Target: ATXN1; (+) strand; PAM type: NRG; PAM sequence: AAG
aaaacaaacccccatgacac

SEQ ID NO: 127041 - DNA, 20 bp, Artificial Sequence
  Description of Artificial Sequence: Synthetic oligonucleotide
  Target: ATXN1; (+) strand; PAM type: NRG; PAM sequence: AAG
tacatctgaacttaaaatat

SEQ ID NO: 127042 - DNA, 20 bp, Artificial Sequence
  Description of Artificial Sequence: Synthetic oligonucleotide
  Target: ATXN1; (+) strand; PAM type: NRG; PAM sequence: AAG
ataagttaaatgaataaaaa

SEQ ID NO: 127043 - DNA, 20 bp, Artificial Sequence
  Description of Artificial Sequence: Synthetic oligonucleotide
  Target: ATXN1; (+) strand; PAM type: NRG; PAM sequence: TAG
aaaaagaaaacatccacaca

SEQ ID NO: 127044 - DNA, 20 bp, Artificial Sequence
  Description of Artificial Sequence: Synthetic oligonucleotide
  Target: ATXN1; (+) strand; PAM type: NRG; PAM sequence: AAG
aagaaaacatccacacatag

SEQ ID NO: 127045 - DNA, 20 bp, Artificial Sequence
  Description of Artificial Sequence: Synthetic oligonucleotide
  Target: ATXN1; (+) strand; PAM type: NRG; PAM sequence: CAG
atccacacatagaagtcaat

SEQ ID NO: 127046 - DNA, 20 bp, Artificial Sequence
  Description of Artificial Sequence: Synthetic oligonucleotide
  Target: ATXN1; (+) strand; PAM type: NRG; PAM sequence: AGG
tccacacatagaagtcaatc

SEQ ID NO: 127047 - DNA, 20 bp, Artificial Sequence
  Description of Artificial Sequence: Synthetic oligonucleotide
  Target: ATXN1; (+) strand; PAM type: NRG; PAM sequence: TGG
aatcaggttttatgatttcc

SEQ ID NO: 127048 - DNA, 20 bp, Artificial Sequence
  Description of Artificial Sequence: Synthetic oligonucleotide
  Target: ATXN1; (+) strand; PAM type: NRG; PAM sequence: GGG
atcaggttttatgatttcct

SEQ ID NO: 127049 - DNA, 20 bp, Artificial Sequence
  Description of Artificial Sequence: Synthetic oligonucleotide
  Target: ATXN1; (+) strand; PAM type: NRG; PAM sequence: CGG
ttcctgggtgtctgtgttca

SEQ ID NO: 127050 - DNA, 20 bp, Artificial Sequence
  Description of Artificial Sequence: Synthetic oligonucleotide
  Target: ATXN1; (+) strand; PAM type: NRG; PAM sequence: GGG
tcctgggtgtctgtgttcac

SEQ ID NO: 127051 - DNA, 20 bp, Artificial Sequence
  Description of Artificial Sequence: Synthetic oligonucleotide
  Target: ATXN1; (+) strand; PAM type: NRG; PAM sequence: TGG
tgggtgtctgtgttcacggg

SEQ ID NO: 127052 - DNA, 20 bp, Artificial Sequence
  Description of Artificial Sequence: Synthetic oligonucleotide
  Target: ATXN1; (+) strand; PAM type: NRG; PAM sequence: GGG
gggtgtctgtgttcacgggt

SEQ ID NO: 127053 - DNA, 20 bp, Artificial Sequence
  Description of Artificial Sequence: Synthetic oligonucleotide
  Target: ATXN1; (+) strand; PAM type: NRG; PAM sequence: TAG
tatgcgtgtgtgtgtatgtg

SEQ ID NO: 127054 - DNA, 20 bp, Artificial Sequence
  Description of Artificial Sequence: Synthetic oligonucleotide
  Target: ATXN1; (+) strand; PAM type: NRG; PAM sequence: AAG
cttattatacataatttttt

SEQ ID NO: 127055 - DNA, 20 bp, Artificial Sequence
  Description of Artificial Sequence: Synthetic oligonucleotide
  Target: ATXN1; (+) strand; PAM type: NRG; PAM sequence: AAG
cataccatataaactcttca

SEQ ID NO: 127056 - DNA, 20 bp, Artificial Sequence
  Description of Artificial Sequence: Synthetic oligonucleotide
  Target: ATXN1; (+) strand; PAM type: NRG; PAM sequence: CAG
ccatataaactcttcaaaga

SEQ ID NO: 127057 - DNA, 20 bp, Artificial Sequence
  Description of Artificial Sequence: Synthetic oligonucleotide
  Target: ATXN1; (+) strand; PAM type: NRG; PAM sequence: AAG
cagtgtccatacaccttaat

SEQ ID NO: 127058 - DNA, 20 bp, Artificial Sequence
  Description of Artificial Sequence: Synthetic oligonucleotide
  Target: ATXN1; (+) strand; PAM type: NRG; PAM sequence: CAG
caccttaataagtcctctaa

SEQ ID NO: 127059 - DNA, 20 bp, Artificial Sequence
  Description of Artificial Sequence: Synthetic oligonucleotide
  Target: ATXN1; (+) strand; PAM type: NRG; PAM sequence: TAG
ttaataagtcctctaacagc

SEQ ID NO: 127060 - DNA, 20 bp, Artificial Sequence
  Description of Artificial Sequence: Synthetic oligonucleotide
  Target: ATXN1; (+) strand; PAM type: NRG; PAM sequence: AAG
agtcctctaacagctagcat

SEQ ID NO: 127061 - DNA, 20 bp, Artificial Sequence
  Description of Artificial Sequence: Synthetic oligonucleotide
  Target: ATXN1; (+) strand; PAM type: NRG; PAM sequence: TGG
gcataagtttactgtataca

SEQ ID NO: 127062 - DNA, 20 bp, Artificial Sequence
  Description of Artificial Sequence: Synthetic oligonucleotide
  Target: ATXN1; (+) strand; PAM type: NRG; PAM sequence: AAG
agtttactgtatacatggtc

SEQ ID NO: 127063 - DNA, 20 bp, Artificial Sequence
  Description of Artificial Sequence: Synthetic oligonucleotide
  Target: ATXN1; (+) strand; PAM type: NRG; PAM sequence: AGG
gtttactgtatacatggtca

SEQ ID NO: 127064 - DNA, 20 bp, Artificial Sequence
  Description of Artificial Sequence: Synthetic oligonucleotide
  Target: ATXN1; (+) strand; PAM type: NRG; PAM sequence: AAG
tatacatggtcaaggtattg

SEQ ID NO: 127065 - DNA, 20 bp, Artificial Sequence
  Description of Artificial Sequence: Synthetic oligonucleotide
  Target: ATXN1; (+) strand; PAM type: NRG; PAM sequence: GAG
tacatggtcaaggtattgaa

SEQ ID NO: 127066 - DNA, 20 bp, Artificial Sequence
  Description of Artificial Sequence: Synthetic oligonucleotide
  Target: ATXN1; (+) strand; PAM type: NRG; PAM sequence: CAG
gagaatttgtacaaaacaat

SEQ ID NO: 127067 - DNA, 20 bp, Artificial Sequence
  Description of Artificial Sequence: Synthetic oligonucleotide
  Target: ATXN1; (+) strand; PAM type: NRG; PAM sequence: CAG
caaaacaatcagcacatcca

SEQ ID NO: 127068 - DNA, 20 bp, Artificial Sequence
  Description of Artificial Sequence: Synthetic oligonucleotide
  Target: ATXN1; (+) strand; PAM type: NRG; PAM sequence: TGG
gtatctcaaaattcccaaat

SEQ ID NO: 127069 - DNA, 20 bp, Artificial Sequence
  Description of Artificial Sequence: Synthetic oligonucleotide
  Target: ATXN1; (+) strand; PAM type: NRG; PAM sequence: TAG
caaattggcaatcactgcct

SEQ ID NO: 127070 - DNA, 20 bp, Artificial Sequence
  Description of Artificial Sequence: Synthetic oligonucleotide
  Target: ATXN1; (+) strand; PAM type: NRG; PAM sequence: AAG
tggcaatcactgccttagca

SEQ ID NO: 127071 - DNA, 20 bp, Artificial Sequence
  Description of Artificial Sequence: Synthetic oligonucleotide
  Target: ATXN1; (+) strand; PAM type: NRG; PAM sequence: TGG
gcaaagctgcatctctgacc

SEQ ID NO: 127072 - DNA, 20 bp, Artificial Sequence
  Description of Artificial Sequence: Synthetic oligonucleotide
  Target: ATXN1; (+) strand; PAM type: NRG; PAM sequence: GAG
aaagctgcatctctgacctg

SEQ ID NO: 127073 - DNA, 20 bp, Artificial Sequence
  Description of Artificial Sequence: Synthetic oligonucleotide
  Target: ATXN1; (+) strand; PAM type: NRG; PAM sequence: TAG
ctgcatctctgacctggaga

SEQ ID NO: 127074 - DNA, 20 bp, Artificial Sequence
  Description of Artificial Sequence: Synthetic oligonucleotide
  Target: ATXN1; (+) strand; PAM type: NRG; PAM sequence: GAG
gcatctctgacctggagata

SEQ ID NO: 127075 - DNA, 20 bp, Artificial Sequence
  Description of Artificial Sequence: Synthetic oligonucleotide
  Target: ATXN1; (+) strand; PAM type: NRG; PAM sequence: AGG
catctctgacctggagatag

SEQ ID NO: 127076 - DNA, 20 bp, Artificial Sequence
  Description of Artificial Sequence: Synthetic oligonucleotide
  Target: ATXN1; (+) strand; PAM type: NRG; PAM sequence: GGG
atctctgacctggagataga

SEQ ID NO: 127077 - DNA, 20 bp, Artificial Sequence
  Description of Artificial Sequence: Synthetic oligonucleotide
  Target: ATXN1; (+) strand; PAM type: NRG; PAM sequence: GGG
tctctgacctggagatagag

SEQ ID NO: 127078 - DNA, 20 bp, Artificial Sequence
  Description of Artificial Sequence: Synthetic oligonucleotide
  Target: ATXN1; (+) strand; PAM type: NRG; PAM sequence: AAG
ctgacctggagatagagggg

SEQ ID NO: 127079 - DNA, 20 bp, Artificial Sequence
  Description of Artificial Sequence: Synthetic oligonucleotide
  Target: ATXN1; (+) strand; PAM type: NRG; PAM sequence: GAG
gacctggagatagaggggaa

SEQ ID NO: 127080 - DNA, 20 bp, Artificial Sequence
  Description of Artificial Sequence: Synthetic oligonucleotide
  Target: ATXN1; (+) strand; PAM type: NRG; PAM sequence: AAG
ctggagatagaggggaagag

SEQ ID NO: 127081 - DNA, 20 bp, Artificial Sequence
  Description of Artificial Sequence: Synthetic oligonucleotide
  Target: ATXN1; (+) strand; PAM type: NRG; PAM sequence: CAG
gagatagaggggaagagaag

SEQ ID NO: 127082 - DNA, 20 bp, Artificial Sequence
  Description of Artificial Sequence: Synthetic oligonucleotide
  Target: ATXN1; (+) strand; PAM type: NRG; PAM sequence: AGG
agatagaggggaagagaagc

SEQ ID NO: 127083 - DNA, 20 bp, Artificial Sequence
  Description of Artificial Sequence: Synthetic oligonucleotide
  Target: ATXN1; (+) strand; PAM type: NRG; PAM sequence: TAG
gagaagcaggaaaccatctt

SEQ ID NO: 127084 - DNA, 20 bp, Artificial Sequence
  Description of Artificial Sequence: Synthetic oligonucleotide
  Target: ATXN1; (+) strand; PAM type: NRG; PAM sequence: AGG
agaagcaggaaaccatcttt

SEQ ID NO: 127085 - DNA, 20 bp, Artificial Sequence
  Description of Artificial Sequence: Synthetic oligonucleotide
  Target: ATXN1; (+) strand; PAM type: NRG; PAM sequence: GGG
gaagcaggaaaccatcttta

SEQ ID NO: 127086 - DNA, 20 bp, Artificial Sequence
  Description of Artificial Sequence: Synthetic oligonucleotide
  Target: ATXN1; (+) strand; PAM type: NRG; PAM sequence: CAG
ggaaaccatctttagggtgc

SEQ ID NO: 127087 - DNA, 20 bp, Artificial Sequence
  Description of Artificial Sequence: Synthetic oligonucleotide
  Target: ATXN1; (+) strand; PAM type: NRG; PAM sequence: AGG
gaaaccatctttagggtgcc

SEQ ID NO: 127088 - DNA, 20 bp, Artificial Sequence
  Description of Artificial Sequence: Synthetic oligonucleotide
  Target: ATXN1; (+) strand; PAM type: NRG; PAM sequence: CAG
accatctttagggtgccagg

SEQ ID NO: 127089 - DNA, 20 bp, Artificial Sequence
  Description of Artificial Sequence: Synthetic oligonucleotide
  Target: ATXN1; (+) strand; PAM type: NRG; PAM sequence: AAG
tctttagggtgccaggcagc

SEQ ID NO: 127090 - DNA, 20 bp, Artificial Sequence
  Description of Artificial Sequence: Synthetic oligonucleotide
  Target: ATXN1; (+) strand; PAM type: NRG; PAM sequence: TGG
gccaggcagcaagttgcctg

SEQ ID NO: 127091 - DNA, 20 bp, Artificial Sequence
  Description of Artificial Sequence: Synthetic oligonucleotide
  Target: ATXN1; (+) strand; PAM type: NRG; PAM sequence: CGG
gttgcctgtggtctacgttt

SEQ ID NO: 127092 - DNA, 20 bp, Artificial Sequence
  Description of Artificial Sequence: Synthetic oligonucleotide
  Target: ATXN1; (+) strand; PAM type: NRG; PAM sequence: GGG
ttgcctgtggtctacgtttc

SEQ ID NO: 127093 - DNA, 20 bp, Artificial Sequence
  Description of Artificial Sequence: Synthetic oligonucleotide
  Target: ATXN1; (+) strand; PAM type: NRG; PAM sequence: GGG
tgcctgtggtctacgtttcg

SEQ ID NO: 127094 - DNA, 20 bp, Artificial Sequence
  Description of Artificial Sequence: Synthetic oligonucleotide
  Target: ATXN1; (+) strand; PAM type: NRG; PAM sequence: CAG
ctgtggtctacgtttcgggg

SEQ ID NO: 127095 - DNA, 20 bp, Artificial Sequence
  Description of Artificial Sequence: Synthetic oligonucleotide
  Target: ATXN1; (+) strand; PAM type: NRG; PAM sequence: AGG
tgtggtctacgtttcggggc

SEQ ID NO: 127096 - DNA, 20 bp, Artificial Sequence
  Description of Artificial Sequence: Synthetic oligonucleotide
  Target: ATXN1; (+) strand; PAM type: NRG; PAM sequence: CAG
ttccataactcctctcacca

SEQ ID NO: 127097 - DNA, 20 bp, Artificial Sequence
  Description of Artificial Sequence: Synthetic oligonucleotide
  Target: ATXN1; (+) strand; PAM type: NRG; PAM sequence: AAG
aactcctctcaccacagcta

SEQ ID NO: 127098 - DNA, 20 bp, Artificial Sequence
  Description of Artificial Sequence: Synthetic oligonucleotide
  Target: ATXN1; (+) strand; PAM type: NRG; PAM sequence: CAG
ctctcaccacagctaaagat

SEQ ID NO: 127099 - DNA, 20 bp, Artificial Sequence
  Description of Artificial Sequence: Synthetic oligonucleotide
  Target: ATXN1; (+) strand; PAM type: NRG; PAM sequence: GAG
ctcaccacagctaaagatca

SEQ ID NO: 127100 - DNA, 20 bp, Artificial Sequence
  Description of Artificial Sequence: Synthetic oligonucleotide
  Target: ATXN1; (+) strand; PAM type: NRG; PAM sequence: AAG
agatcagagctacttcacca

SEQ ID NO: 127101 - DNA, 20 bp, Artificial Sequence
  Description of Artificial Sequence: Synthetic oligonucleotide
  Target: ATXN1; (+) strand; PAM type: NRG; PAM sequence: TAG
agagctacttcaccaaagtt

SEQ ID NO: 127102 - DNA, 20 bp, Artificial Sequence
  Description of Artificial Sequence: Synthetic oligonucleotide
  Target: ATXN1; (+) strand; PAM type: NRG; PAM sequence: TAG
tcaccaaagtttagtacgaa

SEQ ID NO: 127103 - DNA, 20 bp, Artificial Sequence
  Description of Artificial Sequence: Synthetic oligonucleotide
  Target: ATXN1; (+) strand; PAM type: NRG; PAM sequence: AGG
caccaaagtttagtacgaat

SEQ ID NO: 127104 - DNA, 20 bp, Artificial Sequence
  Description of Artificial Sequence: Synthetic oligonucleotide
  Target: ATXN1; (+) strand; PAM type: NRG; PAM sequence: CAG
agtacgaataggaaatatca

SEQ ID NO: 127105 - DNA, 20 bp, Artificial Sequence
  Description of Artificial Sequence: Synthetic oligonucleotide
  Target: ATXN1; (+) strand; PAM type: NRG; PAM sequence: GAG
tacgaataggaaatatcaca

SEQ ID NO: 127106 - DNA, 20 bp, Artificial Sequence
  Description of Artificial Sequence: Synthetic oligonucleotide
  Target: ATXN1; (+) strand; PAM type: NRG; PAM sequence: AGG
acgaataggaaatatcacag

SEQ ID NO: 127107 - DNA, 20 bp, Artificial Sequence
  Description of Artificial Sequence: Synthetic oligonucleotide
  Target: ATXN1; (+) strand; PAM type: NRG; PAM sequence: AAG
ataggaaatatcacagagga

SEQ ID NO: 127108 - DNA, 20 bp, Artificial Sequence
  Description of Artificial Sequence: Synthetic oligonucleotide
  Target: ATXN1; (+) strand; PAM type: NRG; PAM sequence: AGG
taggaaatatcacagaggaa

SEQ ID NO: 127109 - DNA, 20 bp, Artificial Sequence
  Description of Artificial Sequence: Synthetic oligonucleotide
  Target: ATXN1; (+) strand; PAM type: NRG; PAM sequence: CAG
gaaatatcacagaggaaagg

SEQ ID NO: 127110 - DNA, 20 bp, Artificial Sequence
  Description of Artificial Sequence: Synthetic oligonucleotide
  Target: ATXN1; (+) strand; PAM type: NRG; PAM sequence: CAG
cacagaggaaaggcagaatt

SEQ ID NO: 127111 - DNA, 20 bp, Artificial Sequence
  Description of Artificial Sequence: Synthetic oligonucleotide
  Target: ATXN1; (+) strand; PAM type: NRG; PAM sequence: AAG
tcagattctgtgactttaaa

SEQ ID NO: 127112 - DNA, 20 bp, Artificial Sequence
  Description of Artificial Sequence: Synthetic oligonucleotide
  Target: ATXN1; (+) strand; PAM type: NRG; PAM sequence: CAG
tgactttaaaaagtgcaacc

SEQ ID NO: 127113 - DNA, 20 bp, Artificial Sequence
  Description of Artificial Sequence: Synthetic oligonucleotide
  Target: ATXN1; (+) strand; PAM type: NRG; PAM sequence: AGG
gactttaaaaagtgcaaccc

SEQ ID NO: 127114 - DNA, 20 bp, Artificial Sequence
  Description of Artificial Sequence: Synthetic oligonucleotide
  Target: ATXN1; (+) strand; PAM type: NRG; PAM sequence: CAG
tttaaaaagtgcaacccagg

SEQ ID NO: 127115 - DNA, 20 bp, Artificial Sequence
  Description of Artificial Sequence: Synthetic oligonucleotide
  Target: ATXN1; (+) strand; PAM type: NRG; PAM sequence: AGG
ttaaaaagtgcaacccaggc

SEQ ID NO: 127116 - DNA, 20 bp, Artificial Sequence
  Description of Artificial Sequence: Synthetic oligonucleotide
  Target: ATXN1; (+) strand; PAM type: NRG; PAM sequence: CAG
agtgcaacccaggcaggacg

SEQ ID NO: 127117 - DNA, 20 bp, Artificial Sequence
  Description of Artificial Sequence: Synthetic oligonucleotide
  Target: ATXN1; (+) strand; PAM type: NRG; PAM sequence: TGG
gcaacccaggcaggacgcag

SEQ ID NO: 127118 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatcctaacactt

SEQ ID NO: 127119 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcctaacacttt

SEQ ID NO: 127120 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcctaacactttgg

SEQ ID NO: 127121 - DNA, 20 bp, Artificial Sequence
  Description of Artificial Sequence: Synthetic oligonucleotide
  Target: ATXN1; (+) strand; PAM type: NRG; PAM sequence: AGG
tgtaatcctaacactttggg

SEQ ID NO: 127122 - DNA, 20 bp, Artificial Sequence
  Description of Artificial Sequence: Synthetic oligonucleotide
  Target: ATXN1; (+) strand; PAM type: NRG; PAM sequence: GAG
tcctaacactttgggaggcc

SEQ ID NO: 127123 - DNA, 20 bp, Artificial Sequence
  Description of Artificial Sequence: Synthetic oligonucleotide
  Target: ATXN1; (+) strand; PAM type: NRG; PAM sequence: AGG
cctaacactttgggaggccg

SEQ ID NO: 127124 - DNA, 20 bp, Artificial Sequence
  Description of Artificial Sequence: Synthetic oligonucleotide
  Target: ATXN1; (+) strand; PAM type: NRG; PAM sequence: CAG
acactttgggaggccgaggc

SEQ ID NO: 127125 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccgaggccag

SEQ ID NO: 127126 - DNA, 20 bp, Artificial Sequence
  Description of Artificial Sequence: Synthetic oligonucleotide
  Target: ATXN1; (+) strand; PAM type: NRG; PAM sequence: GAG
ccgaggccagtggatcacct

SEQ ID NO: 127127 - DNA, 20 bp, Artificial Sequence
  Description of Artificial Sequence: Synthetic oligonucleotide
  Target: ATXN1; (+) strand; PAM type: NRG; PAM sequence: AGG
cgaggccagtggatcacctg

SEQ ID NO: 127128 - DNA, 20 bp, Artificial Sequence
  Description of Artificial Sequence: Synthetic oligonucleotide
  Target: ATXN1; (+) strand; PAM type: NRG; PAM sequence: CAG
gccagtggatcacctgaggt

SEQ ID NO: 127129 - DNA, 20 bp, Artificial Sequence
  Description of Artificial Sequence: Synthetic oligonucleotide
  Target: ATXN1; (+) strand; PAM type: NRG; PAM sequence: AAG
agtggatcacctgaggtcag

SEQ ID NO: 127130 - DNA, 20 bp, Artificial Sequence
  Description of Artificial Sequence: Synthetic oligonucleotide
  Target: ATXN1; (+) strand; PAM type: NRG; PAM sequence: AAG
tcacctgaggtcagaagttc

SEQ ID NO: 127131 - DNA, 20 bp, Artificial Sequence
  Description of Artificial Sequence: Synthetic oligonucleotide
  Target: ATXN1; (+) strand; PAM type: NRG; PAM sequence: CAG
tgaggtcagaagttcaagac

SEQ ID NO: 127132 - DNA, 20 bp, Artificial Sequence
  Description of Artificial Sequence: Synthetic oligonucleotide
  Target: ATXN1; (+) strand; PAM type: NRG; PAM sequence: TGG
tcagaagttcaagaccagcc

SEQ ID NO: 127133 - DNA, 20 bp, Artificial Sequence
  Description of Artificial Sequence: Synthetic oligonucleotide
  Target: ATXN1; (+) strand; PAM type: NRG; PAM sequence: TGG
caagaccagcctggccaaca

SEQ ID NO: 127134 - DNA, 20 bp, Artificial Sequence
  Description of Artificial Sequence: Synthetic oligonucleotide
  Target: ATXN1; (+) strand; PAM type: NRG; PAM sequence: GAG
tctactaaatatacaaaaat

SEQ ID NO: 127135 - DNA, 20 bp, Artificial Sequence
  Description of Artificial Sequence: Synthetic oligonucleotide
  Target: ATXN1; (+) strand; PAM type: NRG; PAM sequence: TGG
ctaaatatacaaaaatgagc

SEQ ID NO: 127136 - DNA, 20 bp, Artificial Sequence
  Description of Artificial Sequence: Synthetic oligonucleotide
  Target: ATXN1; (+) strand; PAM type: NRG; PAM sequence: GGG
taaatatacaaaaatgagct

SEQ ID NO: 127137 - DNA, 20 bp, Artificial Sequence
  Description of Artificial Sequence: Synthetic oligonucleotide
  Target: ATXN1; (+) strand; PAM type: NRG; PAM sequence: TGG
atacaaaaatgagctgggcg

SEQ ID NO: 127138 - DNA, 20 bp, Artificial Sequence
  Description of Artificial Sequence: Synthetic oligonucleotide
  Target: ATXN1; (+) strand; PAM type: NRG; PAM sequence: TGG
caaaaatgagctgggcgtgg

SEQ ID NO: 127139 - DNA, 20 bp, Artificial Sequence
  Description of Artificial Sequence: Synthetic oligonucleotide
  Target: ATXN1; (+) strand; PAM type: NRG; PAM sequence: CAG
aaatgagctgggcgtggtgg

SEQ ID NO: 127140 - DNA, 20 bp, Artificial Sequence
  Description of Artificial Sequence: Synthetic oligonucleotide
  Target: ATXN1; (+) strand; PAM type: NRG; PAM sequence: CAG
gtggcagacacctgtaatct

SEQ ID NO: 127141 - DNA, 20 bp, Artificial Sequence
  Description of Artificial Sequence: Synthetic oligonucleotide
  Target: ATXN1; (+) strand; PAM type: NRG; PAM sequence: CAG
cacctgtaatctcagctact

SEQ ID NO: 127142 - DNA, 20 bp, Artificial Sequence
  Description of Artificial Sequence: Synthetic oligonucleotide
  Target: ATXN1; (+) strand; PAM type: NRG; PAM sequence: AGG
acctgtaatctcagctactc

SEQ ID NO: 127143 - DNA, 20 bp, Artificial Sequence
  Description of Artificial Sequence: Synthetic oligonucleotide
  Target: ATXN1; (+) strand; PAM type: NRG; PAM sequence: GAG
ctgtaatctcagctactcag

SEQ ID NO: 127144 - DNA, 20 bp, Artificial Sequence
  Description of Artificial Sequence: Synthetic oligonucleotide
  Target: ATXN1; (+) strand; PAM type: NRG; PAM sequence: AGG
tgtaatctcagctactcagg

SEQ ID NO: 127145 - DNA, 20 bp, Artificial Sequence
  Description of Artificial Sequence: Synthetic oligonucleotide
  Target: ATXN1; (+) strand; PAM type: NRG; PAM sequence: GAG
tctcagctactcaggaggct

SEQ ID NO: 127146 - DNA, 20 bp, Artificial Sequence
  Description of Artificial Sequence: Synthetic oligonucleotide
  Target: ATXN1; (+) strand; PAM type: NRG; PAM sequence: AGG
ctcagctactcaggaggctg

SEQ ID NO: 127147 - DNA, 20 bp, Artificial Sequence
  Description of Artificial Sequence: Synthetic oligonucleotide
  Target: ATXN1; (+) strand; PAM type: NRG; PAM sequence: CAG
agctactcaggaggctgagg

SEQ ID NO: 127148 - DNA, 20 bp, Artificial Sequence
  Description of Artificial Sequence: Synthetic oligonucleotide
  Target: ATXN1; (+) strand; PAM type: NRG; PAM sequence: AGG
gctactcaggaggctgaggc

SEQ ID NO: 127149 - DNA, 20 bp, Artificial Sequence
  Description of Artificial Sequence: Synthetic oligonucleotide
  Target: ATXN1; (+) strand; PAM type: NRG; PAM sequence: GAG
tactcaggaggctgaggcag

SEQ ID NO: 127150 - DNA, 20 bp, Artificial Sequence
  Description of Artificial Sequence: Synthetic oligonucleotide
  Target: ATXN1; (+) strand; PAM type: NRG; PAM sequence: TGG
gcaggagaattgcttgaacc

SEQ ID NO: 127151 - DNA, 20 bp, Artificial Sequence
  Description of Artificial Sequence: Synthetic oligonucleotide
  Target: ATXN1; (+) strand; PAM type: NRG; PAM sequence: GGG
caggagaattgcttgaacct

SEQ ID NO: 127152 - DNA, 20 bp, Artificial Sequence
  Description of Artificial Sequence: Synthetic oligonucleotide
  Target: ATXN1; (+) strand; PAM type: NRG; PAM sequence: TGG
aattgcttgaacctgggatg

SEQ ID NO: 127153 - DNA, 20 bp, Artificial Sequence
  Description of Artificial Sequence: Synthetic oligonucleotide
  Target: ATXN1; (+) strand; PAM type: NRG; PAM sequence: GAG
ttgcttgaacctgggatgtg

SEQ ID NO: 127154 - DNA, 20 bp, Artificial Sequence
  Description of Artificial Sequence: Synthetic oligonucleotide
  Target: ATXN1; (+) strand; PAM type: NRG; PAM sequence: AGG
tgcttgaacctgggatgtgg

SEQ ID NO: 127155 - DNA, 20 bp, Artificial Sequence
  Description of Artificial Sequence: Synthetic oligonucleotide
  Target: ATXN1; (+) strand; PAM type: NRG; PAM sequence: CAG
aacctgggatgtggaggttg

SEQ ID NO: 127156 - DNA, 20 bp, Artificial Sequence
  Description of Artificial Sequence: Synthetic oligonucleotide
  Target: ATXN1; (+) strand; PAM type: NRG; PAM sequence: GAG
tgggatgtggaggttgcagt

SEQ ID NO: 127157 - DNA, 20 bp, Artificial Sequence
  Description of Artificial Sequence: Synthetic oligonucleotide
  Target: ATXN1; (+) strand; PAM type: NRG; PAM sequence: GAG
tgtggaggttgcagtgagcc

SEQ ID NO: 127158 - DNA, 20 bp, Artificial Sequence
  Description of Artificial Sequence: Synthetic oligonucleotide
  Target: ATXN1; (+) strand; PAM type: NRG; PAM sequence: CAG
gagatcatgccattgcactc

SEQ ID NO: 127159 - DNA, 20 bp, Artificial Sequence
  Description of Artificial Sequence: Synthetic oligonucleotide
  Target: ATXN1; (+) strand; PAM type: NRG; PAM sequence: TGG
catgccattgcactccagcc

SEQ ID NO: 127160 - DNA, 20 bp, Artificial Sequence
  Description of Artificial Sequence: Synthetic oligonucleotide
  Target: ATXN1; (+) strand; PAM type: NRG; PAM sequence: GGG
atgccattgcactccagcct

SEQ ID NO: 127161 - DNA, 20 bp, Artificial Sequence
  Description of Artificial Sequence: Synthetic oligonucleotide
  Target: ATXN1; (+) strand; PAM type: NRG; PAM sequence: AAG
tgcactccagcctgggaaac

SEQ ID NO: 127162 - DNA, 20 bp, Artificial Sequence
  Description of Artificial Sequence: Synthetic oligonucleotide
  Target: ATXN1; (+) strand; PAM type: NRG; PAM sequence: GAG
cactccagcctgggaaacaa

SEQ ID NO: 127163 - DNA, 20 bp, Artificial Sequence
  Description of Artificial Sequence: Synthetic oligonucleotide
  Target: ATXN1; (+) strand; PAM type: NRG; PAM sequence: AAG
ctcaaaaaaaaaaaaaaaaa

SEQ ID NO: 127164 - DNA, 20 bp, Artificial Sequence
  Description of Artificial Sequence: Synthetic oligonucleotide
  Target: ATXN1; (+) strand; PAM type: NRG; PAM sequence: TAG
aaaaaaagtgctacccatgt

SEQ ID NO: 127165 - DNA, 20 bp, Artificial Sequence
  Description of Artificial Sequence: Synthetic oligonucleotide
  Target: ATXN1; (+) strand; PAM type: NRG; PAM sequence: TGG
tacccatgttagaaaccttt

SEQ ID NO: 127166 - DNA, 20 bp, Artificial Sequence
  Description of Artificial Sequence: Synthetic oligonucleotide
  Target: ATXN1; (+) strand; PAM type: NRG; PAM sequence: TGG
agaaaccttttggtcacatc

SEQ ID NO: 127167 - DNA, 20 bp, Artificial Sequence
  Description of Artificial Sequence: Synthetic oligonucleotide
  Target: ATXN1; (+) strand; PAM type: NRG; PAM sequence: CAG
cttttggtcacatctggtaa

SEQ ID NO: 127168 - DNA, 20 bp, Artificial Sequence
  Description of Artificial Sequence: Synthetic oligonucleotide
  Target: ATXN1; (+) strand; PAM type: NRG; PAM sequence: CAG
gtcacatctggtaacagccc

SEQ ID NO: 127169 - DNA, 20 bp, Artificial Sequence
  Description of Artificial Sequence: Synthetic oligonucleotide
  Target: ATXN1; (+) strand; PAM type: NRG; PAM sequence: TGG
acatctggtaacagccccag

SEQ ID NO: 127170 - DNA, 20 bp, Artificial Sequence
  Description of Artificial Sequence: Synthetic oligonucleotide
  Target: ATXN1; (+) strand; PAM type: NRG; PAM sequence: AAG
gtaacagccccagtggtgct

SEQ ID NO: 127171 - DNA, 20 bp, Artificial Sequence
  Description of Artificial Sequence: Synthetic oligonucleotide
  Target: ATXN1; (+) strand; PAM type: NRG; PAM sequence: AGG
taacagccccagtggtgcta

SEQ ID NO: 127172 - DNA, 20 bp, Artificial Sequence
  Description of Artificial Sequence: Synthetic oligonucleotide
  Target: ATXN1; (+) strand; PAM type: NRG; PAM sequence: AAG
cagtggtgctaaggacatga

SEQ ID NO: 127173 - DNA, 20 bp, Artificial Sequence
  Description of Artificial Sequence: Synthetic oligonucleotide
  Target: ATXN1; (+) strand; PAM type: NRG; PAM sequence: AAG
attgccccaatcaaaaaaca

SEQ ID NO: 127174 - DNA, 20 bp, Artificial Sequence
  Description of Artificial Sequence: Synthetic oligonucleotide
  Target: ATXN1; (+) strand; PAM type: NRG; PAM sequence: AGG
ttgccccaatcaaaaaacaa

SEQ ID NO: 127175 - DNA, 20 bp, Artificial Sequence
  Description of Artificial Sequence: Synthetic oligonucleotide
  Target: ATXN1; (+) strand; PAM type: NRG; PAM sequence: AAG
ccaatcaaaaaacaaaggca

SEQ ID NO: 127176 - DNA, 20 bp, Artificial Sequence
  Description of Artificial Sequence: Synthetic oligonucleotide
  Target: ATXN1; (+) strand; PAM type: NRG; PAM sequence: CAG
aaaaacaaaggcaaagaaca

SEQ ID NO: 127177 - DNA, 20 bp, Artificial Sequence
  Description of Artificial Sequence: Synthetic oligonucleotide
  Target: ATXN1; (+) strand; PAM type: NRG; PAM sequence: TGG
aaaggcaaagaacacagctc

SEQ ID NO: 127178 - DNA, 20 bp, Artificial Sequence
  Description of Artificial Sequence: Synthetic oligonucleotide
  Target: ATXN1; (+) strand; PAM type: NRG; PAM sequence: TGG
cacagctctggacacaaaat

SEQ ID NO: 127179 - DNA, 20 bp, Artificial Sequence
  Description of Artificial Sequence: Synthetic oligonucleotide
  Target: ATXN1; (+) strand; PAM type: NRG; PAM sequence: CAG
ctggacacaaaattggaatt

SEQ ID NO: 127180 - DNA, 20 bp, Artificial Sequence
  Description of Artificial Sequence: Synthetic oligonucleotide
  Target: ATXN1; (+) strand; PAM type: NRG; PAM sequence: AAG
ggaattcagtaaatacttaa

SEQ ID NO: 127181 - DNA, 20 bp, Artificial Sequence
  Description of Artificial Sequence: Synthetic oligonucleotide
  Target: ATXN1; (+) strand; PAM type: NRG; PAM sequence: CAG
attcagtaaatacttaaaag

SEQ ID NO: 127182 - DNA, 20 bp, Artificial Sequence
  Description of Artificial Sequence: Synthetic oligonucleotide
  Target: ATXN1; (+) strand; PAM type: NRG; PAM sequence: CAG
acttaaaagcagtaatgtaa

SEQ ID NO: 127183 - DNA, 20 bp, Artificial Sequence
  Description of Artificial Sequence: Synthetic oligonucleotide
  Target: ATXN1; (+) strand; PAM type: NRG; PAM sequence: AGG
cttaaaagcagtaatgtaac

SEQ ID NO: 127184 - DNA, 20 bp, Artificial Sequence
  Description of Artificial Sequence: Synthetic oligonucleotide
  Target: ATXN1; (+) strand; PAM type: NRG; PAM sequence: GGG
ttaaaagcagtaatgtaaca

SEQ ID NO: 127185 - DNA, 20 bp, Artificial Sequence
  Description of Artificial Sequence: Synthetic oligonucleotide
  Target: ATXN1; (+) strand; PAM type: NRG; PAM sequence: GGG
taaaagcagtaatgtaacag

SEQ ID NO: 127186 - DNA, 20 bp, Artificial Sequence
  Description of Artificial Sequence: Synthetic oligonucleotide
  Target: ATXN1; (+) strand; PAM type: NRG; PAM sequence: CAG
taacaggggtctatcttatt

SEQ ID NO: 127187 - DNA, 20 bp, Artificial Sequence
  Description of Artificial Sequence: Synthetic oligonucleotide
  Target: ATXN1; (+) strand; PAM type: NRG; PAM sequence: CAG
tattcagtaaatacttaaaa

SEQ ID NO: 127188 - DNA, 20 bp, Artificial Sequence
  Description of Artificial Sequence: Synthetic oligonucleotide
  Target: ATXN1; (+) strand; PAM type: NRG; PAM sequence: AAG
aacagtaatatctactacat

SEQ ID NO: 127189 - DNA, 20 bp, Artificial Sequence
  Description of Artificial Sequence: Synthetic oligonucleotide
  Target: ATXN1; (+) strand; PAM type: NRG; PAM sequence: AAG
cataagctttattgttttca

SEQ ID NO: 127190 - DNA, 20 bp, Artificial Sequence
  Description of Artificial Sequence: Synthetic oligonucleotide
  Target: ATXN1; (+) strand; PAM type: NRG; PAM sequence: TAG
tttattgttttcaaagtgaa

SEQ ID NO: 127191 - DNA, 20 bp, Artificial Sequence
  Description of Artificial Sequence: Synthetic oligonucleotide
  Target: ATXN1; (+) strand; PAM type: NRG; PAM sequence: CAG
ttttcaaagtgaatagcttg

SEQ ID NO: 127192 - DNA, 20 bp, Artificial Sequence
  Description of Artificial Sequence: Synthetic oligonucleotide
  Target: ATXN1; (+) strand; PAM type: NRG; PAM sequence: CGG
acatcactacattatatata

SEQ ID NO: 127193 - DNA, 20 bp, Artificial Sequence
  Description of Artificial Sequence: Synthetic oligonucleotide
  Target: ATXN1; (+) strand; PAM type: NRG; PAM sequence: TAG
tatatatacggttctaaaaa

SEQ ID NO: 127194 - DNA, 20 bp, Artificial Sequence
  Description of Artificial Sequence: Synthetic oligonucleotide
  Target: ATXN1; (+) strand; PAM type: NRG; PAM sequence: TAG
aatagtatttcttaaacacc

SEQ ID NO: 127195 - DNA, 20 bp, Artificial Sequence
  Description of Artificial Sequence: Synthetic oligonucleotide
  Target: ATXN1; (+) strand; PAM type: NRG; PAM sequence: CAG
tatttcttaaacacctagaa

SEQ ID NO: 127196 - DNA, 20 bp, Artificial Sequence
  Description of Artificial Sequence: Synthetic oligonucleotide
  Target: ATXN1; (+) strand; PAM type: NRG; PAM sequence: AAG
ttaaacacctagaacagcca

SEQ ID NO: 127197 - DNA, 20 bp, Artificial Sequence
  Description of Artificial Sequence: Synthetic oligonucleotide
  Target: ATXN1; (+) strand; PAM type: NRG; PAM sequence: AGG
taaacacctagaacagccaa

SEQ ID NO: 127198 - DNA, 20 bp, Artificial Sequence
  Description of Artificial Sequence: Synthetic oligonucleotide
  Target: ATXN1; (+) strand; PAM type: NRG; PAM sequence: TGG
cacctagaacagccaaaggt

SEQ ID NO: 127199 - DNA, 20 bp, Artificial Sequence
  Description of Artificial Sequence: Synthetic oligonucleotide
  Target: ATXN1; (+) strand; PAM type: NRG; PAM sequence: AAG
gttggcaaactttttctata

SEQ ID NO: 127200 - DNA, 20 bp, Artificial Sequence
  Description of Artificial Sequence: Synthetic oligonucleotide
  Target: ATXN1; (+) strand; PAM type: NRG; PAM sequence: AGG
ttggcaaactttttctataa

SEQ ID NO: 127201 - DNA, 20 bp, Artificial Sequence
  Description of Artificial Sequence: Synthetic oligonucleotide
  Target: ATXN1; (+) strand; PAM type: NRG; PAM sequence: CAG
aaactttttctataaaggac

SEQ ID NO: 127202 - DNA, 20 bp, Artificial Sequence
  Description of Artificial Sequence: Synthetic oligonucleotide
  Target: ATXN1; (+) strand; PAM type: NRG; PAM sequence: AGG
aactttttctataaaggacc

SEQ ID NO: 127203 - DNA, 20 bp, Artificial Sequence
  Description of Artificial Sequence: Synthetic oligonucleotide
  Target: ATXN1; (+) strand; PAM type: NRG; PAM sequence: GGG
actttttctataaaggacca

SEQ ID NO: 127204 - DNA, 20 bp, Artificial Sequence
  Description of Artificial Sequence: Synthetic oligonucleotide
  Target: ATXN1; (+) strand; PAM type: NRG; PAM sequence: GAG
tttttctataaaggaccagg

SEQ ID NO: 127205 - DNA, 20 bp, Artificial Sequence
  Description of Artificial Sequence: Synthetic oligonucleotide
  Target: ATXN1; (+) strand; PAM type: NRG; PAM sequence: TAG
ggaccagggagcaaatgctt

SEQ ID NO: 127206 - DNA, 20 bp, Artificial Sequence
  Description of Artificial Sequence: Synthetic oligonucleotide
  Target: ATXN1; (+) strand; PAM type: NRG; PAM sequence: AGG
gaccagggagcaaatgcttt

SEQ ID NO: 127207 - DNA, 20 bp, Artificial Sequence
  Description of Artificial Sequence: Synthetic oligonucleotide
  Target: ATXN1; (+) strand; PAM type: NRG; PAM sequence: TGG
agcaaatgctttaggctgtg

SEQ ID NO: 127208 - DNA, 20 bp, Artificial Sequence
  Description of Artificial Sequence: Synthetic oligonucleotide
  Target: ATXN1; (+) strand; PAM type: NRG; PAM sequence: GGG
gcaaatgctttaggctgtgt

SEQ ID NO: 127209 - DNA, 20 bp, Artificial Sequence
  Description of Artificial Sequence: Synthetic oligonucleotide
  Target: ATXN1; (+) strand; PAM type: NRG; PAM sequence: CAG
atgctttaggctgtgtgggc

SEQ ID NO: 127210 - DNA, 20 bp, Artificial Sequence
  Description of Artificial Sequence: Synthetic oligonucleotide
  Target: ATXN1; (+) strand; PAM type: NRG; PAM sequence: AAG
aatctgtcattgtcgtgcaa

SEQ ID NO: 127211 - DNA, 20 bp, Artificial Sequence
  Description of Artificial Sequence: Synthetic oligonucleotide
  Target: ATXN1; (+) strand; PAM type: NRG; PAM sequence: CAG
ctgtcattgtcgtgcaaaag

SEQ ID NO: 127212 - DNA, 20 bp, Artificial Sequence
  Description of Artificial Sequence: Synthetic oligonucleotide
  Target: ATXN1; (+) strand; PAM type: NRG; PAM sequence: AAG
tcgtgcaaaagcagcaattg

SEQ ID NO: 127213 - DNA, 20 bp, Artificial Sequence
  Description of Artificial Sequence: Synthetic oligonucleotide
  Target: ATXN1; (+) strand; PAM type: NRG; PAM sequence: CAG
attgaagatactcatacaaa

SEQ ID NO: 127214 - DNA, 20 bp, Artificial Sequence
  Description of Artificial Sequence: Synthetic oligonucleotide
  Target: ATXN1; (+) strand; PAM type: NRG; PAM sequence: AGG
ttgaagatactcatacaaac

SEQ ID NO: 127215 - DNA, 20 bp, Artificial Sequence
  Description of Artificial Sequence: Synthetic oligonucleotide
  Target: ATXN1; (+) strand; PAM type: NRG; PAM sequence: CGG
actcatacaaacaggcatgt

SEQ ID NO: 127216 - DNA, 20 bp, Artificial Sequence
  Description of Artificial Sequence: Synthetic oligonucleotide
  Target: ATXN1; (+) strand; PAM type: NRG; PAM sequence: CAG
ttccaataaaacttaattta

SEQ ID NO: 127217 - DNA, 20 bp, Artificial Sequence
  Description of Artificial Sequence: Synthetic oligonucleotide
  Target: ATXN1; (+) strand; PAM type: NRG; PAM sequence: CAG
taaaacttaatttacagaaa

SEQ ID NO: 127218 - DNA, 20 bp, Artificial Sequence
  Description of Artificial Sequence: Synthetic oligonucleotide
  Target: ATXN1; (+) strand; PAM type: NRG; PAM sequence: AGG
aaaacttaatttacagaaac

SEQ ID NO: 127219 - DNA, 20 bp, Artificial Sequence
  Description of Artificial Sequence: Synthetic oligonucleotide
  Target: ATXN1; (+) strand; PAM type: NRG; PAM sequence: TGG
cttaatttacagaaacaggc

SEQ ID NO: 127220 - DNA, 20 bp, Artificial Sequence
  Description of Artificial Sequence: Synthetic oligonucleotide
  Target: ATXN1; (+) strand; PAM type: NRG; PAM sequence: GGG
ttaatttacagaaacaggct

SEQ ID NO: 127221 - DNA, 20 bp, Artificial Sequence
  Description of Artificial Sequence: Synthetic oligonucleotide
  Target: ATXN1; (+) strand; PAM type: NRG; PAM sequence: GGG
taatttacagaaacaggctg

SEQ ID NO: 127222 - DNA, 20 bp, Artificial Sequence
  Description of Artificial Sequence: Synthetic oligonucleotide
  Target: ATXN1; (+) strand; PAM type: NRG; PAM sequence: TGG
aaacaggctggggtgatatt

SEQ ID NO: 127223 - DNA, 20 bp, Artificial Sequence
  Description of Artificial Sequence: Synthetic oligonucleotide
  Target: ATXN1; (+) strand; PAM type: NRG; PAM sequence: TGG
ctggggtgatatttggccca

SEQ ID NO: 127224 - DNA, 20 bp, Artificial Sequence
  Description of Artificial Sequence: Synthetic oligonucleotide
  Target: ATXN1; (+) strand; PAM type: NRG; PAM sequence: CAG
gtgatatttggcccatggtc

SEQ ID NO: 127225 - DNA, 20 bp, Artificial Sequence
  Description of Artificial Sequence: Synthetic oligonucleotide
  Target: ATXN1; (+) strand; PAM type: NRG; PAM sequence: TGG
tggtccagtttgtcaatacc

SEQ ID NO: 127226 - DNA, 20 bp, Artificial Sequence
  Description of Artificial Sequence: Synthetic oligonucleotide
  Target: ATXN1; (+) strand; PAM type: NRG; PAM sequence: TAG
cagtttgtcaatacctggtc

SEQ ID NO: 127227 - DNA, 20 bp, Artificial Sequence
  Description of Artificial Sequence: Synthetic oligonucleotide
  Target: ATXN1; (+) strand; PAM type: NRG; PAM sequence: AAG
ttattacactgaaaaattat

SEQ ID NO: 127228 - DNA, 20 bp, Artificial Sequence
  Description of Artificial Sequence: Synthetic oligonucleotide
  Target: ATXN1; (+) strand; PAM type: NRG; PAM sequence: TGG
tacactgaaaaattataaga

SEQ ID NO: 127229 - DNA, 20 bp, Artificial Sequence
  Description of Artificial Sequence: Synthetic oligonucleotide
  Target: ATXN1; (+) strand; PAM type: NRG; PAM sequence: AAG
aacttccttcctttcctcta

SEQ ID NO: 127230 - DNA, 20 bp, Artificial Sequence
  Description of Artificial Sequence: Synthetic oligonucleotide
  Target: ATXN1; (+) strand; PAM type: NRG; PAM sequence: GAG
cttccttcctttcctctaaa

SEQ ID NO: 127231 - DNA, 20 bp, Artificial Sequence
  Description of Artificial Sequence: Synthetic oligonucleotide
  Target: ATXN1; (+) strand; PAM type: NRG; PAM sequence: TAG
tctaaagagattatttttct

SEQ ID NO: 127232 - DNA, 20 bp, Artificial Sequence
  Description of Artificial Sequence: Synthetic oligonucleotide
  Target: ATXN1; (+) strand; PAM type: NRG; PAM sequence: AAG
agattatttttcttagtgaa

SEQ ID NO: 127233 - DNA, 20 bp, Artificial Sequence
  Description of Artificial Sequence: Synthetic oligonucleotide
  Target: ATXN1; (+) strand; PAM type: NRG; PAM sequence: TAG
tatttttcttagtgaaaagt

SEQ ID NO: 127234 - DNA, 20 bp, Artificial Sequence
  Description of Artificial Sequence: Synthetic oligonucleotide
  Target: ATXN1; (+) strand; PAM type: NRG; PAM sequence: CAG
agttagatgacaatgtcaca

SEQ ID NO: 127235 - DNA, 20 bp, Artificial Sequence
  Description of Artificial Sequence: Synthetic oligonucleotide
  Target: ATXN1; (+) strand; PAM type: NRG; PAM sequence: TAG
tagatgacaatgtcacacag

SEQ ID NO: 127236 - DNA, 20 bp, Artificial Sequence
  Description of Artificial Sequence: Synthetic oligonucleotide
  Target: ATXN1; (+) strand; PAM type: NRG; PAM sequence: AAG
caatgtcacacagtagccaa

SEQ ID NO: 127237 - DNA, 20 bp, Artificial Sequence
  Description of Artificial Sequence: Synthetic oligonucleotide
  Target: ATXN1; (+) strand; PAM type: NRG; PAM sequence: CAG
tgtcacacagtagccaaaag

SEQ ID NO: 127238 - DNA, 20 bp, Artificial Sequence
  Description of Artificial Sequence: Synthetic oligonucleotide
  Target: ATXN1; (+) strand; PAM type: NRG; PAM sequence: CGG
acacagtagccaaaagcagt

SEQ ID NO: 127239 - DNA, 20 bp, Artificial Sequence
  Description of Artificial Sequence: Synthetic oligonucleotide
  Target: ATXN1; (+) strand; PAM type: NRG; PAM sequence: TGG
cagtagccaaaagcagtcgg

SEQ ID NO: 127240 - DNA, 20 bp, Artificial Sequence
  Description of Artificial Sequence: Synthetic oligonucleotide
  Target: ATXN1; (+) strand; PAM type: NRG; PAM sequence: CAG
gcagtcggtggtatattctg

SEQ ID NO: 127241 - DNA, 20 bp, Artificial Sequence
  Description of Artificial Sequence: Synthetic oligonucleotide
  Target: ATXN1; (+) strand; PAM type: NRG; PAM sequence: AAG
cactgaacctcgtccatgat

SEQ ID NO: 127242 - DNA, 20 bp, Artificial Sequence
  Description of Artificial Sequence: Synthetic oligonucleotide
  Target: ATXN1; (+) strand; PAM type: NRG; PAM sequence: CAG
tgaacctcgtccatgataag

SEQ ID NO: 127243 - DNA, 20 bp, Artificial Sequence
  Description of Artificial Sequence: Synthetic oligonucleotide
  Target: ATXN1; (+) strand; PAM type: NRG; PAM sequence: TGG
tcgtccatgataagcagata

SEQ ID NO: 127244 - DNA, 20 bp, Artificial Sequence
  Description of Artificial Sequence: Synthetic oligonucleotide
  Target: ATXN1; (+) strand; PAM type: NRG; PAM sequence: GGG
cgtccatgataagcagatat

SEQ ID NO: 127245 - DNA, 20 bp, Artificial Sequence
  Description of Artificial Sequence: Synthetic oligonucleotide
  Target: ATXN1; (+) strand; PAM type: NRG; PAM sequence: GAG
aagcagatatgggcaaatct

SEQ ID NO: 127246 - DNA, 20 bp, Artificial Sequence
  Description of Artificial Sequence: Synthetic oligonucleotide
  Target: ATXN1; (+) strand; PAM type: NRG; PAM sequence: CAG
atgggcaaatctgagaattc

SEQ ID NO: 127247 - DNA, 20 bp, Artificial Sequence
  Description of Artificial Sequence: Synthetic oligonucleotide
  Target: ATXN1; (+) strand; PAM type: NRG; PAM sequence: AGG
tgggcaaatctgagaattcc

SEQ ID NO: 127248 - DNA, 20 bp, Artificial Sequence
  Description of Artificial Sequence: Synthetic oligonucleotide
  Target: ATXN1; (+) strand; PAM type: NRG; PAM sequence: CAG
aaatctgagaattccaggtg

SEQ ID NO: 127249 - DNA, 20 bp, Artificial Sequence
  Description of Artificial Sequence: Synthetic oligonucleotide
  Target: ATXN1; (+) strand; PAM type: NRG; PAM sequence: CAG
gaattccaggtgcagttttc

SEQ ID NO: 127250 - DNA, 20 bp, Artificial Sequence
  Description of Artificial Sequence: Synthetic oligonucleotide
  Target: ATXN1; (+) strand; PAM type: NRG; PAM sequence: TGG
ttccaggtgcagttttccag

SEQ ID NO: 127251 - DNA, 20 bp, Artificial Sequence
  Description of Artificial Sequence: Synthetic oligonucleotide
  Target: ATXN1; (+) strand; PAM type: NRG; PAM sequence: AAG
aggtgcagttttccagtggt

SEQ ID NO: 127252 - DNA, 20 bp, Artificial Sequence
  Description of Artificial Sequence: Synthetic oligonucleotide
  Target: ATXN1; (+) strand; PAM type: NRG; PAM sequence: AAG
ctctgcattacatatgtgca

SEQ ID NO: 127253 - DNA, 20 bp, Artificial Sequence
  Description of Artificial Sequence: Synthetic oligonucleotide
  Target: ATXN1; (+) strand; PAM type: NRG; PAM sequence: AGG
tctgcattacatatgtgcaa

SEQ ID NO: 127254 - DNA, 20 bp, Artificial Sequence
  Description of Artificial Sequence: Synthetic oligonucleotide
  Target: ATXN1; (+) strand; PAM type: NRG; PAM sequence: GGG
ctgcattacatatgtgcaaa

SEQ ID NO: 127255 - DNA, 20 bp, Artificial Sequence
  Description of Artificial Sequence: Synthetic oligonucleotide
  Target: ATXN1; (+) strand; PAM type: NRG; PAM sequence: CAG
ttacatatgtgcaaagggaa

SEQ ID NO: 127256 - DNA, 20 bp, Artificial Sequence
  Description of Artificial Sequence: Synthetic oligonucleotide
  Target: ATXN1; (+) strand; PAM type: NRG; PAM sequence: AGG
tacatatgtgcaaagggaac

SEQ ID NO: 127257 - DNA, 20 bp, Artificial Sequence
  Description of Artificial Sequence: Synthetic oligonucleotide
  Target: ATXN1; (+) strand; PAM type: NRG; PAM sequence: TGG
aaagggaacaggctgcccca

SEQ ID NO: 127258 - DNA, 20 bp, Artificial Sequence
  Description of Artificial Sequence: Synthetic oligonucleotide
  Target: ATXN1; (+) strand; PAM type: NRG; PAM sequence: CAG
caggctgccccatggaaccc

SEQ ID NO: 127259 - DNA, 20 bp, Artificial Sequence
  Description of Artificial Sequence: Synthetic oligonucleotide
  Target: ATXN1; (+) strand; PAM type: NRG; PAM sequence: TAG
aaccccagataaatgctaaa

SEQ ID NO: 127260 - DNA, 20 bp, Artificial Sequence
  Description of Artificial Sequence: Synthetic oligonucleotide
  Target: ATXN1; (+) strand; PAM type: NRG; PAM sequence: AAG
aaatgctaaatagcctcttg

SEQ ID NO: 127261 - DNA, 20 bp, Artificial Sequence
  Description of Artificial Sequence: Synthetic oligonucleotide
  Target: ATXN1; (+) strand; PAM type: NRG; PAM sequence: TAG
tgctaaatagcctcttgaag

SEQ ID NO: 127262 - DNA, 20 bp, Artificial Sequence
  Description of Artificial Sequence: Synthetic oligonucleotide
  Target: ATXN1; (+) strand; PAM type: NRG; PAM sequence: TAG
tcttgaagtagtgtactatc

SEQ ID NO: 127263 - DNA, 20 bp, Artificial Sequence
  Description of Artificial Sequence: Synthetic oligonucleotide
  Target: ATXN1; (+) strand; PAM type: NRG; PAM sequence: AGG
cttgaagtagtgtactatct

SEQ ID NO: 127264 - DNA, 20 bp, Artificial Sequence
  Description of Artificial Sequence: Synthetic oligonucleotide
  Target: ATXN1; (+) strand; PAM type: NRG; PAM sequence: AAG
agtgtactatctaggcatgc

SEQ ID NO: 127265 - DNA, 20 bp, Artificial Sequence
  Description of Artificial Sequence: Synthetic oligonucleotide
  Target: ATXN1; (+) strand; PAM type: NRG; PAM sequence: AAG
gtactatctaggcatgcaag

SEQ ID NO: 127266 - DNA, 20 bp, Artificial Sequence
  Description of Artificial Sequence: Synthetic oligonucleotide
  Target: ATXN1; (+) strand; PAM type: NRG; PAM sequence: GAG
aggcatgcaagaagactctt

SEQ ID NO: 127267 - DNA, 20 bp, Artificial Sequence
  Description of Artificial Sequence: Synthetic oligonucleotide
  Target: ATXN1; (+) strand; PAM type: NRG; PAM sequence: TGG
caaataccttgattaaaaaa

SEQ ID NO: 127268 - DNA, 20 bp, Artificial Sequence
  Description of Artificial Sequence: Synthetic oligonucleotide
  Target: ATXN1; (+) strand; PAM type: NRG; PAM sequence: GGG
aaataccttgattaaaaaat

SEQ ID NO: 127269 - DNA, 20 bp, Artificial Sequence
  Description of Artificial Sequence: Synthetic oligonucleotide
  Target: ATXN1; (+) strand; PAM type: NRG; PAM sequence: AAG
ccttgattaaaaaatgggca

SEQ ID NO: 127270 - DNA, 20 bp, Artificial Sequence
  Description of Artificial Sequence: Synthetic oligonucleotide
  Target: ATXN1; (+) strand; PAM type: NRG; PAM sequence: AGG
cttgattaaaaaatgggcaa

SEQ ID NO: 127271 - DNA, 20 bp, Artificial Sequence
  Description of Artificial Sequence: Synthetic oligonucleotide
  Target: ATXN1; (+) strand; PAM type: NRG; PAM sequence: AAG
cttgaattgacatttcttca

SEQ ID NO: 127272 - DNA, 20 bp, Artificial Sequence
  Description of Artificial Sequence: Synthetic oligonucleotide
  Target: ATXN1; (+) strand; PAM type: NRG; PAM sequence: AAG
aaaatatgcaaatgaccatt

SEQ ID NO: 127273 - DNA, 20 bp, Artificial Sequence
  Description of Artificial Sequence: Synthetic oligonucleotide
  Target: ATXN1; (+) strand; PAM type: NRG; PAM sequence: AAG
atgaccattaagcacacgaa

SEQ ID NO: 127274 - DNA, 20 bp, Artificial Sequence
  Description of Artificial Sequence: Synthetic oligonucleotide
  Target: ATXN1; (+) strand; PAM type: NRG; PAM sequence: TAG
cactcaacatcactaatcat

SEQ ID NO: 127275 - DNA, 20 bp, Artificial Sequence
  Description of Artificial Sequence: Synthetic oligonucleotide
  Target: ATXN1; (+) strand; PAM type: NRG; PAM sequence: AGG
actcaacatcactaatcatt

SEQ ID NO: 127276 - DNA, 20 bp, Artificial Sequence
  Description of Artificial Sequence: Synthetic oligonucleotide
  Target: ATXN1; (+) strand; PAM type: NRG; PAM sequence: AAG
cataccatttcactcacatt

SEQ ID NO: 127277 - DNA, 20 bp, Artificial Sequence
  Description of Artificial Sequence: Synthetic oligonucleotide
  Target: ATXN1; (+) strand; PAM type: NRG; PAM sequence: TGG
ccatttcactcacattaaga

SEQ ID NO: 127278 - DNA, 20 bp, Artificial Sequence
  Description of Artificial Sequence: Synthetic oligonucleotide
  Target: ATXN1; (+) strand; PAM type: NRG; PAM sequence: AAG
aaaaaaacaacccccaaaac

SEQ ID NO: 127279 - DNA, 20 bp, Artificial Sequence
  Description of Artificial Sequence: Synthetic oligonucleotide
  Target: ATXN1; (+) strand; PAM type: NRG; PAM sequence: TGG
aacaagaaaataacaaatgt

SEQ ID NO: 127280 - DNA, 20 bp, Artificial Sequence
  Description of Artificial Sequence: Synthetic oligonucleotide
  Target: ATXN1; (+) strand; PAM type: NRG; PAM sequence: AAG
agaaaataacaaatgttggc

SEQ ID NO: 127281 - DNA, 20 bp, Artificial Sequence
  Description of Artificial Sequence: Synthetic oligonucleotide
  Target: ATXN1; (+) strand; PAM type: NRG; PAM sequence: AGG
gaaaataacaaatgttggca

SEQ ID NO: 127282 - DNA, 20 bp, Artificial Sequence
  Description of Artificial Sequence: Synthetic oligonucleotide
  Target: ATXN1; (+) strand; PAM type: NRG; PAM sequence: TGG
aacaaatgttggcaaggatg

SEQ ID NO: 127283 - DNA, 20 bp, Artificial Sequence
  Description of Artificial Sequence: Synthetic oligonucleotide
  Target: ATXN1; (+) strand; PAM type: NRG; PAM sequence: TGG
tggcaaggatgtggacaaat

SEQ ID NO: 127284 - DNA, 20 bp, Artificial Sequence
  Description of Artificial Sequence: Synthetic oligonucleotide
  Target: ATXN1; (+) strand; PAM type: NRG; PAM sequence: TAG
aactctgtgtacattactga

SEQ ID NO: 127285 - DNA, 20 bp, Artificial Sequence
  Description of Artificial Sequence: Synthetic oligonucleotide
  Target: ATXN1; (+) strand; PAM type: NRG; PAM sequence: TGG
ttactgatagaaatgcaaaa

SEQ ID NO: 127286 - DNA, 20 bp, Artificial Sequence
  Description of Artificial Sequence: Synthetic oligonucleotide
  Target: ATXN1; (+) strand; PAM type: NRG; PAM sequence: CAG
gatagaaatgcaaaatggta

SEQ ID NO: 127287 - DNA, 20 bp, Artificial Sequence
  Description of Artificial Sequence: Synthetic oligonucleotide
  Target: ATXN1; (+) strand; PAM type: NRG; PAM sequence: TGG
tgctgtgaaaaataccatga

SEQ ID NO: 127288 - DNA, 20 bp, Artificial Sequence
  Description of Artificial Sequence: Synthetic oligonucleotide
  Target: ATXN1; (+) strand; PAM type: NRG; PAM sequence: TAG
tgattcaccaattccacttc

SEQ ID NO: 127289 - DNA, 20 bp, Artificial Sequence
  Description of Artificial Sequence: Synthetic oligonucleotide
  Target: ATXN1; (+) strand; PAM type: NRG; PAM sequence: AGG
gattcaccaattccacttct

SEQ ID NO: 127290 - DNA, 20 bp, Artificial Sequence
  Description of Artificial Sequence: Synthetic oligonucleotide
  Target: ATXN1; (+) strand; PAM type: NRG; PAM sequence: AAG
tatatacccaaaaaaactga

SEQ ID NO: 127291 - DNA, 20 bp, Artificial Sequence
  Description of Artificial Sequence: Synthetic oligonucleotide
  Target: ATXN1; (+) strand; PAM type: NRG; PAM sequence: AGG
atatacccaaaaaaactgaa

SEQ ID NO: 127292 - DNA, 20 bp, Artificial Sequence
  Description of Artificial Sequence: Synthetic oligonucleotide
  Target: ATXN1; (+) strand; PAM type: NRG; PAM sequence: GAG
atacccaaaaaaactgaaag

SEQ ID NO: 127293 - DNA, 20 bp, Artificial Sequence
  Description of Artificial Sequence: Synthetic oligonucleotide
  Target: ATXN1; (+) strand; PAM type: NRG; PAM sequence: AGG
tacccaaaaaaactgaaagg

SEQ ID NO: 127294 - DNA, 20 bp, Artificial Sequence
  Description of Artificial Sequence: Synthetic oligonucleotide
  Target: ATXN1; (+) strand; PAM type: NRG; PAM sequence: CAG
actgaaaggaggcacttgaa

SEQ ID NO: 127295 - DNA, 20 bp, Artificial Sequence
  Description of Artificial Sequence: Synthetic oligonucleotide
  Target: ATXN1; (+) strand; PAM type: NRG; PAM sequence: CAG
ttgaacagatatttgtatac

SEQ ID NO: 127296 - DNA, 20 bp, Artificial Sequence
  Description of Artificial Sequence: Synthetic oligonucleotide
  Target: ATXN1; (+) strand; PAM type: NRG; PAM sequence: TAG
tatttgtataccagtgttca

SEQ ID NO: 127297 - DNA, 20 bp, Artificial Sequence
  Description of Artificial Sequence: Synthetic oligonucleotide
  Target: ATXN1; (+) strand; PAM type: NRG; PAM sequence: AAG
acataattcacaataaccta

SEQ ID NO: 127298 - DNA, 20 bp, Artificial Sequence
  Description of Artificial Sequence: Synthetic oligonucleotide
  Target: ATXN1; (+) strand; PAM type: NRG; PAM sequence: TGG
taattcacaataacctaaag

SEQ ID NO: 127299 - DNA, 20 bp, Artificial Sequence
  Description of Artificial Sequence: Synthetic oligonucleotide
  Target: ATXN1; (+) strand; PAM type: NRG; PAM sequence: AAG
ttcacaataacctaaagtgg

SEQ ID NO: 127300 - DNA, 20 bp, Artificial Sequence
  Description of Artificial Sequence: Synthetic oligonucleotide
  Target: ATXN1; (+) strand; PAM type: NRG; PAM sequence: AAG
acctaaagtggaagcaacct

SEQ ID NO: 127301 - DNA, 20 bp, Artificial Sequence
  Description of Artificial Sequence: Synthetic oligonucleotide
  Target: ATXN1; (+) strand; PAM type: NRG; PAM sequence: TGG
gcaacctaagtgtccatcaa

SEQ ID NO: 127302 - DNA, 20 bp, Artificial Sequence
  Description of Artificial Sequence: Synthetic oligonucleotide
  Target: ATXN1; (+) strand; PAM type: NRG; PAM sequence: TAG
agtgtccatcaatggatgaa

SEQ ID NO: 127303 - DNA, 20 bp, Artificial Sequence
  Description of Artificial Sequence: Synthetic oligonucleotide
  Target: ATXN1; (+) strand; PAM type: NRG; PAM sequence: CAG
tacatatgtgcaatattatt

SEQ ID NO: 127304 - DNA, 20 bp, Artificial Sequence
  Description of Artificial Sequence: Synthetic oligonucleotide
  Target: ATXN1; (+) strand; PAM type: NRG; PAM sequence: AAG
tgcaatattattcagcccta

SEQ ID NO: 127305 - DNA, 20 bp, Artificial Sequence
  Description of Artificial Sequence: Synthetic oligonucleotide
  Target: ATXN1; (+) strand; PAM type: NRG; PAM sequence: GAG
caatattattcagccctaaa

SEQ ID NO: 127306 - DNA, 20 bp, Artificial Sequence
  Description of Artificial Sequence: Synthetic oligonucleotide
  Target: ATXN1; (+) strand; PAM type: NRG; PAM sequence: AGG
aatattattcagccctaaag

SEQ ID NO: 127307 - DNA, 20 bp, Artificial Sequence
  Description of Artificial Sequence: Synthetic oligonucleotide
  Target: ATXN1; (+) strand; PAM type: NRG; PAM sequence: AAG
attattcagccctaaagagg

SEQ ID NO: 127308 - DNA, 20 bp, Artificial Sequence
  Description of Artificial Sequence: Synthetic oligonucleotide
  Target: ATXN1; (+) strand; PAM type: NRG; PAM sequence: AGG
ttattcagccctaaagagga

SEQ ID NO: 127309 - DNA, 20 bp, Artificial Sequence
  Description of Artificial Sequence: Synthetic oligonucleotide
  Target: ATXN1; (+) strand; PAM type: NRG; PAM sequence: GAG
attcagccctaaagaggaag

SEQ ID NO: 127310 - DNA, 20 bp, Artificial Sequence
  Description of Artificial Sequence: Synthetic oligonucleotide
  Target: ATXN1; (+) strand; PAM type: NRG; PAM sequence: TGG
ttctgacacatgctacaaca

SEQ ID NO: 127311 - DNA, 20 bp, Artificial Sequence
  Description of Artificial Sequence: Synthetic oligonucleotide
  Target: ATXN1; (+) strand; PAM type: NRG; PAM sequence: CAG
catgctacaacatggatatg

SEQ ID NO: 127312 - DNA, 20 bp, Artificial Sequence
  Description of Artificial Sequence: Synthetic oligonucleotide
  Target: ATXN1; (+) strand; PAM type: NRG; PAM sequence: TGG
atggatatgcagttttgctt

SEQ ID NO: 127313 - DNA, 20 bp, Artificial Sequence
  Description of Artificial Sequence: Synthetic oligonucleotide
  Target: ATXN1; (+) strand; PAM type: NRG; PAM sequence: GGG
tggatatgcagttttgcttt

SEQ ID NO: 127314 - DNA, 20 bp, Artificial Sequence
  Description of Artificial Sequence: Synthetic oligonucleotide
  Target: ATXN1; (+) strand; PAM type: NRG; PAM sequence: AAG
atatgcagttttgctttggg

SEQ ID NO: 127315 - DNA, 20 bp, Artificial Sequence
  Description of Artificial Sequence: Synthetic oligonucleotide
  Target: ATXN1; (+) strand; PAM type: NRG; PAM sequence: AAG
gggaagatgaaaacgttctg

SEQ ID NO: 127316 - DNA, 20 bp, Artificial Sequence
  Description of Artificial Sequence: Synthetic oligonucleotide
  Target: ATXN1; (+) strand; PAM type: NRG; PAM sequence: TGG
agatgaaaacgttctgaaga

SEQ ID NO: 127317 - DNA, 20 bp, Artificial Sequence
  Description of Artificial Sequence: Synthetic oligonucleotide
  Target: ATXN1; (+) strand; PAM type: NRG; PAM sequence: TGG
aacgttctgaagatggatcg

SEQ ID NO: 127318 - DNA, 20 bp, Artificial Sequence
  Description of Artificial Sequence: Synthetic oligonucleotide
  Target: ATXN1; (+) strand; PAM type: NRG; PAM sequence: TGG
ctgaactgtacacttaaaaa

SEQ ID NO: 127319 - DNA, 20 bp, Artificial Sequence
  Description of Artificial Sequence: Synthetic oligonucleotide
  Target: ATXN1; (+) strand; PAM type: NRG; PAM sequence: GGG
tgaactgtacacttaaaaat

SEQ ID NO: 127320 - DNA, 20 bp, Artificial Sequence
  Description of Artificial Sequence: Synthetic oligonucleotide
  Target: ATXN1; (+) strand; PAM type: NRG; PAM sequence: AAG
atgaattttatcacaataaa

SEQ ID NO: 127321 - DNA, 20 bp, Artificial Sequence
  Description of Artificial Sequence: Synthetic oligonucleotide
  Target: ATXN1; (+) strand; PAM type: NRG; PAM sequence: AAG
aattttatcacaataaaaag

SEQ ID NO: 127322 - DNA, 20 bp, Artificial Sequence
  Description of Artificial Sequence: Synthetic oligonucleotide
  Target: ATXN1; (+) strand; PAM type: NRG; PAM sequence: AAG
tttatcacaataaaaagaag

SEQ ID NO: 127323 - DNA, 20 bp, Artificial Sequence
  Description of Artificial Sequence: Synthetic oligonucleotide
  Target: ATXN1; (+) strand; PAM type: NRG; PAM sequence: AAG
atcacaataaaaagaagaag

SEQ ID NO: 127324 - DNA, 20 bp, Artificial Sequence
  Description of Artificial Sequence: Synthetic oligonucleotide
  Target: ATXN1; (+) strand; PAM type: NRG; PAM sequence: AAG
acaataaaaagaagaagaag

SEQ ID NO: 127325 - DNA, 20 bp, Artificial Sequence
  Description of Artificial Sequence: Synthetic oligonucleotide
  Target: ATXN1; (+) strand; PAM type: NRG; PAM sequence: AAG
ataaaaagaagaagaagaag

SEQ ID NO: 127326 - DNA, 20 bp, Artificial Sequence
  Description of Artificial Sequence: Synthetic oligonucleotide
  Target: ATXN1; (+) strand; PAM type: NRG; PAM sequence: AAG
ctgtgatcacttgaccttat

SEQ ID NO: 127327 - DNA, 20 bp, Artificial Sequence
  Description of Artificial Sequence: Synthetic oligonucleotide
  Target: ATXN1; (+) strand; PAM type: NRG; PAM sequence: AGG
tgtgatcacttgaccttata

SEQ ID NO: 127328 - DNA, 20 bp, Artificial Sequence
  Description of Artificial Sequence: Synthetic oligonucleotide
  Target: ATXN1; (+) strand; PAM type: NRG; PAM sequence: GGG
gtgatcacttgaccttataa

SEQ ID NO: 127329 - DNA, 20 bp, Artificial Sequence
  Description of Artificial Sequence: Synthetic oligonucleotide
  Target: ATXN1; (+) strand; PAM type: NRG; PAM sequence: GAG
gatcacttgaccttataagg

SEQ ID NO: 127330 - DNA, 20 bp, Artificial Sequence
  Description of Artificial Sequence: Synthetic oligonucleotide
  Target: ATXN1; (+) strand; PAM type: NRG; PAM sequence: CAG
gaccttataagggagctttt

SEQ ID NO: 127331 - DNA, 20 bp, Artificial Sequence
  Description of Artificial Sequence: Synthetic oligonucleotide
  Target: ATXN1; (+) strand; PAM type: NRG; PAM sequence: AGG
accttataagggagcttttc

SEQ ID NO: 127332 - DNA, 20 bp, Artificial Sequence
  Description of Artificial Sequence: Synthetic oligonucleotide
  Target: ATXN1; (+) strand; PAM type: NRG; PAM sequence: TGG
agcttttcaggtgatctgtt

SEQ ID NO: 127333 - DNA, 20 bp, Artificial Sequence
  Description of Artificial Sequence: Synthetic oligonucleotide
  Target: ATXN1; (+) strand; PAM type: NRG; PAM sequence: AAG
tcaggtgatctgtttggatc

SEQ ID NO: 127334 - DNA, 20 bp, Artificial Sequence
  Description of Artificial Sequence: Synthetic oligonucleotide
  Target: ATXN1; (+) strand; PAM type: NRG; PAM sequence: AAG
tgtttggatcaagatatccc

SEQ ID NO: 127335 - DNA, 20 bp, Artificial Sequence
  Description of Artificial Sequence: Synthetic oligonucleotide
  Target: ATXN1; (+) strand; PAM type: NRG; PAM sequence: AAG
ttggatcaagatatcccaag

SEQ ID NO: 127336 - DNA, 20 bp, Artificial Sequence
  Description of Artificial Sequence: Synthetic oligonucleotide
  Target: ATXN1; (+) strand; PAM type: NRG; PAM sequence: GAG
tatcccaagaagtttcaaat

SEQ ID NO: 127337 - DNA, 20 bp, Artificial Sequence
  Description of Artificial Sequence: Synthetic oligonucleotide
  Target: ATXN1; (+) strand; PAM type: NRG; PAM sequence: GAG
tcccaagaagtttcaaatga

SEQ ID NO: 127338 - DNA, 20 bp, Artificial Sequence
  Description of Artificial Sequence: Synthetic oligonucleotide
  Target: ATXN1; (+) strand; PAM type: NRG; PAM sequence: GAG
tcaaatgagagttgaaactt

SEQ ID NO: 127339 - DNA, 20 bp, Artificial Sequence
  Description of Artificial Sequence: Synthetic oligonucleotide
  Target: ATXN1; (+) strand; PAM type: NRG; PAM sequence: GAG
aaatgagagttgaaacttga

SEQ ID NO: 127340 - DNA, 20 bp, Artificial Sequence
  Description of Artificial Sequence: Synthetic oligonucleotide
  Target: ATXN1; (+) strand; PAM type: NRG; PAM sequence: AGG
aatgagagttgaaacttgag

SEQ ID NO: 127341 - DNA, 20 bp, Artificial Sequence
  Description of Artificial Sequence: Synthetic oligonucleotide
  Target: ATXN1; (+) strand; PAM type: NRG; PAM sequence: GGG
atgagagttgaaacttgaga

SEQ ID NO: 127342 - DNA, 20 bp, Artificial Sequence
  Description of Artificial Sequence: Synthetic oligonucleotide
  Target: ATXN1; (+) strand; PAM type: NRG; PAM sequence: TGG
gagttgaaacttgagagggt

SEQ ID NO: 127343 - DNA, 20 bp, Artificial Sequence
  Description of Artificial Sequence: Synthetic oligonucleotide
  Target: ATXN1; (+) strand; PAM type: NRG; PAM sequence: TGG
aacttgagagggttggttta

SEQ ID NO: 127344 - DNA, 20 bp, Artificial Sequence
  Description of Artificial Sequence: Synthetic oligonucleotide
  Target: ATXN1; (+) strand; PAM type: NRG; PAM sequence: GGG
acttgagagggttggtttat

SEQ ID NO: 127345 - DNA, 20 bp, Artificial Sequence
  Description of Artificial Sequence: Synthetic oligonucleotide
  Target: ATXN1; (+) strand; PAM type: NRG; PAM sequence: GAG
ttgagagggttggtttatgg

SEQ ID NO: 127346 - DNA, 20 bp, Artificial Sequence
  Description of Artificial Sequence: Synthetic oligonucleotide
  Target: ATXN1; (+) strand; PAM type: NRG; PAM sequence: AGG
tgagagggttggtttatggg

SEQ ID NO: 127347 - DNA, 20 bp, Artificial Sequence
  Description of Artificial Sequence: Synthetic oligonucleotide
  Target: ATXN1; (+) strand; PAM type: NRG; PAM sequence: CAG
gagggttggtttatgggagg

SEQ ID NO: 127348 - DNA, 20 bp, Artificial Sequence
  Description of Artificial Sequence: Synthetic oligonucleotide
  Target: ATXN1; (+) strand; PAM type: NRG; PAM sequence: GAG
gatgaactgtgacctcgttt

SEQ ID NO: 127349 - DNA, 20 bp, Artificial Sequence
  Description of Artificial Sequence: Synthetic oligonucleotide
  Target: ATXN1; (+) strand; PAM type: NRG; PAM sequence: CAG
gtgacctcgtttgagtgttc

SEQ ID NO: 127350 - DNA, 20 bp, Artificial Sequence
  Description of Artificial Sequence: Synthetic oligonucleotide
  Target: ATXN1; (+) strand; PAM type: NRG; PAM sequence: AGG
tgacctcgtttgagtgttcc

SEQ ID NO: 127351 - DNA, 20 bp, Artificial Sequence
  Description of Artificial Sequence: Synthetic oligonucleotide
  Target: ATXN1; (+) strand; PAM type: NRG; PAM sequence: CGG
gtttgagtgttccaggaaat

SEQ ID NO: 127352 - DNA, 20 bp, Artificial Sequence
  Description of Artificial Sequence: Synthetic oligonucleotide
  Target: ATXN1; (+) strand; PAM type: NRG; PAM sequence: TAG
aggaaatcggcttccacatc

SEQ ID NO: 127353 - DNA, 20 bp, Artificial Sequence
  Description of Artificial Sequence: Synthetic oligonucleotide
  Target: ATXN1; (+) strand; PAM type: NRG; PAM sequence: AGG
ggaaatcggcttccacatct

SEQ ID NO: 127354 - DNA, 20 bp, Artificial Sequence
  Description of Artificial Sequence: Synthetic oligonucleotide
  Target: ATXN1; (+) strand; PAM type: NRG; PAM sequence: TGG
ttccacatctaggaatcact

SEQ ID NO: 127355 - DNA, 20 bp, Artificial Sequence
  Description of Artificial Sequence: Synthetic oligonucleotide
  Target: ATXN1; (+) strand; PAM type: NRG; PAM sequence: AAG
aggaatcacttggactaaaa

SEQ ID NO: 127356 - DNA, 20 bp, Artificial Sequence
  Description of Artificial Sequence: Synthetic oligonucleotide
  Target: ATXN1; (+) strand; PAM type: NRG; PAM sequence: GAG
cttggactaaaaaagaatgt

SEQ ID NO: 127357 - DNA, 20 bp, Artificial Sequence
  Description of Artificial Sequence: Synthetic oligonucleotide
  Target: ATXN1; (+) strand; PAM type: NRG; PAM sequence: GAG
tggactaaaaaagaatgtga

SEQ ID NO: 127358 - DNA, 20 bp, Artificial Sequence
  Description of Artificial Sequence: Synthetic oligonucleotide
  Target: ATXN1; (+) strand; PAM type: NRG; PAM sequence: CAG
atgtgagagctcctttgatt

SEQ ID NO: 127359 - DNA, 20 bp, Artificial Sequence
  Description of Artificial Sequence: Synthetic oligonucleotide
  Target: ATXN1; (+) strand; PAM type: NRG; PAM sequence: GAG
gtgagagctcctttgattca

SEQ ID NO: 127360 - DNA, 20 bp, Artificial Sequence
  Description of Artificial Sequence: Synthetic oligonucleotide
  Target: ATXN1; (+) strand; PAM type: NRG; PAM sequence: GAG
gagctcctttgattcagagt

SEQ ID NO: 127361 - DNA, 20 bp, Artificial Sequence
  Description of Artificial Sequence: Synthetic oligonucleotide
  Target: ATXN1; (+) strand; PAM type: NRG; PAM sequence: GAG
ttcagagtgagctctcacat

SEQ ID NO: 127362 - DNA, 20 bp, Artificial Sequence
  Description of Artificial Sequence: Synthetic oligonucleotide
  Target: ATXN1; (+) strand; PAM type: NRG; PAM sequence: TGG
ctcacatgagatttgtaata

SEQ ID NO: 127363 - DNA, 20 bp, Artificial Sequence
  Description of Artificial Sequence: Synthetic oligonucleotide
  Target: ATXN1; (+) strand; PAM type: NRG; PAM sequence: CAG
catgagatttgtaatatggc

SEQ ID NO: 127364 - DNA, 20 bp, Artificial Sequence
  Description of Artificial Sequence: Synthetic oligonucleotide
  Target: ATXN1; (+) strand; PAM type: NRG; PAM sequence: GAG
tgcttgcaatatccttttct

SEQ ID NO: 127365 - DNA, 20 bp, Artificial Sequence
  Description of Artificial Sequence: Synthetic oligonucleotide
  Target: ATXN1; (+) strand; PAM type: NRG; PAM sequence: CAG
ttttctgagttttacaacct

SEQ ID NO: 127366 - DNA, 20 bp, Artificial Sequence
  Description of Artificial Sequence: Synthetic oligonucleotide
  Target: ATXN1; (+) strand; PAM type: NRG; PAM sequence: GAG
ttctgagttttacaacctca

SEQ ID NO: 127367 - DNA, 20 bp, Artificial Sequence
  Description of Artificial Sequence: Synthetic oligonucleotide
  Target: ATXN1; (+) strand; PAM type: NRG; PAM sequence: TGG
acaacctcagagacccaatt

SEQ ID NO: 127368 - DNA, 20 bp, Artificial Sequence
  Description of Artificial Sequence: Synthetic oligonucleotide
  Target: ATXN1; (+) strand; PAM type: NRG; PAM sequence: CAG
acctcagagacccaatttgg

SEQ ID NO: 127369 - DNA, 20 bp, Artificial Sequence
  Description of Artificial Sequence: Synthetic oligonucleotide
  Target: ATXN1; (+) strand; PAM type: NRG; PAM sequence: TGG
tcagagacccaatttggcag

SEQ ID NO: 127370 - DNA, 20 bp, Artificial Sequence
  Description of Artificial Sequence: Synthetic oligonucleotide
  Target: ATXN1; (+) strand; PAM type: NRG; PAM sequence: CAG
gacccaatttggcagtggat

SEQ ID NO: 127371 - DNA, 20 bp, Artificial Sequence
  Description of Artificial Sequence: Synthetic oligonucleotide
  Target: ATXN1; (+) strand; PAM type: NRG; PAM sequence: AGG
acccaatttggcagtggatc

SEQ ID NO: 127372 - DNA, 20 bp, Artificial Sequence
  Description of Artificial Sequence: Synthetic oligonucleotide
  Target: ATXN1; (+) strand; PAM type: NRG; PAM sequence: GAG
ccaatttggcagtggatcag

SEQ ID NO: 127373 - DNA, 20 bp, Artificial Sequence
  Description of Artificial Sequence: Synthetic oligonucleotide
  Target: ATXN1; (+) strand; PAM type: NRG; PAM sequence: AAG
ttggcagtggatcaggagta

SEQ ID NO: 127374 - DNA, 20 bp, Artificial Sequence
  Description of Artificial Sequence: Synthetic oligonucleotide
  Target: ATXN1; (+) strand; PAM type: NRG; PAM sequence: TAG
atcaggagtaaagtcactaa

SEQ ID NO: 127375 - DNA, 20 bp, Artificial Sequence
  Description of Artificial Sequence: Synthetic oligonucleotide
  Target: ATXN1; (+) strand; PAM type: NRG; PAM sequence: AGG
tcaggagtaaagtcactaat

SEQ ID NO: 127376 - DNA, 20 bp, Artificial Sequence
  Description of Artificial Sequence: Synthetic oligonucleotide
  Target: ATXN1; (+) strand; PAM type: NRG; PAM sequence: AAG
aaagtcactaataggaacaa

SEQ ID NO: 127377 - DNA, 20 bp, Artificial Sequence
  Description of Artificial Sequence: Synthetic oligonucleotide
  Target: ATXN1; (+) strand; PAM type: NRG; PAM sequence: TAG
tcactaataggaacaaaagc

SEQ ID NO: 127378 - DNA, 20 bp, Artificial Sequence
  Description of Artificial Sequence: Synthetic oligonucleotide
  Target: ATXN1; (+) strand; PAM type: NRG; PAM sequence: AGG
cactaataggaacaaaagct

SEQ ID NO: 127379 - DNA, 20 bp, Artificial Sequence
  Description of Artificial Sequence: Synthetic oligonucleotide
  Target: ATXN1; (+) strand; PAM type: NRG; PAM sequence: TGG
ggaaaatttaccatacctga

SEQ ID NO: 127380 - DNA, 20 bp, Artificial Sequence
  Description of Artificial Sequence: Synthetic oligonucleotide
  Target: ATXN1; (+) strand; PAM type: NRG; PAM sequence: GAG
aaaatttaccatacctgatg

SEQ ID NO: 127381 - DNA, 20 bp, Artificial Sequence
  Description of Artificial Sequence: Synthetic oligonucleotide
  Target: ATXN1; (+) strand; PAM type: NRG; PAM sequence: AGG
aaatttaccatacctgatgg

SEQ ID NO: 127382 - DNA, 20 bp, Artificial Sequence
  Description of Artificial Sequence: Synthetic oligonucleotide
  Target: ATXN1; (+) strand; PAM type: NRG; PAM sequence: GGG
aatttaccatacctgatgga

SEQ ID NO: 127383 - DNA, 20 bp, Artificial Sequence
  Description of Artificial Sequence: Synthetic oligonucleotide
  Target: ATXN1; (+) strand; PAM type: NRG; PAM sequence: TAG
ccatacctgatggagggaca

SEQ ID NO: 127384 - DNA, 20 bp, Artificial Sequence
  Description of Artificial Sequence: Synthetic oligonucleotide
  Target: ATXN1; (+) strand; PAM type: NRG; PAM sequence: AGG
catacctgatggagggacat

SEQ ID NO: 127385 - DNA, 20 bp, Artificial Sequence
  Description of Artificial Sequence: Synthetic oligonucleotide
  Target: ATXN1; (+) strand; PAM type: NRG; PAM sequence: AAG
cctgatggagggacatagga

SEQ ID NO: 127386 - DNA, 20 bp, Artificial Sequence
  Description of Artificial Sequence: Synthetic oligonucleotide
  Target: ATXN1; (+) strand; PAM type: NRG; PAM sequence: AGG
ctgatggagggacataggaa

SEQ ID NO: 127387 - DNA, 20 bp, Artificial Sequence
  Description of Artificial Sequence: Synthetic oligonucleotide
  Target: ATXN1; (+) strand; PAM type: NRG; PAM sequence: GGG
tgatggagggacataggaaa

SEQ ID NO: 127388 - DNA, 20 bp, Artificial Sequence
  Description of Artificial Sequence: Synthetic oligonucleotide
  Target: ATXN1; (+) strand; PAM type: NRG; PAM sequence: AAG
gagggacataggaaagggca

SEQ ID NO: 127389 - DNA, 20 bp, Artificial Sequence
  Description of Artificial Sequence: Synthetic oligonucleotide
  Target: ATXN1; (+) strand; PAM type: NRG; PAM sequence: GAG
gggacataggaaagggcaaa

SEQ ID NO: 127390 - DNA, 20 bp, Artificial Sequence
  Description of Artificial Sequence: Synthetic oligonucleotide
  Target: ATXN1; (+) strand; PAM type: NRG; PAM sequence: AGG
ggacataggaaagggcaaag

SEQ ID NO: 127391 - DNA, 20 bp, Artificial Sequence
  Description of Artificial Sequence: Synthetic oligonucleotide
  Target: ATXN1; (+) strand; PAM type: NRG; PAM sequence: AAG
aggaaagggcaaagaggtaa

SEQ ID NO: 127392 - DNA, 20 bp, Artificial Sequence
  Description of Artificial Sequence: Synthetic oligonucleotide
  Target: ATXN1; (+) strand; PAM type: NRG; PAM sequence: AAG
taaaagaaatccctgtaatt

SEQ ID NO: 127393 - DNA, 20 bp, Artificial Sequence
  Description of Artificial Sequence: Synthetic oligonucleotide
  Target: ATXN1; (+) strand; PAM type: NRG; PAM sequence: AGG
aaaagaaatccctgtaatta

SEQ ID NO: 127394 - DNA, 20 bp, Artificial Sequence
  Description of Artificial Sequence: Synthetic oligonucleotide
  Target: ATXN1; (+) strand; PAM type: NRG; PAM sequence: AAG
aaatccctgtaattaaggca

SEQ ID NO: 127395 - DNA, 20 bp, Artificial Sequence
  Description of Artificial Sequence: Synthetic oligonucleotide
  Target: ATXN1; (+) strand; PAM type: NRG; PAM sequence: CAG
ggcaaagccaacctatcttt

SEQ ID NO: 127396 - DNA, 20 bp, Artificial Sequence
  Description of Artificial Sequence: Synthetic oligonucleotide
  Target: ATXN1; (+) strand; PAM type: NRG; PAM sequence: AGG
gcaaagccaacctatctttc

SEQ ID NO: 127397 - DNA, 20 bp, Artificial Sequence
  Description of Artificial Sequence: Synthetic oligonucleotide
  Target: ATXN1; (+) strand; PAM type: NRG; PAM sequence: CAG
caacctatctttcaggatca

SEQ ID NO: 127398 - DNA, 20 bp, Artificial Sequence
  Description of Artificial Sequence: Synthetic oligonucleotide
  Target: ATXN1; (+) strand; PAM type: NRG; PAM sequence: CAG
cagtgaaaactcacaatctc

SEQ ID NO: 127399 - DNA, 20 bp, Artificial Sequence
  Description of Artificial Sequence: Synthetic oligonucleotide
  Target: ATXN1; (+) strand; PAM type: NRG; PAM sequence: GAG
aactcacaatctccagttat

SEQ ID NO: 127400 - DNA, 20 bp, Artificial Sequence
  Description of Artificial Sequence: Synthetic oligonucleotide
  Target: ATXN1; (+) strand; PAM type: NRG; PAM sequence: AAG
cacaatctccagttatgagt

SEQ ID NO: 127401 - DNA, 20 bp, Artificial Sequence
  Description of Artificial Sequence: Synthetic oligonucleotide
  Target: ATXN1; (+) strand; PAM type: NRG; PAM sequence: GAG
caatctccagttatgagtaa

SEQ ID NO: 127402 - DNA, 20 bp, Artificial Sequence
  Description of Artificial Sequence: Synthetic oligonucleotide
  Target: ATXN1; (+) strand; PAM type: NRG; PAM sequence: AAG
tctccagttatgagtaagag

SEQ ID NO: 127403 - DNA, 20 bp, Artificial Sequence
  Description of Artificial Sequence: Synthetic oligonucleotide
  Target: ATXN1; (+) strand; PAM type: NRG; PAM sequence: TAG
gtcacgcatataactgcttt

SEQ ID NO: 127404 - DNA, 20 bp, Artificial Sequence
  Description of Artificial Sequence: Synthetic oligonucleotide
  Target: ATXN1; (+) strand; PAM type: NRG; PAM sequence: AGG
tcacgcatataactgctttt

SEQ ID NO: 127405 - DNA, 20 bp, Artificial Sequence
  Description of Artificial Sequence: Synthetic oligonucleotide
  Target: ATXN1; (+) strand; PAM type: NRG; PAM sequence: AAG
aggtgactcgtttgaaatgt

SEQ ID NO: 127406 - DNA, 20 bp, Artificial Sequence
  Description of Artificial Sequence: Synthetic oligonucleotide
  Target: ATXN1; (+) strand; PAM type: NRG; PAM sequence: GAG
tttgaaatgtaagctgctct

SEQ ID NO: 127407 - DNA, 20 bp, Artificial Sequence
  Description of Artificial Sequence: Synthetic oligonucleotide
  Target: ATXN1; (+) strand; PAM type: NRG; PAM sequence: CGG
aagctgctctgagtctaatt

SEQ ID NO: 127408 - DNA, 20 bp, Artificial Sequence
  Description of Artificial Sequence: Synthetic oligonucleotide
  Target: ATXN1; (+) strand; PAM type: NRG; PAM sequence: AAG
taacaccatataccatgcac

SEQ ID NO: 127409 - DNA, 20 bp, Artificial Sequence
  Description of Artificial Sequence: Synthetic oligonucleotide
  Target: ATXN1; (+) strand; PAM type: NRG; PAM sequence: GAG
acaccatataccatgcacaa

SEQ ID NO: 127410 - DNA, 20 bp, Artificial Sequence
  Description of Artificial Sequence: Synthetic oligonucleotide
  Target: ATXN1; (+) strand; PAM type: NRG; PAM sequence: AGG
caccatataccatgcacaag

SEQ ID NO: 127411 - DNA, 20 bp, Artificial Sequence
  Description of Artificial Sequence: Synthetic oligonucleotide
  Target: ATXN1; (+) strand; PAM type: NRG; PAM sequence: TGG
atgcacaagaggtgacttca

SEQ ID NO: 127412 - DNA, 20 bp, Artificial Sequence
  Description of Artificial Sequence: Synthetic oligonucleotide
  Target: ATXN1; (+) strand; PAM type: NRG; PAM sequence: TAG
ggaaactgtccctatttgca

SEQ ID NO: 127413 - DNA, 20 bp, Artificial Sequence
  Description of Artificial Sequence: Synthetic oligonucleotide
  Target: ATXN1; (+) strand; PAM type: NRG; PAM sequence: TGG
atttgcatagcactattccc

SEQ ID NO: 127414 - DNA, 20 bp, Artificial Sequence
  Description of Artificial Sequence: Synthetic oligonucleotide
  Target: ATXN1; (+) strand; PAM type: NRG; PAM sequence: CAG
gcactattccctggattact

SEQ ID NO: 127415 - DNA, 20 bp, Artificial Sequence
  Description of Artificial Sequence: Synthetic oligonucleotide
  Target: ATXN1; (+) strand; PAM type: NRG; PAM sequence: AGG
cactattccctggattactc

SEQ ID NO: 127416 - DNA, 20 bp, Artificial Sequence
  Description of Artificial Sequence: Synthetic oligonucleotide
  Target: ATXN1; (+) strand; PAM type: NRG; PAM sequence: AAG
ctcaggtatcatccttgcaa

SEQ ID NO: 127417 - DNA, 20 bp, Artificial Sequence
  Description of Artificial Sequence: Synthetic oligonucleotide
  Target: ATXN1; (+) strand; PAM type: NRG; PAM sequence: CAG
ttgcaaaagtcaaactgata

SEQ ID NO: 127418 - DNA, 20 bp, Artificial Sequence
  Description of Artificial Sequence: Synthetic oligonucleotide
  Target: ATXN1; (+) strand; PAM type: NRG; PAM sequence: AGG
tgcaaaagtcaaactgatac

SEQ ID NO: 127419 - DNA, 20 bp, Artificial Sequence
  Description of Artificial Sequence: Synthetic oligonucleotide
  Target: ATXN1; (+) strand; PAM type: NRG; PAM sequence: GGG
gcaaaagtcaaactgataca

SEQ ID NO: 127420 - DNA, 20 bp, Artificial Sequence
  Description of Artificial Sequence: Synthetic oligonucleotide
  Target: ATXN1; (+) strand; PAM type: NRG; PAM sequence: AAG
agggttgcattgcctactac

SEQ ID NO: 127421 - DNA, 20 bp, Artificial Sequence
  Description of Artificial Sequence: Synthetic oligonucleotide
  Target: ATXN1; (+) strand; PAM type: NRG; PAM sequence: CAG
gttgcattgcctactacaag

SEQ ID NO: 127422 - DNA, 20 bp, Artificial Sequence
  Description of Artificial Sequence: Synthetic oligonucleotide
  Target: ATXN1; (+) strand; PAM type: NRG; PAM sequence: GAG
actacaagcagaataacgtt

SEQ ID NO: 127423 - DNA, 20 bp, Artificial Sequence
  Description of Artificial Sequence: Synthetic oligonucleotide
  Target: ATXN1; (+) strand; PAM type: NRG; PAM sequence: TGG
agcagaataacgttgagtca

SEQ ID NO: 127424 - DNA, 20 bp, Artificial Sequence
  Description of Artificial Sequence: Synthetic oligonucleotide
  Target: ATXN1; (+) strand; PAM type: NRG; PAM sequence: CAG
aacgttgagtcatggtttct

SEQ ID NO: 127425 - DNA, 20 bp, Artificial Sequence
  Description of Artificial Sequence: Synthetic oligonucleotide
  Target: ATXN1; (+) strand; PAM type: NRG; PAM sequence: AAG
agtcatggtttctcagctga

SEQ ID NO: 127426 - DNA, 20 bp, Artificial Sequence
  Description of Artificial Sequence: Synthetic oligonucleotide
  Target: ATXN1; (+) strand; PAM type: NRG; PAM sequence: TGG
atcgttttttcctatattct

SEQ ID NO: 127427 - DNA, 20 bp, Artificial Sequence
  Description of Artificial Sequence: Synthetic oligonucleotide
  Target: ATXN1; (+) strand; PAM type: NRG; PAM sequence: AAG
ttttttcctatattcttggt

SEQ ID NO: 127428 - DNA, 20 bp, Artificial Sequence
  Description of Artificial Sequence: Synthetic oligonucleotide
  Target: ATXN1; (+) strand; PAM type: NRG; PAM sequence: CAG
cctatattcttggtaagaat

SEQ ID NO: 127429 - DNA, 20 bp, Artificial Sequence
  Description of Artificial Sequence: Synthetic oligonucleotide
  Target: ATXN1; (+) strand; PAM type: NRG; PAM sequence: AAG
atattcttggtaagaatcag

SEQ ID NO: 127430 - DNA, 20 bp, Artificial Sequence
  Description of Artificial Sequence: Synthetic oligonucleotide
  Target: ATXN1; (+) strand; PAM type: NRG; PAM sequence: AAG
aagaatcagaagatacctcc

SEQ ID NO: 127431 - DNA, 20 bp, Artificial Sequence
  Description of Artificial Sequence: Synthetic oligonucleotide
  Target: ATXN1; (+) strand; PAM type: NRG; PAM sequence: CAG
atcagaagatacctccaagc

SEQ ID NO: 127432 - DNA, 20 bp, Artificial Sequence
  Description of Artificial Sequence: Synthetic oligonucleotide
  Target: ATXN1; (+) strand; PAM type: NRG; PAM sequence: CAG
atgacactgatgactacctt

SEQ ID NO: 127433 - DNA, 20 bp, Artificial Sequence
  Description of Artificial Sequence: Synthetic oligonucleotide
  Target: ATXN1; (+) strand; PAM type: NRG; PAM sequence: AGG
tgacactgatgactaccttc

SEQ ID NO: 127434 - DNA, 20 bp, Artificial Sequence
  Description of Artificial Sequence: Synthetic oligonucleotide
  Target: ATXN1; (+) strand; PAM type: NRG; PAM sequence: CAG
tgactaccttcaggtgacaa

SEQ ID NO: 127435 - DNA, 20 bp, Artificial Sequence
  Description of Artificial Sequence: Synthetic oligonucleotide
  Target: ATXN1; (+) strand; PAM type: NRG; PAM sequence: AGG
gactaccttcaggtgacaac

SEQ ID NO: 127436 - DNA, 20 bp, Artificial Sequence
  Description of Artificial Sequence: Synthetic oligonucleotide
  Target: ATXN1; (+) strand; PAM type: NRG; PAM sequence: AAG
ttccccatgctgccaaaata

SEQ ID NO: 127437 - DNA, 20 bp, Artificial Sequence
  Description of Artificial Sequence: Synthetic oligonucleotide
  Target: ATXN1; (+) strand; PAM type: NRG; PAM sequence: TAG
cccatgctgccaaaataaag

SEQ ID NO: 127438 - DNA, 20 bp, Artificial Sequence
  Description of Artificial Sequence: Synthetic oligonucleotide
  Target: ATXN1; (+) strand; PAM type: NRG; PAM sequence: AAG
atgctgccaaaataaagtag

SEQ ID NO: 127439 - DNA, 20 bp, Artificial Sequence
  Description of Artificial Sequence: Synthetic oligonucleotide
  Target: ATXN1; (+) strand; PAM type: NRG; PAM sequence: AGG
tgctgccaaaataaagtaga

SEQ ID NO: 127440 - DNA, 20 bp, Artificial Sequence
  Description of Artificial Sequence: Synthetic oligonucleotide
  Target: ATXN1; (+) strand; PAM type: NRG; PAM sequence: TGG
gccaaaataaagtagaaggc

SEQ ID NO: 127441 - DNA, 20 bp, Artificial Sequence
  Description of Artificial Sequence: Synthetic oligonucleotide
  Target: ATXN1; (+) strand; PAM type: NRG; PAM sequence: GGG
ccaaaataaagtagaaggct

SEQ ID NO: 127442 - DNA, 20 bp, Artificial Sequence
  Description of Artificial Sequence: Synthetic oligonucleotide
  Target: ATXN1; (+) strand; PAM type: NRG; PAM sequence: TGG
taaagtagaaggctgggtaa

SEQ ID NO: 127443 - DNA, 20 bp, Artificial Sequence
  Description of Artificial Sequence: Synthetic oligonucleotide
  Target: ATXN1; (+) strand; PAM type: NRG; PAM sequence: TAG
tagaaggctgggtaatggtt

SEQ ID NO: 127444 - DNA, 20 bp, Artificial Sequence
  Description of Artificial Sequence: Synthetic oligonucleotide
  Target: ATXN1; (+) strand; PAM type: NRG; PAM sequence: CAG
aatcatgcacttttccaact

SEQ ID NO: 127445 - DNA, 20 bp, Artificial Sequence
  Description of Artificial Sequence: Synthetic oligonucleotide
  Target: ATXN1; (+) strand; PAM type: NRG; PAM sequence: GAG
acttttccaactcagttatt

SEQ ID NO: 127446 - DNA, 20 bp, Artificial Sequence
  Description of Artificial Sequence: Synthetic oligonucleotide
  Target: ATXN1; (+) strand; PAM type: NRG; PAM sequence: TGG
tccaactcagttattgagaa

SEQ ID NO: 127447 - DNA, 20 bp, Artificial Sequence
  Description of Artificial Sequence: Synthetic oligonucleotide
  Target: ATXN1; (+) strand; PAM type: NRG; PAM sequence: TAG
cagttattgagaatggccat

SEQ ID NO: 127448 - DNA, 20 bp, Artificial Sequence
  Description of Artificial Sequence: Synthetic oligonucleotide
  Target: ATXN1; (+) strand; PAM type: NRG; PAM sequence: GAG
gttattgagaatggccatta

SEQ ID NO: 127449 - DNA, 20 bp, Artificial Sequence
  Description of Artificial Sequence: Synthetic oligonucleotide
  Target: ATXN1; (+) strand; PAM type: NRG; PAM sequence: AGG
ttattgagaatggccattag

SEQ ID NO: 127450 - DNA, 20 bp, Artificial Sequence
  Description of Artificial Sequence: Synthetic oligonucleotide
  Target: ATXN1; (+) strand; PAM type: NRG; PAM sequence: GGG
tattgagaatggccattaga

SEQ ID NO: 127451 - DNA, 20 bp, Artificial Sequence
  Description of Artificial Sequence: Synthetic oligonucleotide
  Target: ATXN1; (+) strand; PAM type: NRG; PAM sequence: CAG
ttagagggtcccaaataacc

SEQ ID NO: 127452 - DNA, 20 bp, Artificial Sequence
  Description of Artificial Sequence: Synthetic oligonucleotide
  Target: ATXN1; (+) strand; PAM type: NRG; PAM sequence: AAG
caaaaaattttctgaccgtt

SEQ ID NO: 127453 - DNA, 20 bp, Artificial Sequence
  Description of Artificial Sequence: Synthetic oligonucleotide
  Target: ATXN1; (+) strand; PAM type: NRG; PAM sequence: GAG
aaaaattttctgaccgttaa

SEQ ID NO: 127454 - DNA, 20 bp, Artificial Sequence
  Description of Artificial Sequence: Synthetic oligonucleotide
  Target: ATXN1; (+) strand; PAM type: NRG; PAM sequence: CAG
taagagttttaaccaatatg

SEQ ID NO: 127455 - DNA, 20 bp, Artificial Sequence
  Description of Artificial Sequence: Synthetic oligonucleotide
  Target: ATXN1; (+) strand; PAM type: NRG; PAM sequence: CAG
aaccaatatgcagtaaaatg

SEQ ID NO: 127456 - DNA, 20 bp, Artificial Sequence
  Description of Artificial Sequence: Synthetic oligonucleotide
  Target: ATXN1; (+) strand; PAM type: NRG; PAM sequence: CAG
agtaaaatgcagttttcaat

SEQ ID NO: 127457 - DNA, 20 bp, Artificial Sequence
  Description of Artificial Sequence: Synthetic oligonucleotide
  Target: ATXN1; (+) strand; PAM type: NRG; PAM sequence: AGG
gtaaaatgcagttttcaatc

SEQ ID NO: 127458 - DNA, 20 bp, Artificial Sequence
  Description of Artificial Sequence: Synthetic oligonucleotide
  Target: ATXN1; (+) strand; PAM type: NRG; PAM sequence: GGG
taaaatgcagttttcaatca

SEQ ID NO: 127459 - DNA, 20 bp, Artificial Sequence
  Description of Artificial Sequence: Synthetic oligonucleotide
  Target: ATXN1; (+) strand; PAM type: NRG; PAM sequence: GGG
aaaatgcagttttcaatcag

SEQ ID NO: 127460 - DNA, 20 bp, Artificial Sequence
  Description of Artificial Sequence: Synthetic oligonucleotide
  Target: ATXN1; (+) strand; PAM type: NRG; PAM sequence: CAG
ctactgtaaccattttttga

SEQ ID NO: 127461 - DNA, 20 bp, Artificial Sequence
  Description of Artificial Sequence: Synthetic oligonucleotide
  Target: ATXN1; (+) strand; PAM type: NRG; PAM sequence: TAG
ccattttttgacagttttgt

SEQ ID NO: 127462 - DNA, 20 bp, Artificial Sequence
  Description of Artificial Sequence: Synthetic oligonucleotide
  Target: ATXN1; (+) strand; PAM type: NRG; PAM sequence: GAG
attttttgacagttttgtta

SEQ ID NO: 127463 - DNA, 20 bp, Artificial Sequence
  Description of Artificial Sequence: Synthetic oligonucleotide
  Target: ATXN1; (+) strand; PAM type: NRG; PAM sequence: AAG
cagttttgttagagaattca

SEQ ID NO: 127464 - DNA, 20 bp, Artificial Sequence
  Description of Artificial Sequence: Synthetic oligonucleotide
  Target: ATXN1; (+) strand; PAM type: NRG; PAM sequence: AAG
ataaaaatgtgtacctgaaa

SEQ ID NO: 127465 - DNA, 20 bp, Artificial Sequence
  Description of Artificial Sequence: Synthetic oligonucleotide
  Target: ATXN1; (+) strand; PAM type: NRG; PAM sequence: TAG
gtgtacctgaaaaagactac

SEQ ID NO: 127466 - DNA, 20 bp, Artificial Sequence
  Description of Artificial Sequence: Synthetic oligonucleotide
  Target: ATXN1; (+) strand; PAM type: NRG; PAM sequence: GAG
gtacctgaaaaagactacta

SEQ ID NO: 127467 - DNA, 20 bp, Artificial Sequence
  Description of Artificial Sequence: Synthetic oligonucleotide
  Target: ATXN1; (+) strand; PAM type: NRG; PAM sequence: AGG
tacctgaaaaagactactag

SEQ ID NO: 127468 - DNA, 20 bp, Artificial Sequence
  Description of Artificial Sequence: Synthetic oligonucleotide
  Target: ATXN1; (+) strand; PAM type: NRG; PAM sequence: CAG
agaggaaaaaaaaataaatt

SEQ ID NO: 127469 - DNA, 20 bp, Artificial Sequence
  Description of Artificial Sequence: Synthetic oligonucleotide
  Target: ATXN1; (+) strand; PAM type: NRG; PAM sequence: AGG
gaggaaaaaaaaataaattc

SEQ ID NO: 127470 - DNA, 20 bp, Artificial Sequence
  Description of Artificial Sequence: Synthetic oligonucleotide
  Target: ATXN1; (+) strand; PAM type: NRG; PAM sequence: GGG
aggaaaaaaaaataaattca

SEQ ID NO: 127471 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaataaattcagggt

SEQ ID NO: 127472 - DNA, 20 bp, Artificial Sequence
  Description of Artificial Sequence: Synthetic oligonucleotide
  Target: ATXN1; (+) strand; PAM type: NRG; PAM sequence: AGG
aaaaaaataaattcagggta

SEQ ID NO: 127473 - DNA, 20 bp, Artificial Sequence
  Description of Artificial Sequence: Synthetic oligonucleotide
  Target: ATXN1; (+) strand; PAM type: NRG; PAM sequence: GGG
aaaaaataaattcagggtaa

SEQ ID NO: 127474 - DNA, 20 bp, Artificial Sequence
  Description of Artificial Sequence: Synthetic oligonucleotide
  Target: ATXN1; (+) strand; PAM type: NRG; PAM sequence: TAG
ttcagggtaagggtacatac

SEQ ID NO: 127475 - DNA, 20 bp, Artificial Sequence
  Description of Artificial Sequence: Synthetic oligonucleotide
  Target: ATXN1; (+) strand; PAM type: NRG; PAM sequence: TAG
aagggtacatactagatatt

SEQ ID NO: 127476 - DNA, 20 bp, Artificial Sequence
  Description of Artificial Sequence: Synthetic oligonucleotide
  Target: ATXN1; (+) strand; PAM type: NRG; PAM sequence: CAG
gtacatactagatatttaga

SEQ ID NO: 127477 - DNA, 20 bp, Artificial Sequence
  Description of Artificial Sequence: Synthetic oligonucleotide
  Target: ATXN1; (+) strand; PAM type: NRG; PAM sequence: AAG
actagatatttagacagctg

SEQ ID NO: 127478 - DNA, 20 bp, Artificial Sequence
  Description of Artificial Sequence: Synthetic oligonucleotide
  Target: ATXN1; (+) strand; PAM type: NRG; PAM sequence: CAG
gatatttagacagctgaagc

SEQ ID NO: 127479 - DNA, 20 bp, Artificial Sequence
  Description of Artificial Sequence: Synthetic oligonucleotide
  Target: ATXN1; (+) strand; PAM type: NRG; PAM sequence: TGG
atttagacagctgaagccag

SEQ ID NO: 127480 - DNA, 20 bp, Artificial Sequence
  Description of Artificial Sequence: Synthetic oligonucleotide
  Target: ATXN1; (+) strand; PAM type: NRG; PAM sequence: CAG
gctgaagccagtggtgtgtg

SEQ ID NO: 127481 - DNA, 20 bp, Artificial Sequence
  Description of Artificial Sequence: Synthetic oligonucleotide
  Target: ATXN1; (+) strand; PAM type: NRG; PAM sequence: AAG
tgtgcagaaatgtttaataa

SEQ ID NO: 127482 - DNA, 20 bp, Artificial Sequence
  Description of Artificial Sequence: Synthetic oligonucleotide
  Target: ATXN1; (+) strand; PAM type: NRG; PAM sequence: TGG
gcagaaatgtttaataaaag

SEQ ID NO: 127483 - DNA, 20 bp, Artificial Sequence
  Description of Artificial Sequence: Synthetic oligonucleotide
  Target: ATXN1; (+) strand; PAM type: NRG; PAM sequence: GGG
cagaaatgtttaataaaagt

SEQ ID NO: 127484 - DNA, 20 bp, Artificial Sequence
  Description of Artificial Sequence: Synthetic oligonucleotide
  Target: ATXN1; (+) strand; PAM type: NRG; PAM sequence: GAG
gaaatgtttaataaaagtgg

SEQ ID NO: 127485 - DNA, 20 bp, Artificial Sequence
  Description of Artificial Sequence: Synthetic oligonucleotide
  Target: ATXN1; (+) strand; PAM type: NRG; PAM sequence: AGG
aaatgtttaataaaagtggg

SEQ ID NO: 127486 - DNA, 20 bp, Artificial Sequence
  Description of Artificial Sequence: Synthetic oligonucleotide
  Target: ATXN1; (+) strand; PAM type: NRG; PAM sequence: GGG
aatgtttaataaaagtggga

SEQ ID NO: 127487 - DNA, 20 bp, Artificial Sequence
  Description of Artificial Sequence: Synthetic oligonucleotide
  Target: ATXN1; (+) strand; PAM type: NRG; PAM sequence: GGG
atgtttaataaaagtgggag

SEQ ID NO: 127488 - DNA, 20 bp, Artificial Sequence
  Description of Artificial Sequence: Synthetic oligonucleotide
  Target: ATXN1; (+) strand; PAM type: NRG; PAM sequence: GAG
gtttaataaaagtgggaggg

SEQ ID NO: 127489 - DNA, 20 bp, Artificial Sequence
  Description of Artificial Sequence: Synthetic oligonucleotide
  Target: ATXN1; (+) strand; PAM type: NRG; PAM sequence: GAG
ttaataaaagtgggagggga

SEQ ID NO: 127490 - DNA, 20 bp, Artificial Sequence
  Description of Artificial Sequence: Synthetic oligonucleotide
  Target: ATXN1; (+) strand; PAM type: NRG; PAM sequence: GAG
aataaaagtgggaggggaga

SEQ ID NO: 127491 - DNA, 20 bp, Artificial Sequence
  Description of Artificial Sequence: Synthetic oligonucleotide
  Target: ATXN1; (+) strand; PAM type: NRG; PAM sequence: AGG
ataaaagtgggaggggagag

SEQ ID NO: 127492 - DNA, 20 bp, Artificial Sequence
  Description of Artificial Sequence: Synthetic oligonucleotide
  Target: ATXN1; (+) strand; PAM type: NRG; PAM sequence: TAG
gagagaggacccctgatgtg

SEQ ID NO: 127493 - DNA, 20 bp, Artificial Sequence
  Description of Artificial Sequence: Synthetic oligonucleotide
  Target: ATXN1; (+) strand; PAM type: NRG; PAM sequence: CAG
cccctgatgtgtagcatttg

SEQ ID NO: 127494 - DNA, 20 bp, Artificial Sequence
  Description of Artificial Sequence: Synthetic oligonucleotide
  Target: ATXN1; (+) strand; PAM type: NRG; PAM sequence: TAG
gtagcatttgcagacttctg

SEQ ID NO: 127495 - DNA, 20 bp, Artificial Sequence
  Description of Artificial Sequence: Synthetic oligonucleotide
  Target: ATXN1; (+) strand; PAM type: NRG; PAM sequence: TGG
tagtgtaaacactcccacca

SEQ ID NO: 127496 - DNA, 20 bp, Artificial Sequence
  Description of Artificial Sequence: Synthetic oligonucleotide
  Target: ATXN1; (+) strand; PAM type: NRG; PAM sequence: AAG
ctcccaccatggccaatttc

SEQ ID NO: 127497 - DNA, 20 bp, Artificial Sequence
  Description of Artificial Sequence: Synthetic oligonucleotide
  Target: ATXN1; (+) strand; PAM type: NRG; PAM sequence: AGG
tcccaccatggccaatttca

SEQ ID NO: 127498 - DNA, 20 bp, Artificial Sequence
  Description of Artificial Sequence: Synthetic oligonucleotide
  Target: ATXN1; (+) strand; PAM type: NRG; PAM sequence: TGG
atttctgaacatttaacact

SEQ ID NO: 127499 - DNA, 20 bp, Artificial Sequence
  Description of Artificial Sequence: Synthetic oligonucleotide
  Target: ATXN1; (+) strand; PAM type: NRG; PAM sequence: AAG
atttaacacttggctcataa

SEQ ID NO: 127500 - DNA, 20 bp, Artificial Sequence
  Description of Artificial Sequence: Synthetic oligonucleotide
  Target: ATXN1; (+) strand; PAM type: NRG; PAM sequence: AAG
cacttggctcataaaagtgc

SEQ ID NO: 127501 - DNA, 20 bp, Artificial Sequence
  Description of Artificial Sequence: Synthetic oligonucleotide
  Target: ATXN1; (+) strand; PAM type: NRG; PAM sequence: TGG
tggctcataaaagtgcaagc

SEQ ID NO: 127502 - DNA, 20 bp, Artificial Sequence
  Description of Artificial Sequence: Synthetic oligonucleotide
  Target: ATXN1; (+) strand; PAM type: NRG; PAM sequence: TGG
agctggctccactacaccac

SEQ ID NO: 127503 - DNA, 20 bp, Artificial Sequence
  Description of Artificial Sequence: Synthetic oligonucleotide
  Target: ATXN1; (+) strand; PAM type: NRG; PAM sequence: AAG
gtccatttcctcatcccacc

SEQ ID NO: 127504 - DNA, 20 bp, Artificial Sequence
  Description of Artificial Sequence: Synthetic oligonucleotide
  Target: ATXN1; (+) strand; PAM type: NRG; PAM sequence: CAG
tttcctcatcccaccaagat

SEQ ID NO: 127505 - DNA, 20 bp, Artificial Sequence
  Description of Artificial Sequence: Synthetic oligonucleotide
  Target: ATXN1; (+) strand; PAM type: NRG; PAM sequence: AAG
ttcctacctaaaataaaccc

SEQ ID NO: 127506 - DNA, 20 bp, Artificial Sequence
  Description of Artificial Sequence: Synthetic oligonucleotide
  Target: ATXN1; (+) strand; PAM type: NRG; PAM sequence: AAG
ctacctaaaataaacccaag

SEQ ID NO: 127507 - DNA, 20 bp, Artificial Sequence
  Description of Artificial Sequence: Synthetic oligonucleotide
  Target: ATXN1; (+) strand; PAM type: NRG; PAM sequence: AAG
taaaataaacccaagaagca

SEQ ID NO: 127508 - DNA, 20 bp, Artificial Sequence
  Description of Artificial Sequence: Synthetic oligonucleotide
  Target: ATXN1; (+) strand; PAM type: NRG; PAM sequence: CGG
gcaaagtccttcattatttt

SEQ ID NO: 127509 - DNA, 20 bp, Artificial Sequence
  Description of Artificial Sequence: Synthetic oligonucleotide
  Target: ATXN1; (+) strand; PAM type: NRG; PAM sequence: TAG
ttcggctttcttcttatcca

SEQ ID NO: 127510 - DNA, 20 bp, Artificial Sequence
  Description of Artificial Sequence: Synthetic oligonucleotide
  Target: ATXN1; (+) strand; PAM type: NRG; PAM sequence: AAG
cttcttatccatagatattt

SEQ ID NO: 127511 - DNA, 20 bp, Artificial Sequence
  Description of Artificial Sequence: Synthetic oligonucleotide
  Target: ATXN1; (+) strand; PAM type: NRG; PAM sequence: GAG
tcttatccatagatatttaa

SEQ ID NO: 127512 - DNA, 20 bp, Artificial Sequence
  Description of Artificial Sequence: Synthetic oligonucleotide
  Target: ATXN1; (+) strand; PAM type: NRG; PAM sequence: TAG
cacttccatgtctttgcttc

SEQ ID NO: 127513 - DNA, 20 bp, Artificial Sequence
  Description of Artificial Sequence: Synthetic oligonucleotide
  Target: ATXN1; (+) strand; PAM type: NRG; PAM sequence: TGG
ttgcttctagcctcctcatc

SEQ ID NO: 127514 - DNA, 20 bp, Artificial Sequence
  Description of Artificial Sequence: Synthetic oligonucleotide
  Target: ATXN1; (+) strand; PAM type: NRG; PAM sequence: AAG
catctggaataaaccttcct

SEQ ID NO: 127515 - DNA, 20 bp, Artificial Sequence
  Description of Artificial Sequence: Synthetic oligonucleotide
  Target: ATXN1; (+) strand; PAM type: NRG; PAM sequence: CAG
taagtctgctcttgtataaa

SEQ ID NO: 127516 - DNA, 20 bp, Artificial Sequence
  Description of Artificial Sequence: Synthetic oligonucleotide
  Target: ATXN1; (+) strand; PAM type: NRG; PAM sequence: TAG
cagctttctttgaatgctct

SEQ ID NO: 127517 - DNA, 20 bp, Artificial Sequence
  Description of Artificial Sequence: Synthetic oligonucleotide
  Target: ATXN1; (+) strand; PAM type: NRG; PAM sequence: AGG
agctttctttgaatgctctt

SEQ ID NO: 127518 - DNA, 20 bp, Artificial Sequence
  Description of Artificial Sequence: Synthetic oligonucleotide
  Target: ATXN1; (+) strand; PAM type: NRG; PAM sequence: TAG
ttctttgaatgctcttaggc

SEQ ID NO: 127519 - DNA, 20 bp, Artificial Sequence
  Description of Artificial Sequence: Synthetic oligonucleotide
  Target: ATXN1; (+) strand; PAM type: NRG; PAM sequence: AGG
tctttgaatgctcttaggct

SEQ ID NO: 127520 - DNA, 20 bp, Artificial Sequence
  Description of Artificial Sequence: Synthetic oligonucleotide
  Target: ATXN1; (+) strand; PAM type: NRG; PAM sequence: CAG
gctcttaggctaggtcgcac

SEQ ID NO: 127521 - DNA, 20 bp, Artificial Sequence
  Description of Artificial Sequence: Synthetic oligonucleotide
  Target: ATXN1; (+) strand; PAM type: NRG; PAM sequence: CAG
ttctgtattctgattttcta

SEQ ID NO: 127522 - DNA, 20 bp, Artificial Sequence
  Description of Artificial Sequence: Synthetic oligonucleotide
  Target: ATXN1; (+) strand; PAM type: NRG; PAM sequence: TAG
actgtcctgtcatttgattc

SEQ ID NO: 127523 - DNA, 20 bp, Artificial Sequence
  Description of Artificial Sequence: Synthetic oligonucleotide
  Target: ATXN1; (+) strand; PAM type: NRG; PAM sequence: GAG
tgtcctgtcatttgattcta

SEQ ID NO: 127524 - DNA, 20 bp, Artificial Sequence
  Description of Artificial Sequence: Synthetic oligonucleotide
  Target: ATXN1; (+) strand; PAM type: NRG; PAM sequence: AGG
gtcctgtcatttgattctag

SEQ ID NO: 127525 - DNA, 20 bp, Artificial Sequence
  Description of Artificial Sequence: Synthetic oligonucleotide
  Target: ATXN1; (+) strand; PAM type: NRG; PAM sequence: GGG
tcctgtcatttgattctaga

SEQ ID NO: 127526 - DNA, 20 bp, Artificial Sequence
  Description of Artificial Sequence: Synthetic oligonucleotide
  Target: ATXN1; (+) strand; PAM type: NRG; PAM sequence: CAG
tgtcatttgattctagaggg

SEQ ID NO: 127527 - DNA, 20 bp, Artificial Sequence
  Description of Artificial Sequence: Synthetic oligonucleotide
  Target: ATXN1; (+) strand; PAM type: NRG; PAM sequence: AGG
gtcatttgattctagagggc

SEQ ID NO: 127528 - DNA, 20 bp, Artificial Sequence
  Description of Artificial Sequence: Synthetic oligonucleotide
  Target: ATXN1; (+) strand; PAM type: NRG; PAM sequence: GGG
tcatttgattctagagggca

SEQ ID NO: 127529 - DNA, 20 bp, Artificial Sequence
  Description of Artificial Sequence: Synthetic oligonucleotide
  Target: ATXN1; (+) strand; PAM type: NRG; PAM sequence: GGG
catttgattctagagggcag

SEQ ID NO: 127530 - DNA, 20 bp, Artificial Sequence
  Description of Artificial Sequence: Synthetic oligonucleotide
  Target: ATXN1; (+) strand; PAM type: NRG; PAM sequence: GAG
tctagagggcaggggtctgt

SEQ ID NO: 127531 - DNA, 20 bp, Artificial Sequence
  Description of Artificial Sequence: Synthetic oligonucleotide
  Target: ATXN1; (+) strand; PAM type: NRG; PAM sequence: AGG
ctagagggcaggggtctgtg

SEQ ID NO: 127532 - DNA, 20 bp, Artificial Sequence
  Description of Artificial Sequence: Synthetic oligonucleotide
  Target: ATXN1; (+) strand; PAM type: NRG; PAM sequence: GGG
tagagggcaggggtctgtga

SEQ ID NO: 127533 - DNA, 20 bp, Artificial Sequence
  Description of Artificial Sequence: Synthetic oligonucleotide
  Target: ATXN1; (+) strand; PAM type: NRG; PAM sequence: CAG
agggcaggggtctgtgaggg

SEQ ID NO: 127534 - DNA, 20 bp, Artificial Sequence
  Description of Artificial Sequence: Synthetic oligonucleotide
  Target: ATXN1; (+) strand; PAM type: NRG; PAM sequence: AGG
gggcaggggtctgtgagggc

SEQ ID NO: 127535 - DNA, 20 bp, Artificial Sequence
  Description of Artificial Sequence: Synthetic oligonucleotide
  Target: ATXN1; (+) strand; PAM type: NRG; PAM sequence: GGG
ggcaggggtctgtgagggca

SEQ ID NO: 127536 - DNA, 20 bp, Artificial Sequence
  Description of Artificial Sequence: Synthetic oligonucleotide
  Target: ATXN1; (+) strand; PAM type: NRG; PAM sequence: CAG
gagggcagggcatctgccca

SEQ ID NO: 127537 - DNA, 20 bp, Artificial Sequence
  Description of Artificial Sequence: Synthetic oligonucleotide
  Target: ATXN1; (+) strand; PAM type: NRG; PAM sequence: AGG
agggcagggcatctgcccac

SEQ ID NO: 127538 - DNA, 20 bp, Artificial Sequence
  Description of Artificial Sequence: Synthetic oligonucleotide
  Target: ATXN1; (+) strand; PAM type: NRG; PAM sequence: AAG
gggcatctgcccacaggaat

SEQ ID NO: 127539 - DNA, 20 bp, Artificial Sequence
  Description of Artificial Sequence: Synthetic oligonucleotide
  Target: ATXN1; (+) strand; PAM type: NRG; PAM sequence: CAG
tctgcccacaggaataagca

SEQ ID NO: 127540 - DNA, 20 bp, Artificial Sequence
  Description of Artificial Sequence: Synthetic oligonucleotide
  Target: ATXN1; (+) strand; PAM type: NRG; PAM sequence: AAG
acaggaataagcacagcacc

SEQ ID NO: 127541 - DNA, 20 bp, Artificial Sequence
  Description of Artificial Sequence: Synthetic oligonucleotide
  Target: ATXN1; (+) strand; PAM type: NRG; PAM sequence: TGG
gcacagcaccaagtctgact

SEQ ID NO: 127542 - DNA, 20 bp, Artificial Sequence
  Description of Artificial Sequence: Synthetic oligonucleotide
  Target: ATXN1; (+) strand; PAM type: NRG; PAM sequence: GAG
caccaagtctgacttggatt

SEQ ID NO: 127543 - DNA, 20 bp, Artificial Sequence
  Description of Artificial Sequence: Synthetic oligonucleotide
  Target: ATXN1; (+) strand; PAM type: NRG; PAM sequence: GAG
ctgaataaatgaaatctgtt

SEQ ID NO: 127544 - DNA, 20 bp, Artificial Sequence
  Description of Artificial Sequence: Synthetic oligonucleotide
  Target: ATXN1; (+) strand; PAM type: NRG; PAM sequence: TGG
atgaaatctgttgagttgac

SEQ ID NO: 127545 - DNA, 20 bp, Artificial Sequence
  Description of Artificial Sequence: Synthetic oligonucleotide
  Target: ATXN1; (+) strand; PAM type: NRG; PAM sequence: TGG
aatctgttgagttgactggc

SEQ ID NO: 127546 - DNA, 20 bp, Artificial Sequence
  Description of Artificial Sequence: Synthetic oligonucleotide
  Target: ATXN1; (+) strand; PAM type: NRG; PAM sequence: GGG
atctgttgagttgactggct

SEQ ID NO: 127547 - DNA, 20 bp, Artificial Sequence
  Description of Artificial Sequence: Synthetic oligonucleotide
  Target: ATXN1; (+) strand; PAM type: NRG; PAM sequence: TAG
tggctgggctgccttctgtc

SEQ ID NO: 127548 - DNA, 20 bp, Artificial Sequence
  Description of Artificial Sequence: Synthetic oligonucleotide
  Target: ATXN1; (+) strand; PAM type: NRG; PAM sequence: CAG
gccttctgtctagtctgcca

SEQ ID NO: 127549 - DNA, 20 bp, Artificial Sequence
  Description of Artificial Sequence: Synthetic oligonucleotide
  Target: ATXN1; (+) strand; PAM type: NRG; PAM sequence: GAG
tctgtctagtctgccacagt

SEQ ID NO: 127550 - DNA, 20 bp, Artificial Sequence
  Description of Artificial Sequence: Synthetic oligonucleotide
  Target: ATXN1; (+) strand; PAM type: NRG; PAM sequence: TAG
tctagtctgccacagtgagc

SEQ ID NO: 127551 - DNA, 20 bp, Artificial Sequence
  Description of Artificial Sequence: Synthetic oligonucleotide
  Target: ATXN1; (+) strand; PAM type: NRG; PAM sequence: AGG
ctagtctgccacagtgagct

SEQ ID NO: 127552 - DNA, 20 bp, Artificial Sequence
  Description of Artificial Sequence: Synthetic oligonucleotide
  Target: ATXN1; (+) strand; PAM type: NRG; PAM sequence: AAG
agtgagctaggctcctcctg

SEQ ID NO: 127553 - DNA, 20 bp, Artificial Sequence
  Description of Artificial Sequence: Synthetic oligonucleotide
  Target: ATXN1; (+) strand; PAM type: NRG; PAM sequence: TAG
aggctcctcctgaagtgaac

SEQ ID NO: 127554 - DNA, 20 bp, Artificial Sequence
  Description of Artificial Sequence: Synthetic oligonucleotide
  Target: ATXN1; (+) strand; PAM type: NRG; PAM sequence: AGG
ggctcctcctgaagtgaact

SEQ ID NO: 127555 - DNA, 20 bp, Artificial Sequence
  Description of Artificial Sequence: Synthetic oligonucleotide
  Target: ATXN1; (+) strand; PAM type: NRG; PAM sequence: CAG
ctcctgaagtgaactaggat

SEQ ID NO: 127556 - DNA, 20 bp, Artificial Sequence
  Description of Artificial Sequence: Synthetic oligonucleotide
  Target: ATXN1; (+) strand; PAM type: NRG; PAM sequence: GAG
tgaagtgaactaggatcagt

SEQ ID NO: 127557 - DNA, 20 bp, Artificial Sequence
  Description of Artificial Sequence: Synthetic oligonucleotide
  Target: ATXN1; (+) strand; PAM type: NRG; PAM sequence: AGG
gaagtgaactaggatcagtg

SEQ ID NO: 127558 - DNA, 20 bp, Artificial Sequence
  Description of Artificial Sequence: Synthetic oligonucleotide
  Target: ATXN1; (+) strand; PAM type: NRG; PAM sequence: GGG
aagtgaactaggatcagtga

SEQ ID NO: 127559 - DNA, 20 bp, Artificial Sequence
  Description of Artificial Sequence: Synthetic oligonucleotide
  Target: ATXN1; (+) strand; PAM type: NRG; PAM sequence: AAG
ctaggatcagtgagggacta

SEQ ID NO: 127560 - DNA, 20 bp, Artificial Sequence
  Description of Artificial Sequence: Synthetic oligonucleotide
  Target: ATXN1; (+) strand; PAM type: NRG; PAM sequence: TAG
gagggactaaagtcaatctg

SEQ ID NO: 127561 - DNA, 20 bp, Artificial Sequence
  Description of Artificial Sequence: Synthetic oligonucleotide
  Target: ATXN1; (+) strand; PAM type: NRG; PAM sequence: AAG
taaagtcaatctgtagcatg

SEQ ID NO: 127562 - DNA, 20 bp, Artificial Sequence
  Description of Artificial Sequence: Synthetic oligonucleotide
  Target: ATXN1; (+) strand; PAM type: NRG; PAM sequence: CAG
tctgtagcatgaagatttca

SEQ ID NO: 127563 - DNA, 20 bp, Artificial Sequence
  Description of Artificial Sequence: Synthetic oligonucleotide
  Target: ATXN1; (+) strand; PAM type: NRG; PAM sequence: AGG
ctgtagcatgaagatttcac

SEQ ID NO: 127564 - DNA, 20 bp, Artificial Sequence
  Description of Artificial Sequence: Synthetic oligonucleotide
  Target: ATXN1; (+) strand; PAM type: NRG; PAM sequence: GGG
tgtagcatgaagatttcaca

SEQ ID NO: 127565 - DNA, 20 bp, Artificial Sequence
  Description of Artificial Sequence: Synthetic oligonucleotide
  Target: ATXN1; (+) strand; PAM type: NRG; PAM sequence: AAG
cacacaccaaactcccacaa

SEQ ID NO: 127566 - DNA, 20 bp, Artificial Sequence
  Description of Artificial Sequence: Synthetic oligonucleotide
  Target: ATXN1; (+) strand; PAM type: NRG; PAM sequence: AGG
acacaccaaactcccacaaa

SEQ ID NO: 127567 - DNA, 20 bp, Artificial Sequence
  Description of Artificial Sequence: Synthetic oligonucleotide
  Target: ATXN1; (+) strand; PAM type: NRG; PAM sequence: AAG
caccaaactcccacaaaagg

SEQ ID NO: 127568 - DNA, 20 bp, Artificial Sequence
  Description of Artificial Sequence: Synthetic oligonucleotide
  Target: ATXN1; (+) strand; PAM type: NRG; PAM sequence: GAG
ccaaactcccacaaaaggaa

SEQ ID NO: 127569 - DNA, 20 bp, Artificial Sequence
  Description of Artificial Sequence: Synthetic oligonucleotide
  Target: ATXN1; (+) strand; PAM type: NRG; PAM sequence: AGG
caaactcccacaaaaggaag

SEQ ID NO: 127570 - DNA, 20 bp, Artificial Sequence
  Description of Artificial Sequence: Synthetic oligonucleotide
  Target: ATXN1; (+) strand; PAM type: NRG; PAM sequence: GGG
aaactcccacaaaaggaaga

SEQ ID NO: 127571 - DNA, 20 bp, Artificial Sequence
  Description of Artificial Sequence: Synthetic oligonucleotide
  Target: ATXN1; (+) strand; PAM type: NRG; PAM sequence: GGG
aactcccacaaaaggaagag

SEQ ID NO: 127572 - DNA, 20 bp, Artificial Sequence
  Description of Artificial Sequence: Synthetic oligonucleotide
  Target: ATXN1; (+) strand; PAM type: NRG; PAM sequence: GGG
actcccacaaaaggaagagg

SEQ ID NO: 127573 - DNA, 20 bp, Artificial Sequence
  Description of Artificial Sequence: Synthetic oligonucleotide
  Target: ATXN1; (+) strand; PAM type: NRG; PAM sequence: GAG
tcccacaaaaggaagagggg

SEQ ID NO: 127574 - DNA, 20 bp, Artificial Sequence
  Description of Artificial Sequence: Synthetic oligonucleotide
  Target: ATXN1; (+) strand; PAM type: NRG; PAM sequence: TGG
gagggggagctaatatgtgt

SEQ ID NO: 127575 - DNA, 20 bp, Artificial Sequence
  Description of Artificial Sequence: Synthetic oligonucleotide
  Target: ATXN1; (+) strand; PAM type: NRG; PAM sequence: GGG
agggggagctaatatgtgtt

SEQ ID NO: 127576 - DNA, 20 bp, Artificial Sequence
  Description of Artificial Sequence: Synthetic oligonucleotide
  Target: ATXN1; (+) strand; PAM type: NRG; PAM sequence: AAG
gttgggcataaaatttctgc

SEQ ID NO: 127577 - DNA, 20 bp, Artificial Sequence
  Description of Artificial Sequence: Synthetic oligonucleotide
  Target: ATXN1; (+) strand; PAM type: NRG; PAM sequence: CAG
cataaaatttctgcaagccc

SEQ ID NO: 127578 - DNA, 20 bp, Artificial Sequence
  Description of Artificial Sequence: Synthetic oligonucleotide
  Target: ATXN1; (+) strand; PAM type: NRG; PAM sequence: CAG
tttctgcaagccccagcacc

SEQ ID NO: 127579 - DNA, 20 bp, Artificial Sequence
  Description of Artificial Sequence: Synthetic oligonucleotide
  Target: ATXN1; (+) strand; PAM type: NRG; PAM sequence: TAG
aagccccagcacccagaact

SEQ ID NO: 127580 - DNA, 20 bp, Artificial Sequence
  Description of Artificial Sequence: Synthetic oligonucleotide
  Target: ATXN1; (+) strand; PAM type: NRG; PAM sequence: CAG
cattctccaataaaacaaac

SEQ ID NO: 127581 - DNA, 20 bp, Artificial Sequence
  Description of Artificial Sequence: Synthetic oligonucleotide
  Target: ATXN1; (+) strand; PAM type: NRG; PAM sequence: AGG
attctccaataaaacaaacc

SEQ ID NO: 127582 - DNA, 20 bp, Artificial Sequence
  Description of Artificial Sequence: Synthetic oligonucleotide
  Target: ATXN1; (+) strand; PAM type: NRG; PAM sequence: GGG
ttctccaataaaacaaacca

SEQ ID NO: 127583 - DNA, 20 bp, Artificial Sequence
  Description of Artificial Sequence: Synthetic oligonucleotide
  Target: ATXN1; (+) strand; PAM type: NRG; PAM sequence: GGG
tctccaataaaacaaaccag

SEQ ID NO: 127584 - DNA, 20 bp, Artificial Sequence
  Description of Artificial Sequence: Synthetic oligonucleotide
  Target: ATXN1; (+) strand; PAM type: NRG; PAM sequence: TGG
taaaacaaaccaggggtctt

SEQ ID NO: 127585 - DNA, 20 bp, Artificial Sequence
  Description of Artificial Sequence: Synthetic oligonucleotide
  Target: ATXN1; (+) strand; PAM type: NRG; PAM sequence: GAG
aaacaaaccaggggtctttg

SEQ ID NO: 127586 - DNA, 20 bp, Artificial Sequence
  Description of Artificial Sequence: Synthetic oligonucleotide
  Target: ATXN1; (+) strand; PAM type: NRG; PAM sequence: TGG
accaggggtctttggagaaa

SEQ ID NO: 127587 - DNA, 20 bp, Artificial Sequence
  Description of Artificial Sequence: Synthetic oligonucleotide
  Target: ATXN1; (+) strand; PAM type: NRG; PAM sequence: TAG
tttggagaaatggctgattc

SEQ ID NO: 127588 - DNA, 20 bp, Artificial Sequence
  Description of Artificial Sequence: Synthetic oligonucleotide
  Target: ATXN1; (+) strand; PAM type: NRG; PAM sequence: CAG
ggctgattctagtactgtga

SEQ ID NO: 127589 - DNA, 20 bp, Artificial Sequence
  Description of Artificial Sequence: Synthetic oligonucleotide
  Target: ATXN1; (+) strand; PAM type: NRG; PAM sequence: AGG
gctgattctagtactgtgac

SEQ ID NO: 127590 - DNA, 20 bp, Artificial Sequence
  Description of Artificial Sequence: Synthetic oligonucleotide
  Target: ATXN1; (+) strand; PAM type: NRG; PAM sequence: GGG
ctgattctagtactgtgaca

SEQ ID NO: 127591 - DNA, 20 bp, Artificial Sequence
  Description of Artificial Sequence: Synthetic oligonucleotide
  Target: ATXN1; (+) strand; PAM type: NRG; PAM sequence: AAG
tactgtgacagggaatatcc

SEQ ID NO: 127592 - DNA, 20 bp, Artificial Sequence
  Description of Artificial Sequence: Synthetic oligonucleotide
  Target: ATXN1; (+) strand; PAM type: NRG; PAM sequence: GAG
tgacagggaatatccaagat

SEQ ID NO: 127593 - DNA, 20 bp, Artificial Sequence
  Description of Artificial Sequence: Synthetic oligonucleotide
  Target: ATXN1; (+) strand; PAM type: NRG; PAM sequence: TGG
gggaatatccaagatgagca

SEQ ID NO: 127594 - DNA, 20 bp, Artificial Sequence
  Description of Artificial Sequence: Synthetic oligonucleotide
  Target: ATXN1; (+) strand; PAM type: NRG; PAM sequence: GAG
gaatatccaagatgagcatg

SEQ ID NO: 127595 - DNA, 20 bp, Artificial Sequence
  Description of Artificial Sequence: Synthetic oligonucleotide
  Target: ATXN1; (+) strand; PAM type: NRG; PAM sequence: TAG
gatgagcatggagcatcttg

SEQ ID NO: 127596 - DNA, 20 bp, Artificial Sequence
  Description of Artificial Sequence: Synthetic oligonucleotide
  Target: ATXN1; (+) strand; PAM type: NRG; PAM sequence: CAG
catggagcatcttgtagtat

SEQ ID NO: 127597 - DNA, 20 bp, Artificial Sequence
  Description of Artificial Sequence: Synthetic oligonucleotide
  Target: ATXN1; (+) strand; PAM type: NRG; PAM sequence: AAG
gagcatcttgtagtatcaga

SEQ ID NO: 127598 - DNA, 20 bp, Artificial Sequence
  Description of Artificial Sequence: Synthetic oligonucleotide
  Target: ATXN1; (+) strand; PAM type: NRG; PAM sequence: TGG
catcttgtagtatcagaaag

SEQ ID NO: 127599 - DNA, 20 bp, Artificial Sequence
  Description of Artificial Sequence: Synthetic oligonucleotide
  Target: ATXN1; (+) strand; PAM type: NRG; PAM sequence: GGG
atcttgtagtatcagaaagt

SEQ ID NO: 127600 - DNA, 20 bp, Artificial Sequence
  Description of Artificial Sequence: Synthetic oligonucleotide
  Target: ATXN1; (+) strand; PAM type: NRG; PAM sequence: TAG
gaaagtgggaaaatgctaaa

SEQ ID NO: 127601 - DNA, 20 bp, Artificial Sequence
  Description of Artificial Sequence: Synthetic oligonucleotide
  Target: ATXN1; (+) strand; PAM type: NRG; PAM sequence: CAG
atagataaatcaatacccca

SEQ ID NO: 127602 - DNA, 20 bp, Artificial Sequence
  Description of Artificial Sequence: Synthetic oligonucleotide
  Target: ATXN1; (+) strand; PAM type: NRG; PAM sequence: TGG
aaatcaataccccacagtga

SEQ ID NO: 127603 - DNA, 20 bp, Artificial Sequence
  Description of Artificial Sequence: Synthetic oligonucleotide
  Target: ATXN1; (+) strand; PAM type: NRG; PAM sequence: GGG
aatcaataccccacagtgat

SEQ ID NO: 127604 - DNA, 20 bp, Artificial Sequence
  Description of Artificial Sequence: Synthetic oligonucleotide
  Target: ATXN1; (+) strand; PAM type: NRG; PAM sequence: GGG
atcaataccccacagtgatg

SEQ ID NO: 127605 - DNA, 20 bp, Artificial Sequence
  Description of Artificial Sequence: Synthetic oligonucleotide
  Target: ATXN1; (+) strand; PAM type: NRG; PAM sequence: GGG
tcaataccccacagtgatgg

SEQ ID NO: 127606 - DNA, 20 bp, Artificial Sequence
  Description of Artificial Sequence: Synthetic oligonucleotide
  Target: ATXN1; (+) strand; PAM type: NRG; PAM sequence: AAG
acagtgatgggggcatataa

SEQ ID NO: 127607 - DNA, 20 bp, Artificial Sequence
  Description of Artificial Sequence: Synthetic oligonucleotide
  Target: ATXN1; (+) strand; PAM type: NRG; PAM sequence: AGG
cagtgatgggggcatataaa

SEQ ID NO: 127608 - DNA, 20 bp, Artificial Sequence
  Description of Artificial Sequence: Synthetic oligonucleotide
  Target: ATXN1; (+) strand; PAM type: NRG; PAM sequence: GGG
agtgatgggggcatataaaa

SEQ ID NO: 127609 - DNA, 20 bp, Artificial Sequence
  Description of Artificial Sequence: Synthetic oligonucleotide
  Target: ATXN1; (+) strand; PAM type: NRG; PAM sequence: GGG
gtgatgggggcatataaaag

SEQ ID NO: 127610 - DNA, 20 bp, Artificial Sequence
  Description of Artificial Sequence: Synthetic oligonucleotide
  Target: ATXN1; (+) strand; PAM type: NRG; PAM sequence: GGG
tgatgggggcatataaaagg

SEQ ID NO: 127611 - DNA, 20 bp, Artificial Sequence
  Description of Artificial Sequence: Synthetic oligonucleotide
  Target: ATXN1; (+) strand; PAM type: NRG; PAM sequence: AAG
ggggcatataaaagggggac

SEQ ID NO: 127612 - DNA, 20 bp, Artificial Sequence
  Description of Artificial Sequence: Synthetic oligonucleotide
  Target: ATXN1; (+) strand; PAM type: NRG; PAM sequence: GAG
ggcatataaaagggggacaa

SEQ ID NO: 127613 - DNA, 20 bp, Artificial Sequence
  Description of Artificial Sequence: Synthetic oligonucleotide
  Target: ATXN1; (+) strand; PAM type: NRG; PAM sequence: AAG
aatattcctaatatttctca

SEQ ID NO: 127614 - DNA, 20 bp, Artificial Sequence
  Description of Artificial Sequence: Synthetic oligonucleotide
  Target: ATXN1; (+) strand; PAM type: NRG; PAM sequence: GAG
tattcctaatatttctcaaa

SEQ ID NO: 127615 - DNA, 20 bp, Artificial Sequence
  Description of Artificial Sequence: Synthetic oligonucleotide
  Target: ATXN1; (+) strand; PAM type: NRG; PAM sequence: TGG
atttctcaaagagctgccaa

SEQ ID NO: 127616 - DNA, 20 bp, Artificial Sequence
  Description of Artificial Sequence: Synthetic oligonucleotide
  Target: ATXN1; (+) strand; PAM type: NRG; PAM sequence: CAG
ctcaaagagctgccaatggc

SEQ ID NO: 127617 - DNA, 20 bp, Artificial Sequence
  Description of Artificial Sequence: Synthetic oligonucleotide
  Target: ATXN1; (+) strand; PAM type: NRG; PAM sequence: CAG
atggccagaactaaaacaac

SEQ ID NO: 127618 - DNA, 20 bp, Artificial Sequence
  Description of Artificial Sequence: Synthetic oligonucleotide
  Target: ATXN1; (+) strand; PAM type: NRG; PAM sequence: GAG
ggccagaactaaaacaacca

SEQ ID NO: 127619 - DNA, 20 bp, Artificial Sequence
  Description of Artificial Sequence: Synthetic oligonucleotide
  Target: ATXN1; (+) strand; PAM type: NRG; PAM sequence: TAG
gagcaacaaaataaacaaca

SEQ ID NO: 127620 - DNA, 20 bp, Artificial Sequence
  Description of Artificial Sequence: Synthetic oligonucleotide
  Target: ATXN1; (+) strand; PAM type: NRG; PAM sequence: TGG
caaaataaacaacatagtac

SEQ ID NO: 127621 - DNA, 20 bp, Artificial Sequence
  Description of Artificial Sequence: Synthetic oligonucleotide
  Target: ATXN1; (+) strand; PAM type: NRG; PAM sequence: TAG
taaacaacatagtactggat

SEQ ID NO: 127622 - DNA, 20 bp, Artificial Sequence
  Description of Artificial Sequence: Synthetic oligonucleotide
  Target: ATXN1; (+) strand; PAM type: NRG; PAM sequence: AAG
tagtactggattagaaccta

SEQ ID NO: 127623 - DNA, 20 bp, Artificial Sequence
  Description of Artificial Sequence: Synthetic oligonucleotide
  Target: ATXN1; (+) strand; PAM type: NRG; PAM sequence: GAG
agaataaaataaacacccat

SEQ ID NO: 127624 - DNA, 20 bp, Artificial Sequence
  Description of Artificial Sequence: Synthetic oligonucleotide
  Target: ATXN1; (+) strand; PAM type: NRG; PAM sequence: AAG
ttgatataaataaattttaa

SEQ ID NO: 127625 - DNA, 20 bp, Artificial Sequence
  Description of Artificial Sequence: Synthetic oligonucleotide
  Target: ATXN1; (+) strand; PAM type: NRG; PAM sequence: GAG
gatataaataaattttaaaa

SEQ ID NO: 127626 - DNA, 20 bp, Artificial Sequence
  Description of Artificial Sequence: Synthetic oligonucleotide
  Target: ATXN1; (+) strand; PAM type: NRG; PAM sequence: AGG
atataaataaattttaaaag

SEQ ID NO: 127627 - DNA, 20 bp, Artificial Sequence
  Description of Artificial Sequence: Synthetic oligonucleotide
  Target: ATXN1; (+) strand; PAM type: NRG; PAM sequence: AAG
taaataaattttaaaagagg

SEQ ID NO: 127628 - DNA, 20 bp, Artificial Sequence
  Description of Artificial Sequence: Synthetic oligonucleotide
  Target: ATXN1; (+) strand; PAM type: NRG; PAM sequence: GAG
gaagaaaacacgcatctctt

SEQ ID NO: 127629 - DNA, 20 bp, Artificial Sequence
  Description of Artificial Sequence: Synthetic oligonucleotide
  Target: ATXN1; (+) strand; PAM type: NRG; PAM sequence: AAG
aaacacgcatctcttgagca

SEQ ID NO: 127630 - DNA, 20 bp, Artificial Sequence
  Description of Artificial Sequence: Synthetic oligonucleotide
  Target: ATXN1; (+) strand; PAM type: NRG; PAM sequence: AGG
aacacgcatctcttgagcaa

SEQ ID NO: 127631 - DNA, 20 bp, Artificial Sequence
  Description of Artificial Sequence: Synthetic oligonucleotide
  Target: ATXN1; (+) strand; PAM type: NRG; PAM sequence: GAG
cacgcatctcttgagcaaag

SEQ ID NO: 127632 - DNA, 20 bp, Artificial Sequence
  Description of Artificial Sequence: Synthetic oligonucleotide
  Target: ATXN1; (+) strand; PAM type: NRG; PAM sequence: CAG
ggagttctaaataattcatg

SEQ ID NO: 127633 - DNA, 20 bp, Artificial Sequence
  Description of Artificial Sequence: Synthetic oligonucleotide
  Target: ATXN1; (+) strand; PAM type: NRG; PAM sequence: AAG
gcagatgttctgcccttgta

SEQ ID NO: 127634 - DNA, 20 bp, Artificial Sequence
  Description of Artificial Sequence: Synthetic oligonucleotide
  Target: ATXN1; (+) strand; PAM type: NRG; PAM sequence: AGG
cagatgttctgcccttgtaa

SEQ ID NO: 127635 - DNA, 20 bp, Artificial Sequence
  Description of Artificial Sequence: Synthetic oligonucleotide
  Target: ATXN1; (+) strand; PAM type: NRG; PAM sequence: TAG
atgttctgcccttgtaaagg

SEQ ID NO: 127636 - DNA, 20 bp, Artificial Sequence
  Description of Artificial Sequence: Synthetic oligonucleotide
  Target: ATXN1; (+) strand; PAM type: NRG; PAM sequence: GAG
gttctgcccttgtaaaggta

SEQ ID NO: 127637 - DNA, 20 bp, Artificial Sequence
  Description of Artificial Sequence: Synthetic oligonucleotide
  Target: ATXN1; (+) strand; PAM type: NRG; PAM sequence: AAG
agcgtaactgcccacccctt

SEQ ID NO: 127638 - DNA, 20 bp, Artificial Sequence
  Description of Artificial Sequence: Synthetic oligonucleotide
  Target: ATXN1; (+) strand; PAM type: NRG; PAM sequence: TGG
aactgcccaccccttaagtg

SEQ ID NO: 127639 - DNA, 20 bp, Artificial Sequence
  Description of Artificial Sequence: Synthetic oligonucleotide
  Target: ATXN1; (+) strand; PAM type: NRG; PAM sequence: GGG
actgcccaccccttaagtgt

SEQ ID NO: 127640 - DNA, 20 bp, Artificial Sequence
  Description of Artificial Sequence: Synthetic oligonucleotide
  Target: ATXN1; (+) strand; PAM type: NRG; PAM sequence: CAG
ccttaagtgtgggctgtgca

SEQ ID NO: 127641 - DNA, 20 bp, Artificial Sequence
  Description of Artificial Sequence: Synthetic oligonucleotide
  Target: ATXN1; (+) strand; PAM type: NRG; PAM sequence: GAG
cacagtgacttccttccaac

SEQ ID NO: 127642 - DNA, 20 bp, Artificial Sequence
  Description of Artificial Sequence: Synthetic oligonucleotide
  Target: ATXN1; (+) strand; PAM type: NRG; PAM sequence: TAG
agtgacttccttccaacgag

SEQ ID NO: 127643 - DNA, 20 bp, Artificial Sequence
  Description of Artificial Sequence: Synthetic oligonucleotide
  Target: ATXN1; (+) strand; PAM type: NRG; PAM sequence: CAG
cttccttccaacgagtagta

SEQ ID NO: 127644 - DNA, 20 bp, Artificial Sequence
  Description of Artificial Sequence: Synthetic oligonucleotide
  Target: ATXN1; (+) strand; PAM type: NRG; PAM sequence: TGG
ttccaacgagtagtacagta

SEQ ID NO: 127645 - DNA, 20 bp, Artificial Sequence
  Description of Artificial Sequence: Synthetic oligonucleotide
  Target: ATXN1; (+) strand; PAM type: NRG; PAM sequence: AAG
acgagtagtacagtatggaa

SEQ ID NO: 127646 - DNA, 20 bp, Artificial Sequence
  Description of Artificial Sequence: Synthetic oligonucleotide
  Target: ATXN1; (+) strand; PAM type: NRG; PAM sequence: AGG
cgagtagtacagtatggaaa

SEQ ID NO: 127647 - DNA, 20 bp, Artificial Sequence
  Description of Artificial Sequence: Synthetic oligonucleotide
  Target: ATXN1; (+) strand; PAM type: NRG; PAM sequence: GGG
gagtagtacagtatggaaaa

SEQ ID NO: 127648 - DNA, 20 bp, Artificial Sequence
  Description of Artificial Sequence: Synthetic oligonucleotide
  Target: ATXN1; (+) strand; PAM type: NRG; PAM sequence: GAG
gtatggaaaagggtgtgtgt

SEQ ID NO: 127649 - DNA, 20 bp, Artificial Sequence
  Description of Artificial Sequence: Synthetic oligonucleotide
  Target: ATXN1; (+) strand; PAM type: NRG; PAM sequence: AAG
tgtgagtgtgtctgtgtaca

SEQ ID NO: 127650 - DNA, 20 bp, Artificial Sequence
  Description of Artificial Sequence: Synthetic oligonucleotide
  Target: ATXN1; (+) strand; PAM type: NRG; PAM sequence: GAG
tgagtgtgtctgtgtacaaa

SEQ ID NO: 127651 - DNA, 20 bp, Artificial Sequence
  Description of Artificial Sequence: Synthetic oligonucleotide
  Target: ATXN1; (+) strand; PAM type: NRG; PAM sequence: AAG
gtgtacaaagagtaacttta

SEQ ID NO: 127652 - DNA, 20 bp, Artificial Sequence
  Description of Artificial Sequence: Synthetic oligonucleotide
  Target: ATXN1; (+) strand; PAM type: NRG; PAM sequence: CGG
gacaaaccctgacacaacct

SEQ ID NO: 127653 - DNA, 20 bp, Artificial Sequence
  Description of Artificial Sequence: Synthetic oligonucleotide
  Target: ATXN1; (+) strand; PAM type: NRG; PAM sequence: GAG
accctgacacaacctcggct

SEQ ID NO: 127654 - DNA, 20 bp, Artificial Sequence
  Description of Artificial Sequence: Synthetic oligonucleotide
  Target: ATXN1; (+) strand; PAM type: NRG; PAM sequence: AGG
ccctgacacaacctcggctg

SEQ ID NO: 127655 - DNA, 20 bp, Artificial Sequence
  Description of Artificial Sequence: Synthetic oligonucleotide
  Target: ATXN1; (+) strand; PAM type: NRG; PAM sequence: AAG
caacctcggctgaggtcatc

SEQ ID NO: 127656 - DNA, 20 bp, Artificial Sequence
  Description of Artificial Sequence: Synthetic oligonucleotide
  Target: ATXN1; (+) strand; PAM type: NRG; PAM sequence: CAG
gctgaggtcatcaagatcaa

SEQ ID NO: 127657 - DNA, 20 bp, Artificial Sequence
  Description of Artificial Sequence: Synthetic oligonucleotide
  Target: ATXN1; (+) strand; PAM type: NRG; PAM sequence: TAG
tcaagatcaacagcccatga

SEQ ID NO: 127658 - DNA, 20 bp, Artificial Sequence
  Description of Artificial Sequence: Synthetic oligonucleotide
  Target: ATXN1; (+) strand; PAM type: NRG; PAM sequence: AGG
caagatcaacagcccatgat

SEQ ID NO: 127659 - DNA, 20 bp, Artificial Sequence
  Description of Artificial Sequence: Synthetic oligonucleotide
  Target: ATXN1; (+) strand; PAM type: NRG; PAM sequence: AAG
ggtcacatatgatgtgataa

SEQ ID NO: 127660 - DNA, 20 bp, Artificial Sequence
  Description of Artificial Sequence: Synthetic oligonucleotide
  Target: ATXN1; (+) strand; PAM type: NRG; PAM sequence: AAG
agtgacaatctgccaatttt

SEQ ID NO: 127661 - DNA, 20 bp, Artificial Sequence
  Description of Artificial Sequence: Synthetic oligonucleotide
  Target: ATXN1; (+) strand; PAM type: NRG; PAM sequence: AGG
gtgacaatctgccaatttta

SEQ ID NO: 127662 - DNA, 20 bp, Artificial Sequence
  Description of Artificial Sequence: Synthetic oligonucleotide
  Target: ATXN1; (+) strand; PAM type: NRG; PAM sequence: GAG
gacaatctgccaattttaag

SEQ ID NO: 127663 - DNA, 20 bp, Artificial Sequence
  Description of Artificial Sequence: Synthetic oligonucleotide
  Target: ATXN1; (+) strand; PAM type: NRG; PAM sequence: CAG
tctgccaattttaaggagta

SEQ ID NO: 127664 - DNA, 20 bp, Artificial Sequence
  Description of Artificial Sequence: Synthetic oligonucleotide
  Target: ATXN1; (+) strand; PAM type: NRG; PAM sequence: TGG
agtacagactaatcattttg

SEQ ID NO: 127665 - DNA, 20 bp, Artificial Sequence
  Description of Artificial Sequence: Synthetic oligonucleotide
  Target: ATXN1; (+) strand; PAM type: NRG; PAM sequence: TGG
ttgtggactgtccctcaatt

SEQ ID NO: 127666 - DNA, 20 bp, Artificial Sequence
  Description of Artificial Sequence: Synthetic oligonucleotide
  Target: ATXN1; (+) strand; PAM type: NRG; PAM sequence: GGG
tgtggactgtccctcaattt

SEQ ID NO: 127667 - DNA, 20 bp, Artificial Sequence
  Description of Artificial Sequence: Synthetic oligonucleotide
  Target: ATXN1; (+) strand; PAM type: NRG; PAM sequence: TGG
tccctcaatttgggtttttc

SEQ ID NO: 127668 - DNA, 20 bp, Artificial Sequence
  Description of Artificial Sequence: Synthetic oligonucleotide
  Target: ATXN1; (+) strand; PAM type: NRG; PAM sequence: CAG
tcaatttgggtttttctggc

SEQ ID NO: 127669 - DNA, 20 bp, Artificial Sequence
  Description of Artificial Sequence: Synthetic oligonucleotide
  Target: ATXN1; (+) strand; PAM type: NRG; PAM sequence: AGG
caatttgggtttttctggcc

SEQ ID NO: 127670 - DNA, 20 bp, Artificial Sequence
  Description of Artificial Sequence: Synthetic oligonucleotide
  Target: ATXN1; (+) strand; PAM type: NRG; PAM sequence: TGG
tgggtttttctggccaggca

SEQ ID NO: 127671 - DNA, 20 bp, Artificial Sequence
  Description of Artificial Sequence: Synthetic oligonucleotide
  Target: ATXN1; (+) strand; PAM type: NRG; PAM sequence: TGG
tttttctggccaggcatggt

SEQ ID NO: 127672 - DNA, 20 bp, Artificial Sequence
  Description of Artificial Sequence: Synthetic oligonucleotide
  Target: ATXN1; (+) strand; PAM type: NRG; PAM sequence: CAG
ttggctcacgcctgtaatcc

SEQ ID NO: 127673 - DNA, 20 bp, Artificial Sequence
  Description of Artificial Sequence: Synthetic oligonucleotide
  Target: ATXN1; (+) strand; PAM type: NRG; PAM sequence: TGG
cctgtaatcccagcactttg

SEQ ID NO: 127674 - DNA, 20 bp, Artificial Sequence
  Description of Artificial Sequence: Synthetic oligonucleotide
  Target: ATXN1; (+) strand; PAM type: NRG; PAM sequence: GGG
ctgtaatcccagcactttgt

SEQ ID NO: 127675 - DNA, 20 bp, Artificial Sequence
  Description of Artificial Sequence: Synthetic oligonucleotide
  Target: ATXN1; (+) strand; PAM type: NRG; PAM sequence: GGG
tgtaatcccagcactttgtg

SEQ ID NO: 127676 - DNA, 20 bp, Artificial Sequence
  Description of Artificial Sequence: Synthetic oligonucleotide
  Target: ATXN1; (+) strand; PAM type: NRG; PAM sequence: AAG
cccagcactttgtggggcca

SEQ ID NO: 127677 - DNA, 20 bp, Artificial Sequence
  Description of Artificial Sequence: Synthetic oligonucleotide
  Target: ATXN1; (+) strand; PAM type: NRG; PAM sequence: GAG
cagcactttgtggggccaaa

SEQ ID NO: 127678 - DNA, 20 bp, Artificial Sequence
  Description of Artificial Sequence: Synthetic oligonucleotide
  Target: ATXN1; (+) strand; PAM type: NRG; PAM sequence: AGG
agcactttgtggggccaaag

SEQ ID NO: 127679 - DNA, 20 bp, Artificial Sequence
  Description of Artificial Sequence: Synthetic oligonucleotide
  Target: ATXN1; (+) strand; PAM type: NRG; PAM sequence: GGG
gcactttgtggggccaaaga

SEQ ID NO: 127680 - DNA, 20 bp, Artificial Sequence
  Description of Artificial Sequence: Synthetic oligonucleotide
  Target: ATXN1; (+) strand; PAM type: NRG; PAM sequence: TGG
ctttgtggggccaaagaggg

SEQ ID NO: 127681 - DNA, 20 bp, Artificial Sequence
  Description of Artificial Sequence: Synthetic oligonucleotide
  Target: ATXN1; (+) strand; PAM type: NRG; PAM sequence: GAG
ccaaagagggtggatcactt

SEQ ID NO: 127682 - DNA, 20 bp, Artificial Sequence
  Description of Artificial Sequence: Synthetic oligonucleotide
  Target: ATXN1; (+) strand; PAM type: NRG; PAM sequence: CAG
gagggtggatcacttgagcc

SEQ ID NO: 127683 - DNA, 20 bp, Artificial Sequence
  Description of Artificial Sequence: Synthetic oligonucleotide
  Target: ATXN1; (+) strand; PAM type: NRG; PAM sequence: AAG
ggtggatcacttgagcccag

SEQ ID NO: 127684 - DNA, 20 bp, Artificial Sequence
  Description of Artificial Sequence: Synthetic oligonucleotide
  Target: ATXN1; (+) strand; PAM type: NRG; PAM sequence: CAG
tgagcccagaagtttgacac

SEQ ID NO: 127685 - DNA, 20 bp, Artificial Sequence
  Description of Artificial Sequence: Synthetic oligonucleotide
  Target: ATXN1; (+) strand; PAM type: NRG; PAM sequence: TGG
ccagaagtttgacaccagcc

SEQ ID NO: 127686 - DNA, 20 bp, Artificial Sequence
  Description of Artificial Sequence: Synthetic oligonucleotide
  Target: ATXN1; (+) strand; PAM type: NRG; PAM sequence: TAG
ccaaaaaccaaaaaccaaat

SEQ ID NO: 127687 - DNA, 20 bp, Artificial Sequence
  Description of Artificial Sequence: Synthetic oligonucleotide
  Target: ATXN1; (+) strand; PAM type: NRG; PAM sequence: TGG
aaaccaaaaaccaaattagc

SEQ ID NO: 127688 - DNA, 20 bp, Artificial Sequence
  Description of Artificial Sequence: Synthetic oligonucleotide
  Target: ATXN1; (+) strand; PAM type: NRG; PAM sequence: TGG
aaaaccaaattagctggatg

SEQ ID NO: 127689 - DNA, 20 bp, Artificial Sequence
  Description of Artificial Sequence: Synthetic oligonucleotide
  Target: ATXN1; (+) strand; PAM type: NRG; PAM sequence: TAG
accaaattagctggatgtgg

SEQ ID NO: 127690 - DNA, 20 bp, Artificial Sequence
  Description of Artificial Sequence: Synthetic oligonucleotide
  Target: ATXN1; (+) strand; PAM type: NRG; PAM sequence: TAG
gatgtggtagcctatgcctg

SEQ ID NO: 127691 - DNA, 20 bp, Artificial Sequence
  Description of Artificial Sequence: Synthetic oligonucleotide
  Target: ATXN1; (+) strand; PAM type: NRG; PAM sequence: CAG
gtagcctatgcctgtagtcc

SEQ ID NO: 127692 - DNA, 20 bp, Artificial Sequence
  Description of Artificial Sequence: Synthetic oligonucleotide
  Target: ATXN1; (+) strand; PAM type: NRG; PAM sequence: CAG
tgcctgtagtcccagctact

SEQ ID NO: 127693 - DNA, 20 bp, Artificial Sequence
  Description of Artificial Sequence: Synthetic oligonucleotide
  Target: ATXN1; (+) strand; PAM type: NRG; PAM sequence: AGG
gcctgtagtcccagctactc

SEQ ID NO: 127694 - DNA, 20 bp, Artificial Sequence
  Description of Artificial Sequence: Synthetic oligonucleotide
  Target: ATXN1; (+) strand; PAM type: NRG; PAM sequence: GGG
cctgtagtcccagctactca

SEQ ID NO: 127695 - DNA, 20 bp, Artificial Sequence
  Description of Artificial Sequence: Synthetic oligonucleotide
  Target: ATXN1; (+) strand; PAM type: NRG; PAM sequence: GGG
ctgtagtcccagctactcag

SEQ ID NO: 127696 - DNA, 20 bp, Artificial Sequence
  Description of Artificial Sequence: Synthetic oligonucleotide
  Target: ATXN1; (+) strand; PAM type: NRG; PAM sequence: GGG
tgtagtcccagctactcagg

SEQ ID NO: 127697 - DNA, 20 bp, Artificial Sequence
  Description of Artificial Sequence: Synthetic oligonucleotide
  Target: ATXN1; (+) strand; PAM type: NRG; PAM sequence: AAG
tcccagctactcagggggct

SEQ ID NO: 127698 - DNA, 20 bp, Artificial Sequence
  Description of Artificial Sequence: Synthetic oligonucleotide
  Target: ATXN1; (+) strand; PAM type: NRG; PAM sequence: TGG
agctactcagggggctaaga

SEQ ID NO: 127699 - DNA, 20 bp, Artificial Sequence
  Description of Artificial Sequence: Synthetic oligonucleotide
  Target: ATXN1; (+) strand; PAM type: NRG; PAM sequence: GGG
gctactcagggggctaagat

SEQ ID NO: 127700 - DNA, 20 bp, Artificial Sequence
  Description of Artificial Sequence: Synthetic oligonucleotide
  Target: ATXN1; (+) strand; PAM type: NRG; PAM sequence: GAG
tactcagggggctaagatgg

SEQ ID NO: 127701 - DNA, 20 bp, Artificial Sequence
  Description of Artificial Sequence: Synthetic oligonucleotide
  Target: ATXN1; (+) strand; PAM type: NRG; PAM sequence: AGG
actcagggggctaagatggg

SEQ ID NO: 127702 - DNA, 20 bp, Artificial Sequence
  Description of Artificial Sequence: Synthetic oligonucleotide
  Target: ATXN1; (+) strand; PAM type: NRG; PAM sequence: AAG
ctaagatgggaggattgctt

SEQ ID NO: 127703 - DNA, 20 bp, Artificial Sequence
  Description of Artificial Sequence: Synthetic oligonucleotide
  Target: ATXN1; (+) strand; PAM type: NRG; PAM sequence: AAG
ggaggattgcttaagccccg

SEQ ID NO: 127704 - DNA, 20 bp, Artificial Sequence
  Description of Artificial Sequence: Synthetic oligonucleotide
  Target: ATXN1; (+) strand; PAM type: NRG; PAM sequence: AGG
gaggattgcttaagccccga

SEQ ID NO: 127705 - DNA, 20 bp, Artificial Sequence
  Description of Artificial Sequence: Synthetic oligonucleotide
  Target: ATXN1; (+) strand; PAM type: NRG; PAM sequence: CAG
ttgcttaagccccgaaggtc

SEQ ID NO: 127706 - DNA, 20 bp, Artificial Sequence
  Description of Artificial Sequence: Synthetic oligonucleotide
  Target: ATXN1; (+) strand; PAM type: NRG; PAM sequence: CAG
agccccgaaggtccagtctg

SEQ ID NO: 127707 - DNA, 20 bp, Artificial Sequence
  Description of Artificial Sequence: Synthetic oligonucleotide
  Target: ATXN1; (+) strand; PAM type: NRG; PAM sequence: GAG
ccgaaggtccagtctgcagt

SEQ ID NO: 127708 - DNA, 20 bp, Artificial Sequence
  Description of Artificial Sequence: Synthetic oligonucleotide
  Target: ATXN1; (+) strand; PAM type: NRG; PAM sequence: GAG
ggtccagtctgcagtgagct

SEQ ID NO: 127709 - DNA, 20 bp, Artificial Sequence
  Description of Artificial Sequence: Synthetic oligonucleotide
  Target: ATXN1; (+) strand; PAM type: NRG; PAM sequence: TGG
cgtaccactgcactccaacc

SEQ ID NO: 127710 - DNA, 20 bp, Artificial Sequence
  Description of Artificial Sequence: Synthetic oligonucleotide
  Target: ATXN1; (+) strand; PAM type: NRG; PAM sequence: GGG
gtaccactgcactccaacct

SEQ ID NO: 127711 - DNA, 20 bp, Artificial Sequence
  Description of Artificial Sequence: Synthetic oligonucleotide
  Target: ATXN1; (+) strand; PAM type: NRG; PAM sequence: CAG
ctgcactccaacctgggcga

SEQ ID NO: 127712 - DNA, 20 bp, Artificial Sequence
  Description of Artificial Sequence: Synthetic oligonucleotide
  Target: ATXN1; (+) strand; PAM type: NRG; PAM sequence: GAG
gcactccaacctgggcgaca

SEQ ID NO: 127713 - DNA, 20 bp, Artificial Sequence
  Description of Artificial Sequence: Synthetic oligonucleotide
  Target: ATXN1; (+) strand; PAM type: NRG; PAM sequence: GAG
tccaacctgggcgacagagt

SEQ ID NO: 127714 - DNA, 20 bp, Artificial Sequence
  Description of Artificial Sequence: Synthetic oligonucleotide
  Target: ATXN1; (+) strand; PAM type: NRG; PAM sequence: TAG
ctcaacaataataataataa

SEQ ID NO: 127715 - DNA, 20 bp, Artificial Sequence
  Description of Artificial Sequence: Synthetic oligonucleotide
  Target: ATXN1; (+) strand; PAM type: NRG; PAM sequence: AAG
ataaaataaaatttacctaa

SEQ ID NO: 127716 - DNA, 20 bp, Artificial Sequence
  Description of Artificial Sequence: Synthetic oligonucleotide
  Target: ATXN1; (+) strand; PAM type: NRG; PAM sequence: AAG
aataaaatttacctaaaagc

SEQ ID NO: 127717 - DNA, 20 bp, Artificial Sequence
  Description of Artificial Sequence: Synthetic oligonucleotide
  Target: ATXN1; (+) strand; PAM type: NRG; PAM sequence: AAG
ttacctaaaagcaagaacta

SEQ ID NO: 127718 - DNA, 20 bp, Artificial Sequence
  Description of Artificial Sequence: Synthetic oligonucleotide
  Target: ATXN1; (+) strand; PAM type: NRG; PAM sequence: GAG
gccaatattttattttgatt

SEQ ID NO: 127719 - DNA, 20 bp, Artificial Sequence
  Description of Artificial Sequence: Synthetic oligonucleotide
  Target: ATXN1; (+) strand; PAM type: NRG; PAM sequence: TAG
gagtaatgatacacaataac

SEQ ID NO: 127720 - DNA, 20 bp, Artificial Sequence
  Description of Artificial Sequence: Synthetic oligonucleotide
  Target: ATXN1; (+) strand; PAM type: NRG; PAM sequence: AAG
atacacaataactagtcttg

SEQ ID NO: 127721 - DNA, 20 bp, Artificial Sequence
  Description of Artificial Sequence: Synthetic oligonucleotide
  Target: ATXN1; (+) strand; PAM type: NRG; PAM sequence: AGG
tacacaataactagtcttga

SEQ ID NO: 127722 - DNA, 20 bp, Artificial Sequence
  Description of Artificial Sequence: Synthetic oligonucleotide
  Target: ATXN1; (+) strand; PAM type: NRG; PAM sequence: GGG
acacaataactagtcttgaa

SEQ ID NO: 127723 - DNA, 20 bp, Artificial Sequence
  Description of Artificial Sequence: Synthetic oligonucleotide
  Target: ATXN1; (+) strand; PAM type: NRG; PAM sequence: TGG
gggcatcaactaaaacatga

SEQ ID NO: 127724 - DNA, 20 bp, Artificial Sequence
  Description of Artificial Sequence: Synthetic oligonucleotide
  Target: ATXN1; (+) strand; PAM type: NRG; PAM sequence: CAG
aactaaaacatgatggactg

SEQ ID NO: 127725 - DNA, 20 bp, Artificial Sequence
  Description of Artificial Sequence: Synthetic oligonucleotide
  Target: ATXN1; (+) strand; PAM type: NRG; PAM sequence: AGG
actaaaacatgatggactgc

SEQ ID NO: 127726 - DNA, 20 bp, Artificial Sequence
  Description of Artificial Sequence: Synthetic oligonucleotide
  Target: ATXN1; (+) strand; PAM type: NRG; PAM sequence: TGG
aaacatgatggactgcagga

SEQ ID NO: 127727 - DNA, 20 bp, Artificial Sequence
  Description of Artificial Sequence: Synthetic oligonucleotide
  Target: ATXN1; (+) strand; PAM type: NRG; PAM sequence: CAG
atgatggactgcaggatgga

SEQ ID NO: 127728 - DNA, 20 bp, Artificial Sequence
  Description of Artificial Sequence: Synthetic oligonucleotide
  Target: ATXN1; (+) strand; PAM type: NRG; PAM sequence: TGG
tggactgcaggatggacaga

SEQ ID NO: 127729 - DNA, 20 bp, Artificial Sequence
  Description of Artificial Sequence: Synthetic oligonucleotide
  Target: ATXN1; (+) strand; PAM type: NRG; PAM sequence: AAG
agatggcttgatacctgaca

SEQ ID NO: 127730 - DNA, 20 bp, Artificial Sequence
  Description of Artificial Sequence: Synthetic oligonucleotide
  Target: ATXN1; (+) strand; PAM type: NRG; PAM sequence: TAG
gatacctgacaaagcaaata

SEQ ID NO: 127731 - DNA, 20 bp, Artificial Sequence
  Description of Artificial Sequence: Synthetic oligonucleotide
  Target: ATXN1; (+) strand; PAM type: NRG; PAM sequence: TAG
aaaatattatttgcaaaatc

SEQ ID NO: 127732 - DNA, 20 bp, Artificial Sequence
  Description of Artificial Sequence: Synthetic oligonucleotide
  Target: ATXN1; (+) strand; PAM type: NRG; PAM sequence: AGG
aaatattatttgcaaaatct

SEQ ID NO: 127733 - DNA, 20 bp, Artificial Sequence
  Description of Artificial Sequence: Synthetic oligonucleotide
  Target: ATXN1; (+) strand; PAM type: NRG; PAM sequence: TGG
tattatttgcaaaatctagg

SEQ ID NO: 127734 - DNA, 20 bp, Artificial Sequence
  Description of Artificial Sequence: Synthetic oligonucleotide
  Target: ATXN1; (+) strand; PAM type: NRG; PAM sequence: AAG
atttgcaaaatctaggtggc

SEQ ID NO: 127735 - DNA, 20 bp, Artificial Sequence
  Description of Artificial Sequence: Synthetic oligonucleotide
  Target: ATXN1; (+) strand; PAM type: NRG; PAM sequence: TGG
aaatctaggtggcaagttta

SEQ ID NO: 127736 - DNA, 20 bp, Artificial Sequence
  Description of Artificial Sequence: Synthetic oligonucleotide
  Target: ATXN1; (+) strand; PAM type: NRG; PAM sequence: GGG
aatctaggtggcaagtttat

SEQ ID NO: 127737 - DNA, 20 bp, Artificial Sequence
  Description of Artificial Sequence: Synthetic oligonucleotide
  Target: ATXN1; (+) strand; PAM type: NRG; PAM sequence: TGG
aatttttcctaataaaatgt

SEQ ID NO: 127738 - DNA, 20 bp, Artificial Sequence
  Description of Artificial Sequence: Synthetic oligonucleotide
  Target: ATXN1; (+) strand; PAM type: NRG; PAM sequence: GGG
atttttcctaataaaatgtt

SEQ ID NO: 127739 - DNA, 20 bp, Artificial Sequence
  Description of Artificial Sequence: Synthetic oligonucleotide
  Target: ATXN1; (+) strand; PAM type: NRG; PAM sequence: GGG
tttttcctaataaaatgttg

SEQ ID NO: 127740 - DNA, 20 bp, Artificial Sequence
  Description of Artificial Sequence: Synthetic oligonucleotide
  Target: ATXN1; (+) strand; PAM type: NRG; PAM sequence: GGG
ttttcctaataaaatgttgg

SEQ ID NO: 127741 - DNA, 20 bp, Artificial Sequence
  Description of Artificial Sequence: Synthetic oligonucleotide
  Target: ATXN1; (+) strand; PAM type: NRG; PAM sequence: GGG
tttcctaataaaatgttggg

SEQ ID NO: 127742 - DNA, 20 bp, Artificial Sequence
  Description of Artificial Sequence: Synthetic oligonucleotide
  Target: ATXN1; (+) strand; PAM type: NRG; PAM sequence: AAG
ctaataaaatgttgggggga

SEQ ID NO: 127743 - DNA, 20 bp, Artificial Sequence
  Description of Artificial Sequence: Synthetic oligonucleotide
  Target: ATXN1; (+) strand; PAM type: NRG; PAM sequence: CAG
ctctcgtgaacaactctgcc

SEQ ID NO: 127744 - DNA, 20 bp, Artificial Sequence
  Description of Artificial Sequence: Synthetic oligonucleotide
  Target: ATXN1; (+) strand; PAM type: NRG; PAM sequence: TAG
tgaacaactctgcccagtca

SEQ ID NO: 127745 - DNA, 20 bp, Artificial Sequence
  Description of Artificial Sequence: Synthetic oligonucleotide
  Target: ATXN1; (+) strand; PAM type: NRG; PAM sequence: AAG
acaactctgcccagtcatag

SEQ ID NO: 127746 - DNA, 20 bp, Artificial Sequence
  Description of Artificial Sequence: Synthetic oligonucleotide
  Target: ATXN1; (+) strand; PAM type: NRG; PAM sequence: GAG
aactctgcccagtcatagaa

SEQ ID NO: 127747 - DNA, 20 bp, Artificial Sequence
  Description of Artificial Sequence: Synthetic oligonucleotide
  Target: ATXN1; (+) strand; PAM type: NRG; PAM sequence: CAG
ccagtcatagaagagtttcc

SEQ ID NO: 127748 - DNA, 20 bp, Artificial Sequence
  Description of Artificial Sequence: Synthetic oligonucleotide
  Target: ATXN1; (+) strand; PAM type: NRG; PAM sequence: AGG
cagtcatagaagagtttccc

SEQ ID NO: 127749 - DNA, 20 bp, Artificial Sequence
  Description of Artificial Sequence: Synthetic oligonucleotide
  Target: ATXN1; (+) strand; PAM type: NRG; PAM sequence: AAG
catagaagagtttcccagga

SEQ ID NO: 127750 - DNA, 20 bp, Artificial Sequence
  Description of Artificial Sequence: Synthetic oligonucleotide
  Target: ATXN1; (+) strand; PAM type: NRG; PAM sequence: TAG
tttcccaggaaagatttatt

SEQ ID NO: 127751 - DNA, 20 bp, Artificial Sequence
  Description of Artificial Sequence: Synthetic oligonucleotide
  Target: ATXN1; (+) strand; PAM type: NRG; PAM sequence: TGG
atatgcatgtatctgacttt

SEQ ID NO: 127752 - DNA, 20 bp, Artificial Sequence
  Description of Artificial Sequence: Synthetic oligonucleotide
  Target: ATXN1; (+) strand; PAM type: NRG; PAM sequence: GGG
tatgcatgtatctgactttt

SEQ ID NO: 127753 - DNA, 20 bp, Artificial Sequence
  Description of Artificial Sequence: Synthetic oligonucleotide
  Target: ATXN1; (+) strand; PAM type: NRG; PAM sequence: GGG
atgcatgtatctgacttttg

SEQ ID NO: 127754 - DNA, 20 bp, Artificial Sequence
  Description of Artificial Sequence: Synthetic oligonucleotide
  Target: ATXN1; (+) strand; PAM type: NRG; PAM sequence: GGG
tgcatgtatctgacttttgg

SEQ ID NO: 127755 - DNA, 20 bp, Artificial Sequence
  Description of Artificial Sequence: Synthetic oligonucleotide
  Target: ATXN1; (+) strand; PAM type: NRG; PAM sequence: TAG
acatctcatttaacaaaaat

SEQ ID NO: 127756 - DNA, 20 bp, Artificial Sequence
  Description of Artificial Sequence: Synthetic oligonucleotide
  Target: ATXN1; (+) strand; PAM type: NRG; PAM sequence: AGG
catctcatttaacaaaaatt

SEQ ID NO: 127757 - DNA, 20 bp, Artificial Sequence
  Description of Artificial Sequence: Synthetic oligonucleotide
  Target: ATXN1; (+) strand; PAM type: NRG; PAM sequence: CAG
tctccttttaacctctttta

SEQ ID NO: 127758 - DNA, 20 bp, Artificial Sequence
  Description of Artificial Sequence: Synthetic oligonucleotide
  Target: ATXN1; (+) strand; PAM type: NRG; PAM sequence: TAG
ttacagaaaactgcccccct

SEQ ID NO: 127759 - DNA, 20 bp, Artificial Sequence
  Description of Artificial Sequence: Synthetic oligonucleotide
  Target: ATXN1; (+) strand; PAM type: NRG; PAM sequence: CAG
cagaaaactgccccccttag

SEQ ID NO: 127760 - DNA, 20 bp, Artificial Sequence
  Description of Artificial Sequence: Synthetic oligonucleotide
  Target: ATXN1; (+) strand; PAM type: NRG; PAM sequence: AAG
actgccccccttagcagtga

SEQ ID NO: 127761 - DNA, 20 bp, Artificial Sequence
  Description of Artificial Sequence: Synthetic oligonucleotide
  Target: ATXN1; (+) strand; PAM type: NRG; PAM sequence: AGG
ctgccccccttagcagtgaa

SEQ ID NO: 127762 - DNA, 20 bp, Artificial Sequence
  Description of Artificial Sequence: Synthetic oligonucleotide
  Target: ATXN1; (+) strand; PAM type: NRG; PAM sequence: CAG
ccccccttagcagtgaaagg

SEQ ID NO: 127763 - DNA, 20 bp, Artificial Sequence
  Description of Artificial Sequence: Synthetic oligonucleotide
  Target: ATXN1; (+) strand; PAM type: NRG; PAM sequence: TAG
actgcaatgtgcaatgcaat

SEQ ID NO: 127764 - DNA, 20 bp, Artificial Sequence
  Description of Artificial Sequence: Synthetic oligonucleotide
  Target: ATXN1; (+) strand; PAM type: NRG; PAM sequence: AGG
ctgcaatgtgcaatgcaatt

SEQ ID NO: 127765 - DNA, 20 bp, Artificial Sequence
  Description of Artificial Sequence: Synthetic oligonucleotide
  Target: ATXN1; (+) strand; PAM type: NRG; PAM sequence: TAG
gcaattaggctattaaataa

SEQ ID NO: 127766 - DNA, 20 bp, Artificial Sequence
  Description of Artificial Sequence: Synthetic oligonucleotide
  Target: ATXN1; (+) strand; PAM type: NRG; PAM sequence: AAG
ggctattaaataatagacaa

SEQ ID NO: 127767 - DNA, 20 bp, Artificial Sequence
  Description of Artificial Sequence: Synthetic oligonucleotide
  Target: ATXN1; (+) strand; PAM type: NRG; PAM sequence: AGG
gctattaaataatagacaaa

SEQ ID NO: 127768 - DNA, 20 bp, Artificial Sequence
  Description of Artificial Sequence: Synthetic oligonucleotide
  Target: ATXN1; (+) strand; PAM type: NRG; PAM sequence: TAG
aaaggccaatgtttattaat

SEQ ID NO: 127769 - DNA, 20 bp, Artificial Sequence
  Description of Artificial Sequence: Synthetic oligonucleotide
  Target: ATXN1; (+) strand; PAM type: NRG; PAM sequence: AAG
aatgtttattaattagcaaa

SEQ ID NO: 127770 - DNA, 20 bp, Artificial Sequence
  Description of Artificial Sequence: Synthetic oligonucleotide
  Target: ATXN1; (+) strand; PAM type: NRG; PAM sequence: TAG
ttaattagcaaaaagccata

SEQ ID NO: 127771 - DNA, 20 bp, Artificial Sequence
  Description of Artificial Sequence: Synthetic oligonucleotide
  Target: ATXN1; (+) strand; PAM type: NRG; PAM sequence: AGG
taattagcaaaaagccatat

SEQ ID NO: 127772 - DNA, 20 bp, Artificial Sequence
  Description of Artificial Sequence: Synthetic oligonucleotide
  Target: ATXN1; (+) strand; PAM type: NRG; PAM sequence: GAG
caaaaagccatataggatat

SEQ ID NO: 127773 - DNA, 20 bp, Artificial Sequence
  Description of Artificial Sequence: Synthetic oligonucleotide
  Target: ATXN1; (+) strand; PAM type: NRG; PAM sequence: TAG
gccatataggatatgagctc

SEQ ID NO: 127774 - DNA, 20 bp, Artificial Sequence
  Description of Artificial Sequence: Synthetic oligonucleotide
  Target: ATXN1; (+) strand; PAM type: NRG; PAM sequence: CAG
gatatgagctctagactctg

SEQ ID NO: 127775 - DNA, 20 bp, Artificial Sequence
  Description of Artificial Sequence: Synthetic oligonucleotide
  Target: ATXN1; (+) strand; PAM type: NRG; PAM sequence: GAG
tatgagctctagactctgca

SEQ ID NO: 127776 - DNA, 20 bp, Artificial Sequence
  Description of Artificial Sequence: Synthetic oligonucleotide
  Target: ATXN1; (+) strand; PAM type: NRG; PAM sequence: TGG
gcagagctttatattccaca

SEQ ID NO: 127777 - DNA, 20 bp, Artificial Sequence
  Description of Artificial Sequence: Synthetic oligonucleotide
  Target: ATXN1; (+) strand; PAM type: NRG; PAM sequence: TGG
ggaccctccaatcatttttg

SEQ ID NO: 127778 - DNA, 20 bp, Artificial Sequence
  Description of Artificial Sequence: Synthetic oligonucleotide
  Target: ATXN1; (+) strand; PAM type: NRG; PAM sequence: TGG
ctccaatcatttttgtggct

SEQ ID NO: 127779 - DNA, 20 bp, Artificial Sequence
  Description of Artificial Sequence: Synthetic oligonucleotide
  Target: ATXN1; (+) strand; PAM type: NRG; PAM sequence: TGG
aatcatttttgtggcttgga

SEQ ID NO: 127780 - DNA, 20 bp, Artificial Sequence
  Description of Artificial Sequence: Synthetic oligonucleotide
  Target: ATXN1; (+) strand; PAM type: NRG; PAM sequence: CAG
tttgtggcttggatggattt

SEQ ID NO: 127781 - DNA, 20 bp, Artificial Sequence
  Description of Artificial Sequence: Synthetic oligonucleotide
  Target: ATXN1; (+) strand; PAM type: NRG; PAM sequence: TGG
gcttggatggatttcagcac

SEQ ID NO: 127782 - DNA, 20 bp, Artificial Sequence
  Description of Artificial Sequence: Synthetic oligonucleotide
  Target: ATXN1; (+) strand; PAM type: NRG; PAM sequence: TGG
ttcagcactggtacttatca

SEQ ID NO: 127783 - DNA, 20 bp, Artificial Sequence
  Description of Artificial Sequence: Synthetic oligonucleotide
  Target: ATXN1; (+) strand; PAM type: NRG; PAM sequence: AAG
actggtacttatcatggtca

SEQ ID NO: 127784 - DNA, 20 bp, Artificial Sequence
  Description of Artificial Sequence: Synthetic oligonucleotide
  Target: ATXN1; (+) strand; PAM type: NRG; PAM sequence: TAG
aagatacatcattattgctc

SEQ ID NO: 127785 - DNA, 20 bp, Artificial Sequence
  Description of Artificial Sequence: Synthetic oligonucleotide
  Target: ATXN1; (+) strand; PAM type: NRG; PAM sequence: TAG
caatacacattttcattaaa

SEQ ID NO: 127786 - DNA, 20 bp, Artificial Sequence
  Description of Artificial Sequence: Synthetic oligonucleotide
  Target: ATXN1; (+) strand; PAM type: NRG; PAM sequence: TGG
ttttacaatttccataaact

SEQ ID NO: 127787 - DNA, 20 bp, Artificial Sequence
  Description of Artificial Sequence: Synthetic oligonucleotide
  Target: ATXN1; (+) strand; PAM type: NRG; PAM sequence: TGG
ttctaccttcaactcttact

SEQ ID NO: 127788 - DNA, 20 bp, Artificial Sequence
  Description of Artificial Sequence: Synthetic oligonucleotide
  Target: ATXN1; (+) strand; PAM type: NRG; PAM sequence: TAG
cttcaactcttacttggcct

SEQ ID NO: 127789 - DNA, 20 bp, Artificial Sequence
  Description of Artificial Sequence: Synthetic oligonucleotide
  Target: ATXN1; (+) strand; PAM type: NRG; PAM sequence: AGG
ttcaactcttacttggcctt

SEQ ID NO: 127790 - DNA, 20 bp, Artificial Sequence
  Description of Artificial Sequence: Synthetic oligonucleotide
  Target: ATXN1; (+) strand; PAM type: NRG; PAM sequence: AAG
atcttttttttttttttgat

SEQ ID NO: 127791 - DNA, 20 bp, Artificial Sequence
  Description of Artificial Sequence: Synthetic oligonucleotide
  Target: ATXN1; (+) strand; PAM type: NRG; PAM sequence: GAG
cttttttttttttttgataa

SEQ ID NO: 127792 - DNA, 20 bp, Artificial Sequence
  Description of Artificial Sequence: Synthetic oligonucleotide
  Target: ATXN1; (+) strand; PAM type: NRG; PAM sequence: AGG
ttttttttttttttgataag

SEQ ID NO: 127793 - DNA, 20 bp, Artificial Sequence
  Description of Artificial Sequence: Synthetic oligonucleotide
  Target: ATXN1; (+) strand; PAM type: NRG; PAM sequence: TAG
ataagaggtttttcttgaaa

SEQ ID NO: 127794 - DNA, 20 bp, Artificial Sequence
  Description of Artificial Sequence: Synthetic oligonucleotide
  Target: ATXN1; (+) strand; PAM type: NRG; PAM sequence: AGG
taagaggtttttcttgaaat

SEQ ID NO: 127795 - DNA, 20 bp, Artificial Sequence
  Description of Artificial Sequence: Synthetic oligonucleotide
  Target: ATXN1; (+) strand; PAM type: NRG; PAM sequence: GAG
agaggtttttcttgaaatag

SEQ ID NO: 127796 - DNA, 20 bp, Artificial Sequence
  Description of Artificial Sequence: Synthetic oligonucleotide
  Target: ATXN1; (+) strand; PAM type: NRG; PAM sequence: AAG
ttgaaataggagttaattaa

SEQ ID NO: 127797 - DNA, 20 bp, Artificial Sequence
  Description of Artificial Sequence: Synthetic oligonucleotide
  Target: ATXN1; (+) strand; PAM type: NRG; PAM sequence: AAG
aggagttaattaaaagattt

SEQ ID NO: 127798 - DNA, 20 bp, Artificial Sequence
  Description of Artificial Sequence: Synthetic oligonucleotide
  Target: ATXN1; (+) strand; PAM type: NRG; PAM sequence: AGG
ggagttaattaaaagattta

SEQ ID NO: 127799 - DNA, 20 bp, Artificial Sequence
  Description of Artificial Sequence: Synthetic oligonucleotide
  Target: ATXN1; (+) strand; PAM type: NRG; PAM sequence: GAG
acctcttgtgattcaaacat

SEQ ID NO: 127800 - DNA, 20 bp, Artificial Sequence
  Description of Artificial Sequence: Synthetic oligonucleotide
  Target: ATXN1; (+) strand; PAM type: NRG; PAM sequence: AAG
attattattatcttttataa

SEQ ID NO: 127801 - DNA, 20 bp, Artificial Sequence
  Description of Artificial Sequence: Synthetic oligonucleotide
  Target: ATXN1; (+) strand; PAM type: NRG; PAM sequence: AGG
ttattattatcttttataaa

SEQ ID NO: 127802 - DNA, 20 bp, Artificial Sequence
  Description of Artificial Sequence: Synthetic oligonucleotide
  Target: ATXN1; (+) strand; PAM type: NRG; PAM sequence: CAG
ataaaaggtaaaatctattt

SEQ ID NO: 127803 - DNA, 20 bp, Artificial Sequence
  Description of Artificial Sequence: Synthetic oligonucleotide
  Target: ATXN1; (+) strand; PAM type: NRG; PAM sequence: GAG
aaaaggtaaaatctatttca

SEQ ID NO: 127804 - DNA, 20 bp, Artificial Sequence
  Description of Artificial Sequence: Synthetic oligonucleotide
  Target: ATXN1; (+) strand; PAM type: NRG; PAM sequence: AAG
aatctatttcagagcatttt

SEQ ID NO: 127805 - DNA, 20 bp, Artificial Sequence
  Description of Artificial Sequence: Synthetic oligonucleotide
  Target: ATXN1; (+) strand; PAM type: NRG; PAM sequence: TAG
ccgatgcttgacaaattcat

SEQ ID NO: 127806 - DNA, 20 bp, Artificial Sequence
  Description of Artificial Sequence: Synthetic oligonucleotide
  Target: ATXN1; (+) strand; PAM type: NRG; PAM sequence: TAG
taacaaatgttaaacctgtc

SEQ ID NO: 127807 - DNA, 20 bp, Artificial Sequence
  Description of Artificial Sequence: Synthetic oligonucleotide
  Target: ATXN1; (+) strand; PAM type: NRG; PAM sequence: GAG
acaaatgttaaacctgtcta

SEQ ID NO: 127808 - DNA, 20 bp, Artificial Sequence
  Description of Artificial Sequence: Synthetic oligonucleotide
  Target: ATXN1; (+) strand; PAM type: NRG; PAM sequence: CAG
tatttccttgctattctacg

SEQ ID NO: 127809 - DNA, 20 bp, Artificial Sequence
  Description of Artificial Sequence: Synthetic oligonucleotide
  Target: ATXN1; (+) strand; PAM type: NRG; PAM sequence: TGG
tattctacgcagcaaatcaa

SEQ ID NO: 127810 - DNA, 20 bp, Artificial Sequence
  Description of Artificial Sequence: Synthetic oligonucleotide
  Target: ATXN1; (+) strand; PAM type: NRG; PAM sequence: CAG
aatggcctcgccaaccgcca

SEQ ID NO: 127811 - DNA, 20 bp, Artificial Sequence
  Description of Artificial Sequence: Synthetic oligonucleotide
  Target: ATXN1; (+) strand; PAM type: NRG; PAM sequence: AGG
atggcctcgccaaccgccac

SEQ ID NO: 127812 - DNA, 20 bp, Artificial Sequence
  Description of Artificial Sequence: Synthetic oligonucleotide
  Target: ATXN1; (+) strand; PAM type: NRG; PAM sequence: AAG
cgccaaccgccacaggataa

SEQ ID NO: 127813 - DNA, 20 bp, Artificial Sequence
  Description of Artificial Sequence: Synthetic oligonucleotide
  Target: ATXN1; (+) strand; PAM type: NRG; PAM sequence: CAG
tgccaacgtgatgccaccga

SEQ ID NO: 127814 - DNA, 20 bp, Artificial Sequence
  Description of Artificial Sequence: Synthetic oligonucleotide
  Target: ATXN1; (+) strand; PAM type: NRG; PAM sequence: AGG
gccaacgtgatgccaccgac

SEQ ID NO: 127815 - DNA, 20 bp, Artificial Sequence
  Description of Artificial Sequence: Synthetic oligonucleotide
  Target: ATXN1; (+) strand; PAM type: NRG; PAM sequence: GGG
ccaacgtgatgccaccgaca

SEQ ID NO: 127816 - DNA, 20 bp, Artificial Sequence
  Description of Artificial Sequence: Synthetic oligonucleotide
  Target: ATXN1; (+) strand; PAM type: NRG; PAM sequence: GAG
aacgtgatgccaccgacagg

SEQ ID NO: 127817 - DNA, 20 bp, Artificial Sequence
  Description of Artificial Sequence: Synthetic oligonucleotide
  Target: ATXN1; (+) strand; PAM type: NRG; PAM sequence: GAG
cgtgatgccaccgacaggga

SEQ ID NO: 127818 - DNA, 20 bp, Artificial Sequence
  Description of Artificial Sequence: Synthetic oligonucleotide
  Target: ATXN1; (+) strand; PAM type: NRG; PAM sequence: GAG
gccaactctgctcaccctcc

SEQ ID NO: 127819 - DNA, 20 bp, Artificial Sequence
  Description of Artificial Sequence: Synthetic oligonucleotide
  Target: ATXN1; (+) strand; PAM type: NRG; PAM sequence: AAG
aactctgctcaccctccgag

SEQ ID NO: 127820 - DNA, 20 bp, Artificial Sequence
  Description of Artificial Sequence: Synthetic oligonucleotide
  Target: ATXN1; (+) strand; PAM type: NRG; PAM sequence: AGG
actctgctcaccctccgaga

SEQ ID NO: 127821 - DNA, 20 bp, Artificial Sequence
  Description of Artificial Sequence: Synthetic oligonucleotide
  Target: ATXN1; (+) strand; PAM type: NRG; PAM sequence: TAG
tcaccctccgagaaggactc

SEQ ID NO: 127822 - DNA, 20 bp, Artificial Sequence
  Description of Artificial Sequence: Synthetic oligonucleotide
  Target: ATXN1; (+) strand; PAM type: NRG; PAM sequence: AAG
cgagaaggactctagtgcat

SEQ ID NO: 127823 - DNA, 20 bp, Artificial Sequence
  Description of Artificial Sequence: Synthetic oligonucleotide
  Target: ATXN1; (+) strand; PAM type: NRG; PAM sequence: TGG
gaaggactctagtgcataag

SEQ ID NO: 127824 - DNA, 20 bp, Artificial Sequence
  Description of Artificial Sequence: Synthetic oligonucleotide
  Target: ATXN1; (+) strand; PAM type: NRG; PAM sequence: TGG
ataagtggctgcctatgtat

SEQ ID NO: 127825 - DNA, 20 bp, Artificial Sequence
  Description of Artificial Sequence: Synthetic oligonucleotide
  Target: ATXN1; (+) strand; PAM type: NRG; PAM sequence: GGG
taagtggctgcctatgtatt

SEQ ID NO: 127826 - DNA, 20 bp, Artificial Sequence
  Description of Artificial Sequence: Synthetic oligonucleotide
  Target: ATXN1; (+) strand; PAM type: NRG; PAM sequence: TGG
gcctatgtattgggatgttc

SEQ ID NO: 127827 - DNA, 20 bp, Artificial Sequence
  Description of Artificial Sequence: Synthetic oligonucleotide
  Target: ATXN1; (+) strand; PAM type: NRG; PAM sequence: CGG
atgtattgggatgttctggc

SEQ ID NO: 127828 - DNA, 20 bp, Artificial Sequence
  Description of Artificial Sequence: Synthetic oligonucleotide
  Target: ATXN1; (+) strand; PAM type: NRG; PAM sequence: GGG
tgtattgggatgttctggcc

SEQ ID NO: 127829 - DNA, 20 bp, Artificial Sequence
  Description of Artificial Sequence: Synthetic oligonucleotide
  Target: ATXN1; (+) strand; PAM type: NRG; PAM sequence: CGG
tgggatgttctggccgggcg

SEQ ID NO: 127830 - DNA, 20 bp, Artificial Sequence
  Description of Artificial Sequence: Synthetic oligonucleotide
  Target: ATXN1; (+) strand; PAM type: NRG; PAM sequence: TGG
gatgttctggccgggcgcgg

SEQ ID NO: 127831 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcatgtaatcc

SEQ ID NO: 127832 - DNA, 20 bp, Artificial Sequence
  Description of Artificial Sequence: Synthetic oligonucleotide
  Target: ATXN1; (+) strand; PAM type: NRG; PAM sequence: TGG
cgcatgtaatcccagcactt

SEQ ID NO: 127833 - DNA, 20 bp, Artificial Sequence
  Description of Artificial Sequence: Synthetic oligonucleotide
  Target: ATXN1; (+) strand; PAM type: NRG; PAM sequence: GGG
gcatgtaatcccagcacttt

SEQ ID NO: 127834 - DNA, 20 bp, Artificial Sequence
  Description of Artificial Sequence: Synthetic oligonucleotide
  Target: ATXN1; (+) strand; PAM type: NRG; PAM sequence: GAG
atgtaatcccagcactttgg

SEQ ID NO: 127835 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 127836 - DNA, 20 bp, Artificial Sequence
  Description of Artificial Sequence: Synthetic oligonucleotide
  Target: ATXN1; (+) strand; PAM type: NRG; PAM sequence: TGG
atcccagcactttgggaggc

SEQ ID NO: 127837 - DNA, 20 bp, Artificial Sequence
  Description of Artificial Sequence: Synthetic oligonucleotide
  Target: ATXN1; (+) strand; PAM type: NRG; PAM sequence: GGG
tcccagcactttgggaggct

SEQ ID NO: 127838 - DNA, 20 bp, Artificial Sequence
  Description of Artificial Sequence: Synthetic oligonucleotide
  Target: ATXN1; (+) strand; PAM type: NRG; PAM sequence: GGG
cccagcactttgggaggctg

SEQ ID NO: 127839 - DNA, 20 bp, Artificial Sequence
  Description of Artificial Sequence: Synthetic oligonucleotide
  Target: ATXN1; (+) strand; PAM type: NRG; PAM sequence: CAG
agcactttgggaggctgggg

SEQ ID NO: 127840 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggctggggcaga

SEQ ID NO: 127841 - DNA, 20 bp, Artificial Sequence
  Description of Artificial Sequence: Synthetic oligonucleotide
  Target: ATXN1; (+) strand; PAM type: NRG; PAM sequence: GAG
ctggggcagatggatcacct

SEQ ID NO: 127842 - DNA, 20 bp, Artificial Sequence
  Description of Artificial Sequence: Synthetic oligonucleotide
  Target: ATXN1; (+) strand; PAM type: NRG; PAM sequence: AGG
tggggcagatggatcacctg

SEQ ID NO: 127843 - DNA, 20 bp, Artificial Sequence
  Description of Artificial Sequence: Synthetic oligonucleotide
  Target: ATXN1; (+) strand; PAM type: NRG; PAM sequence: AAG
cagatggatcacctgaggtc

SEQ ID NO: 127844 - DNA, 20 bp, Artificial Sequence
  Description of Artificial Sequence: Synthetic oligonucleotide
  Target: ATXN1; (+) strand; PAM type: NRG; PAM sequence: GAG
gatggatcacctgaggtcaa

SEQ ID NO: 127845 - DNA, 20 bp, Artificial Sequence
  Description of Artificial Sequence: Synthetic oligonucleotide
  Target: ATXN1; (+) strand; PAM type: NRG; PAM sequence: AAG
tcacctgaggtcaagagttc

SEQ ID NO: 127846 - DNA, 20 bp, Artificial Sequence
  Description of Artificial Sequence: Synthetic oligonucleotide
  Target: ATXN1; (+) strand; PAM type: NRG; PAM sequence: TGG
ctgaggtcaagagttcaaga

SEQ ID NO: 127847 - DNA, 20 bp, Artificial Sequence
  Description of Artificial Sequence: Synthetic oligonucleotide
  Target: ATXN1; (+) strand; PAM type: NRG; PAM sequence: GGG
tgaggtcaagagttcaagat

SEQ ID NO: 127848 - DNA, 20 bp, Artificial Sequence
  Description of Artificial Sequence: Synthetic oligonucleotide
  Target: ATXN1; (+) strand; PAM type: NRG; PAM sequence: TGG
tcaagagttcaagatgggct

SEQ ID NO: 127849 - DNA, 20 bp, Artificial Sequence
  Description of Artificial Sequence: Synthetic oligonucleotide
  Target: ATXN1; (+) strand; PAM type: NRG; PAM sequence: CAG
gagttcaagatgggcttggt

SEQ ID NO: 127850 - DNA, 20 bp, Artificial Sequence
  Description of Artificial Sequence: Synthetic oligonucleotide
  Target: ATXN1; (+) strand; PAM type: NRG; PAM sequence: CAG
caagatgggcttggtcagca

SEQ ID NO: 127851 - DNA, 20 bp, Artificial Sequence
  Description of Artificial Sequence: Synthetic oligonucleotide
  Target: ATXN1; (+) strand; PAM type: NRG; PAM sequence: AAG
gaaacactgtcactactaaa

SEQ ID NO: 127852 - DNA, 20 bp, Artificial Sequence
  Description of Artificial Sequence: Synthetic oligonucleotide
  Target: ATXN1; (+) strand; PAM type: NRG; PAM sequence: TAG
ctactaaaaagacgcaaaat

SEQ ID NO: 127853 - DNA, 20 bp, Artificial Sequence
  Description of Artificial Sequence: Synthetic oligonucleotide
  Target: ATXN1; (+) strand; PAM type: NRG; PAM sequence: TGG
taaaaagacgcaaaattagc

SEQ ID NO: 127854 - DNA, 20 bp, Artificial Sequence
  Description of Artificial Sequence: Synthetic oligonucleotide
  Target: ATXN1; (+) strand; PAM type: NRG; PAM sequence: TGG
gacgcaaaattagctggacg

SEQ ID NO: 127855 - DNA, 20 bp, Artificial Sequence
  Description of Artificial Sequence: Synthetic oligonucleotide
  Target: ATXN1; (+) strand; PAM type: NRG; PAM sequence: TGG
gcaaaattagctggacgtgg

SEQ ID NO: 127856 - DNA, 20 bp, Artificial Sequence
  Description of Artificial Sequence: Synthetic oligonucleotide
  Target: ATXN1; (+) strand; PAM type: NRG; PAM sequence: CAG
aaattagctggacgtggtgg

SEQ ID NO: 127857 - DNA, 20 bp, Artificial Sequence
  Description of Artificial Sequence: Synthetic oligonucleotide
  Target: ATXN1; (+) strand; PAM type: NRG; PAM sequence: AGG
aattagctggacgtggtggc

SEQ ID NO: 127858 - DNA, 20 bp, Artificial Sequence
  Description of Artificial Sequence: Synthetic oligonucleotide
  Target: ATXN1; (+) strand; PAM type: NRG; PAM sequence: TAG
caggtgcctgtaatccctgc

SEQ ID NO: 127859 - DNA, 20 bp, Artificial Sequence
  Description of Artificial Sequence: Synthetic oligonucleotide
  Target: ATXN1; (+) strand; PAM type: NRG; PAM sequence: CGG
tgcctgtaatccctgctagt

SEQ ID NO: 127860 - DNA, 20 bp, Artificial Sequence
  Description of Artificial Sequence: Synthetic oligonucleotide
  Target: ATXN1; (+) strand; PAM type: NRG; PAM sequence: CAG
ctgtaatccctgctagtcgg

SEQ ID NO: 127861 - DNA, 20 bp, Artificial Sequence
  Description of Artificial Sequence: Synthetic oligonucleotide
  Target: ATXN1; (+) strand; PAM type: NRG; PAM sequence: AGG
tgtaatccctgctagtcggc

SEQ ID NO: 127862 - DNA, 20 bp, Artificial Sequence
  Description of Artificial Sequence: Synthetic oligonucleotide
  Target: ATXN1; (+) strand; PAM type: NRG; PAM sequence: TGG
atccctgctagtcggcaggc

SEQ ID NO: 127863 - DNA, 20 bp, Artificial Sequence
  Description of Artificial Sequence: Synthetic oligonucleotide
  Target: ATXN1; (+) strand; PAM type: NRG; PAM sequence: GGG
tccctgctagtcggcaggct

SEQ ID NO: 127864 - DNA, 20 bp, Artificial Sequence
  Description of Artificial Sequence: Synthetic oligonucleotide
  Target: ATXN1; (+) strand; PAM type: NRG; PAM sequence: GGG
ccctgctagtcggcaggctg

SEQ ID NO: 127865 - DNA, 20 bp, Artificial Sequence
  Description of Artificial Sequence: Synthetic oligonucleotide
  Target: ATXN1; (+) strand; PAM type: NRG; PAM sequence: CAG
tgctagtcggcaggctgggg

SEQ ID NO: 127866 - DNA, 20 bp, Artificial Sequence
  Description of Artificial Sequence: Synthetic oligonucleotide
  Target: ATXN1; (+) strand; PAM type: NRG; PAM sequence: AGG
gctagtcggcaggctggggc

SEQ ID NO: 127867 - DNA, 20 bp, Artificial Sequence
  Description of Artificial Sequence: Synthetic oligonucleotide
  Target: ATXN1; (+) strand; PAM type: NRG; PAM sequence: GAG
tagtcggcaggctggggcag

SEQ ID NO: 127868 - DNA, 20 bp, Artificial Sequence
  Description of Artificial Sequence: Synthetic oligonucleotide
  Target: ATXN1; (+) strand; PAM type: NRG; PAM sequence: CAG
gcaggagaatcgcttgaacc

SEQ ID NO: 127869 - DNA, 20 bp, Artificial Sequence
  Description of Artificial Sequence: Synthetic oligonucleotide
  Target: ATXN1; (+) strand; PAM type: NRG; PAM sequence: AGG
caggagaatcgcttgaaccc

SEQ ID NO: 127870 - DNA, 20 bp, Artificial Sequence
  Description of Artificial Sequence: Synthetic oligonucleotide
  Target: ATXN1; (+) strand; PAM type: NRG; PAM sequence: GAG
ggagaatcgcttgaacccag

SEQ ID NO: 127871 - DNA, 20 bp, Artificial Sequence
  Description of Artificial Sequence: Synthetic oligonucleotide
  Target: ATXN1; (+) strand; PAM type: NRG; PAM sequence: AGG
gagaatcgcttgaacccagg

SEQ ID NO: 127872 - DNA, 20 bp, Artificial Sequence
  Description of Artificial Sequence: Synthetic oligonucleotide
  Target: ATXN1; (+) strand; PAM type: NRG; PAM sequence: TAG
aatcgcttgaacccaggagg

SEQ ID NO: 127873 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaacccaggaggta

SEQ ID NO: 127874 - DNA, 20 bp, Artificial Sequence
  Description of Artificial Sequence: Synthetic oligonucleotide
  Target: ATXN1; (+) strand; PAM type: NRG; PAM sequence: AGG
cgcttgaacccaggaggtag

SEQ ID NO: 127875 - DNA, 20 bp, Artificial Sequence
  Description of Artificial Sequence: Synthetic oligonucleotide
  Target: ATXN1; (+) strand; PAM type: NRG; PAM sequence: CAG
aacccaggaggtagaggttg

SEQ ID NO: 127876 - DNA, 20 bp, Artificial Sequence
  Description of Artificial Sequence: Synthetic oligonucleotide
  Target: ATXN1; (+) strand; PAM type: NRG; PAM sequence: GAG
caggaggtagaggttgcagt

SEQ ID NO: 127877 - DNA, 20 bp, Artificial Sequence
  Description of Artificial Sequence: Synthetic oligonucleotide
  Target: ATXN1; (+) strand; PAM type: NRG; PAM sequence: GAG
ggtagaggttgcagtgagcc

SEQ ID NO: 127878 - DNA, 20 bp, Artificial Sequence
  Description of Artificial Sequence: Synthetic oligonucleotide
  Target: ATXN1; (+) strand; PAM type: NRG; PAM sequence: CAG
gagactgcaccactgcactc

SEQ ID NO: 127879 - DNA, 20 bp, Artificial Sequence
  Description of Artificial Sequence: Synthetic oligonucleotide
  Target: ATXN1; (+) strand; PAM type: NRG; PAM sequence: TGG
tgcaccactgcactccagtc

SEQ ID NO: 127880 - DNA, 20 bp, Artificial Sequence
  Description of Artificial Sequence: Synthetic oligonucleotide
  Target: ATXN1; (+) strand; PAM type: NRG; PAM sequence: GGG
gcaccactgcactccagtct

SEQ ID NO: 127881 - DNA, 20 bp, Artificial Sequence
  Description of Artificial Sequence: Synthetic oligonucleotide
  Target: ATXN1; (+) strand; PAM type: NRG; PAM sequence: AAG
tgcactccagtctgggcaac

SEQ ID NO: 127882 - DNA, 20 bp, Artificial Sequence
  Description of Artificial Sequence: Synthetic oligonucleotide
  Target: ATXN1; (+) strand; PAM type: NRG; PAM sequence: GAG
cactccagtctgggcaacaa

SEQ ID NO: 127883 - DNA, 20 bp, Artificial Sequence
  Description of Artificial Sequence: Synthetic oligonucleotide
  Target: ATXN1; (+) strand; PAM type: NRG; PAM sequence: AAG
tgaaactctgtctcaaaaaa

SEQ ID NO: 127884 - DNA, 20 bp, Artificial Sequence
  Description of Artificial Sequence: Synthetic oligonucleotide
  Target: ATXN1; (+) strand; PAM type: NRG; PAM sequence: AAG
tgtctcaaaaaaaagaaaaa

SEQ ID NO: 127885 - DNA, 20 bp, Artificial Sequence
  Description of Artificial Sequence: Synthetic oligonucleotide
  Target: ATXN1; (+) strand; PAM type: NRG; PAM sequence: AAG
aaaaaagaaaaaaagaaaaa

SEQ ID NO: 127886 - DNA, 20 bp, Artificial Sequence
  Description of Artificial Sequence: Synthetic oligonucleotide
  Target: ATXN1; (+) strand; PAM type: NRG; PAM sequence: AAG
aagaaaaaaagaaaaaaaaa

SEQ ID NO: 127887 - DNA, 20 bp, Artificial Sequence
  Description of Artificial Sequence: Synthetic oligonucleotide
  Target: ATXN1; (+) strand; PAM type: NRG; PAM sequence: CAG
actgaaatacaaccatgata

SEQ ID NO: 127888 - DNA, 20 bp, Artificial Sequence
  Description of Artificial Sequence: Synthetic oligonucleotide
  Target: ATXN1; (+) strand; PAM type: NRG; PAM sequence: AGG
ctgaaatacaaccatgatac

SEQ ID NO: 127889 - DNA, 20 bp, Artificial Sequence
  Description of Artificial Sequence: Synthetic oligonucleotide
  Target: ATXN1; (+) strand; PAM type: NRG; PAM sequence: CAG
aaccatgatacaggcaaaaa

SEQ ID NO: 127890 - DNA, 20 bp, Artificial Sequence
  Description of Artificial Sequence: Synthetic oligonucleotide
  Target: ATXN1; (+) strand; PAM type: NRG; PAM sequence: TGG
ggcaaaaacagacttcgatt

SEQ ID NO: 127891 - DNA, 20 bp, Artificial Sequence
  Description of Artificial Sequence: Synthetic oligonucleotide
  Target: ATXN1; (+) strand; PAM type: NRG; PAM sequence: AAG
aaaaacagacttcgatttgg

SEQ ID NO: 127892 - DNA, 20 bp, Artificial Sequence
  Description of Artificial Sequence: Synthetic oligonucleotide
  Target: ATXN1; (+) strand; PAM type: NRG; PAM sequence: AAG
cttcgatttggaagctaaaa

SEQ ID NO: 127893 - DNA, 20 bp, Artificial Sequence
  Description of Artificial Sequence: Synthetic oligonucleotide
  Target: ATXN1; (+) strand; PAM type: NRG; PAM sequence: AGG
ttcgatttggaagctaaaaa

SEQ ID NO: 127894 - DNA, 20 bp, Artificial Sequence
  Description of Artificial Sequence: Synthetic oligonucleotide
  Target: ATXN1; (+) strand; PAM type: NRG; PAM sequence: TGG
ggaagctaaaaaaggtgtct

SEQ ID NO: 127895 - DNA, 20 bp, Artificial Sequence
  Description of Artificial Sequence: Synthetic oligonucleotide
  Target: ATXN1; (+) strand; PAM type: NRG; PAM sequence: CAG
gctaaaaaaggtgtcttggc

SEQ ID NO: 127896 - DNA, 20 bp, Artificial Sequence
  Description of Artificial Sequence: Synthetic oligonucleotide
  Target: ATXN1; (+) strand; PAM type: NRG; PAM sequence: AGG
ctaaaaaaggtgtcttggcc

SEQ ID NO: 127897 - DNA, 20 bp, Artificial Sequence
  Description of Artificial Sequence: Synthetic oligonucleotide
  Target: ATXN1; (+) strand; PAM type: NRG; PAM sequence: CGG
aaaggtgtcttggccaggtg

SEQ ID NO: 127898 - DNA, 20 bp, Artificial Sequence
  Description of Artificial Sequence: Synthetic oligonucleotide
  Target: ATXN1; (+) strand; PAM type: NRG; PAM sequence: TGG
ggtgtcttggccaggtgcgg

SEQ ID NO: 127899 - DNA, 20 bp, Artificial Sequence
  Description of Artificial Sequence: Synthetic oligonucleotide
  Target: ATXN1; (+) strand; PAM type: NRG; PAM sequence: CAG
gtggctcacacctgtaatac

SEQ ID NO: 127900 - DNA, 20 bp, Artificial Sequence
  Description of Artificial Sequence: Synthetic oligonucleotide
  Target: ATXN1; (+) strand; PAM type: NRG; PAM sequence: TGG
cacctgtaataccagcactt

SEQ ID NO: 127901 - DNA, 20 bp, Artificial Sequence
  Description of Artificial Sequence: Synthetic oligonucleotide
  Target: ATXN1; (+) strand; PAM type: NRG; PAM sequence: GGG
acctgtaataccagcacttt

SEQ ID NO: 127902 - DNA, 20 bp, Artificial Sequence
  Description of Artificial Sequence: Synthetic oligonucleotide
  Target: ATXN1; (+) strand; PAM type: NRG; PAM sequence: GAG
ctgtaataccagcactttgg

SEQ ID NO: 127903 - DNA, 20 bp, Artificial Sequence
  Description of Artificial Sequence: Synthetic oligonucleotide
  Target: ATXN1; (+) strand; PAM type: NRG; PAM sequence: AGG
tgtaataccagcactttggg

SEQ ID NO: 127904 - DNA, 20 bp, Artificial Sequence
  Description of Artificial Sequence: Synthetic oligonucleotide
  Target: ATXN1; (+) strand; PAM type: NRG; PAM sequence: AAG
taccagcactttgggaggcc

SEQ ID NO: 127905 - DNA, 20 bp, Artificial Sequence
  Description of Artificial Sequence: Synthetic oligonucleotide
  Target: ATXN1; (+) strand; PAM type: NRG; PAM sequence: AGG
accagcactttgggaggcca

SEQ ID NO: 127906 - DNA, 20 bp, Artificial Sequence
  Description of Artificial Sequence: Synthetic oligonucleotide
  Target: ATXN1; (+) strand; PAM type: NRG; PAM sequence: TGG
agcactttgggaggccaagg

SEQ ID NO: 127907 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccaaggt

SEQ ID NO: 127908 - DNA, 20 bp, Artificial Sequence
  Description of Artificial Sequence: Synthetic oligonucleotide
  Target: ATXN1; (+) strand; PAM type: NRG; PAM sequence: CGG
ctttgggaggccaaggtggg

SEQ ID NO: 127909 - DNA, 20 bp, Artificial Sequence
  Description of Artificial Sequence: Synthetic oligonucleotide
  Target: ATXN1; (+) strand; PAM type: NRG; PAM sequence: GAG
ccaaggtgggcggatcacct

SEQ ID NO: 127910 - DNA, 20 bp, Artificial Sequence
  Description of Artificial Sequence: Synthetic oligonucleotide
  Target: ATXN1; (+) strand; PAM type: NRG; PAM sequence: AGG
caaggtgggcggatcacctg

SEQ ID NO: 127911 - DNA, 20 bp, Artificial Sequence
  Description of Artificial Sequence: Synthetic oligonucleotide
  Target: ATXN1; (+) strand; PAM type: NRG; PAM sequence: CAG
gtgggcggatcacctgaggt

SEQ ID NO: 127912 - DNA, 20 bp, Artificial Sequence
  Description of Artificial Sequence: Synthetic oligonucleotide
  Target: ATXN1; (+) strand; PAM type: NRG; PAM sequence: AGG
tgggcggatcacctgaggtc

SEQ ID NO: 127913 - DNA, 20 bp, Artificial Sequence
  Description of Artificial Sequence: Synthetic oligonucleotide
  Target: ATXN1; (+) strand; PAM type: NRG; PAM sequence: GAG
ggcggatcacctgaggtcag

SEQ ID NO: 127914 - DNA, 20 bp, Artificial Sequence
  Description of Artificial Sequence: Synthetic oligonucleotide
  Target: ATXN1; (+) strand; PAM type: NRG; PAM sequence: GAG
tcacctgaggtcaggagttt

SEQ ID NO: 127915 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagtttgagac

SEQ ID NO: 127916 - DNA, 20 bp, Artificial Sequence
  Description of Artificial Sequence: Synthetic oligonucleotide
  Target: ATXN1; (+) strand; PAM type: NRG; PAM sequence: TGG
tcaggagtttgagaccagcc

SEQ ID NO: 127917 - DNA, 20 bp, Artificial Sequence
  Description of Artificial Sequence: Synthetic oligonucleotide
  Target: ATXN1; (+) strand; PAM type: NRG; PAM sequence: TGG
tgagaccagcctggccatca

SEQ ID NO: 127918 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 127919 - DNA, 20 bp, Artificial Sequence
  Description of Artificial Sequence: Synthetic oligonucleotide
  Target: ATXN1; (+) strand; PAM type: NRG; PAM sequence: CAG
ctaaaaatacaaaaattagc

SEQ ID NO: 127920 - DNA, 20 bp, Artificial Sequence
  Description of Artificial Sequence: Synthetic oligonucleotide
  Target: ATXN1; (+) strand; PAM type: NRG; PAM sequence: AGG
taaaaatacaaaaattagcc

SEQ ID NO: 127921 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagccaggca

SEQ ID NO: 127922 - DNA, 20 bp, Artificial Sequence
  Description of Artificial Sequence: Synthetic oligonucleotide
  Target: ATXN1; (+) strand; PAM type: NRG; PAM sequence: TGG
caaaaattagccaggcatgg

SEQ ID NO: 127923 - DNA, 20 bp, Artificial Sequence
  Description of Artificial Sequence: Synthetic oligonucleotide
  Target: ATXN1; (+) strand; PAM type: NRG; PAM sequence: CAG
aaattagccaggcatggtgg

SEQ ID NO: 127924 - DNA, 20 bp, Artificial Sequence
  Description of Artificial Sequence: Synthetic oligonucleotide
  Target: ATXN1; (+) strand; PAM type: NRG; PAM sequence: CAG
gtggcagatgcctgtaatct

SEQ ID NO: 127925 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatctcagctact

SEQ ID NO: 127926 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatctcagctactt

SEQ ID NO: 127927 - DNA, 20 bp, Artificial Sequence
  Description of Artificial Sequence: Synthetic oligonucleotide
  Target: ATXN1; (+) strand; PAM type: NRG; PAM sequence: GAG
ctgtaatctcagctacttgg

SEQ ID NO: 127928 - DNA, 20 bp, Artificial Sequence
  Description of Artificial Sequence: Synthetic oligonucleotide
  Target: ATXN1; (+) strand; PAM type: NRG; PAM sequence: AGG
tgtaatctcagctacttggg

SEQ ID NO: 127929 - DNA, 20 bp, Artificial Sequence
  Description of Artificial Sequence: Synthetic oligonucleotide
  Target: ATXN1; (+) strand; PAM type: NRG; PAM sequence: AAG
ctcagctacttgggaggtca

SEQ ID NO: 127930 - DNA, 20 bp, Artificial Sequence
  Description of Artificial Sequence: Synthetic oligonucleotide
  Target: ATXN1; (+) strand; PAM type: NRG; PAM sequence: CAG
agctacttgggaggtcaaag

SEQ ID NO: 127931 - DNA, 20 bp, Artificial Sequence
  Description of Artificial Sequence: Synthetic oligonucleotide
  Target: ATXN1; (+) strand; PAM type: NRG; PAM sequence: AGG
gctacttgggaggtcaaagc

SEQ ID NO: 127932 - DNA, 20 bp, Artificial Sequence
  Description of Artificial Sequence: Synthetic oligonucleotide
  Target: ATXN1; (+) strand; PAM type: NRG; PAM sequence: GAG
tacttgggaggtcaaagcag

SEQ ID NO: 127933 - DNA, 20 bp, Artificial Sequence
  Description of Artificial Sequence: Synthetic oligonucleotide
  Target: ATXN1; (+) strand; PAM type: NRG; PAM sequence: CAG
gcaggagaatcacttaaacc

SEQ ID NO: 127934 - DNA, 20 bp, Artificial Sequence
  Description of Artificial Sequence: Synthetic oligonucleotide
  Target: ATXN1; (+) strand; PAM type: NRG; PAM sequence: AGG
caggagaatcacttaaaccc

SEQ ID NO: 127935 - DNA, 20 bp, Artificial Sequence
  Description of Artificial Sequence: Synthetic oligonucleotide
  Target: ATXN1; (+) strand; PAM type: NRG; PAM sequence: CAG
agaatcacttaaacccaggt

SEQ ID NO: 127936 - DNA, 20 bp, Artificial Sequence
  Description of Artificial Sequence: Synthetic oligonucleotide
  Target: ATXN1; (+) strand; PAM type: NRG; PAM sequence: TGG
ttaaacccaggtcagcttgc

SEQ ID NO: 127937 - DNA, 20 bp, Artificial Sequence
  Description of Artificial Sequence: Synthetic oligonucleotide
  Target: ATXN1; (+) strand; PAM type: NRG; PAM sequence: CAG
tcagcttgctggcaacttcc

SEQ ID NO: 127938 - DNA, 20 bp, Artificial Sequence
  Description of Artificial Sequence: Synthetic oligonucleotide
  Target: ATXN1; (+) strand; PAM type: NRG; PAM sequence: TAG
ttgctggcaacttcccagat

SEQ ID NO: 127939 - DNA, 20 bp, Artificial Sequence
  Description of Artificial Sequence: Synthetic oligonucleotide
  Target: ATXN1; (+) strand; PAM type: NRG; PAM sequence: CGG
aataattaaattccttccac

SEQ ID NO: 127940 - DNA, 20 bp, Artificial Sequence
  Description of Artificial Sequence: Synthetic oligonucleotide
  Target: ATXN1; (+) strand; PAM type: NRG; PAM sequence: AAG
taaattccttccaccggcac

SEQ ID NO: 127941 - DNA, 20 bp, Artificial Sequence
  Description of Artificial Sequence: Synthetic oligonucleotide
  Target: ATXN1; (+) strand; PAM type: NRG; PAM sequence: TAG
agaaatatgtccactgaaaa

SEQ ID NO: 127942 - DNA, 20 bp, Artificial Sequence
  Description of Artificial Sequence: Synthetic oligonucleotide
  Target: ATXN1; (+) strand; PAM type: NRG; PAM sequence: AGG
gaaatatgtccactgaaaat

SEQ ID NO: 127943 - DNA, 20 bp, Artificial Sequence
  Description of Artificial Sequence: Synthetic oligonucleotide
  Target: ATXN1; (+) strand; PAM type: NRG; PAM sequence: AAG
tcctttctctctttgccctc

SEQ ID NO: 127944 - DNA, 20 bp, Artificial Sequence
  Description of Artificial Sequence: Synthetic oligonucleotide
  Target: ATXN1; (+) strand; PAM type: NRG; PAM sequence: CAG
ccctcaagaccttcaccacc

SEQ ID NO: 127945 - DNA, 20 bp, Artificial Sequence
  Description of Artificial Sequence: Synthetic oligonucleotide
  Target: ATXN1; (+) strand; PAM type: NRG; PAM sequence: AGG
cctcaagaccttcaccaccc

SEQ ID NO: 127946 - DNA, 20 bp, Artificial Sequence
  Description of Artificial Sequence: Synthetic oligonucleotide
  Target: ATXN1; (+) strand; PAM type: NRG; PAM sequence: CAG
aagaccttcaccacccagga

SEQ ID NO: 127947 - DNA, 20 bp, Artificial Sequence
  Description of Artificial Sequence: Synthetic oligonucleotide
  Target: ATXN1; (+) strand; PAM type: NRG; PAM sequence: GAG
ccttcaccacccaggacagt

SEQ ID NO: 127948 - DNA, 20 bp, Artificial Sequence
  Description of Artificial Sequence: Synthetic oligonucleotide
  Target: ATXN1; (+) strand; PAM type: NRG; PAM sequence: GAG
ttcaccacccaggacagtga

SEQ ID NO: 127949 - DNA, 20 bp, Artificial Sequence
  Description of Artificial Sequence: Synthetic oligonucleotide
  Target: ATXN1; (+) strand; PAM type: NRG; PAM sequence: AGG
tcaccacccaggacagtgag

SEQ ID NO: 127950 - DNA, 20 bp, Artificial Sequence
  Description of Artificial Sequence: Synthetic oligonucleotide
  Target: ATXN1; (+) strand; PAM type: NRG; PAM sequence: AAG
ccaggacagtgagaggctat

SEQ ID NO: 127951 - DNA, 20 bp, Artificial Sequence
  Description of Artificial Sequence: Synthetic oligonucleotide
  Target: ATXN1; (+) strand; PAM type: NRG; PAM sequence: AAG
agtgagaggctataagtgtt

SEQ ID NO: 127952 - DNA, 20 bp, Artificial Sequence
  Description of Artificial Sequence: Synthetic oligonucleotide
  Target: ATXN1; (+) strand; PAM type: NRG; PAM sequence: AGG
gtgagaggctataagtgtta

SEQ ID NO: 127953 - DNA, 20 bp, Artificial Sequence
  Description of Artificial Sequence: Synthetic oligonucleotide
  Target: ATXN1; (+) strand; PAM type: NRG; PAM sequence: GGG
tgagaggctataagtgttaa

SEQ ID NO: 127954 - DNA, 20 bp, Artificial Sequence
  Description of Artificial Sequence: Synthetic oligonucleotide
  Target: ATXN1; (+) strand; PAM type: NRG; PAM sequence: CGG
gctataagtgttaagggcac

SEQ ID NO: 127955 - DNA, 20 bp, Artificial Sequence
  Description of Artificial Sequence: Synthetic oligonucleotide
  Target: ATXN1; (+) strand; PAM type: NRG; PAM sequence: GGG
ctataagtgttaagggcacc

SEQ ID NO: 127956 - DNA, 20 bp, Artificial Sequence
  Description of Artificial Sequence: Synthetic oligonucleotide
  Target: ATXN1; (+) strand; PAM type: NRG; PAM sequence: GGG
tataagtgttaagggcaccg

SEQ ID NO: 127957 - DNA, 20 bp, Artificial Sequence
  Description of Artificial Sequence: Synthetic oligonucleotide
  Target: ATXN1; (+) strand; PAM type: NRG; PAM sequence: CAG
aagtgttaagggcaccgggg

SEQ ID NO: 127958 - DNA, 20 bp, Artificial Sequence
  Description of Artificial Sequence: Synthetic oligonucleotide
  Target: ATXN1; (+) strand; PAM type: NRG; PAM sequence: GAG
gtgttaagggcaccggggca

SEQ ID NO: 127959 - DNA, 20 bp, Artificial Sequence
  Description of Artificial Sequence: Synthetic oligonucleotide
  Target: ATXN1; (+) strand; PAM type: NRG; PAM sequence: TGG
accggggcagagccaatatc

SEQ ID NO: 127960 - DNA, 20 bp, Artificial Sequence
  Description of Artificial Sequence: Synthetic oligonucleotide
  Target: ATXN1; (+) strand; PAM type: NRG; PAM sequence: GGG
ccggggcagagccaatatct

SEQ ID NO: 127961 - DNA, 20 bp, Artificial Sequence
  Description of Artificial Sequence: Synthetic oligonucleotide
  Target: ATXN1; (+) strand; PAM type: NRG; PAM sequence: TGG
tatctgggtttaaatgacct

SEQ ID NO: 127962 - DNA, 20 bp, Artificial Sequence
  Description of Artificial Sequence: Synthetic oligonucleotide
  Target: ATXN1; (+) strand; PAM type: NRG; PAM sequence: GGG
atctgggtttaaatgacctt

SEQ ID NO: 127963 - DNA, 20 bp, Artificial Sequence
  Description of Artificial Sequence: Synthetic oligonucleotide
  Target: ATXN1; (+) strand; PAM type: NRG; PAM sequence: CAG
tcacttaacctcactgtttt

SEQ ID NO: 127964 - DNA, 20 bp, Artificial Sequence
  Description of Artificial Sequence: Synthetic oligonucleotide
  Target: ATXN1; (+) strand; PAM type: NRG; PAM sequence: AAG
atataaaatttacataacaa

SEQ ID NO: 127965 - DNA, 20 bp, Artificial Sequence
  Description of Artificial Sequence: Synthetic oligonucleotide
  Target: ATXN1; (+) strand; PAM type: NRG; PAM sequence: GAG
atttacataacaaaagttgt

SEQ ID NO: 127966 - DNA, 20 bp, Artificial Sequence
  Description of Artificial Sequence: Synthetic oligonucleotide
  Target: ATXN1; (+) strand; PAM type: NRG; PAM sequence: AGG
tttacataacaaaagttgtg

SEQ ID NO: 127967 - DNA, 20 bp, Artificial Sequence
  Description of Artificial Sequence: Synthetic oligonucleotide
  Target: ATXN1; (+) strand; PAM type: NRG; PAM sequence: AAG
aacaaaagttgtgaggatta

SEQ ID NO: 127968 - DNA, 20 bp, Artificial Sequence
  Description of Artificial Sequence: Synthetic oligonucleotide
  Target: ATXN1; (+) strand; PAM type: NRG; PAM sequence: AGG
acaaaagttgtgaggattaa

SEQ ID NO: 127969 - DNA, 20 bp, Artificial Sequence
  Description of Artificial Sequence: Synthetic oligonucleotide
  Target: ATXN1; (+) strand; PAM type: NRG; PAM sequence: GGG
caaaagttgtgaggattaaa

SEQ ID NO: 127970 - DNA, 20 bp, Artificial Sequence
  Description of Artificial Sequence: Synthetic oligonucleotide
  Target: ATXN1; (+) strand; PAM type: NRG; PAM sequence: TAG
tgaggattaaagggttaata

SEQ ID NO: 127971 - DNA, 20 bp, Artificial Sequence
  Description of Artificial Sequence: Synthetic oligonucleotide
  Target: ATXN1; (+) strand; PAM type: NRG; PAM sequence: AAG
taaagggttaatatagcaca

SEQ ID NO: 127972 - DNA, 20 bp, Artificial Sequence
  Description of Artificial Sequence: Synthetic oligonucleotide
  Target: ATXN1; (+) strand; PAM type: NRG; PAM sequence: TAG
ttaatatagcacaaagcact

SEQ ID NO: 127973 - DNA, 20 bp, Artificial Sequence
  Description of Artificial Sequence: Synthetic oligonucleotide
  Target: ATXN1; (+) strand; PAM type: NRG; PAM sequence: GAG
aatatagcacaaagcactta

SEQ ID NO: 127974 - DNA, 20 bp, Artificial Sequence
  Description of Artificial Sequence: Synthetic oligonucleotide
  Target: ATXN1; (+) strand; PAM type: NRG; PAM sequence: CAG
atagcacaaagcacttagag

SEQ ID NO: 127975 - DNA, 20 bp, Artificial Sequence
  Description of Artificial Sequence: Synthetic oligonucleotide
  Target: ATXN1; (+) strand; PAM type: NRG; PAM sequence: TAG
aagcacttagagcagtatta

SEQ ID NO: 127976 - DNA, 20 bp, Artificial Sequence
  Description of Artificial Sequence: Synthetic oligonucleotide
  Target: ATXN1; (+) strand; PAM type: NRG; PAM sequence: AGG
agcacttagagcagtattat

SEQ ID NO: 127977 - DNA, 20 bp, Artificial Sequence
  Description of Artificial Sequence: Synthetic oligonucleotide
  Target: ATXN1; (+) strand; PAM type: NRG; PAM sequence: AAG
cttttattgaccaacataca

SEQ ID NO: 127978 - DNA, 20 bp, Artificial Sequence
  Description of Artificial Sequence: Synthetic oligonucleotide
  Target: ATXN1; (+) strand; PAM type: NRG; PAM sequence: GAG
tttattgaccaacatacaaa

SEQ ID NO: 127979 - DNA, 20 bp, Artificial Sequence
  Description of Artificial Sequence: Synthetic oligonucleotide
  Target: ATXN1; (+) strand; PAM type: NRG; PAM sequence: AAG
tttgtttttaattatacttt

SEQ ID NO: 127980 - DNA, 20 bp, Artificial Sequence
  Description of Artificial Sequence: Synthetic oligonucleotide
  Target: ATXN1; (+) strand; PAM type: NRG; PAM sequence: TAG
tttaattatactttaagttt

SEQ ID NO: 127981 - DNA, 20 bp, Artificial Sequence
  Description of Artificial Sequence: Synthetic oligonucleotide
  Target: ATXN1; (+) strand; PAM type: NRG; PAM sequence: AGG
ttaattatactttaagtttt

SEQ ID NO: 127982 - DNA, 20 bp, Artificial Sequence
  Description of Artificial Sequence: Synthetic oligonucleotide
  Target: ATXN1; (+) strand; PAM type: NRG; PAM sequence: GGG
taattatactttaagtttta

SEQ ID NO: 127983 - DNA, 20 bp, Artificial Sequence
  Description of Artificial Sequence: Synthetic oligonucleotide
  Target: ATXN1; (+) strand; PAM type: NRG; PAM sequence: CAG
gggtacatgtgcacaacatg

SEQ ID NO: 127984 - DNA, 20 bp, Artificial Sequence
  Description of Artificial Sequence: Synthetic oligonucleotide
  Target: ATXN1; (+) strand; PAM type: NRG; PAM sequence: AGG
ggtacatgtgcacaacatgc

SEQ ID NO: 127985 - DNA, 20 bp, Artificial Sequence
  Description of Artificial Sequence: Synthetic oligonucleotide
  Target: ATXN1; (+) strand; PAM type: NRG; PAM sequence: TAG
gcaggtttgttacatatgta

SEQ ID NO: 127986 - DNA, 20 bp, Artificial Sequence
  Description of Artificial Sequence: Synthetic oligonucleotide
  Target: ATXN1; (+) strand; PAM type: NRG; PAM sequence: CAG
ttacatatgtatagatgtgc

SEQ ID NO: 127987 - DNA, 20 bp, Artificial Sequence
  Description of Artificial Sequence: Synthetic oligonucleotide
  Target: ATXN1; (+) strand; PAM type: NRG; PAM sequence: AGG
tacatatgtatagatgtgcc

SEQ ID NO: 127988 - DNA, 20 bp, Artificial Sequence
  Description of Artificial Sequence: Synthetic oligonucleotide
  Target: ATXN1; (+) strand; PAM type: NRG; PAM sequence: TGG
tatgtatagatgtgccaggt

SEQ ID NO: 127989 - DNA, 20 bp, Artificial Sequence
  Description of Artificial Sequence: Synthetic oligonucleotide
  Target: ATXN1; (+) strand; PAM type: NRG; PAM sequence: TAG
attaacttgtcatttaacat

SEQ ID NO: 127990 - DNA, 20 bp, Artificial Sequence
  Description of Artificial Sequence: Synthetic oligonucleotide
  Target: ATXN1; (+) strand; PAM type: NRG; PAM sequence: AGG
ttaacttgtcatttaacatt

SEQ ID NO: 127991 - DNA, 20 bp, Artificial Sequence
  Description of Artificial Sequence: Synthetic oligonucleotide
  Target: ATXN1; (+) strand; PAM type: NRG; PAM sequence: CAG
cccctccccccaccccacaa

SEQ ID NO: 127992 - DNA, 20 bp, Artificial Sequence
  Description of Artificial Sequence: Synthetic oligonucleotide
  Target: ATXN1; (+) strand; PAM type: NRG; PAM sequence: AGG
ccctccccccaccccacaac

SEQ ID NO: 127993 - DNA, 20 bp, Artificial Sequence
  Description of Artificial Sequence: Synthetic oligonucleotide
  Target: ATXN1; (+) strand; PAM type: NRG; PAM sequence: CGG
ccccaccccacaacaggccc

SEQ ID NO: 127994 - DNA, 20 bp, Artificial Sequence
  Description of Artificial Sequence: Synthetic oligonucleotide
  Target: ATXN1; (+) strand; PAM type: NRG; PAM sequence: GAG
attgttcaattcccacctat

SEQ ID NO: 127995 - DNA, 20 bp, Artificial Sequence
  Description of Artificial Sequence: Synthetic oligonucleotide
  Target: ATXN1; (+) strand; PAM type: NRG; PAM sequence: GAG
ttcaattcccacctatgagt

SEQ ID NO: 127996 - DNA, 20 bp, Artificial Sequence
  Description of Artificial Sequence: Synthetic oligonucleotide
  Target: ATXN1; (+) strand; PAM type: NRG; PAM sequence: TGG
cccacctatgagtgagaaca

SEQ ID NO: 127997 - DNA, 20 bp, Artificial Sequence
  Description of Artificial Sequence: Synthetic oligonucleotide
  Target: ATXN1; (+) strand; PAM type: NRG; PAM sequence: GGG
ccacctatgagtgagaacat

SEQ ID NO: 127998 - DNA, 20 bp, Artificial Sequence
  Description of Artificial Sequence: Synthetic oligonucleotide
  Target: ATXN1; (+) strand; PAM type: NRG; PAM sequence: GGG
cacctatgagtgagaacatg

SEQ ID NO: 127999 - DNA, 20 bp, Artificial Sequence
  Description of Artificial Sequence: Synthetic oligonucleotide
  Target: ATXN1; (+) strand; PAM type: NRG; PAM sequence: TGG
gagtgagaacatggggtgtt

SEQ ID NO: 128000 - DNA, 20 bp, Artificial Sequence
  Description of Artificial Sequence: Synthetic oligonucleotide
  Target: ATXN1; (+) strand; PAM type: NRG; PAM sequence: GAG
ggttttttgtccttgcgatt

SEQ ID NO: 128001 - DNA, 20 bp, Artificial Sequence
  Description of Artificial Sequence: Synthetic oligonucleotide
  Target: ATXN1; (+) strand; PAM type: NRG; PAM sequence: TAG
ttttgtccttgcgattgaga

SEQ ID NO: 128002 - DNA, 20 bp, Artificial Sequence
  Description of Artificial Sequence: Synthetic oligonucleotide
  Target: ATXN1; (+) strand; PAM type: NRG; PAM sequence: CAG
gatagtctcgctctgtcacc

SEQ ID NO: 128003 - DNA, 20 bp, Artificial Sequence
  Description of Artificial Sequence: Synthetic oligonucleotide
  Target: ATXN1; (+) strand; PAM type: NRG; PAM sequence: AGG
atagtctcgctctgtcaccc

SEQ ID NO: 128004 - DNA, 20 bp, Artificial Sequence
  Description of Artificial Sequence: Synthetic oligonucleotide
  Target: ATXN1; (+) strand; PAM type: NRG; PAM sequence: TGG
tctcgctctgtcacccagga

SEQ ID NO: 128005 - DNA, 20 bp, Artificial Sequence
  Description of Artificial Sequence: Synthetic oligonucleotide
  Target: ATXN1; (+) strand; PAM type: NRG; PAM sequence: GAG
tcgctctgtcacccaggatg

SEQ ID NO: 128006 - DNA, 20 bp, Artificial Sequence
  Description of Artificial Sequence: Synthetic oligonucleotide
  Target: ATXN1; (+) strand; PAM type: NRG; PAM sequence: TGG
tcacccaggatggagtgcaa

SEQ ID NO: 128007 - DNA, 20 bp, Artificial Sequence
  Description of Artificial Sequence: Synthetic oligonucleotide
  Target: ATXN1; (+) strand; PAM type: NRG; PAM sequence: CGG
ggagtgcaatggcactatct

SEQ ID NO: 128008 - DNA, 20 bp, Artificial Sequence
  Description of Artificial Sequence: Synthetic oligonucleotide
  Target: ATXN1; (+) strand; PAM type: NRG; PAM sequence: CAG
tcactgcaacctacgcctcc

SEQ ID NO: 128009 - DNA, 20 bp, Artificial Sequence
  Description of Artificial Sequence: Synthetic oligonucleotide
  Target: ATXN1; (+) strand; PAM type: NRG; PAM sequence: AGG
cactgcaacctacgcctccc

SEQ ID NO: 128010 - DNA, 20 bp, Artificial Sequence
  Description of Artificial Sequence: Synthetic oligonucleotide
  Target: ATXN1; (+) strand; PAM type: NRG; PAM sequence: AAG
aacctacgcctcccaggttc

SEQ ID NO: 128011 - DNA, 20 bp, Artificial Sequence
  Description of Artificial Sequence: Synthetic oligonucleotide
  Target: ATXN1; (+) strand; PAM type: NRG; PAM sequence: CAG
ttcaagcaatcctctcgcct

SEQ ID NO: 128012 - DNA, 20 bp, Artificial Sequence
  Description of Artificial Sequence: Synthetic oligonucleotide
  Target: ATXN1; (+) strand; PAM type: NRG; PAM sequence: AAG
tcctctcgcctcagcctccc

SEQ ID NO: 128013 - DNA, 20 bp, Artificial Sequence
  Description of Artificial Sequence: Synthetic oligonucleotide
  Target: ATXN1; (+) strand; PAM type: NRG; PAM sequence: TAG
tctcgcctcagcctcccaag

SEQ ID NO: 128014 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaagtagc

SEQ ID NO: 128015 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaagtagct

SEQ ID NO: 128016 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtagctgggacta

SEQ ID NO: 128017 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagctgggactac

SEQ ID NO: 128018 - DNA, 20 bp, Artificial Sequence
  Description of Artificial Sequence: Synthetic oligonucleotide
  Target: ATXN1; (+) strand; PAM type: NRG; PAM sequence: GAG
gtagctgggactacaggcat

SEQ ID NO: 128019 - DNA, 20 bp, Artificial Sequence
  Description of Artificial Sequence: Synthetic oligonucleotide
  Target: ATXN1; (+) strand; PAM type: NRG; PAM sequence: TGG
caggcatgagccaccacacc

SEQ ID NO: 128020 - DNA, 20 bp, Artificial Sequence
  Description of Artificial Sequence: Synthetic oligonucleotide
  Target: ATXN1; (+) strand; PAM type: NRG; PAM sequence: CAG
ctggctaattcttgtttttt

SEQ ID NO: 128021 - DNA, 20 bp, Artificial Sequence
  Description of Artificial Sequence: Synthetic oligonucleotide
  Target: ATXN1; (+) strand; PAM type: NRG; PAM sequence: TAG
gctaattcttgttttttcag

SEQ ID NO: 128022 - DNA, 20 bp, Artificial Sequence
  Description of Artificial Sequence: Synthetic oligonucleotide
  Target: ATXN1; (+) strand; PAM type: NRG; PAM sequence: GAG
taattcttgttttttcagta

SEQ ID NO: 128023 - DNA, 20 bp, Artificial Sequence
  Description of Artificial Sequence: Synthetic oligonucleotide
  Target: ATXN1; (+) strand; PAM type: NRG; PAM sequence: CAG
tcttgttttttcagtagaga

SEQ ID NO: 128024 - DNA, 20 bp, Artificial Sequence
  Description of Artificial Sequence: Synthetic oligonucleotide
  Target: ATXN1; (+) strand; PAM type: NRG; PAM sequence: AGG
cttgttttttcagtagagac

SEQ ID NO: 128025 - DNA, 20 bp, Artificial Sequence
  Description of Artificial Sequence: Synthetic oligonucleotide
  Target: ATXN1; (+) strand; PAM type: NRG; PAM sequence: GGG
ttgttttttcagtagagaca

SEQ ID NO: 128026 - DNA, 20 bp, Artificial Sequence
  Description of Artificial Sequence: Synthetic oligonucleotide
  Target: ATXN1; (+) strand; PAM type: NRG; PAM sequence: CAG
cagggtttcaccatgttgtc

SEQ ID NO: 128027 - DNA, 20 bp, Artificial Sequence
  Description of Artificial Sequence: Synthetic oligonucleotide
  Target: ATXN1; (+) strand; PAM type: NRG; PAM sequence: AGG
agggtttcaccatgttgtcc

SEQ ID NO: 128028 - DNA, 20 bp, Artificial Sequence
  Description of Artificial Sequence: Synthetic oligonucleotide
  Target: ATXN1; (+) strand; PAM type: NRG; PAM sequence: TGG
tttcaccatgttgtccagga

SEQ ID NO: 128029 - DNA, 20 bp, Artificial Sequence
  Description of Artificial Sequence: Synthetic oligonucleotide
  Target: ATXN1; (+) strand; PAM type: NRG; PAM sequence: CAG
tggtctcgaactcctgacct

SEQ ID NO: 128030 - DNA, 20 bp, Artificial Sequence
  Description of Artificial Sequence: Synthetic oligonucleotide
  Target: ATXN1; (+) strand; PAM type: NRG; PAM sequence: AGG
ggtctcgaactcctgacctc

SEQ ID NO: 128031 - DNA, 20 bp, Artificial Sequence
  Description of Artificial Sequence: Synthetic oligonucleotide
  Target: ATXN1; (+) strand; PAM type: NRG; PAM sequence: CGG
ctcaggtgatccacctgcct

SEQ ID NO: 128032 - DNA, 20 bp, Artificial Sequence
  Description of Artificial Sequence: Synthetic oligonucleotide
  Target: ATXN1; (+) strand; PAM type: NRG; PAM sequence: AAG
ccacctgcctcggcctccca

SEQ ID NO: 128033 - DNA, 20 bp, Artificial Sequence
  Description of Artificial Sequence: Synthetic oligonucleotide
  Target: ATXN1; (+) strand; PAM type: NRG; PAM sequence: TGG
gcctcggcctcccaaagtgc

SEQ ID NO: 128034 - DNA, 20 bp, Artificial Sequence
  Description of Artificial Sequence: Synthetic oligonucleotide
  Target: ATXN1; (+) strand; PAM type: NRG; PAM sequence: GGG
cctcggcctcccaaagtgct

SEQ ID NO: 128035 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 128036 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 128037 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggcat

SEQ ID NO: 128038 - DNA, 20 bp, Artificial Sequence
  Description of Artificial Sequence: Synthetic oligonucleotide
  Target: ATXN1; (+) strand; PAM type: NRG; PAM sequence: CAG
caggcatgagtcactgcgcc

SEQ ID NO: 128039 - DNA, 20 bp, Artificial Sequence
  Description of Artificial Sequence: Synthetic oligonucleotide
  Target: ATXN1; (+) strand; PAM type: NRG; PAM sequence: AAG
ttcacctgccaacccactct

SEQ ID NO: 128040 - DNA, 20 bp, Artificial Sequence
  Description of Artificial Sequence: Synthetic oligonucleotide
  Target: ATXN1; (+) strand; PAM type: NRG; PAM sequence: TAG
ccactctaagtctgttcatt

SEQ ID NO: 128041 - DNA, 20 bp, Artificial Sequence
  Description of Artificial Sequence: Synthetic oligonucleotide
  Target: ATXN1; (+) strand; PAM type: NRG; PAM sequence: CAG
gacttctacccattcccatg

SEQ ID NO: 128042 - DNA, 20 bp, Artificial Sequence
  Description of Artificial Sequence: Synthetic oligonucleotide
  Target: ATXN1; (+) strand; PAM type: NRG; PAM sequence: AAG
tctacccattcccatgcaga

SEQ ID NO: 128043 - DNA, 20 bp, Artificial Sequence
  Description of Artificial Sequence: Synthetic oligonucleotide
  Target: ATXN1; (+) strand; PAM type: NRG; PAM sequence: AGG
ctacccattcccatgcagaa

SEQ ID NO: 128044 - DNA, 20 bp, Artificial Sequence
  Description of Artificial Sequence: Synthetic oligonucleotide
  Target: ATXN1; (+) strand; PAM type: NRG; PAM sequence: CAG
cattcccatgcagaaaggac

SEQ ID NO: 128045 - DNA, 20 bp, Artificial Sequence
  Description of Artificial Sequence: Synthetic oligonucleotide
  Target: ATXN1; (+) strand; PAM type: NRG; PAM sequence: CAG
ccatgcagaaaggaccagtt

SEQ ID NO: 128046 - DNA, 20 bp, Artificial Sequence
  Description of Artificial Sequence: Synthetic oligonucleotide
  Target: ATXN1; (+) strand; PAM type: NRG; PAM sequence: CAG
agaaaggaccagttcagcaa

SEQ ID NO: 128047 - DNA, 20 bp, Artificial Sequence
  Description of Artificial Sequence: Synthetic oligonucleotide
  Target: ATXN1; (+) strand; PAM type: NRG; PAM sequence: CAG
aaggaccagttcagcaacag

SEQ ID NO: 128048 - DNA, 20 bp, Artificial Sequence
  Description of Artificial Sequence: Synthetic oligonucleotide
  Target: ATXN1; (+) strand; PAM type: NRG; PAM sequence: AGG
aggaccagttcagcaacagc

SEQ ID NO: 128049 - DNA, 20 bp, Artificial Sequence
  Description of Artificial Sequence: Synthetic oligonucleotide
  Target: ATXN1; (+) strand; PAM type: NRG; PAM sequence: GGG
ggaccagttcagcaacagca

SEQ ID NO: 128050 - DNA, 20 bp, Artificial Sequence
  Description of Artificial Sequence: Synthetic oligonucleotide
  Target: ATXN1; (+) strand; PAM type: NRG; PAM sequence: TGG
ttcagcaacagcagggatgc

SEQ ID NO: 128051 - DNA, 20 bp, Artificial Sequence
  Description of Artificial Sequence: Synthetic oligonucleotide
  Target: ATXN1; (+) strand; PAM type: NRG; PAM sequence: CAG
agcaacagcagggatgctgg

SEQ ID NO: 128052 - DNA, 20 bp, Artificial Sequence
  Description of Artificial Sequence: Synthetic oligonucleotide
  Target: ATXN1; (+) strand; PAM type: NRG; PAM sequence: AGG
gcaacagcagggatgctggc

SEQ ID NO: 128053 - DNA, 20 bp, Artificial Sequence
  Description of Artificial Sequence: Synthetic oligonucleotide
  Target: ATXN1; (+) strand; PAM type: NRG; PAM sequence: TAG
acagcagggatgctggcagg

SEQ ID NO: 128054 - DNA, 20 bp, Artificial Sequence
  Description of Artificial Sequence: Synthetic oligonucleotide
  Target: ATXN1; (+) strand; PAM type: NRG; PAM sequence: AGG
cagcagggatgctggcaggt

SEQ ID NO: 128055 - DNA, 20 bp, Artificial Sequence
  Description of Artificial Sequence: Synthetic oligonucleotide
  Target: ATXN1; (+) strand; PAM type: NRG; PAM sequence: TAG
ggatgctggcaggtaggttt

SEQ ID NO: 128056 - DNA, 20 bp, Artificial Sequence
  Description of Artificial Sequence: Synthetic oligonucleotide
  Target: ATXN1; (+) strand; PAM type: NRG; PAM sequence: CAG
gttttagaaactcttaatca

SEQ ID NO: 128057 - DNA, 20 bp, Artificial Sequence
  Description of Artificial Sequence: Synthetic oligonucleotide
  Target: ATXN1; (+) strand; PAM type: NRG; PAM sequence: AGG
ttttagaaactcttaatcac

SEQ ID NO: 128058 - DNA, 20 bp, Artificial Sequence
  Description of Artificial Sequence: Synthetic oligonucleotide
  Target: ATXN1; (+) strand; PAM type: NRG; PAM sequence: GGG
tttagaaactcttaatcaca

SEQ ID NO: 128059 - DNA, 20 bp, Artificial Sequence
  Description of Artificial Sequence: Synthetic oligonucleotide
  Target: ATXN1; (+) strand; PAM type: NRG; PAM sequence: CAG
acagggctaatgtgttgatc

SEQ ID NO: 128060 - DNA, 20 bp, Artificial Sequence
  Description of Artificial Sequence: Synthetic oligonucleotide
  Target: ATXN1; (+) strand; PAM type: NRG; PAM sequence: TAG
gttgatccagcttaaatgta

SEQ ID NO: 128061 - DNA, 20 bp, Artificial Sequence
  Description of Artificial Sequence: Synthetic oligonucleotide
  Target: ATXN1; (+) strand; PAM type: NRG; PAM sequence: AAG
tccacttttcattttataac

SEQ ID NO: 128062 - DNA, 20 bp, Artificial Sequence
  Description of Artificial Sequence: Synthetic oligonucleotide
  Target: ATXN1; (+) strand; PAM type: NRG; PAM sequence: AGG
ccacttttcattttataaca

SEQ ID NO: 128063 - DNA, 20 bp, Artificial Sequence
  Description of Artificial Sequence: Synthetic oligonucleotide
  Target: ATXN1; (+) strand; PAM type: NRG; PAM sequence: GGG
cacttttcattttataacaa

SEQ ID NO: 128064 - DNA, 20 bp, Artificial Sequence
  Description of Artificial Sequence: Synthetic oligonucleotide
  Target: ATXN1; (+) strand; PAM type: NRG; PAM sequence: CAG
aacaagggtttttttgcatg

SEQ ID NO: 128065 - DNA, 20 bp, Artificial Sequence
  Description of Artificial Sequence: Synthetic oligonucleotide
  Target: ATXN1; (+) strand; PAM type: NRG; PAM sequence: AAG
tttctctcttctcttgtatc

SEQ ID NO: 128066 - DNA, 20 bp, Artificial Sequence
  Description of Artificial Sequence: Synthetic oligonucleotide
  Target: ATXN1; (+) strand; PAM type: NRG; PAM sequence: CAG
atcaagcatcttttcatctt

SEQ ID NO: 128067 - DNA, 20 bp, Artificial Sequence
  Description of Artificial Sequence: Synthetic oligonucleotide
  Target: ATXN1; (+) strand; PAM type: NRG; PAM sequence: AAG
cactgctgaattttttaaaa

SEQ ID NO: 128068 - DNA, 20 bp, Artificial Sequence
  Description of Artificial Sequence: Synthetic oligonucleotide
  Target: ATXN1; (+) strand; PAM type: NRG; PAM sequence: AAG
gaattttttaaaaaagaaaa

SEQ ID NO: 128069 - DNA, 20 bp, Artificial Sequence
  Description of Artificial Sequence: Synthetic oligonucleotide
  Target: ATXN1; (+) strand; PAM type: NRG; PAM sequence: CAG
taaaaaagaaaaaagaaacc

SEQ ID NO: 128070 - DNA, 20 bp, Artificial Sequence
  Description of Artificial Sequence: Synthetic oligonucleotide
  Target: ATXN1; (+) strand; PAM type: NRG; PAM sequence: TAG
aaaaaagaaacccagccaac

SEQ ID NO: 128071 - DNA, 20 bp, Artificial Sequence
  Description of Artificial Sequence: Synthetic oligonucleotide
  Target: ATXN1; (+) strand; PAM type: NRG; PAM sequence: CAG
agaaacccagccaactagct

SEQ ID NO: 128072 - DNA, 20 bp, Artificial Sequence
  Description of Artificial Sequence: Synthetic oligonucleotide
  Target: ATXN1; (+) strand; PAM type: NRG; PAM sequence: GAG
aaacccagccaactagctca

SEQ ID NO: 128073 - DNA, 20 bp, Artificial Sequence
  Description of Artificial Sequence: Synthetic oligonucleotide
  Target: ATXN1; (+) strand; PAM type: NRG; PAM sequence: AGG
aacccagccaactagctcag

SEQ ID NO: 128074 - DNA, 20 bp, Artificial Sequence
  Description of Artificial Sequence: Synthetic oligonucleotide
  Target: ATXN1; (+) strand; PAM type: NRG; PAM sequence: CAG
cacactgacgatattataca

SEQ ID NO: 128075 - DNA, 20 bp, Artificial Sequence
  Description of Artificial Sequence: Synthetic oligonucleotide
  Target: ATXN1; (+) strand; PAM type: NRG; PAM sequence: TGG
gacgatattatacacagtca

SEQ ID NO: 128076 - DNA, 20 bp, Artificial Sequence
  Description of Artificial Sequence: Synthetic oligonucleotide
  Target: ATXN1; (+) strand; PAM type: NRG; PAM sequence: CAG
gatattatacacagtcatgg

SEQ ID NO: 128077 - DNA, 20 bp, Artificial Sequence
  Description of Artificial Sequence: Synthetic oligonucleotide
  Target: ATXN1; (+) strand; PAM type: NRG; PAM sequence: CGG
ggcagtgactgtattataca

SEQ ID NO: 128078 - DNA, 20 bp, Artificial Sequence
  Description of Artificial Sequence: Synthetic oligonucleotide
  Target: ATXN1; (+) strand; PAM type: NRG; PAM sequence: TGG
gactgtattatacacggtca

SEQ ID NO: 128079 - DNA, 20 bp, Artificial Sequence
  Description of Artificial Sequence: Synthetic oligonucleotide
  Target: ATXN1; (+) strand; PAM type: NRG; PAM sequence: AAG
tgtattatacacggtcatgg

SEQ ID NO: 128080 - DNA, 20 bp, Artificial Sequence
  Description of Artificial Sequence: Synthetic oligonucleotide
  Target: ATXN1; (+) strand; PAM type: NRG; PAM sequence: TGG
atacacggtcatggaagtta

SEQ ID NO: 128081 - DNA, 20 bp, Artificial Sequence
  Description of Artificial Sequence: Synthetic oligonucleotide
  Target: ATXN1; (+) strand; PAM type: NRG; PAM sequence: GAG
acacggtcatggaagttatg

SEQ ID NO: 128082 - DNA, 20 bp, Artificial Sequence
  Description of Artificial Sequence: Synthetic oligonucleotide
  Target: ATXN1; (+) strand; PAM type: NRG; PAM sequence: TGG
tcatggaagttatggagaat

SEQ ID NO: 128083 - DNA, 20 bp, Artificial Sequence
  Description of Artificial Sequence: Synthetic oligonucleotide
  Target: ATXN1; (+) strand; PAM type: NRG; PAM sequence: AAG
gagaattggaatctaatgaa

SEQ ID NO: 128084 - DNA, 20 bp, Artificial Sequence
  Description of Artificial Sequence: Synthetic oligonucleotide
  Target: ATXN1; (+) strand; PAM type: NRG; PAM sequence: GAG
gaattggaatctaatgaaaa

SEQ ID NO: 128085 - DNA, 20 bp, Artificial Sequence
  Description of Artificial Sequence: Synthetic oligonucleotide
  Target: ATXN1; (+) strand; PAM type: NRG; PAM sequence: AAG
ggaatctaatgaaaagagat

SEQ ID NO: 128086 - DNA, 20 bp, Artificial Sequence
  Description of Artificial Sequence: Synthetic oligonucleotide
  Target: ATXN1; (+) strand; PAM type: NRG; PAM sequence: GAG
aatctaatgaaaagagataa

SEQ ID NO: 128087 - DNA, 20 bp, Artificial Sequence
  Description of Artificial Sequence: Synthetic oligonucleotide
  Target: ATXN1; (+) strand; PAM type: NRG; PAM sequence: GAG
tctaatgaaaagagataaga

SEQ ID NO: 128088 - DNA, 20 bp, Artificial Sequence
  Description of Artificial Sequence: Synthetic oligonucleotide
  Target: ATXN1; (+) strand; PAM type: NRG; PAM sequence: AGG
ctaatgaaaagagataagag

SEQ ID NO: 128089 - DNA, 20 bp, Artificial Sequence
  Description of Artificial Sequence: Synthetic oligonucleotide
  Target: ATXN1; (+) strand; PAM type: NRG; PAM sequence: GAG
aatgaaaagagataagagag

SEQ ID NO: 128090 - DNA, 20 bp, Artificial Sequence
  Description of Artificial Sequence: Synthetic oligonucleotide
  Target: ATXN1; (+) strand; PAM type: NRG; PAM sequence: CAG
gaaaagagataagagaggag

SEQ ID NO: 128091 - DNA, 20 bp, Artificial Sequence
  Description of Artificial Sequence: Synthetic oligonucleotide
  Target: ATXN1; (+) strand; PAM type: NRG; PAM sequence: GAG
aaagagataagagaggagca

SEQ ID NO: 128092 - DNA, 20 bp, Artificial Sequence
  Description of Artificial Sequence: Synthetic oligonucleotide
  Target: ATXN1; (+) strand; PAM type: NRG; PAM sequence: GAG
agagataagagaggagcaga

SEQ ID NO: 128093 - DNA, 20 bp, Artificial Sequence
  Description of Artificial Sequence: Synthetic oligonucleotide
  Target: ATXN1; (+) strand; PAM type: NRG; PAM sequence: AAG
aagagaggagcagagagata

SEQ ID NO: 128094 - DNA, 20 bp, Artificial Sequence
  Description of Artificial Sequence: Synthetic oligonucleotide
  Target: ATXN1; (+) strand; PAM type: NRG; PAM sequence: AGG
agagaggagcagagagataa

SEQ ID NO: 128095 - DNA, 20 bp, Artificial Sequence
  Description of Artificial Sequence: Synthetic oligonucleotide
  Target: ATXN1; (+) strand; PAM type: NRG; PAM sequence: CAG
ataaaggaacccttgaaaat

SEQ ID NO: 128096 - DNA, 20 bp, Artificial Sequence
  Description of Artificial Sequence: Synthetic oligonucleotide
  Target: ATXN1; (+) strand; PAM type: NRG; PAM sequence: CAG
atcagccccaatatctcacc

SEQ ID NO: 128097 - DNA, 20 bp, Artificial Sequence
  Description of Artificial Sequence: Synthetic oligonucleotide
  Target: ATXN1; (+) strand; PAM type: NRG; PAM sequence: TGG
cccaatatctcacccagata

SEQ ID NO: 128098 - DNA, 20 bp, Artificial Sequence
  Description of Artificial Sequence: Synthetic oligonucleotide
  Target: ATXN1; (+) strand; PAM type: NRG; PAM sequence: GGG
ccaatatctcacccagatat

SEQ ID NO: 128099 - DNA, 20 bp, Artificial Sequence
  Description of Artificial Sequence: Synthetic oligonucleotide
  Target: ATXN1; (+) strand; PAM type: NRG; PAM sequence: TGG
atatctcacccagatatggg

SEQ ID NO: 128100 - DNA, 20 bp, Artificial Sequence
  Description of Artificial Sequence: Synthetic oligonucleotide
  Target: ATXN1; (+) strand; PAM type: NRG; PAM sequence: CAG
cacccagatatgggtggcct

SEQ ID NO: 128101 - DNA, 20 bp, Artificial Sequence
  Description of Artificial Sequence: Synthetic oligonucleotide
  Target: ATXN1; (+) strand; PAM type: NRG; PAM sequence: GAG
cccagatatgggtggcctca

SEQ ID NO: 128102 - DNA, 20 bp, Artificial Sequence
  Description of Artificial Sequence: Synthetic oligonucleotide
  Target: ATXN1; (+) strand; PAM type: NRG; PAM sequence: TAG
ggcctcagagcttattgata

SEQ ID NO: 128103 - DNA, 20 bp, Artificial Sequence
  Description of Artificial Sequence: Synthetic oligonucleotide
  Target: ATXN1; (+) strand; PAM type: NRG; PAM sequence: AAG
atagactgtgtctctcacca

SEQ ID NO: 128104 - DNA, 20 bp, Artificial Sequence
  Description of Artificial Sequence: Synthetic oligonucleotide
  Target: ATXN1; (+) strand; PAM type: NRG; PAM sequence: AGG
tagactgtgtctctcaccaa

SEQ ID NO: 128105 - DNA, 20 bp, Artificial Sequence
  Description of Artificial Sequence: Synthetic oligonucleotide
  Target: ATXN1; (+) strand; PAM type: NRG; PAM sequence: GGG
agactgtgtctctcaccaaa

SEQ ID NO: 128106 - DNA, 20 bp, Artificial Sequence
  Description of Artificial Sequence: Synthetic oligonucleotide
  Target: ATXN1; (+) strand; PAM type: NRG; PAM sequence: TAG
catcatttctttaaaactat

SEQ ID NO: 128107 - DNA, 20 bp, Artificial Sequence
  Description of Artificial Sequence: Synthetic oligonucleotide
  Target: ATXN1; (+) strand; PAM type: NRG; PAM sequence: AAG
acaccgatttacctttaaac

SEQ ID NO: 128108 - DNA, 20 bp, Artificial Sequence
  Description of Artificial Sequence: Synthetic oligonucleotide
  Target: ATXN1; (+) strand; PAM type: NRG; PAM sequence: AGG
caccgatttacctttaaaca

SEQ ID NO: 128109 - DNA, 20 bp, Artificial Sequence
  Description of Artificial Sequence: Synthetic oligonucleotide
  Target: ATXN1; (+) strand; PAM type: NRG; PAM sequence: CAG
aaacaaggacattctataac

SEQ ID NO: 128110 - DNA, 20 bp, Artificial Sequence
  Description of Artificial Sequence: Synthetic oligonucleotide
  Target: ATXN1; (+) strand; PAM type: NRG; PAM sequence: AGG
aacaaggacattctataacc

SEQ ID NO: 128111 - DNA, 20 bp, Artificial Sequence
  Description of Artificial Sequence: Synthetic oligonucleotide
  Target: ATXN1; (+) strand; PAM type: NRG; PAM sequence: GGG
acaaggacattctataacca

SEQ ID NO: 128112 - DNA, 20 bp, Artificial Sequence
  Description of Artificial Sequence: Synthetic oligonucleotide
  Target: ATXN1; (+) strand; PAM type: NRG; PAM sequence: TGG
taaccagggatccacctctg

SEQ ID NO: 128113 - DNA, 20 bp, Artificial Sequence
  Description of Artificial Sequence: Synthetic oligonucleotide
  Target: ATXN1; (+) strand; PAM type: NRG; PAM sequence: TAG
agggatccacctctgtggct

SEQ ID NO: 128114 - DNA, 20 bp, Artificial Sequence
  Description of Artificial Sequence: Synthetic oligonucleotide
  Target: ATXN1; (+) strand; PAM type: NRG; PAM sequence: CGG
cacctctgtggcttagtcat

SEQ ID NO: 128115 - DNA, 20 bp, Artificial Sequence
  Description of Artificial Sequence: Synthetic oligonucleotide
  Target: ATXN1; (+) strand; PAM type: NRG; PAM sequence: CAG
ctgtggcttagtcatcggat

SEQ ID NO: 128116 - DNA, 20 bp, Artificial Sequence
  Description of Artificial Sequence: Synthetic oligonucleotide
  Target: ATXN1; (+) strand; PAM type: NRG; PAM sequence: AAG
ttagtcatcggatcagcctc

SEQ ID NO: 128117 - DNA, 20 bp, Artificial Sequence
  Description of Artificial Sequence: Synthetic oligonucleotide
  Target: ATXN1; (+) strand; PAM type: NRG; PAM sequence: AGG
tagtcatcggatcagcctca

SEQ ID NO: 128118 - DNA, 20 bp, Artificial Sequence
  Description of Artificial Sequence: Synthetic oligonucleotide
  Target: ATXN1; (+) strand; PAM type: NRG; PAM sequence: TAG
tcagcctcaaggtcaccgac

SEQ ID NO: 128119 - DNA, 20 bp, Artificial Sequence
  Description of Artificial Sequence: Synthetic oligonucleotide
  Target: ATXN1; (+) strand; PAM type: NRG; PAM sequence: GAG
agcctcaaggtcaccgacta

SEQ ID NO: 128120 - DNA, 20 bp, Artificial Sequence
  Description of Artificial Sequence: Synthetic oligonucleotide
  Target: ATXN1; (+) strand; PAM type: NRG; PAM sequence: TAG
attacctcattcacccacta

SEQ ID NO: 128121 - DNA, 20 bp, Artificial Sequence
  Description of Artificial Sequence: Synthetic oligonucleotide
  Target: ATXN1; (+) strand; PAM type: NRG; PAM sequence: CAG
ctcattcacccactatagaa

SEQ ID NO: 128122 - DNA, 20 bp, Artificial Sequence
  Description of Artificial Sequence: Synthetic oligonucleotide
  Target: ATXN1; (+) strand; PAM type: NRG; PAM sequence: CAG
agttctatcaccgatcaata

SEQ ID NO: 128123 - DNA, 20 bp, Artificial Sequence
  Description of Artificial Sequence: Synthetic oligonucleotide
  Target: ATXN1; (+) strand; PAM type: NRG; PAM sequence: AGG
gttctatcaccgatcaatac

SEQ ID NO: 128124 - DNA, 20 bp, Artificial Sequence
  Description of Artificial Sequence: Synthetic oligonucleotide
  Target: ATXN1; (+) strand; PAM type: NRG; PAM sequence: AAG
acctctgcacaacatcaaca

SEQ ID NO: 128125 - DNA, 20 bp, Artificial Sequence
  Description of Artificial Sequence: Synthetic oligonucleotide
  Target: ATXN1; (+) strand; PAM type: NRG; PAM sequence: AAG
aacatcaacaaagccttctc

SEQ ID NO: 128126 - DNA, 20 bp, Artificial Sequence
  Description of Artificial Sequence: Synthetic oligonucleotide
  Target: ATXN1; (+) strand; PAM type: NRG; PAM sequence: AGG
acatcaacaaagccttctca

SEQ ID NO: 128127 - DNA, 20 bp, Artificial Sequence
  Description of Artificial Sequence: Synthetic oligonucleotide
  Target: ATXN1; (+) strand; PAM type: NRG; PAM sequence: GGG
catcaacaaagccttctcaa

SEQ ID NO: 128128 - DNA, 20 bp, Artificial Sequence
  Description of Artificial Sequence: Synthetic oligonucleotide
  Target: ATXN1; (+) strand; PAM type: NRG; PAM sequence: GGG
atcaacaaagccttctcaag

SEQ ID NO: 128129 - DNA, 20 bp, Artificial Sequence
  Description of Artificial Sequence: Synthetic oligonucleotide
  Target: ATXN1; (+) strand; PAM type: NRG; PAM sequence: GGG
tcaacaaagccttctcaagg

SEQ ID NO: 128130 - DNA, 20 bp, Artificial Sequence
  Description of Artificial Sequence: Synthetic oligonucleotide
  Target: ATXN1; (+) strand; PAM type: NRG; PAM sequence: CAG
agggggcaccctgcatgcat

SEQ ID NO: 128131 - DNA, 20 bp, Artificial Sequence
  Description of Artificial Sequence: Synthetic oligonucleotide
  Target: ATXN1; (+) strand; PAM type: NRG; PAM sequence: TAG
tcagaaacaaattacaccct

SEQ ID NO: 128132 - DNA, 20 bp, Artificial Sequence
  Description of Artificial Sequence: Synthetic oligonucleotide
  Target: ATXN1; (+) strand; PAM type: NRG; PAM sequence: GAG
agaaacaaattacaccctta

SEQ ID NO: 128133 - DNA, 20 bp, Artificial Sequence
  Description of Artificial Sequence: Synthetic oligonucleotide
  Target: ATXN1; (+) strand; PAM type: NRG; PAM sequence: AGG
gaaacaaattacacccttag

SEQ ID NO: 128134 - DNA, 20 bp, Artificial Sequence
  Description of Artificial Sequence: Synthetic oligonucleotide
  Target: ATXN1; (+) strand; PAM type: NRG; PAM sequence: CAG
acaaattacacccttagagg

SEQ ID NO: 128135 - DNA, 20 bp, Artificial Sequence
  Description of Artificial Sequence: Synthetic oligonucleotide
  Target: ATXN1; (+) strand; PAM type: NRG; PAM sequence: AAG
tagaggcagatgacacaccg

SEQ ID NO: 128136 - DNA, 20 bp, Artificial Sequence
  Description of Artificial Sequence: Synthetic oligonucleotide
  Target: ATXN1; (+) strand; PAM type: NRG; PAM sequence: AGG
agaggcagatgacacaccga

SEQ ID NO: 128137 - DNA, 20 bp, Artificial Sequence
  Description of Artificial Sequence: Synthetic oligonucleotide
  Target: ATXN1; (+) strand; PAM type: NRG; PAM sequence: CAG
ggcagatgacacaccgaagg

SEQ ID NO: 128138 - DNA, 20 bp, Artificial Sequence
  Description of Artificial Sequence: Synthetic oligonucleotide
  Target: ATXN1; (+) strand; PAM type: NRG; PAM sequence: AAG
gatgacacaccgaaggcaga

SEQ ID NO: 128139 - DNA, 20 bp, Artificial Sequence
  Description of Artificial Sequence: Synthetic oligonucleotide
  Target: ATXN1; (+) strand; PAM type: NRG; PAM sequence: AAG
gcagaaagatcctctctgca

SEQ ID NO: 128140 - DNA, 20 bp, Artificial Sequence
  Description of Artificial Sequence: Synthetic oligonucleotide
  Target: ATXN1; (+) strand; PAM type: NRG; PAM sequence: AAG
aagatcctctctgcaaagca

SEQ ID NO: 128141 - DNA, 20 bp, Artificial Sequence
  Description of Artificial Sequence: Synthetic oligonucleotide
  Target: ATXN1; (+) strand; PAM type: NRG; PAM sequence: AAG
gcaaagcaaagcctttgttt

SEQ ID NO: 128142 - DNA, 20 bp, Artificial Sequence
  Description of Artificial Sequence: Synthetic oligonucleotide
  Target: ATXN1; (+) strand; PAM type: NRG; PAM sequence: GAG
caaagcctttgtttaagtct

SEQ ID NO: 128143 - DNA, 20 bp, Artificial Sequence
  Description of Artificial Sequence: Synthetic oligonucleotide
  Target: ATXN1; (+) strand; PAM type: NRG; PAM sequence: GAG
aagcctttgtttaagtctga

SEQ ID NO: 128144 - DNA, 20 bp, Artificial Sequence
  Description of Artificial Sequence: Synthetic oligonucleotide
  Target: ATXN1; (+) strand; PAM type: NRG; PAM sequence: AGG
agcctttgtttaagtctgag

SEQ ID NO: 128145 - DNA, 20 bp, Artificial Sequence
  Description of Artificial Sequence: Synthetic oligonucleotide
  Target: ATXN1; (+) strand; PAM type: NRG; PAM sequence: GAG
cctttgtttaagtctgagag

SEQ ID NO: 128146 - DNA, 20 bp, Artificial Sequence
  Description of Artificial Sequence: Synthetic oligonucleotide
  Target: ATXN1; (+) strand; PAM type: NRG; PAM sequence: AAG
tgccaatccaacctcaaaaa

SEQ ID NO: 128147 - DNA, 20 bp, Artificial Sequence
  Description of Artificial Sequence: Synthetic oligonucleotide
  Target: ATXN1; (+) strand; PAM type: NRG; PAM sequence: AGG
gccaatccaacctcaaaaaa

SEQ ID NO: 128148 - DNA, 20 bp, Artificial Sequence
  Description of Artificial Sequence: Synthetic oligonucleotide
  Target: ATXN1; (+) strand; PAM type: NRG; PAM sequence: GAG
caatccaacctcaaaaaaag

SEQ ID NO: 128149 - DNA, 20 bp, Artificial Sequence
  Description of Artificial Sequence: Synthetic oligonucleotide
  Target: ATXN1; (+) strand; PAM type: NRG; PAM sequence: AAG
caacctcaaaaaaaggagaa

SEQ ID NO: 128150 - DNA, 20 bp, Artificial Sequence
  Description of Artificial Sequence: Synthetic oligonucleotide
  Target: ATXN1; (+) strand; PAM type: NRG; PAM sequence: AGG
aacctcaaaaaaaggagaaa

SEQ ID NO: 128151 - DNA, 20 bp, Artificial Sequence
  Description of Artificial Sequence: Synthetic oligonucleotide
  Target: ATXN1; (+) strand; PAM type: NRG; PAM sequence: GAG
cctcaaaaaaaggagaaaag

SEQ ID NO: 128152 - DNA, 20 bp, Artificial Sequence
  Description of Artificial Sequence: Synthetic oligonucleotide
  Target: ATXN1; (+) strand; PAM type: NRG; PAM sequence: GAG
tcaaaaaaaggagaaaagga

SEQ ID NO: 128153 - DNA, 20 bp, Artificial Sequence
  Description of Artificial Sequence: Synthetic oligonucleotide
  Target: ATXN1; (+) strand; PAM type: NRG; PAM sequence: AGG
caaaaaaaggagaaaaggag

SEQ ID NO: 128154 - DNA, 20 bp, Artificial Sequence
  Description of Artificial Sequence: Synthetic oligonucleotide
  Target: ATXN1; (+) strand; PAM type: NRG; PAM sequence: AAG
aaaaggagaaaaggagagga

SEQ ID NO: 128155 - DNA, 20 bp, Artificial Sequence
  Description of Artificial Sequence: Synthetic oligonucleotide
  Target: ATXN1; (+) strand; PAM type: NRG; PAM sequence: GAG
aaggagaaaaggagaggaaa

SEQ ID NO: 128156 - DNA, 20 bp, Artificial Sequence
  Description of Artificial Sequence: Synthetic oligonucleotide
  Target: ATXN1; (+) strand; PAM type: NRG; PAM sequence: AGG
aggagaaaaggagaggaaag

SEQ ID NO: 128157 - DNA, 20 bp, Artificial Sequence
  Description of Artificial Sequence: Synthetic oligonucleotide
  Target: ATXN1; (+) strand; PAM type: NRG; PAM sequence: CAG
aggaaagaggatccatgcca

SEQ ID NO: 128158 - DNA, 20 bp, Artificial Sequence
  Description of Artificial Sequence: Synthetic oligonucleotide
  Target: ATXN1; (+) strand; PAM type: NRG; PAM sequence: CAG
gaggatccatgccacagaaa

SEQ ID NO: 128159 - DNA, 20 bp, Artificial Sequence
  Description of Artificial Sequence: Synthetic oligonucleotide
  Target: ATXN1; (+) strand; PAM type: NRG; PAM sequence: GAG
ggatccatgccacagaaaca

SEQ ID NO: 128160 - DNA, 20 bp, Artificial Sequence
  Description of Artificial Sequence: Synthetic oligonucleotide
  Target: ATXN1; (+) strand; PAM type: NRG; PAM sequence: CGG
cacagaaacagagtactgtt

SEQ ID NO: 128161 - DNA, 20 bp, Artificial Sequence
  Description of Artificial Sequence: Synthetic oligonucleotide
  Target: ATXN1; (+) strand; PAM type: NRG; PAM sequence: CGG
cttgcctttccgctcgaaca

SEQ ID NO: 128162 - DNA, 20 bp, Artificial Sequence
  Description of Artificial Sequence: Synthetic oligonucleotide
  Target: ATXN1; (+) strand; PAM type: NRG; PAM sequence: GGG
ttgcctttccgctcgaacac

SEQ ID NO: 128163 - DNA, 20 bp, Artificial Sequence
  Description of Artificial Sequence: Synthetic oligonucleotide
  Target: ATXN1; (+) strand; PAM type: NRG; PAM sequence: TGG
cgaacacgggatgcatcttc

SEQ ID NO: 128164 - DNA, 20 bp, Artificial Sequence
  Description of Artificial Sequence: Synthetic oligonucleotide
  Target: ATXN1; (+) strand; PAM type: NRG; PAM sequence: GGG
gaacacgggatgcatcttct

SEQ ID NO: 128165 - DNA, 20 bp, Artificial Sequence
  Description of Artificial Sequence: Synthetic oligonucleotide
  Target: ATXN1; (+) strand; PAM type: NRG; PAM sequence: GGG
aacacgggatgcatcttctg

SEQ ID NO: 128166 - DNA, 20 bp, Artificial Sequence
  Description of Artificial Sequence: Synthetic oligonucleotide
  Target: ATXN1; (+) strand; PAM type: NRG; PAM sequence: AAG
acgggatgcatcttctgggg

SEQ ID NO: 128167 - DNA, 20 bp, Artificial Sequence
  Description of Artificial Sequence: Synthetic oligonucleotide
  Target: ATXN1; (+) strand; PAM type: NRG; PAM sequence: GAG
gggatgcatcttctggggaa

SEQ ID NO: 128168 - DNA, 20 bp, Artificial Sequence
  Description of Artificial Sequence: Synthetic oligonucleotide
  Target: ATXN1; (+) strand; PAM type: NRG; PAM sequence: TGG
tcttctggggaagagaaaac

SEQ ID NO: 128169 - DNA, 20 bp, Artificial Sequence
  Description of Artificial Sequence: Synthetic oligonucleotide
  Target: ATXN1; (+) strand; PAM type: NRG; PAM sequence: AAG
tctggggaagagaaaactgg

SEQ ID NO: 128170 - DNA, 20 bp, Artificial Sequence
  Description of Artificial Sequence: Synthetic oligonucleotide
  Target: ATXN1; (+) strand; PAM type: NRG; PAM sequence: CAG
gaaaactggaagtgcaatga

SEQ ID NO: 128171 - DNA, 20 bp, Artificial Sequence
  Description of Artificial Sequence: Synthetic oligonucleotide
  Target: ATXN1; (+) strand; PAM type: NRG; PAM sequence: AGG
aaaactggaagtgcaatgac

SEQ ID NO: 128172 - DNA, 20 bp, Artificial Sequence
  Description of Artificial Sequence: Synthetic oligonucleotide
  Target: ATXN1; (+) strand; PAM type: NRG; PAM sequence: GGG
aaactggaagtgcaatgaca

SEQ ID NO: 128173 - DNA, 20 bp, Artificial Sequence
  Description of Artificial Sequence: Synthetic oligonucleotide
  Target: ATXN1; (+) strand; PAM type: NRG; PAM sequence: GGG
aactggaagtgcaatgacag

SEQ ID NO: 128174 - DNA, 20 bp, Artificial Sequence
  Description of Artificial Sequence: Synthetic oligonucleotide
  Target: ATXN1; (+) strand; PAM type: NRG; PAM sequence: GAG
tgacaggggactgcaatgct

SEQ ID NO: 128175 - DNA, 20 bp, Artificial Sequence
  Description of Artificial Sequence: Synthetic oligonucleotide
  Target: ATXN1; (+) strand; PAM type: NRG; PAM sequence: AAG
ggactgcaatgctgagaatc

SEQ ID NO: 128176 - DNA, 20 bp, Artificial Sequence
  Description of Artificial Sequence: Synthetic oligonucleotide
  Target: ATXN1; (+) strand; PAM type: NRG; PAM sequence: CAG
caatgctgagaatcaagaaa

SEQ ID NO: 128177 - DNA, 20 bp, Artificial Sequence
  Description of Artificial Sequence: Synthetic oligonucleotide
  Target: ATXN1; (+) strand; PAM type: NRG; PAM sequence: CAG
aatcaagaaacagaatttca

SEQ ID NO: 128178 - DNA, 20 bp, Artificial Sequence
  Description of Artificial Sequence: Synthetic oligonucleotide
  Target: ATXN1; (+) strand; PAM type: NRG; PAM sequence: TGG
aacagaatttcacagtgcat

SEQ ID NO: 128179 - DNA, 20 bp, Artificial Sequence
  Description of Artificial Sequence: Synthetic oligonucleotide
  Target: ATXN1; (+) strand; PAM type: NRG; PAM sequence: TAG
atcaccaataataaacatta

SEQ ID NO: 128180 - DNA, 20 bp, Artificial Sequence
  Description of Artificial Sequence: Synthetic oligonucleotide
  Target: ATXN1; (+) strand; PAM type: NRG; PAM sequence: GAG
caccaataataaacattata

SEQ ID NO: 128181 - DNA, 20 bp, Artificial Sequence
  Description of Artificial Sequence: Synthetic oligonucleotide
  Target: ATXN1; (+) strand; PAM type: NRG; PAM sequence: CAG
atagagtgcttactctgtgt

SEQ ID NO: 128182 - DNA, 20 bp, Artificial Sequence
  Description of Artificial Sequence: Synthetic oligonucleotide
  Target: ATXN1; (+) strand; PAM type: NRG; PAM sequence: TGG
attattattataattatttt

SEQ ID NO: 128183 - DNA, 20 bp, Artificial Sequence
  Description of Artificial Sequence: Synthetic oligonucleotide
  Target: ATXN1; (+) strand; PAM type: NRG; PAM sequence: GAG
tattattataattatttttg

SEQ ID NO: 128184 - DNA, 20 bp, Artificial Sequence
  Description of Artificial Sequence: Synthetic oligonucleotide
  Target: ATXN1; (+) strand; PAM type: NRG; PAM sequence: CGG
attataattatttttggaga

SEQ ID NO: 128185 - DNA, 20 bp, Artificial Sequence
  Description of Artificial Sequence: Synthetic oligonucleotide
  Target: ATXN1; (+) strand; PAM type: NRG; PAM sequence: CAG
acggaatcttgttctgtcac

SEQ ID NO: 128186 - DNA, 20 bp, Artificial Sequence
  Description of Artificial Sequence: Synthetic oligonucleotide
  Target: ATXN1; (+) strand; PAM type: NRG; PAM sequence: AGG
cggaatcttgttctgtcacc

SEQ ID NO: 128187 - DNA, 20 bp, Artificial Sequence
  Description of Artificial Sequence: Synthetic oligonucleotide
  Target: ATXN1; (+) strand; PAM type: NRG; PAM sequence: TGG
atcttgttctgtcaccaggc

SEQ ID NO: 128188 - DNA, 20 bp, Artificial Sequence
  Description of Artificial Sequence: Synthetic oligonucleotide
  Target: ATXN1; (+) strand; PAM type: NRG; PAM sequence: GAG
cttgttctgtcaccaggctg

SEQ ID NO: 128189 - DNA, 20 bp, Artificial Sequence
  Description of Artificial Sequence: Synthetic oligonucleotide
  Target: ATXN1; (+) strand; PAM type: NRG; PAM sequence: CAG
tctgtcaccaggctggagtg

SEQ ID NO: 128190 - DNA, 20 bp, Artificial Sequence
  Description of Artificial Sequence: Synthetic oligonucleotide
  Target: ATXN1; (+) strand; PAM type: NRG; PAM sequence: TAG
gtcaccaggctggagtgcag

SEQ ID NO: 128191 - DNA, 20 bp, Artificial Sequence
  Description of Artificial Sequence: Synthetic oligonucleotide
  Target: ATXN1; (+) strand; PAM type: NRG; PAM sequence: CGG
ggagtgcagtagcatgatct

SEQ ID NO: 128192 - DNA, 20 bp, Artificial Sequence
  Description of Artificial Sequence: Synthetic oligonucleotide
  Target: ATXN1; (+) strand; PAM type: NRG; PAM sequence: TGG
tcaatgcaacctccgcctcc

SEQ ID NO: 128193 - DNA, 20 bp, Artificial Sequence
  Description of Artificial Sequence: Synthetic oligonucleotide
  Target: ATXN1; (+) strand; PAM type: NRG; PAM sequence: GGG
caatgcaacctccgcctcct

SEQ ID NO: 128194 - DNA, 20 bp, Artificial Sequence
  Description of Artificial Sequence: Synthetic oligonucleotide
  Target: ATXN1; (+) strand; PAM type: NRG; PAM sequence: AAG
aacctccgcctcctgggttc

SEQ ID NO: 128195 - DNA, 20 bp, Artificial Sequence
  Description of Artificial Sequence: Synthetic oligonucleotide
  Target: ATXN1; (+) strand; PAM type: NRG; PAM sequence: CAG
ttcaagtgattcccctgcct

SEQ ID NO: 128196 - DNA, 20 bp, Artificial Sequence
  Description of Artificial Sequence: Synthetic oligonucleotide
  Target: ATXN1; (+) strand; PAM type: NRG; PAM sequence: AAG
ttcccctgcctcagcctccc

SEQ ID NO: 128197 - DNA, 20 bp, Artificial Sequence
  Description of Artificial Sequence: Synthetic oligonucleotide
  Target: ATXN1; (+) strand; PAM type: NRG; PAM sequence: TAG
ccctgcctcagcctcccaag

SEQ ID NO: 128198 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaagtagc

SEQ ID NO: 128199 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaagtagct

SEQ ID NO: 128200 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtagctgggacta

SEQ ID NO: 128201 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagctgggactac

SEQ ID NO: 128202 - DNA, 20 bp, Artificial Sequence
  Description of Artificial Sequence: Synthetic oligonucleotide
  Target: ATXN1; (+) strand; PAM type: NRG; PAM sequence: TGG
caggcgcgtgccaccacgcc

SEQ ID NO: 128203 - DNA, 20 bp, Artificial Sequence
  Description of Artificial Sequence: Synthetic oligonucleotide
  Target: ATXN1; (+) strand; PAM type: NRG; PAM sequence: TAG
tggctaattttttatatttt

SEQ ID NO: 128204 - DNA, 20 bp, Artificial Sequence
  Description of Artificial Sequence: Synthetic oligonucleotide
  Target: ATXN1; (+) strand; PAM type: NRG; PAM sequence: TAG
ctaattttttatatttttag

SEQ ID NO: 128205 - DNA, 20 bp, Artificial Sequence
  Description of Artificial Sequence: Synthetic oligonucleotide
  Target: ATXN1; (+) strand; PAM type: NRG; PAM sequence: GAG
aattttttatatttttagta

SEQ ID NO: 128206 - DNA, 20 bp, Artificial Sequence
  Description of Artificial Sequence: Synthetic oligonucleotide
  Target: ATXN1; (+) strand; PAM type: NRG; PAM sequence: CGG
ttttatatttttagtagaga

SEQ ID NO: 128207 - DNA, 20 bp, Artificial Sequence
  Description of Artificial Sequence: Synthetic oligonucleotide
  Target: ATXN1; (+) strand; PAM type: NRG; PAM sequence: GGG
tttatatttttagtagagac

SEQ ID NO: 128208 - DNA, 20 bp, Artificial Sequence
  Description of Artificial Sequence: Synthetic oligonucleotide
  Target: ATXN1; (+) strand; PAM type: NRG; PAM sequence: TGG
agagacgggtttcaccatgt

SEQ ID NO: 128209 - DNA, 20 bp, Artificial Sequence
  Description of Artificial Sequence: Synthetic oligonucleotide
  Target: ATXN1; (+) strand; PAM type: NRG; PAM sequence: CAG
acgggtttcaccatgttggc

SEQ ID NO: 128210 - DNA, 20 bp, Artificial Sequence
  Description of Artificial Sequence: Synthetic oligonucleotide
  Target: ATXN1; (+) strand; PAM type: NRG; PAM sequence: AGG
cgggtttcaccatgttggcc

SEQ ID NO: 128211 - DNA, 20 bp, Artificial Sequence
  Description of Artificial Sequence: Synthetic oligonucleotide
  Target: ATXN1; (+) strand; PAM type: NRG; PAM sequence: TGG
tttcaccatgttggccagga

SEQ ID NO: 128212 - DNA, 20 bp, Artificial Sequence
  Description of Artificial Sequence: Synthetic oligonucleotide
  Target: ATXN1; (+) strand; PAM type: NRG; PAM sequence: CAG
tggtctcgaactcctgacct

SEQ ID NO: 128213 - DNA, 20 bp, Artificial Sequence
  Description of Artificial Sequence: Synthetic oligonucleotide
  Target: ATXN1; (+) strand; PAM type: NRG; PAM sequence: AGG
ggtctcgaactcctgacctc

SEQ ID NO: 128214 - DNA, 20 bp, Artificial Sequence
  Description of Artificial Sequence: Synthetic oligonucleotide
  Target: ATXN1; (+) strand; PAM type: NRG; PAM sequence: CAG
ctcaggtgatccacccacct

SEQ ID NO: 128215 - DNA, 20 bp, Artificial Sequence
  Description of Artificial Sequence: Synthetic oligonucleotide
  Target: ATXN1; (+) strand; PAM type: NRG; PAM sequence: CAG
atccacccacctcagcctcc

SEQ ID NO: 128216 - DNA, 20 bp, Artificial Sequence
  Description of Artificial Sequence: Synthetic oligonucleotide
  Target: ATXN1; (+) strand; PAM type: NRG; PAM sequence: GAG
ccacccacctcagcctccca

SEQ ID NO: 128217 - DNA, 20 bp, Artificial Sequence
  Description of Artificial Sequence: Synthetic oligonucleotide
  Target: ATXN1; (+) strand; PAM type: NRG; PAM sequence: TGG
acctcagcctcccagagtgc

SEQ ID NO: 128218 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccagagtgct

SEQ ID NO: 128219 - DNA, 20 bp, Artificial Sequence
  Description of Artificial Sequence: Synthetic oligonucleotide
  Target: ATXN1; (+) strand; PAM type: NRG; PAM sequence: CAG
ctcccagagtgctgggatta

SEQ ID NO: 128220 - DNA, 20 bp, Artificial Sequence
  Description of Artificial Sequence: Synthetic oligonucleotide
  Target: ATXN1; (+) strand; PAM type: NRG; PAM sequence: AGG
tcccagagtgctgggattac

SEQ ID NO: 128221 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggcat

SEQ ID NO: 128222 - DNA, 20 bp, Artificial Sequence
  Description of Artificial Sequence: Synthetic oligonucleotide
  Target: ATXN1; (+) strand; PAM type: NRG; PAM sequence: CGG
caggcatgagccactgcgcc

SEQ ID NO: 128223 - DNA, 20 bp, Artificial Sequence
  Description of Artificial Sequence: Synthetic oligonucleotide
  Target: ATXN1; (+) strand; PAM type: NRG; PAM sequence: CAG
cactgcgcccggaactgatt

SEQ ID NO: 128224 - DNA, 20 bp, Artificial Sequence
  Description of Artificial Sequence: Synthetic oligonucleotide
  Target: ATXN1; (+) strand; PAM type: NRG; PAM sequence: CAG
aactgattcagctctcccaa

SEQ ID NO: 128225 - DNA, 20 bp, Artificial Sequence
  Description of Artificial Sequence: Synthetic oligonucleotide
  Target: ATXN1; (+) strand; PAM type: NRG; PAM sequence: CAG
attcagctctcccaacagcc

SEQ ID NO: 128226 - DNA, 20 bp, Artificial Sequence
  Description of Artificial Sequence: Synthetic oligonucleotide
  Target: ATXN1; (+) strand; PAM type: NRG; PAM sequence: GAG
agctctcccaacagcccagt

SEQ ID NO: 128227 - DNA, 20 bp, Artificial Sequence
  Description of Artificial Sequence: Synthetic oligonucleotide
  Target: ATXN1; (+) strand; PAM type: NRG; PAM sequence: GAG
tcccaacagcccagtgagat

SEQ ID NO: 128228 - DNA, 20 bp, Artificial Sequence
  Description of Artificial Sequence: Synthetic oligonucleotide
  Target: ATXN1; (+) strand; PAM type: NRG; PAM sequence: CAG
ctattattattcccattgta

SEQ ID NO: 128229 - DNA, 20 bp, Artificial Sequence
  Description of Artificial Sequence: Synthetic oligonucleotide
  Target: ATXN1; (+) strand; PAM type: NRG; PAM sequence: TGG
attattcccattgtacagat

SEQ ID NO: 128230 - DNA, 20 bp, Artificial Sequence
  Description of Artificial Sequence: Synthetic oligonucleotide
  Target: ATXN1; (+) strand; PAM type: NRG; PAM sequence: GAG
tattcccattgtacagattg

SEQ ID NO: 128231 - DNA, 20 bp, Artificial Sequence
  Description of Artificial Sequence: Synthetic oligonucleotide
  Target: ATXN1; (+) strand; PAM type: NRG; PAM sequence: GAG
attgtacagattggagtact

SEQ ID NO: 128232 - DNA, 20 bp, Artificial Sequence
  Description of Artificial Sequence: Synthetic oligonucleotide
  Target: ATXN1; (+) strand; PAM type: NRG; PAM sequence: AGG
ttgtacagattggagtactg

SEQ ID NO: 128233 - DNA, 20 bp, Artificial Sequence
  Description of Artificial Sequence: Synthetic oligonucleotide
  Target: ATXN1; (+) strand; PAM type: NRG; PAM sequence: AAG
agattggagtactgaggcac

SEQ ID NO: 128234 - DNA, 20 bp, Artificial Sequence
  Description of Artificial Sequence: Synthetic oligonucleotide
  Target: ATXN1; (+) strand; PAM type: NRG; PAM sequence: GAG
attggagtactgaggcacaa

SEQ ID NO: 128235 - DNA, 20 bp, Artificial Sequence
  Description of Artificial Sequence: Synthetic oligonucleotide
  Target: ATXN1; (+) strand; PAM type: NRG; PAM sequence: AGG
ttggagtactgaggcacaag

SEQ ID NO: 128236 - DNA, 20 bp, Artificial Sequence
  Description of Artificial Sequence: Synthetic oligonucleotide
  Target: ATXN1; (+) strand; PAM type: NRG; PAM sequence: GGG
tggagtactgaggcacaaga

SEQ ID NO: 128237 - DNA, 20 bp, Artificial Sequence
  Description of Artificial Sequence: Synthetic oligonucleotide
  Target: ATXN1; (+) strand; PAM type: NRG; PAM sequence: TAG
agtactgaggcacaagaggg

SEQ ID NO: 128238 - DNA, 20 bp, Artificial Sequence
  Description of Artificial Sequence: Synthetic oligonucleotide
  Target: ATXN1; (+) strand; PAM type: NRG; PAM sequence: AGG
gtactgaggcacaagagggt

SEQ ID NO: 128239 - DNA, 20 bp, Artificial Sequence
  Description of Artificial Sequence: Synthetic oligonucleotide
  Target: ATXN1; (+) strand; PAM type: NRG; PAM sequence: AAG
gaggcacaagagggtaggta

SEQ ID NO: 128240 - DNA, 20 bp, Artificial Sequence
  Description of Artificial Sequence: Synthetic oligonucleotide
  Target: ATXN1; (+) strand; PAM type: NRG; PAM sequence: AAG
gagggtaggtaaagtgcctg

SEQ ID NO: 128241 - DNA, 20 bp, Artificial Sequence
  Description of Artificial Sequence: Synthetic oligonucleotide
  Target: ATXN1; (+) strand; PAM type: NRG; PAM sequence: TGG
cctgaagtcacactgataaa

SEQ ID NO: 128242 - DNA, 20 bp, Artificial Sequence
  Description of Artificial Sequence: Synthetic oligonucleotide
  Target: ATXN1; (+) strand; PAM type: NRG; PAM sequence: CAG
gtcacactgataaatggctg

SEQ ID NO: 128243 - DNA, 20 bp, Artificial Sequence
  Description of Artificial Sequence: Synthetic oligonucleotide
  Target: ATXN1; (+) strand; PAM type: NRG; PAM sequence: TGG
cactgataaatggctgcagt

SEQ ID NO: 128244 - DNA, 20 bp, Artificial Sequence
  Description of Artificial Sequence: Synthetic oligonucleotide
  Target: ATXN1; (+) strand; PAM type: NRG; PAM sequence: GGG
actgataaatggctgcagtt

SEQ ID NO: 128245 - DNA, 20 bp, Artificial Sequence
  Description of Artificial Sequence: Synthetic oligonucleotide
  Target: ATXN1; (+) strand; PAM type: NRG; PAM sequence: AAG
atggctgcagttgggattca

SEQ ID NO: 128246 - DNA, 20 bp, Artificial Sequence
  Description of Artificial Sequence: Synthetic oligonucleotide
  Target: ATXN1; (+) strand; PAM type: NRG; PAM sequence: AAG
tgcagttgggattcaaagcc

SEQ ID NO: 128247 - DNA, 20 bp, Artificial Sequence
  Description of Artificial Sequence: Synthetic oligonucleotide
  Target: ATXN1; (+) strand; PAM type: NRG; PAM sequence: AGG
gcagttgggattcaaagcca

SEQ ID NO: 128248 - DNA, 20 bp, Artificial Sequence
  Description of Artificial Sequence: Synthetic oligonucleotide
  Target: ATXN1; (+) strand; PAM type: NRG; PAM sequence: GAG
agttgggattcaaagccaag

SEQ ID NO: 128249 - DNA, 20 bp, Artificial Sequence
  Description of Artificial Sequence: Synthetic oligonucleotide
  Target: ATXN1; (+) strand; PAM type: NRG; PAM sequence: TAG
gggattcaaagccaaggagt

SEQ ID NO: 128250 - DNA, 20 bp, Artificial Sequence
  Description of Artificial Sequence: Synthetic oligonucleotide
  Target: ATXN1; (+) strand; PAM type: NRG; PAM sequence: AGG
ggattcaaagccaaggagtt

SEQ ID NO: 128251 - DNA, 20 bp, Artificial Sequence
  Description of Artificial Sequence: Synthetic oligonucleotide
  Target: ATXN1; (+) strand; PAM type: NRG; PAM sequence: TAG
aaagccaaggagttaggctc

SEQ ID NO: 128252 - DNA, 20 bp, Artificial Sequence
  Description of Artificial Sequence: Synthetic oligonucleotide
  Target: ATXN1; (+) strand; PAM type: NRG; PAM sequence: GAG
agccaaggagttaggctcta

SEQ ID NO: 128253 - DNA, 20 bp, Artificial Sequence
  Description of Artificial Sequence: Synthetic oligonucleotide
  Target: ATXN1; (+) strand; PAM type: NRG; PAM sequence: TGG
agtcactatattaaactgcc

SEQ ID NO: 128254 - DNA, 20 bp, Artificial Sequence
  Description of Artificial Sequence: Synthetic oligonucleotide
  Target: ATXN1; (+) strand; PAM type: NRG; PAM sequence: AAG
ctatattaaactgcctggtt

SEQ ID NO: 128255 - DNA, 20 bp, Artificial Sequence
  Description of Artificial Sequence: Synthetic oligonucleotide
  Target: ATXN1; (+) strand; PAM type: NRG; PAM sequence: CAG
ttaaactgcctggttaagaa

SEQ ID NO: 128256 - DNA, 20 bp, Artificial Sequence
  Description of Artificial Sequence: Synthetic oligonucleotide
  Target: ATXN1; (+) strand; PAM type: NRG; PAM sequence: TAG
acagcaatattacataatgt

SEQ ID NO: 128257 - DNA, 20 bp, Artificial Sequence
  Description of Artificial Sequence: Synthetic oligonucleotide
  Target: ATXN1; (+) strand; PAM type: NRG; PAM sequence: AGG
cagcaatattacataatgtt

SEQ ID NO: 128258 - DNA, 20 bp, Artificial Sequence
  Description of Artificial Sequence: Synthetic oligonucleotide
  Target: ATXN1; (+) strand; PAM type: NRG; PAM sequence: CAG
taggtttgtgttgtgtttta

SEQ ID NO: 128259 - DNA, 20 bp, Artificial Sequence
  Description of Artificial Sequence: Synthetic oligonucleotide
  Target: ATXN1; (+) strand; PAM type: NRG; PAM sequence: TGG
acatgctttttccctctgct

SEQ ID NO: 128260 - DNA, 20 bp, Artificial Sequence
  Description of Artificial Sequence: Synthetic oligonucleotide
  Target: ATXN1; (+) strand; PAM type: NRG; PAM sequence: TGG
ctttttccctctgcttggaa

SEQ ID NO: 128261 - DNA, 20 bp, Artificial Sequence
  Description of Artificial Sequence: Synthetic oligonucleotide
  Target: ATXN1; (+) strand; PAM type: NRG; PAM sequence: GAG
tgtctcatgtatttacttat

SEQ ID NO: 128262 - DNA, 20 bp, Artificial Sequence
  Description of Artificial Sequence: Synthetic oligonucleotide
  Target: ATXN1; (+) strand; PAM type: NRG; PAM sequence: CAG
cttatgagttcctctcccaa

SEQ ID NO: 128263 - DNA, 20 bp, Artificial Sequence
  Description of Artificial Sequence: Synthetic oligonucleotide
  Target: ATXN1; (+) strand; PAM type: NRG; PAM sequence: GAG
tatgagttcctctcccaaca

SEQ ID NO: 128264 - DNA, 20 bp, Artificial Sequence
  Description of Artificial Sequence: Synthetic oligonucleotide
  Target: ATXN1; (+) strand; PAM type: NRG; PAM sequence: AAG
ccaacagagccttctactga

SEQ ID NO: 128265 - DNA, 20 bp, Artificial Sequence
  Description of Artificial Sequence: Synthetic oligonucleotide
  Target: ATXN1; (+) strand; PAM type: NRG; PAM sequence: AGG
caacagagccttctactgaa

SEQ ID NO: 128266 - DNA, 20 bp, Artificial Sequence
  Description of Artificial Sequence: Synthetic oligonucleotide
  Target: ATXN1; (+) strand; PAM type: NRG; PAM sequence: TAG
ggtgttcaataccgtgttca

SEQ ID NO: 128267 - DNA, 20 bp, Artificial Sequence
  Description of Artificial Sequence: Synthetic oligonucleotide
  Target: ATXN1; (+) strand; PAM type: NRG; PAM sequence: GAG
tgttcaataccgtgttcata

SEQ ID NO: 128268 - DNA, 20 bp, Artificial Sequence
  Description of Artificial Sequence: Synthetic oligonucleotide
  Target: ATXN1; (+) strand; PAM type: NRG; PAM sequence: AAG
aataccgtgttcatagagtg

SEQ ID NO: 128269 - DNA, 20 bp, Artificial Sequence
  Description of Artificial Sequence: Synthetic oligonucleotide
  Target: ATXN1; (+) strand; PAM type: NRG; PAM sequence: AGG
ataccgtgttcatagagtga

SEQ ID NO: 128270 - DNA, 20 bp, Artificial Sequence
  Description of Artificial Sequence: Synthetic oligonucleotide
  Target: ATXN1; (+) strand; PAM type: NRG; PAM sequence: TGG
aattaatccttaaattgctg

SEQ ID NO: 128271 - DNA, 20 bp, Artificial Sequence
  Description of Artificial Sequence: Synthetic oligonucleotide
  Target: ATXN1; (+) strand; PAM type: NRG; PAM sequence: GGG
attaatccttaaattgctgt

SEQ ID NO: 128272 - DNA, 20 bp, Artificial Sequence
  Description of Artificial Sequence: Synthetic oligonucleotide
  Target: ATXN1; (+) strand; PAM type: NRG; PAM sequence: GAG
taatccttaaattgctgtgg

SEQ ID NO: 128273 - DNA, 20 bp, Artificial Sequence
  Description of Artificial Sequence: Synthetic oligonucleotide
  Target: ATXN1; (+) strand; PAM type: NRG; PAM sequence: CAG
ccttaaattgctgtgggaga

SEQ ID NO: 128274 - DNA, 20 bp, Artificial Sequence
  Description of Artificial Sequence: Synthetic oligonucleotide
  Target: ATXN1; (+) strand; PAM type: NRG; PAM sequence: AGG
cttaaattgctgtgggagac

SEQ ID NO: 128275 - DNA, 20 bp, Artificial Sequence
  Description of Artificial Sequence: Synthetic oligonucleotide
  Target: ATXN1; (+) strand; PAM type: NRG; PAM sequence: GAG
attgctgtgggagacaggct

SEQ ID NO: 128276 - DNA, 20 bp, Artificial Sequence
  Description of Artificial Sequence: Synthetic oligonucleotide
  Target: ATXN1; (+) strand; PAM type: NRG; PAM sequence: AAG
gactaaacttgttttgaaat

SEQ ID NO: 128277 - DNA, 20 bp, Artificial Sequence
  Description of Artificial Sequence: Synthetic oligonucleotide
  Target: ATXN1; (+) strand; PAM type: NRG; PAM sequence: AGG
actaaacttgttttgaaata

SEQ ID NO: 128278 - DNA, 20 bp, Artificial Sequence
  Description of Artificial Sequence: Synthetic oligonucleotide
  Target: ATXN1; (+) strand; PAM type: NRG; PAM sequence: GAG
tgttttgaaataaggaaaat

SEQ ID NO: 128279 - DNA, 20 bp, Artificial Sequence
  Description of Artificial Sequence: Synthetic oligonucleotide
  Target: ATXN1; (+) strand; PAM type: NRG; PAM sequence: AGG
gttttgaaataaggaaaatg

SEQ ID NO: 128280 - DNA, 20 bp, Artificial Sequence
  Description of Artificial Sequence: Synthetic oligonucleotide
  Target: ATXN1; (+) strand; PAM type: NRG; PAM sequence: TGG
gaaataaggaaaatgaggtt

SEQ ID NO: 128281 - DNA, 20 bp, Artificial Sequence
  Description of Artificial Sequence: Synthetic oligonucleotide
  Target: ATXN1; (+) strand; PAM type: NRG; PAM sequence: GGG
aaataaggaaaatgaggttt

SEQ ID NO: 128282 - DNA, 20 bp, Artificial Sequence
  Description of Artificial Sequence: Synthetic oligonucleotide
  Target: ATXN1; (+) strand; PAM type: NRG; PAM sequence: AAG
gaaaatcaaatgacttgtct

SEQ ID NO: 128283 - DNA, 20 bp, Artificial Sequence
  Description of Artificial Sequence: Synthetic oligonucleotide
  Target: ATXN1; (+) strand; PAM type: NRG; PAM sequence: AGG
aaaatcaaatgacttgtcta

SEQ ID NO: 128284 - DNA, 20 bp, Artificial Sequence
  Description of Artificial Sequence: Synthetic oligonucleotide
  Target: ATXN1; (+) strand; PAM type: NRG; PAM sequence: GAG
ggtcatattgctttgaatat

SEQ ID NO: 128285 - DNA, 20 bp, Artificial Sequence
  Description of Artificial Sequence: Synthetic oligonucleotide
  Target: ATXN1; (+) strand; PAM type: NRG; PAM sequence: CAG
tgagctcatcgtaactaaac

SEQ ID NO: 128286 - DNA, 20 bp, Artificial Sequence
  Description of Artificial Sequence: Synthetic oligonucleotide
  Target: ATXN1; (+) strand; PAM type: NRG; PAM sequence: TGG
gctcatcgtaactaaaccag

SEQ ID NO: 128287 - DNA, 20 bp, Artificial Sequence
  Description of Artificial Sequence: Synthetic oligonucleotide
  Target: ATXN1; (+) strand; PAM type: NRG; PAM sequence: CAG
aaaaaaattttttttaacca

SEQ ID NO: 128288 - DNA, 20 bp, Artificial Sequence
  Description of Artificial Sequence: Synthetic oligonucleotide
  Target: ATXN1; (+) strand; PAM type: NRG; PAM sequence: AGG
aaaaaattttttttaaccac

SEQ ID NO: 128289 - DNA, 20 bp, Artificial Sequence
  Description of Artificial Sequence: Synthetic oligonucleotide
  Target: ATXN1; (+) strand; PAM type: NRG; PAM sequence: AAG
tttaaccacaggacctttct

SEQ ID NO: 128290 - DNA, 20 bp, Artificial Sequence
  Description of Artificial Sequence: Synthetic oligonucleotide
  Target: ATXN1; (+) strand; PAM type: NRG; PAM sequence: TAG
tctaagaaaactattttaca

SEQ ID NO: 128291 - DNA, 20 bp, Artificial Sequence
  Description of Artificial Sequence: Synthetic oligonucleotide
  Target: ATXN1; (+) strand; PAM type: NRG; PAM sequence: CAG
aaaactattttacatagcct

SEQ ID NO: 128292 - DNA, 20 bp, Artificial Sequence
  Description of Artificial Sequence: Synthetic oligonucleotide
  Target: ATXN1; (+) strand; PAM type: NRG; PAM sequence: CAG
tacatagcctcagaatatca

SEQ ID NO: 128293 - DNA, 20 bp, Artificial Sequence
  Description of Artificial Sequence: Synthetic oligonucleotide
  Target: ATXN1; (+) strand; PAM type: NRG; PAM sequence: GAG
catagcctcagaatatcaca

SEQ ID NO: 128294 - DNA, 20 bp, Artificial Sequence
  Description of Artificial Sequence: Synthetic oligonucleotide
  Target: ATXN1; (+) strand; PAM type: NRG; PAM sequence: AAG
ctcagaatatcacagagctg

SEQ ID NO: 128295 - DNA, 20 bp, Artificial Sequence
  Description of Artificial Sequence: Synthetic oligonucleotide
  Target: ATXN1; (+) strand; PAM type: NRG; PAM sequence: AGG
tcagaatatcacagagctga

SEQ ID NO: 128296 - DNA, 20 bp, Artificial Sequence
  Description of Artificial Sequence: Synthetic oligonucleotide
  Target: ATXN1; (+) strand; PAM type: NRG; PAM sequence: GAG
agaatatcacagagctgaag

SEQ ID NO: 128297 - DNA, 20 bp, Artificial Sequence
  Description of Artificial Sequence: Synthetic oligonucleotide
  Target: ATXN1; (+) strand; PAM type: NRG; PAM sequence: AAG
atatcacagagctgaaggag

SEQ ID NO: 128298 - DNA, 20 bp, Artificial Sequence
  Description of Artificial Sequence: Synthetic oligonucleotide
  Target: ATXN1; (+) strand; PAM type: NRG; PAM sequence: CGG
gagaagctgccccgctgccc

SEQ ID NO: 128299 - DNA, 20 bp, Artificial Sequence
  Description of Artificial Sequence: Synthetic oligonucleotide
  Target: ATXN1; (+) strand; PAM type: NRG; PAM sequence: TAG
tgccccgctgccccggtcaa

SEQ ID NO: 128300 - DNA, 20 bp, Artificial Sequence
  Description of Artificial Sequence: Synthetic oligonucleotide
  Target: ATXN1; (+) strand; PAM type: NRG; PAM sequence: GAG
ccccgctgccccggtcaata

SEQ ID NO: 128301 - DNA, 20 bp, Artificial Sequence
  Description of Artificial Sequence: Synthetic oligonucleotide
  Target: ATXN1; (+) strand; PAM type: NRG; PAM sequence: AGG
cccgctgccccggtcaatag

SEQ ID NO: 128302 - DNA, 20 bp, Artificial Sequence
  Description of Artificial Sequence: Synthetic oligonucleotide
  Target: ATXN1; (+) strand; PAM type: NRG; PAM sequence: GAG
tgccccggtcaatagaggct

SEQ ID NO: 128303 - DNA, 20 bp, Artificial Sequence
  Description of Artificial Sequence: Synthetic oligonucleotide
  Target: ATXN1; (+) strand; PAM type: NRG; PAM sequence: AGG
gccccggtcaatagaggctg

SEQ ID NO: 128304 - DNA, 20 bp, Artificial Sequence
  Description of Artificial Sequence: Synthetic oligonucleotide
  Target: ATXN1; (+) strand; PAM type: NRG; PAM sequence: GGG
ccccggtcaatagaggctga

SEQ ID NO: 128305 - DNA, 20 bp, Artificial Sequence
  Description of Artificial Sequence: Synthetic oligonucleotide
  Target: ATXN1; (+) strand; PAM type: NRG; PAM sequence: CAG
cggtcaatagaggctgaggg

SEQ ID NO: 128306 - DNA, 20 bp, Artificial Sequence
  Description of Artificial Sequence: Synthetic oligonucleotide
  Target: ATXN1; (+) strand; PAM type: NRG; PAM sequence: CAG
tagaggctgagggcagccca

SEQ ID NO: 128307 - DNA, 20 bp, Artificial Sequence
  Description of Artificial Sequence: Synthetic oligonucleotide
  Target: ATXN1; (+) strand; PAM type: NRG; PAM sequence: AAG
gagggcagcccacagcctca

SEQ ID NO: 128308 - DNA, 20 bp, Artificial Sequence
  Description of Artificial Sequence: Synthetic oligonucleotide
  Target: ATXN1; (+) strand; PAM type: NRG; PAM sequence: TGG
gcccacagcctcaaagttta

SEQ ID NO: 128309 - DNA, 20 bp, Artificial Sequence
  Description of Artificial Sequence: Synthetic oligonucleotide
  Target: ATXN1; (+) strand; PAM type: NRG; PAM sequence: GGG
cccacagcctcaaagtttat

SEQ ID NO: 128310 - DNA, 20 bp, Artificial Sequence
  Description of Artificial Sequence: Synthetic oligonucleotide
  Target: ATXN1; (+) strand; PAM type: NRG; PAM sequence: GGG
ccacagcctcaaagtttatg

SEQ ID NO: 128311 - DNA, 20 bp, Artificial Sequence
  Description of Artificial Sequence: Synthetic oligonucleotide
  Target: ATXN1; (+) strand; PAM type: NRG; PAM sequence: GAG
acagcctcaaagtttatggg

SEQ ID NO: 128312 - DNA, 20 bp, Artificial Sequence
  Description of Artificial Sequence: Synthetic oligonucleotide
  Target: ATXN1; (+) strand; PAM type: NRG; PAM sequence: TGG
caaagtttatggggagcctc

SEQ ID NO: 128313 - DNA, 20 bp, Artificial Sequence
  Description of Artificial Sequence: Synthetic oligonucleotide
  Target: ATXN1; (+) strand; PAM type: NRG; PAM sequence: GGG
aaagtttatggggagcctct

SEQ ID NO: 128314 - DNA, 20 bp, Artificial Sequence
  Description of Artificial Sequence: Synthetic oligonucleotide
  Target: ATXN1; (+) strand; PAM type: NRG; PAM sequence: GGG
aagtttatggggagcctctg

SEQ ID NO: 128315 - DNA, 20 bp, Artificial Sequence
  Description of Artificial Sequence: Synthetic oligonucleotide
  Target: ATXN1; (+) strand; PAM type: NRG; PAM sequence: CAG
ggggagcctctggggctttg

SEQ ID NO: 128316 - DNA, 20 bp, Artificial Sequence
  Description of Artificial Sequence: Synthetic oligonucleotide
  Target: ATXN1; (+) strand; PAM type: NRG; PAM sequence: CAG
ctctggggctttgcagaatg

SEQ ID NO: 128317 - DNA, 20 bp, Artificial Sequence
  Description of Artificial Sequence: Synthetic oligonucleotide
  Target: ATXN1; (+) strand; PAM type: NRG; PAM sequence: AGG
tctggggctttgcagaatgc

SEQ ID NO: 128318 - DNA, 20 bp, Artificial Sequence
  Description of Artificial Sequence: Synthetic oligonucleotide
  Target: ATXN1; (+) strand; PAM type: NRG; PAM sequence: TGG
gggctttgcagaatgcaggc

SEQ ID NO: 128319 - DNA, 20 bp, Artificial Sequence
  Description of Artificial Sequence: Synthetic oligonucleotide
  Target: ATXN1; (+) strand; PAM type: NRG; PAM sequence: GGG
ggctttgcagaatgcaggct

SEQ ID NO: 128320 - DNA, 20 bp, Artificial Sequence
  Description of Artificial Sequence: Synthetic oligonucleotide
  Target: ATXN1; (+) strand; PAM type: NRG; PAM sequence: GGG
gctttgcagaatgcaggctg

SEQ ID NO: 128321 - DNA, 20 bp, Artificial Sequence
  Description of Artificial Sequence: Synthetic oligonucleotide
  Target: ATXN1; (+) strand; PAM type: NRG; PAM sequence: TAG
actgcaccacgcaacactac

SEQ ID NO: 128322 - DNA, 20 bp, Artificial Sequence
  Description of Artificial Sequence: Synthetic oligonucleotide
  Target: ATXN1; (+) strand; PAM type: NRG; PAM sequence: AGG
ctgcaccacgcaacactact

SEQ ID NO: 128323 - DNA, 20 bp, Artificial Sequence
  Description of Artificial Sequence: Synthetic oligonucleotide
  Target: ATXN1; (+) strand; PAM type: NRG; PAM sequence: CAG
cactactaggacacctgacc

SEQ ID NO: 128324 - DNA, 20 bp, Artificial Sequence
  Description of Artificial Sequence: Synthetic oligonucleotide
  Target: ATXN1; (+) strand; PAM type: NRG; PAM sequence: GAG
tgacccagccctgaaacttt

SEQ ID NO: 128325 - DNA, 20 bp, Artificial Sequence
  Description of Artificial Sequence: Synthetic oligonucleotide
  Target: ATXN1; (+) strand; PAM type: NRG; PAM sequence: GAG
acccagccctgaaactttga

SEQ ID NO: 128326 - DNA, 20 bp, Artificial Sequence
  Description of Artificial Sequence: Synthetic oligonucleotide
  Target: ATXN1; (+) strand; PAM type: NRG; PAM sequence: GAG
ccagccctgaaactttgaga

SEQ ID NO: 128327 - DNA, 20 bp, Artificial Sequence
  Description of Artificial Sequence: Synthetic oligonucleotide
  Target: ATXN1; (+) strand; PAM type: NRG; PAM sequence: AGG
cagccctgaaactttgagag

SEQ ID NO: 128328 - DNA, 20 bp, Artificial Sequence
  Description of Artificial Sequence: Synthetic oligonucleotide
  Target: ATXN1; (+) strand; PAM type: NRG; PAM sequence: GGG
agccctgaaactttgagaga

SEQ ID NO: 128329 - DNA, 20 bp, Artificial Sequence
  Description of Artificial Sequence: Synthetic oligonucleotide
  Target: ATXN1; (+) strand; PAM type: NRG; PAM sequence: AAG
gggtgaccaaccacaccttc

SEQ ID NO: 128330 - DNA, 20 bp, Artificial Sequence
  Description of Artificial Sequence: Synthetic oligonucleotide
  Target: ATXN1; (+) strand; PAM type: NRG; PAM sequence: TGG
ccatttacgactctgaccca

SEQ ID NO: 128331 - DNA, 20 bp, Artificial Sequence
  Description of Artificial Sequence: Synthetic oligonucleotide
  Target: ATXN1; (+) strand; PAM type: NRG; PAM sequence: GGG
catttacgactctgacccat

SEQ ID NO: 128332 - DNA, 20 bp, Artificial Sequence
  Description of Artificial Sequence: Synthetic oligonucleotide
  Target: ATXN1; (+) strand; PAM type: NRG; PAM sequence: GGG
atttacgactctgacccatg

SEQ ID NO: 128333 - DNA, 20 bp, Artificial Sequence
  Description of Artificial Sequence: Synthetic oligonucleotide
  Target: ATXN1; (+) strand; PAM type: NRG; PAM sequence: GGG
tttacgactctgacccatgg

SEQ ID NO: 128334 - DNA, 20 bp, Artificial Sequence
  Description of Artificial Sequence: Synthetic oligonucleotide
  Target: ATXN1; (+) strand; PAM type: NRG; PAM sequence: AAG
acgactctgacccatggggg

SEQ ID NO: 128335 - DNA, 20 bp, Artificial Sequence
  Description of Artificial Sequence: Synthetic oligonucleotide
  Target: ATXN1; (+) strand; PAM type: NRG; PAM sequence: AGG
cgactctgacccatggggga

SEQ ID NO: 128336 - DNA, 20 bp, Artificial Sequence
  Description of Artificial Sequence: Synthetic oligonucleotide
  Target: ATXN1; (+) strand; PAM type: NRG; PAM sequence: CAG
ctctgacccatgggggaagg

SEQ ID NO: 128337 - DNA, 20 bp, Artificial Sequence
  Description of Artificial Sequence: Synthetic oligonucleotide
  Target: ATXN1; (+) strand; PAM type: NRG; PAM sequence: GAG
ctgacccatgggggaaggca

SEQ ID NO: 128338 - DNA, 20 bp, Artificial Sequence
  Description of Artificial Sequence: Synthetic oligonucleotide
  Target: ATXN1; (+) strand; PAM type: NRG; PAM sequence: AGG
tgacccatgggggaaggcag

SEQ ID NO: 128339 - DNA, 20 bp, Artificial Sequence
  Description of Artificial Sequence: Synthetic oligonucleotide
  Target: ATXN1; (+) strand; PAM type: NRG; PAM sequence: AAG
atgggggaaggcagaggatt

SEQ ID NO: 128340 - DNA, 20 bp, Artificial Sequence
  Description of Artificial Sequence: Synthetic oligonucleotide
  Target: ATXN1; (+) strand; PAM type: NRG; PAM sequence: CAG
gattctttctccttccaccc

SEQ ID NO: 128341 - DNA, 20 bp, Artificial Sequence
  Description of Artificial Sequence: Synthetic oligonucleotide
  Target: ATXN1; (+) strand; PAM type: NRG; PAM sequence: CAG
tctttctccttccaccccag

SEQ ID NO: 128342 - DNA, 20 bp, Artificial Sequence
  Description of Artificial Sequence: Synthetic oligonucleotide
  Target: ATXN1; (+) strand; PAM type: NRG; PAM sequence: GAG
tttctccttccaccccagca

SEQ ID NO: 128343 - DNA, 20 bp, Artificial Sequence
  Description of Artificial Sequence: Synthetic oligonucleotide
  Target: ATXN1; (+) strand; PAM type: NRG; PAM sequence: AGG
ttctccttccaccccagcag

SEQ ID NO: 128344 - DNA, 20 bp, Artificial Sequence
  Description of Artificial Sequence: Synthetic oligonucleotide
  Target: ATXN1; (+) strand; PAM type: NRG; PAM sequence: GGG
tctccttccaccccagcaga

SEQ ID NO: 128345 - DNA, 20 bp, Artificial Sequence
  Description of Artificial Sequence: Synthetic oligonucleotide
  Target: ATXN1; (+) strand; PAM type: NRG; PAM sequence: TAG
ccagcagagggacctgttct

SEQ ID NO: 128346 - DNA, 20 bp, Artificial Sequence
  Description of Artificial Sequence: Synthetic oligonucleotide
  Target: ATXN1; (+) strand; PAM type: NRG; PAM sequence: CAG
gggacctgttcttagcttcc

SEQ ID NO: 128347 - DNA, 20 bp, Artificial Sequence
  Description of Artificial Sequence: Synthetic oligonucleotide
  Target: ATXN1; (+) strand; PAM type: NRG; PAM sequence: GAG
tgttcttagcttcccagctt

SEQ ID NO: 128348 - DNA, 20 bp, Artificial Sequence
  Description of Artificial Sequence: Synthetic oligonucleotide
  Target: ATXN1; (+) strand; PAM type: NRG; PAM sequence: TGG
tctctttctgtttctttctt

SEQ ID NO: 128349 - DNA, 20 bp, Artificial Sequence
  Description of Artificial Sequence: Synthetic oligonucleotide
  Target: ATXN1; (+) strand; PAM type: NRG; PAM sequence: GAG
tctttctgtttctttctttg

SEQ ID NO: 128350 - DNA, 20 bp, Artificial Sequence
  Description of Artificial Sequence: Synthetic oligonucleotide
  Target: ATXN1; (+) strand; PAM type: NRG; PAM sequence: CAG
ttctgtatttgttccttttt

SEQ ID NO: 128351 - DNA, 20 bp, Artificial Sequence
  Description of Artificial Sequence: Synthetic oligonucleotide
  Target: ATXN1; (+) strand; PAM type: NRG; PAM sequence: GAG
tttgttcctttttcagtccc

SEQ ID NO: 128352 - DNA, 20 bp, Artificial Sequence
  Description of Artificial Sequence: Synthetic oligonucleotide
  Target: ATXN1; (+) strand; PAM type: NRG; PAM sequence: AGG
ttgttcctttttcagtcccg

SEQ ID NO: 128353 - DNA, 20 bp, Artificial Sequence
  Description of Artificial Sequence: Synthetic oligonucleotide
  Target: ATXN1; (+) strand; PAM type: NRG; PAM sequence: GGG
tgttcctttttcagtcccga

SEQ ID NO: 128354 - DNA, 20 bp, Artificial Sequence
  Description of Artificial Sequence: Synthetic oligonucleotide
  Target: ATXN1; (+) strand; PAM type: NRG; PAM sequence: TGG
cagtcccgagggctgatcac

SEQ ID NO: 128355 - DNA, 20 bp, Artificial Sequence
  Description of Artificial Sequence: Synthetic oligonucleotide
  Target: ATXN1; (+) strand; PAM type: NRG; PAM sequence: CAG
cgagggctgatcactggaaa

SEQ ID NO: 128356 - DNA, 20 bp, Artificial Sequence
  Description of Artificial Sequence: Synthetic oligonucleotide
  Target: ATXN1; (+) strand; PAM type: NRG; PAM sequence: AGG
gagggctgatcactggaaac

SEQ ID NO: 128357 - DNA, 20 bp, Artificial Sequence
  Description of Artificial Sequence: Synthetic oligonucleotide
  Target: ATXN1; (+) strand; PAM type: NRG; PAM sequence: GGG
agggctgatcactggaaaca

SEQ ID NO: 128358 - DNA, 20 bp, Artificial Sequence
  Description of Artificial Sequence: Synthetic oligonucleotide
  Target: ATXN1; (+) strand; PAM type: NRG; PAM sequence: TGG
actggaaacagggcaacctc

SEQ ID NO: 128359 - DNA, 20 bp, Artificial Sequence
  Description of Artificial Sequence: Synthetic oligonucleotide
  Target: ATXN1; (+) strand; PAM type: NRG; PAM sequence: TGG
cagggcaacctctggtgacc

SEQ ID NO: 128360 - DNA, 20 bp, Artificial Sequence
  Description of Artificial Sequence: Synthetic oligonucleotide
  Target: ATXN1; (+) strand; PAM type: NRG; PAM sequence: CAG
gtgacctggtttttcatcac

SEQ ID NO: 128361 - DNA, 20 bp, Artificial Sequence
  Description of Artificial Sequence: Synthetic oligonucleotide
  Target: ATXN1; (+) strand; PAM type: NRG; PAM sequence: CAG
cctggtttttcatcaccagc

SEQ ID NO: 128362 - DNA, 20 bp, Artificial Sequence
  Description of Artificial Sequence: Synthetic oligonucleotide
  Target: ATXN1; (+) strand; PAM type: NRG; PAM sequence: AGG
ctggtttttcatcaccagcc

SEQ ID NO: 128363 - DNA, 20 bp, Artificial Sequence
  Description of Artificial Sequence: Synthetic oligonucleotide
  Target: ATXN1; (+) strand; PAM type: NRG; PAM sequence: GGG
tggtttttcatcaccagcca

SEQ ID NO: 128364 - DNA, 20 bp, Artificial Sequence
  Description of Artificial Sequence: Synthetic oligonucleotide
  Target: ATXN1; (+) strand; PAM type: NRG; PAM sequence: CAG
tttttcatcaccagccaggg

SEQ ID NO: 128365 - DNA, 20 bp, Artificial Sequence
  Description of Artificial Sequence: Synthetic oligonucleotide
  Target: ATXN1; (+) strand; PAM type: NRG; PAM sequence: AAG
ttcatcaccagccagggcag

SEQ ID NO: 128366 - DNA, 20 bp, Artificial Sequence
  Description of Artificial Sequence: Synthetic oligonucleotide
  Target: ATXN1; (+) strand; PAM type: NRG; PAM sequence: AAG
atcaccagccagggcagaag

SEQ ID NO: 128367 - DNA, 20 bp, Artificial Sequence
  Description of Artificial Sequence: Synthetic oligonucleotide
  Target: ATXN1; (+) strand; PAM type: NRG; PAM sequence: AAG
agccagggcagaagaagtca

SEQ ID NO: 128368 - DNA, 20 bp, Artificial Sequence
  Description of Artificial Sequence: Synthetic oligonucleotide
  Target: ATXN1; (+) strand; PAM type: NRG; PAM sequence: AAG
gaagaagtcaaagtgtgctc

SEQ ID NO: 128369 - DNA, 20 bp, Artificial Sequence
  Description of Artificial Sequence: Synthetic oligonucleotide
  Target: ATXN1; (+) strand; PAM type: NRG; PAM sequence: AGG
aagaagtcaaagtgtgctca

SEQ ID NO: 128370 - DNA, 20 bp, Artificial Sequence
  Description of Artificial Sequence: Synthetic oligonucleotide
  Target: ATXN1; (+) strand; PAM type: NRG; PAM sequence: GGG
agaagtcaaagtgtgctcaa

SEQ ID NO: 128371 - DNA, 20 bp, Artificial Sequence
  Description of Artificial Sequence: Synthetic oligonucleotide
  Target: ATXN1; (+) strand; PAM type: NRG; PAM sequence: TAG
gggctttgcacgctgctccc

SEQ ID NO: 128372 - DNA, 20 bp, Artificial Sequence
  Description of Artificial Sequence: Synthetic oligonucleotide
  Target: ATXN1; (+) strand; PAM type: NRG; PAM sequence: TGG
tgcacgctgctccctagaac

SEQ ID NO: 128373 - DNA, 20 bp, Artificial Sequence
  Description of Artificial Sequence: Synthetic oligonucleotide
  Target: ATXN1; (+) strand; PAM type: NRG; PAM sequence: GAG
ccctagaactggacgccttt

SEQ ID NO: 128374 - DNA, 20 bp, Artificial Sequence
  Description of Artificial Sequence: Synthetic oligonucleotide
  Target: ATXN1; (+) strand; PAM type: NRG; PAM sequence: TGG
ctggacgcctttgagaaatc

SEQ ID NO: 128375 - DNA, 20 bp, Artificial Sequence
  Description of Artificial Sequence: Synthetic oligonucleotide
  Target: ATXN1; (+) strand; PAM type: NRG; PAM sequence: GGG
tggacgcctttgagaaatct

SEQ ID NO: 128376 - DNA, 20 bp, Artificial Sequence
  Description of Artificial Sequence: Synthetic oligonucleotide
  Target: ATXN1; (+) strand; PAM type: NRG; PAM sequence: CAG
tgagaaatctgggattcttc

SEQ ID NO: 128377 - DNA, 20 bp, Artificial Sequence
  Description of Artificial Sequence: Synthetic oligonucleotide
  Target: ATXN1; (+) strand; PAM type: NRG; PAM sequence: AGG
gagaaatctgggattcttcc

SEQ ID NO: 128378 - DNA, 20 bp, Artificial Sequence
  Description of Artificial Sequence: Synthetic oligonucleotide
  Target: ATXN1; (+) strand; PAM type: NRG; PAM sequence: CGG
aaatctgggattcttccagg

SEQ ID NO: 128379 - DNA, 20 bp, Artificial Sequence
  Description of Artificial Sequence: Synthetic oligonucleotide
  Target: ATXN1; (+) strand; PAM type: NRG; PAM sequence: CAG
tctgggattcttccaggcgg

SEQ ID NO: 128380 - DNA, 20 bp, Artificial Sequence
  Description of Artificial Sequence: Synthetic oligonucleotide
  Target: ATXN1; (+) strand; PAM type: NRG; PAM sequence: CAG
aggcggcagacttcattcca

SEQ ID NO: 128381 - DNA, 20 bp, Artificial Sequence
  Description of Artificial Sequence: Synthetic oligonucleotide
  Target: ATXN1; (+) strand; PAM type: NRG; PAM sequence: TGG
cggcagacttcattccacag

SEQ ID NO: 128382 - DNA, 20 bp, Artificial Sequence
  Description of Artificial Sequence: Synthetic oligonucleotide
  Target: ATXN1; (+) strand; PAM type: NRG; PAM sequence: TGG
cagacttcattccacagtgg

SEQ ID NO: 128383 - DNA, 20 bp, Artificial Sequence
  Description of Artificial Sequence: Synthetic oligonucleotide
  Target: ATXN1; (+) strand; PAM type: NRG; PAM sequence: AAG
ttcattccacagtggtggaa

SEQ ID NO: 128384 - DNA, 20 bp, Artificial Sequence
  Description of Artificial Sequence: Synthetic oligonucleotide
  Target: ATXN1; (+) strand; PAM type: NRG; PAM sequence: TGG
ttccacagtggtggaaaagc

SEQ ID NO: 128385 - DNA, 20 bp, Artificial Sequence
  Description of Artificial Sequence: Synthetic oligonucleotide
  Target: ATXN1; (+) strand; PAM type: NRG; PAM sequence: CAG
acagtggtggaaaagctggc

SEQ ID NO: 128386 - DNA, 20 bp, Artificial Sequence
  Description of Artificial Sequence: Synthetic oligonucleotide
  Target: ATXN1; (+) strand; PAM type: NRG; PAM sequence: AGG
cagtggtggaaaagctggcc

SEQ ID NO: 128387 - DNA, 20 bp, Artificial Sequence
  Description of Artificial Sequence: Synthetic oligonucleotide
  Target: ATXN1; (+) strand; PAM type: NRG; PAM sequence: GGG
agtggtggaaaagctggcca

SEQ ID NO: 128388 - DNA, 20 bp, Artificial Sequence
  Description of Artificial Sequence: Synthetic oligonucleotide
  Target: ATXN1; (+) strand; PAM type: NRG; PAM sequence: GAG
tggtggaaaagctggccagg

SEQ ID NO: 128389 - DNA, 20 bp, Artificial Sequence
  Description of Artificial Sequence: Synthetic oligonucleotide
  Target: ATXN1; (+) strand; PAM type: NRG; PAM sequence: GAG
gtggaaaagctggccaggga

SEQ ID NO: 128390 - DNA, 20 bp, Artificial Sequence
  Description of Artificial Sequence: Synthetic oligonucleotide
  Target: ATXN1; (+) strand; PAM type: NRG; PAM sequence: GAG
ggaaaagctggccagggaga

SEQ ID NO: 128391 - DNA, 20 bp, Artificial Sequence
  Description of Artificial Sequence: Synthetic oligonucleotide
  Target: ATXN1; (+) strand; PAM type: NRG; PAM sequence: GAG
aaaagctggccagggagaga

SEQ ID NO: 128392 - DNA, 20 bp, Artificial Sequence
  Description of Artificial Sequence: Synthetic oligonucleotide
  Target: ATXN1; (+) strand; PAM type: NRG; PAM sequence: AAG
gggagagagagcaattttgc

SEQ ID NO: 128393 - DNA, 20 bp, Artificial Sequence
  Description of Artificial Sequence: Synthetic oligonucleotide
  Target: ATXN1; (+) strand; PAM type: NRG; PAM sequence: AGG
ggagagagagcaattttgca

SEQ ID NO: 128394 - DNA, 20 bp, Artificial Sequence
  Description of Artificial Sequence: Synthetic oligonucleotide
  Target: ATXN1; (+) strand; PAM type: NRG; PAM sequence: CAG
gagagcaattttgcaaggca

SEQ ID NO: 128395 - DNA, 20 bp, Artificial Sequence
  Description of Artificial Sequence: Synthetic oligonucleotide
  Target: ATXN1; (+) strand; PAM type: NRG; PAM sequence: TGG
gcaaggcacagtgccgcact

SEQ ID NO: 128396 - DNA, 20 bp, Artificial Sequence
  Description of Artificial Sequence: Synthetic oligonucleotide
  Target: ATXN1; (+) strand; PAM type: NRG; PAM sequence: CAG
gtatcctgacaccgccaaat

SEQ ID NO: 128397 - DNA, 20 bp, Artificial Sequence
  Description of Artificial Sequence: Synthetic oligonucleotide
  Target: ATXN1; (+) strand; PAM type: NRG; PAM sequence: GAG
atcctgacaccgccaaatca

SEQ ID NO: 128398 - DNA, 20 bp, Artificial Sequence
  Description of Artificial Sequence: Synthetic oligonucleotide
  Target: ATXN1; (+) strand; PAM type: NRG; PAM sequence: AGG
tcctgacaccgccaaatcag

SEQ ID NO: 128399 - DNA, 20 bp, Artificial Sequence
  Description of Artificial Sequence: Synthetic oligonucleotide
  Target: ATXN1; (+) strand; PAM type: NRG; PAM sequence: GAG
ctgacaccgccaaatcagag

SEQ ID NO: 128400 - DNA, 20 bp, Artificial Sequence
  Description of Artificial Sequence: Synthetic oligonucleotide
  Target: ATXN1; (+) strand; PAM type: NRG; PAM sequence: AGG
tgacaccgccaaatcagagg

SEQ ID NO: 128401 - DNA, 20 bp, Artificial Sequence
  Description of Artificial Sequence: Synthetic oligonucleotide
  Target: ATXN1; (+) strand; PAM type: NRG; PAM sequence: CAG
caccgccaaatcagaggagg

SEQ ID NO: 128402 - DNA, 20 bp, Artificial Sequence
  Description of Artificial Sequence: Synthetic oligonucleotide
  Target: ATXN1; (+) strand; PAM type: NRG; PAM sequence: AAG
gccaaatcagaggaggcaga

SEQ ID NO: 128403 - DNA, 20 bp, Artificial Sequence
  Description of Artificial Sequence: Synthetic oligonucleotide
  Target: ATXN1; (+) strand; PAM type: NRG; PAM sequence: GAG
cagaggaggcagaaagccct

SEQ ID NO: 128404 - DNA, 20 bp, Artificial Sequence
  Description of Artificial Sequence: Synthetic oligonucleotide
  Target: ATXN1; (+) strand; PAM type: NRG; PAM sequence: CAG
gcagaaagccctgagtgtta

SEQ ID NO: 128405 - DNA, 20 bp, Artificial Sequence
  Description of Artificial Sequence: Synthetic oligonucleotide
  Target: ATXN1; (+) strand; PAM type: NRG; PAM sequence: GAG
ctgagtgttacagaacgtct

SEQ ID NO: 128406 - DNA, 20 bp, Artificial Sequence
  Description of Artificial Sequence: Synthetic oligonucleotide
  Target: ATXN1; (+) strand; PAM type: NRG; PAM sequence: TAG
gtgttacagaacgtctgagc

SEQ ID NO: 128407 - DNA, 20 bp, Artificial Sequence
  Description of Artificial Sequence: Synthetic oligonucleotide
  Target: ATXN1; (+) strand; PAM type: NRG; PAM sequence: GAG
gttacagaacgtctgagcta

SEQ ID NO: 128408 - DNA, 20 bp, Artificial Sequence
  Description of Artificial Sequence: Synthetic oligonucleotide
  Target: ATXN1; (+) strand; PAM type: NRG; PAM sequence: AGG
ttacagaacgtctgagctag

SEQ ID NO: 128409 - DNA, 20 bp, Artificial Sequence
  Description of Artificial Sequence: Synthetic oligonucleotide
  Target: ATXN1; (+) strand; PAM type: NRG; PAM sequence: GAG
acagaacgtctgagctagag

SEQ ID NO: 128410 - DNA, 20 bp, Artificial Sequence
  Description of Artificial Sequence: Synthetic oligonucleotide
  Target: ATXN1; (+) strand; PAM type: NRG; PAM sequence: AGG
cagaacgtctgagctagagg

SEQ ID NO: 128411 - DNA, 20 bp, Artificial Sequence
  Description of Artificial Sequence: Synthetic oligonucleotide
  Target: ATXN1; (+) strand; PAM type: NRG; PAM sequence: AAG
ctgagctagaggaggcctct

SEQ ID NO: 128412 - DNA, 20 bp, Artificial Sequence
  Description of Artificial Sequence: Synthetic oligonucleotide
  Target: ATXN1; (+) strand; PAM type: NRG; PAM sequence: GAG
gagctagaggaggcctctaa

SEQ ID NO: 128413 - DNA, 20 bp, Artificial Sequence
  Description of Artificial Sequence: Synthetic oligonucleotide
  Target: ATXN1; (+) strand; PAM type: NRG; PAM sequence: CAG
aggaggcctctaagagcttt

SEQ ID NO: 128414 - DNA, 20 bp, Artificial Sequence
  Description of Artificial Sequence: Synthetic oligonucleotide
  Target: ATXN1; (+) strand; PAM type: NRG; PAM sequence: CAG
gcctctaagagctttcagtc

SEQ ID NO: 128415 - DNA, 20 bp, Artificial Sequence
  Description of Artificial Sequence: Synthetic oligonucleotide
  Target: ATXN1; (+) strand; PAM type: NRG; PAM sequence: CGG
gtctcctcatttaatgaaca

SEQ ID NO: 128416 - DNA, 20 bp, Artificial Sequence
  Description of Artificial Sequence: Synthetic oligonucleotide
  Target: ATXN1; (+) strand; PAM type: NRG; PAM sequence: AAG
aattgtatcctgctaacgta

SEQ ID NO: 128417 - DNA, 20 bp, Artificial Sequence
  Description of Artificial Sequence: Synthetic oligonucleotide
  Target: ATXN1; (+) strand; PAM type: NRG; PAM sequence: TGG
cctgctaacgtaaagtgact

SEQ ID NO: 128418 - DNA, 20 bp, Artificial Sequence
  Description of Artificial Sequence: Synthetic oligonucleotide
  Target: ATXN1; (+) strand; PAM type: NRG; PAM sequence: AAG
aacgtaaagtgacttggtca

SEQ ID NO: 128419 - DNA, 20 bp, Artificial Sequence
  Description of Artificial Sequence: Synthetic oligonucleotide
  Target: ATXN1; (+) strand; PAM type: NRG; PAM sequence: CAG
gtgacttggtcaaagctacg

SEQ ID NO: 128420 - DNA, 20 bp, Artificial Sequence
  Description of Artificial Sequence: Synthetic oligonucleotide
  Target: ATXN1; (+) strand; PAM type: NRG; PAM sequence: TGG
acttggtcaaagctacgcag

SEQ ID NO: 128421 - DNA, 20 bp, Artificial Sequence
  Description of Artificial Sequence: Synthetic oligonucleotide
  Target: ATXN1; (+) strand; PAM type: NRG; PAM sequence: CAG
gcagtggcacaactaaaact

SEQ ID NO: 128422 - DNA, 20 bp, Artificial Sequence
  Description of Artificial Sequence: Synthetic oligonucleotide
  Target: ATXN1; (+) strand; PAM type: NRG; PAM sequence: AGG
cagtggcacaactaaaactc

SEQ ID NO: 128423 - DNA, 20 bp, Artificial Sequence
  Description of Artificial Sequence: Synthetic oligonucleotide
  Target: ATXN1; (+) strand; PAM type: NRG; PAM sequence: GAG
atttctgacatcttgcccct

SEQ ID NO: 128424 - DNA, 20 bp, Artificial Sequence
  Description of Artificial Sequence: Synthetic oligonucleotide
  Target: ATXN1; (+) strand; PAM type: NRG; PAM sequence: AAG
ccctgagcacccaaaactca

SEQ ID NO: 128425 - DNA, 20 bp, Artificial Sequence
  Description of Artificial Sequence: Synthetic oligonucleotide
  Target: ATXN1; (+) strand; PAM type: NRG; PAM sequence: AGG
cctgagcacccaaaactcaa

SEQ ID NO: 128426 - DNA, 20 bp, Artificial Sequence
  Description of Artificial Sequence: Synthetic oligonucleotide
  Target: ATXN1; (+) strand; PAM type: NRG; PAM sequence: CAG
agcacccaaaactcaaagga

SEQ ID NO: 128427 - DNA, 20 bp, Artificial Sequence
  Description of Artificial Sequence: Synthetic oligonucleotide
  Target: ATXN1; (+) strand; PAM type: NRG; PAM sequence: AAG
cccaaaactcaaaggacaga

SEQ ID NO: 128428 - DNA, 20 bp, Artificial Sequence
  Description of Artificial Sequence: Synthetic oligonucleotide
  Target: ATXN1; (+) strand; PAM type: NRG; PAM sequence: CAG
agaaagtacaatgtgaacta

SEQ ID NO: 128429 - DNA, 20 bp, Artificial Sequence
  Description of Artificial Sequence: Synthetic oligonucleotide
  Target: ATXN1; (+) strand; PAM type: NRG; PAM sequence: AAG
aagtacaatgtgaactacag

SEQ ID NO: 128430 - DNA, 20 bp, Artificial Sequence
  Description of Artificial Sequence: Synthetic oligonucleotide
  Target: ATXN1; (+) strand; PAM type: NRG; PAM sequence: AAG
gtgaactacagaagtaacca

SEQ ID NO: 128431 - DNA, 20 bp, Artificial Sequence
  Description of Artificial Sequence: Synthetic oligonucleotide
  Target: ATXN1; (+) strand; PAM type: NRG; PAM sequence: AGG
tgaactacagaagtaaccaa

SEQ ID NO: 128432 - DNA, 20 bp, Artificial Sequence
  Description of Artificial Sequence: Synthetic oligonucleotide
  Target: ATXN1; (+) strand; PAM type: NRG; PAM sequence: TGG
gaagtaaccaaaggactttc

SEQ ID NO: 128433 - DNA, 20 bp, Artificial Sequence
  Description of Artificial Sequence: Synthetic oligonucleotide
  Target: ATXN1; (+) strand; PAM type: NRG; PAM sequence: AAG
ctggtgatgtcaaatgatgc

SEQ ID NO: 128434 - DNA, 20 bp, Artificial Sequence
  Description of Artificial Sequence: Synthetic oligonucleotide
  Target: ATXN1; (+) strand; PAM type: NRG; PAM sequence: CAG
tgatgtcaaatgatgcaaga

SEQ ID NO: 128435 - DNA, 20 bp, Artificial Sequence
  Description of Artificial Sequence: Synthetic oligonucleotide
  Target: ATXN1; (+) strand; PAM type: NRG; PAM sequence: AAG
tgcaagacagcaaaatgctc

SEQ ID NO: 128436 - DNA, 20 bp, Artificial Sequence
  Description of Artificial Sequence: Synthetic oligonucleotide
  Target: ATXN1; (+) strand; PAM type: NRG; PAM sequence: TGG
agacagcaaaatgctcaagt

SEQ ID NO: 128437 - DNA, 20 bp, Artificial Sequence
  Description of Artificial Sequence: Synthetic oligonucleotide
  Target: ATXN1; (+) strand; PAM type: NRG; PAM sequence: GGG
gacagcaaaatgctcaagtt

SEQ ID NO: 128438 - DNA, 20 bp, Artificial Sequence
  Description of Artificial Sequence: Synthetic oligonucleotide
  Target: ATXN1; (+) strand; PAM type: NRG; PAM sequence: TAG
tcaagttgggaataaattga

SEQ ID NO: 128439 - DNA, 20 bp, Artificial Sequence
  Description of Artificial Sequence: Synthetic oligonucleotide
  Target: ATXN1; (+) strand; PAM type: NRG; PAM sequence: AGG
caagttgggaataaattgat

SEQ ID NO: 128440 - DNA, 20 bp, Artificial Sequence
  Description of Artificial Sequence: Synthetic oligonucleotide
  Target: ATXN1; (+) strand; PAM type: NRG; PAM sequence: AAG
atctattaaaaccatctctt

SEQ ID NO: 128441 - DNA, 20 bp, Artificial Sequence
  Description of Artificial Sequence: Synthetic oligonucleotide
  Target: ATXN1; (+) strand; PAM type: NRG; PAM sequence: AGG
tctattaaaaccatctctta

SEQ ID NO: 128442 - DNA, 20 bp, Artificial Sequence
  Description of Artificial Sequence: Synthetic oligonucleotide
  Target: ATXN1; (+) strand; PAM type: NRG; PAM sequence: TGG
aaccatctcttaaggccttc

SEQ ID NO: 128443 - DNA, 20 bp, Artificial Sequence
  Description of Artificial Sequence: Synthetic oligonucleotide
  Target: ATXN1; (+) strand; PAM type: NRG; PAM sequence: GGG
accatctcttaaggccttct

SEQ ID NO: 128444 - DNA, 20 bp, Artificial Sequence
  Description of Artificial Sequence: Synthetic oligonucleotide
  Target: ATXN1; (+) strand; PAM type: NRG; PAM sequence: GGG
ccatctcttaaggccttctg

SEQ ID NO: 128445 - DNA, 20 bp, Artificial Sequence
  Description of Artificial Sequence: Synthetic oligonucleotide
  Target: ATXN1; (+) strand; PAM type: NRG; PAM sequence: GGG
catctcttaaggccttctgg

SEQ ID NO: 128446 - DNA, 20 bp, Artificial Sequence
  Description of Artificial Sequence: Synthetic oligonucleotide
  Target: ATXN1; (+) strand; PAM type: NRG; PAM sequence: AAG
tgggggaaaacgccaccacc

SEQ ID NO: 128447 - DNA, 20 bp, Artificial Sequence
  Description of Artificial Sequence: Synthetic oligonucleotide
  Target: ATXN1; (+) strand; PAM type: NRG; PAM sequence: AAG
ccaccaccaagaattacttg

SEQ ID NO: 128448 - DNA, 20 bp, Artificial Sequence
  Description of Artificial Sequence: Synthetic oligonucleotide
  Target: ATXN1; (+) strand; PAM type: NRG; PAM sequence: AGG
caccaccaagaattacttga

SEQ ID NO: 128449 - DNA, 20 bp, Artificial Sequence
  Description of Artificial Sequence: Synthetic oligonucleotide
  Target: ATXN1; (+) strand; PAM type: NRG; PAM sequence: AAG
gaattacttgaaggcttgtc

SEQ ID NO: 128450 - DNA, 20 bp, Artificial Sequence
  Description of Artificial Sequence: Synthetic oligonucleotide
  Target: ATXN1; (+) strand; PAM type: NRG; PAM sequence: AAG
gaaggcttgtcaagtgcttt

SEQ ID NO: 128451 - DNA, 20 bp, Artificial Sequence
  Description of Artificial Sequence: Synthetic oligonucleotide
  Target: ATXN1; (+) strand; PAM type: NRG; PAM sequence: AGG
aaggcttgtcaagtgcttta

SEQ ID NO: 128452 - DNA, 20 bp, Artificial Sequence
  Description of Artificial Sequence: Synthetic oligonucleotide
  Target: ATXN1; (+) strand; PAM type: NRG; PAM sequence: AAG
caagtgctttaaggcgctat

SEQ ID NO: 128453 - DNA, 20 bp, Artificial Sequence
  Description of Artificial Sequence: Synthetic oligonucleotide
  Target: ATXN1; (+) strand; PAM type: NRG; PAM sequence: AGG
aagtgctttaaggcgctata

SEQ ID NO: 128454 - DNA, 20 bp, Artificial Sequence
  Description of Artificial Sequence: Synthetic oligonucleotide
  Target: ATXN1; (+) strand; PAM type: NRG; PAM sequence: AAG
gctttaaggcgctataaggc

SEQ ID NO: 128455 - DNA, 20 bp, Artificial Sequence
  Description of Artificial Sequence: Synthetic oligonucleotide
  Target: ATXN1; (+) strand; PAM type: NRG; PAM sequence: GAG
ataaggcaagatgcaacact

SEQ ID NO: 128456 - DNA, 20 bp, Artificial Sequence
  Description of Artificial Sequence: Synthetic oligonucleotide
  Target: ATXN1; (+) strand; PAM type: NRG; PAM sequence: GAG
aaggcaagatgcaacactga

SEQ ID NO: 128457 - DNA, 20 bp, Artificial Sequence
  Description of Artificial Sequence: Synthetic oligonucleotide
  Target: ATXN1; (+) strand; PAM type: NRG; PAM sequence: AAG
acactgagagacattaaaaa

SEQ ID NO: 128458 - DNA, 20 bp, Artificial Sequence
  Description of Artificial Sequence: Synthetic oligonucleotide
  Target: ATXN1; (+) strand; PAM type: NRG; PAM sequence: GAG
taaccttttccccactgcct

SEQ ID NO: 128459 - DNA, 20 bp, Artificial Sequence
  Description of Artificial Sequence: Synthetic oligonucleotide
  Target: ATXN1; (+) strand; PAM type: NRG; PAM sequence: GAG
ccactgcctgagttgctctt

SEQ ID NO: 128460 - DNA, 20 bp, Artificial Sequence
  Description of Artificial Sequence: Synthetic oligonucleotide
  Target: ATXN1; (+) strand; PAM type: NRG; PAM sequence: TAG
ctgagttgctcttgagtgcc

SEQ ID NO: 128461 - DNA, 20 bp, Artificial Sequence
  Description of Artificial Sequence: Synthetic oligonucleotide
  Target: ATXN1; (+) strand; PAM type: NRG; PAM sequence: TGG
agttgctcttgagtgcctag

SEQ ID NO: 128462 - DNA, 20 bp, Artificial Sequence
  Description of Artificial Sequence: Synthetic oligonucleotide
  Target: ATXN1; (+) strand; PAM type: NRG; PAM sequence: GGG
gttgctcttgagtgcctagt

SEQ ID NO: 128463 - DNA, 20 bp, Artificial Sequence
  Description of Artificial Sequence: Synthetic oligonucleotide
  Target: ATXN1; (+) strand; PAM type: NRG; PAM sequence: CAG
ttgagtgcctagtgggtgaa

SEQ ID NO: 128464 - DNA, 20 bp, Artificial Sequence
  Description of Artificial Sequence: Synthetic oligonucleotide
  Target: ATXN1; (+) strand; PAM type: NRG; PAM sequence: GAG
gagtgcctagtgggtgaaca

SEQ ID NO: 128465 - DNA, 20 bp, Artificial Sequence
  Description of Artificial Sequence: Synthetic oligonucleotide
  Target: ATXN1; (+) strand; PAM type: NRG; PAM sequence: AGG
agtgcctagtgggtgaacag

SEQ ID NO: 128466 - DNA, 20 bp, Artificial Sequence
  Description of Artificial Sequence: Synthetic oligonucleotide
  Target: ATXN1; (+) strand; PAM type: NRG; PAM sequence: GAG
tgcctagtgggtgaacagag

SEQ ID NO: 128467 - DNA, 20 bp, Artificial Sequence
  Description of Artificial Sequence: Synthetic oligonucleotide
  Target: ATXN1; (+) strand; PAM type: NRG; PAM sequence: AGG
gcctagtgggtgaacagagg

SEQ ID NO: 128468 - DNA, 20 bp, Artificial Sequence
  Description of Artificial Sequence: Synthetic oligonucleotide
  Target: ATXN1; (+) strand; PAM type: NRG; PAM sequence: GGG
cctagtgggtgaacagagga

SEQ ID NO: 128469 - DNA, 20 bp, Artificial Sequence
  Description of Artificial Sequence: Synthetic oligonucleotide
  Target: ATXN1; (+) strand; PAM type: NRG; PAM sequence: GAG
tagtgggtgaacagaggagg

SEQ ID NO: 128470 - DNA, 20 bp, Artificial Sequence
  Description of Artificial Sequence: Synthetic oligonucleotide
  Target: ATXN1; (+) strand; PAM type: NRG; PAM sequence: AAG
tgggtgaacagaggagggag

SEQ ID NO: 128471 - DNA, 20 bp, Artificial Sequence
  Description of Artificial Sequence: Synthetic oligonucleotide
  Target: ATXN1; (+) strand; PAM type: NRG; PAM sequence: CAG
acagaggagggagaagcgcc

SEQ ID NO: 128472 - DNA, 20 bp, Artificial Sequence
  Description of Artificial Sequence: Synthetic oligonucleotide
  Target: ATXN1; (+) strand; PAM type: NRG; PAM sequence: AGG
cagaggagggagaagcgccc

SEQ ID NO: 128473 - DNA, 20 bp, Artificial Sequence
  Description of Artificial Sequence: Synthetic oligonucleotide
  Target: ATXN1; (+) strand; PAM type: NRG; PAM sequence: TGG
agaagcgcccaggcttccaa

SEQ ID NO: 128474 - DNA, 20 bp, Artificial Sequence
  Description of Artificial Sequence: Synthetic oligonucleotide
  Target: ATXN1; (+) strand; PAM type: NRG; PAM sequence: GGG
gaagcgcccaggcttccaat

SEQ ID NO: 128475 - DNA, 20 bp, Artificial Sequence
  Description of Artificial Sequence: Synthetic oligonucleotide
  Target: ATXN1; (+) strand; PAM type: NRG; PAM sequence: CAG
cttccaatgggttctctgca

SEQ ID NO: 128476 - DNA, 20 bp, Artificial Sequence
  Description of Artificial Sequence: Synthetic oligonucleotide
  Target: ATXN1; (+) strand; PAM type: NRG; PAM sequence: CGG
gggttctctgcacagccaca

SEQ ID NO: 128477 - DNA, 20 bp, Artificial Sequence
  Description of Artificial Sequence: Synthetic oligonucleotide
  Target: ATXN1; (+) strand; PAM type: NRG; PAM sequence: TAG
ctgcacagccacacggtcat

SEQ ID NO: 128478 - DNA, 20 bp, Artificial Sequence
  Description of Artificial Sequence: Synthetic oligonucleotide
  Target: ATXN1; (+) strand; PAM type: NRG; PAM sequence: CAG
tccacaatctgcattcactc

SEQ ID NO: 128479 - DNA, 20 bp, Artificial Sequence
  Description of Artificial Sequence: Synthetic oligonucleotide
  Target: ATXN1; (+) strand; PAM type: NRG; PAM sequence: GAG
aatctgcattcactccagat

SEQ ID NO: 128480 - DNA, 20 bp, Artificial Sequence
  Description of Artificial Sequence: Synthetic oligonucleotide
  Target: ATXN1; (+) strand; PAM type: NRG; PAM sequence: TAG
tctaaattgcgctcttcaaa

SEQ ID NO: 128481 - DNA, 20 bp, Artificial Sequence
  Description of Artificial Sequence: Synthetic oligonucleotide
  Target: ATXN1; (+) strand; PAM type: NRG; PAM sequence: CAG
aaattgcgctcttcaaatag

SEQ ID NO: 128482 - DNA, 20 bp, Artificial Sequence
  Description of Artificial Sequence: Synthetic oligonucleotide
  Target: ATXN1; (+) strand; PAM type: NRG; PAM sequence: GAG
attgcgctcttcaaatagca

SEQ ID NO: 128483 - DNA, 20 bp, Artificial Sequence
  Description of Artificial Sequence: Synthetic oligonucleotide
  Target: ATXN1; (+) strand; PAM type: NRG; PAM sequence: GAG
tgcgctcttcaaatagcaga

SEQ ID NO: 128484 - DNA, 20 bp, Artificial Sequence
  Description of Artificial Sequence: Synthetic oligonucleotide
  Target: ATXN1; (+) strand; PAM type: NRG; PAM sequence: CAG
tagcagagagcactatgctt

SEQ ID NO: 128485 - DNA, 20 bp, Artificial Sequence
  Description of Artificial Sequence: Synthetic oligonucleotide
  Target: ATXN1; (+) strand; PAM type: NRG; PAM sequence: AAG
agagagcactatgcttcagt

SEQ ID NO: 128486 - DNA, 20 bp, Artificial Sequence
  Description of Artificial Sequence: Synthetic oligonucleotide
  Target: ATXN1; (+) strand; PAM type: NRG; PAM sequence: AGG
gagagcactatgcttcagta

SEQ ID NO: 128487 - DNA, 20 bp, Artificial Sequence
  Description of Artificial Sequence: Synthetic oligonucleotide
  Target: ATXN1; (+) strand; PAM type: NRG; PAM sequence: GGG
agagcactatgcttcagtaa

SEQ ID NO: 128488 - DNA, 20 bp, Artificial Sequence
  Description of Artificial Sequence: Synthetic oligonucleotide
  Target: ATXN1; (+) strand; PAM type: NRG; PAM sequence: GGG
gagcactatgcttcagtaag

SEQ ID NO: 128489 - DNA, 20 bp, Artificial Sequence
  Description of Artificial Sequence: Synthetic oligonucleotide
  Target: ATXN1; (+) strand; PAM type: NRG; PAM sequence: AAG
actatgcttcagtaagggga

SEQ ID NO: 128490 - DNA, 20 bp, Artificial Sequence
  Description of Artificial Sequence: Synthetic oligonucleotide
  Target: ATXN1; (+) strand; PAM type: NRG; PAM sequence: GAG
tatgcttcagtaaggggaaa

SEQ ID NO: 128491 - DNA, 20 bp, Artificial Sequence
  Description of Artificial Sequence: Synthetic oligonucleotide
  Target: ATXN1; (+) strand; PAM type: NRG; PAM sequence: AAG
gaaagagaaacgatcacatt

SEQ ID NO: 128492 - DNA, 20 bp, Artificial Sequence
  Description of Artificial Sequence: Synthetic oligonucleotide
  Target: ATXN1; (+) strand; PAM type: NRG; PAM sequence: GAG
aagagaaacgatcacattaa

SEQ ID NO: 128493 - DNA, 20 bp, Artificial Sequence
  Description of Artificial Sequence: Synthetic oligonucleotide
  Target: ATXN1; (+) strand; PAM type: NRG; PAM sequence: TGG
ttctccctcctatgttactt

SEQ ID NO: 128494 - DNA, 20 bp, Artificial Sequence
  Description of Artificial Sequence: Synthetic oligonucleotide
  Target: ATXN1; (+) strand; PAM type: NRG; PAM sequence: CAG
ctatgttactttggtcttga

SEQ ID NO: 128495 - DNA, 20 bp, Artificial Sequence
  Description of Artificial Sequence: Synthetic oligonucleotide
  Target: ATXN1; (+) strand; PAM type: NRG; PAM sequence: CAG
cttgacagccttaattcaca

SEQ ID NO: 128496 - DNA, 20 bp, Artificial Sequence
  Description of Artificial Sequence: Synthetic oligonucleotide
  Target: ATXN1; (+) strand; PAM type: NRG; PAM sequence: CGG
cttaattcacacagtgctcc

SEQ ID NO: 128497 - DNA, 20 bp, Artificial Sequence
  Description of Artificial Sequence: Synthetic oligonucleotide
  Target: ATXN1; (+) strand; PAM type: NRG; PAM sequence: GAG
taattcacacagtgctcccg

SEQ ID NO: 128498 - DNA, 20 bp, Artificial Sequence
  Description of Artificial Sequence: Synthetic oligonucleotide
  Target: ATXN1; (+) strand; PAM type: NRG; PAM sequence: TGG
gtgctcccggagcccttccc

SEQ ID NO: 128499 - DNA, 20 bp, Artificial Sequence
  Description of Artificial Sequence: Synthetic oligonucleotide
  Target: ATXN1; (+) strand; PAM type: NRG; PAM sequence: AAG
gcccttccctggctcgtccc

SEQ ID NO: 128500 - DNA, 20 bp, Artificial Sequence
  Description of Artificial Sequence: Synthetic oligonucleotide
  Target: ATXN1; (+) strand; PAM type: NRG; PAM sequence: AGG
cccttccctggctcgtccca

SEQ ID NO: 128501 - DNA, 20 bp, Artificial Sequence
  Description of Artificial Sequence: Synthetic oligonucleotide
  Target: ATXN1; (+) strand; PAM type: NRG; PAM sequence: CAG
ccctggctcgtcccaaggat

SEQ ID NO: 128502 - DNA, 20 bp, Artificial Sequence
  Description of Artificial Sequence: Synthetic oligonucleotide
  Target: ATXN1; (+) strand; PAM type: NRG; PAM sequence: CGG
cccaaggatcagcaaacaca

SEQ ID NO: 128503 - DNA, 20 bp, Artificial Sequence
  Description of Artificial Sequence: Synthetic oligonucleotide
  Target: ATXN1; (+) strand; PAM type: NRG; PAM sequence: TAG
cagcaaacacacggctatct

SEQ ID NO: 128504 - DNA, 20 bp, Artificial Sequence
  Description of Artificial Sequence: Synthetic oligonucleotide
  Target: ATXN1; (+) strand; PAM type: NRG; PAM sequence: TGG
gctatcttagtttttcacac

SEQ ID NO: 128505 - DNA, 20 bp, Artificial Sequence
  Description of Artificial Sequence: Synthetic oligonucleotide
  Target: ATXN1; (+) strand; PAM type: NRG; PAM sequence: GGG
ctatcttagtttttcacact

SEQ ID NO: 128506 - DNA, 20 bp, Artificial Sequence
  Description of Artificial Sequence: Synthetic oligonucleotide
  Target: ATXN1; (+) strand; PAM type: NRG; PAM sequence: GGG
tatcttagtttttcacactg

SEQ ID NO: 128507 - DNA, 20 bp, Artificial Sequence
  Description of Artificial Sequence: Synthetic oligonucleotide
  Target: ATXN1; (+) strand; PAM type: NRG; PAM sequence: TAG
tttcacactggggctctctc

SEQ ID NO: 128508 - DNA, 20 bp, Artificial Sequence
  Description of Artificial Sequence: Synthetic oligonucleotide
  Target: ATXN1; (+) strand; PAM type: NRG; PAM sequence: GAG
tcacactggggctctctcta

SEQ ID NO: 128509 - DNA, 20 bp, Artificial Sequence
  Description of Artificial Sequence: Synthetic oligonucleotide
  Target: ATXN1; (+) strand; PAM type: NRG; PAM sequence: AGG
cacactggggctctctctag

SEQ ID NO: 128510 - DNA, 20 bp, Artificial Sequence
  Description of Artificial Sequence: Synthetic oligonucleotide
  Target: ATXN1; (+) strand; PAM type: NRG; PAM sequence: GGG
acactggggctctctctaga

SEQ ID NO: 128511 - DNA, 20 bp, Artificial Sequence
  Description of Artificial Sequence: Synthetic oligonucleotide
  Target: ATXN1; (+) strand; PAM type: NRG; PAM sequence: AAG
tggggctctctctagaggga

SEQ ID NO: 128512 - DNA, 20 bp, Artificial Sequence
  Description of Artificial Sequence: Synthetic oligonucleotide
  Target: ATXN1; (+) strand; PAM type: NRG; PAM sequence: TAG
ctctctagagggaaagtatg

SEQ ID NO: 128513 - DNA, 20 bp, Artificial Sequence
  Description of Artificial Sequence: Synthetic oligonucleotide
  Target: ATXN1; (+) strand; PAM type: NRG; PAM sequence: TGG
tttccacattcccaactact

SEQ ID NO: 128514 - DNA, 20 bp, Artificial Sequence
  Description of Artificial Sequence: Synthetic oligonucleotide
  Target: ATXN1; (+) strand; PAM type: NRG; PAM sequence: GGG
ttccacattcccaactactt

SEQ ID NO: 128515 - DNA, 20 bp, Artificial Sequence
  Description of Artificial Sequence: Synthetic oligonucleotide
  Target: ATXN1; (+) strand; PAM type: NRG; PAM sequence: GAG
ccacattcccaactacttgg

SEQ ID NO: 128516 - DNA, 20 bp, Artificial Sequence
  Description of Artificial Sequence: Synthetic oligonucleotide
  Target: ATXN1; (+) strand; PAM type: NRG; PAM sequence: AAG
tcccaactacttgggagccc

SEQ ID NO: 128517 - DNA, 20 bp, Artificial Sequence
  Description of Artificial Sequence: Synthetic oligonucleotide
  Target: ATXN1; (+) strand; PAM type: NRG; PAM sequence: AGG
cccaactacttgggagccca

SEQ ID NO: 128518 - DNA, 20 bp, Artificial Sequence
  Description of Artificial Sequence: Synthetic oligonucleotide
  Target: ATXN1; (+) strand; PAM type: NRG; PAM sequence: CAG
ttgggagcccaaggtgtttg

SEQ ID NO: 128519 - DNA, 20 bp, Artificial Sequence
  Description of Artificial Sequence: Synthetic oligonucleotide
  Target: ATXN1; (+) strand; PAM type: NRG; PAM sequence: CAG
ggagcccaaggtgtttgcag

SEQ ID NO: 128520 - DNA, 20 bp, Artificial Sequence
  Description of Artificial Sequence: Synthetic oligonucleotide
  Target: ATXN1; (+) strand; PAM type: NRG; PAM sequence: GAG
agcagccaaatacaactaac

SEQ ID NO: 128521 - DNA, 20 bp, Artificial Sequence
  Description of Artificial Sequence: Synthetic oligonucleotide
  Target: ATXN1; (+) strand; PAM type: NRG; PAM sequence: TAG
agccaaatacaactaacgag

SEQ ID NO: 128522 - DNA, 20 bp, Artificial Sequence
  Description of Artificial Sequence: Synthetic oligonucleotide
  Target: ATXN1; (+) strand; PAM type: NRG; PAM sequence: AGG
gccaaatacaactaacgagt

SEQ ID NO: 128523 - DNA, 20 bp, Artificial Sequence
  Description of Artificial Sequence: Synthetic oligonucleotide
  Target: ATXN1; (+) strand; PAM type: NRG; PAM sequence: AAG
tacaactaacgagtaggaaa

SEQ ID NO: 128524 - DNA, 20 bp, Artificial Sequence
  Description of Artificial Sequence: Synthetic oligonucleotide
  Target: ATXN1; (+) strand; PAM type: NRG; PAM sequence: AAG
acgagtaggaaaaagacact

SEQ ID NO: 128525 - DNA, 20 bp, Artificial Sequence
  Description of Artificial Sequence: Synthetic oligonucleotide
  Target: ATXN1; (+) strand; PAM type: NRG; PAM sequence: AAG
attgtgtctgacacattcaa

SEQ ID NO: 128526 - DNA, 20 bp, Artificial Sequence
  Description of Artificial Sequence: Synthetic oligonucleotide
  Target: ATXN1; (+) strand; PAM type: NRG; PAM sequence: CAG
tgtctgacacattcaaaaga

SEQ ID NO: 128527 - DNA, 20 bp, Artificial Sequence
  Description of Artificial Sequence: Synthetic oligonucleotide
  Target: ATXN1; (+) strand; PAM type: NRG; PAM sequence: TGG
gacagttgtcctcccatcca

SEQ ID NO: 128528 - DNA, 20 bp, Artificial Sequence
  Description of Artificial Sequence: Synthetic oligonucleotide
  Target: ATXN1; (+) strand; PAM type: NRG; PAM sequence: GAG
cagttgtcctcccatccatg

SEQ ID NO: 128529 - DNA, 20 bp, Artificial Sequence
  Description of Artificial Sequence: Synthetic oligonucleotide
  Target: ATXN1; (+) strand; PAM type: NRG; PAM sequence: AGG
agttgtcctcccatccatgg

SEQ ID NO: 128530 - DNA, 20 bp, Artificial Sequence
  Description of Artificial Sequence: Synthetic oligonucleotide
  Target: ATXN1; (+) strand; PAM type: NRG; PAM sequence: AAG
atccatggaggatctgttcc

SEQ ID NO: 128531 - DNA, 20 bp, Artificial Sequence
  Description of Artificial Sequence: Synthetic oligonucleotide
  Target: ATXN1; (+) strand; PAM type: NRG; PAM sequence: CAG
gaggatctgttccaagaccc

SEQ ID NO: 128532 - DNA, 20 bp, Artificial Sequence
  Description of Artificial Sequence: Synthetic oligonucleotide
  Target: ATXN1; (+) strand; PAM type: NRG; PAM sequence: TGG
gatctgttccaagaccccag

SEQ ID NO: 128533 - DNA, 20 bp, Artificial Sequence
  Description of Artificial Sequence: Synthetic oligonucleotide
  Target: ATXN1; (+) strand; PAM type: NRG; PAM sequence: TAG
tggacgcctaaaaccatgaa

SEQ ID NO: 128534 - DNA, 20 bp, Artificial Sequence
  Description of Artificial Sequence: Synthetic oligonucleotide
  Target: ATXN1; (+) strand; PAM type: NRG; PAM sequence: TAG
ctatacatatacacccatga

SEQ ID NO: 128535 - DNA, 20 bp, Artificial Sequence
  Description of Artificial Sequence: Synthetic oligonucleotide
  Target: ATXN1; (+) strand; PAM type: NRG; PAM sequence: GAG
atacatatacacccatgata

SEQ ID NO: 128536 - DNA, 20 bp, Artificial Sequence
  Description of Artificial Sequence: Synthetic oligonucleotide
  Target: ATXN1; (+) strand; PAM type: NRG; PAM sequence: AAG
atagagtttaatttataaat

SEQ ID NO: 128537 - DNA, 20 bp, Artificial Sequence
  Description of Artificial Sequence: Synthetic oligonucleotide
  Target: ATXN1; (+) strand; PAM type: NRG; PAM sequence: CAG
tttaatttataaataagtca

SEQ ID NO: 128538 - DNA, 20 bp, Artificial Sequence
  Description of Artificial Sequence: Synthetic oligonucleotide
  Target: ATXN1; (+) strand; PAM type: NRG; PAM sequence: AAG
atttataaataagtcacagt

SEQ ID NO: 128539 - DNA, 20 bp, Artificial Sequence
  Description of Artificial Sequence: Synthetic oligonucleotide
  Target: ATXN1; (+) strand; PAM type: NRG; PAM sequence: GAG
ttataaataagtcacagtaa

SEQ ID NO: 128540 - DNA, 20 bp, Artificial Sequence
  Description of Artificial Sequence: Synthetic oligonucleotide
  Target: ATXN1; (+) strand; PAM type: NRG; PAM sequence: TAG
aacaaaaactaataataaaa

SEQ ID NO: 128541 - DNA, 20 bp, Artificial Sequence
  Description of Artificial Sequence: Synthetic oligonucleotide
  Target: ATXN1; (+) strand; PAM type: NRG; PAM sequence: AAG
ataacattatactgtactaa

SEQ ID NO: 128542 - DNA, 20 bp, Artificial Sequence
  Description of Artificial Sequence: Synthetic oligonucleotide
  Target: ATXN1; (+) strand; PAM type: NRG; PAM sequence: TGG
tactaaaagttatgtgaatg

SEQ ID NO: 128543 - DNA, 20 bp, Artificial Sequence
  Description of Artificial Sequence: Synthetic oligonucleotide
  Target: ATXN1; (+) strand; PAM type: NRG; PAM sequence: TGG
tctcaaaatatcttattgca

SEQ ID NO: 128544 - DNA, 20 bp, Artificial Sequence
  Description of Artificial Sequence: Synthetic oligonucleotide
  Target: ATXN1; (+) strand; PAM type: NRG; PAM sequence: TGG
ttttgtaccacgcttgactg

SEQ ID NO: 128545 - DNA, 20 bp, Artificial Sequence
  Description of Artificial Sequence: Synthetic oligonucleotide
  Target: ATXN1; (+) strand; PAM type: NRG; PAM sequence: GGG
tttgtaccacgcttgactgt

SEQ ID NO: 128546 - DNA, 20 bp, Artificial Sequence
  Description of Artificial Sequence: Synthetic oligonucleotide
  Target: ATXN1; (+) strand; PAM type: NRG; PAM sequence: CAG
ttgactgtgggtaattgaaa

SEQ ID NO: 128547 - DNA, 20 bp, Artificial Sequence
  Description of Artificial Sequence: Synthetic oligonucleotide
  Target: ATXN1; (+) strand; PAM type: NRG; PAM sequence: CAG
actgtgggtaattgaaacag

SEQ ID NO: 128548 - DNA, 20 bp, Artificial Sequence
  Description of Artificial Sequence: Synthetic oligonucleotide
  Target: ATXN1; (+) strand; PAM type: NRG; PAM sequence: AAG
aacagcagaaaatgacaccg

SEQ ID NO: 128549 - DNA, 20 bp, Artificial Sequence
  Description of Artificial Sequence: Synthetic oligonucleotide
  Target: ATXN1; (+) strand; PAM type: NRG; PAM sequence: TGG
gcagaaaatgacaccgaaga

SEQ ID NO: 128550 - DNA, 20 bp, Artificial Sequence
  Description of Artificial Sequence: Synthetic oligonucleotide
  Target: ATXN1; (+) strand; PAM type: NRG; PAM sequence: GGG
cagaaaatgacaccgaagat

SEQ ID NO: 128551 - DNA, 20 bp, Artificial Sequence
  Description of Artificial Sequence: Synthetic oligonucleotide
  Target: ATXN1; (+) strand; PAM type: NRG; PAM sequence: GGG
agaaaatgacaccgaagatg

SEQ ID NO: 128552 - DNA, 20 bp, Artificial Sequence
  Description of Artificial Sequence: Synthetic oligonucleotide
  Target: ATXN1; (+) strand; PAM type: NRG; PAM sequence: GGG
gaaaatgacaccgaagatgg

SEQ ID NO: 128553 - DNA, 20 bp, Artificial Sequence
  Description of Artificial Sequence: Synthetic oligonucleotide
  Target: ATXN1; (+) strand; PAM type: NRG; PAM sequence: GGG
aaaatgacaccgaagatggg

SEQ ID NO: 128554 - DNA, 20 bp, Artificial Sequence
  Description of Artificial Sequence: Synthetic oligonucleotide
  Target: ATXN1; (+) strand; PAM type: NRG; PAM sequence: TGG
atgacaccgaagatgggggg

SEQ ID NO: 128555 - DNA, 20 bp, Artificial Sequence
  Description of Artificial Sequence: Synthetic oligonucleotide
  Target: ATXN1; (+) strand; PAM type: NRG; PAM sequence: GGG
tgacaccgaagatggggggt

SEQ ID NO: 128556 - DNA, 20 bp, Artificial Sequence
  Description of Artificial Sequence: Synthetic oligonucleotide
  Target: ATXN1; (+) strand; PAM type: NRG; PAM sequence: GGG
gacaccgaagatggggggtg

SEQ ID NO: 128557 - DNA, 20 bp, Artificial Sequence
  Description of Artificial Sequence: Synthetic oligonucleotide
  Target: ATXN1; (+) strand; PAM type: NRG; PAM sequence: GGG
acaccgaagatggggggtgg

SEQ ID NO: 128558 - DNA, 20 bp, Artificial Sequence
  Description of Artificial Sequence: Synthetic oligonucleotide
  Target: ATXN1; (+) strand; PAM type: NRG; PAM sequence: GGG
caccgaagatggggggtggg

SEQ ID NO: 128559 - DNA, 20 bp, Artificial Sequence
  Description of Artificial Sequence: Synthetic oligonucleotide
  Target: ATXN1; (+) strand; PAM type: NRG; PAM sequence: TGG
ggggaactactgtatcaacc

SEQ ID NO: 128560 - DNA, 20 bp, Artificial Sequence
  Description of Artificial Sequence: Synthetic oligonucleotide
  Target: ATXN1; (+) strand; PAM type: NRG; PAM sequence: AAG
actactgtatcaacctggat

SEQ ID NO: 128561 - DNA, 20 bp, Artificial Sequence
  Description of Artificial Sequence: Synthetic oligonucleotide
  Target: ATXN1; (+) strand; PAM type: NRG; PAM sequence: CAG
tatcaacctggataagttca

SEQ ID NO: 128562 - DNA, 20 bp, Artificial Sequence
  Description of Artificial Sequence: Synthetic oligonucleotide
  Target: ATXN1; (+) strand; PAM type: NRG; PAM sequence: AGG
atcaacctggataagttcac

SEQ ID NO: 128563 - DNA, 20 bp, Artificial Sequence
  Description of Artificial Sequence: Synthetic oligonucleotide
  Target: ATXN1; (+) strand; PAM type: NRG; PAM sequence: GGG
tcaacctggataagttcaca

SEQ ID NO: 128564 - DNA, 20 bp, Artificial Sequence
  Description of Artificial Sequence: Synthetic oligonucleotide
  Target: ATXN1; (+) strand; PAM type: NRG; PAM sequence: CGG
ctggataagttcacagggaa

SEQ ID NO: 128565 - DNA, 20 bp, Artificial Sequence
  Description of Artificial Sequence: Synthetic oligonucleotide
  Target: ATXN1; (+) strand; PAM type: NRG; PAM sequence: CAG
ggaacggaacacattctttc

SEQ ID NO: 128566 - DNA, 20 bp, Artificial Sequence
  Description of Artificial Sequence: Synthetic oligonucleotide
  Target: ATXN1; (+) strand; PAM type: NRG; PAM sequence: AAG
acggaacacattctttccag

SEQ ID NO: 128567 - DNA, 20 bp, Artificial Sequence
  Description of Artificial Sequence: Synthetic oligonucleotide
  Target: ATXN1; (+) strand; PAM type: NRG; PAM sequence: AGG
cggaacacattctttccaga

SEQ ID NO: 128568 - DNA, 20 bp, Artificial Sequence
  Description of Artificial Sequence: Synthetic oligonucleotide
  Target: ATXN1; (+) strand; PAM type: NRG; PAM sequence: CAG
gaaggtgatgcataaaatca

SEQ ID NO: 128569 - DNA, 20 bp, Artificial Sequence
  Description of Artificial Sequence: Synthetic oligonucleotide
  Target: ATXN1; (+) strand; PAM type: NRG; PAM sequence: TGG
aatcacagcatgtccacaaa

SEQ ID NO: 128570 - DNA, 20 bp, Artificial Sequence
  Description of Artificial Sequence: Synthetic oligonucleotide
  Target: ATXN1; (+) strand; PAM type: NRG; PAM sequence: TGG
gcatgtccacaaatggcctt

SEQ ID NO: 128571 - DNA, 20 bp, Artificial Sequence
  Description of Artificial Sequence: Synthetic oligonucleotide
  Target: ATXN1; (+) strand; PAM type: NRG; PAM sequence: GGG
catgtccacaaatggccttt

SEQ ID NO: 128572 - DNA, 20 bp, Artificial Sequence
  Description of Artificial Sequence: Synthetic oligonucleotide
  Target: ATXN1; (+) strand; PAM type: NRG; PAM sequence: TGG
caaatggcctttgggaatga

SEQ ID NO: 128573 - DNA, 20 bp, Artificial Sequence
  Description of Artificial Sequence: Synthetic oligonucleotide
  Target: ATXN1; (+) strand; PAM type: NRG; PAM sequence: GGG
aaatggcctttgggaatgat

SEQ ID NO: 128574 - DNA, 20 bp, Artificial Sequence
  Description of Artificial Sequence: Synthetic oligonucleotide
  Target: ATXN1; (+) strand; PAM type: NRG; PAM sequence: GAG
ttgggaatgatgggacattt

SEQ ID NO: 128575 - DNA, 20 bp, Artificial Sequence
  Description of Artificial Sequence: Synthetic oligonucleotide
  Target: ATXN1; (+) strand; PAM type: NRG; PAM sequence: GAG
catttgagtttacaaaatgc

SEQ ID NO: 128576 - DNA, 20 bp, Artificial Sequence
  Description of Artificial Sequence: Synthetic oligonucleotide
  Target: ATXN1; (+) strand; PAM type: NRG; PAM sequence: AAG
gagtttacaaaatgcgagac

SEQ ID NO: 128577 - DNA, 20 bp, Artificial Sequence
  Description of Artificial Sequence: Synthetic oligonucleotide
  Target: ATXN1; (+) strand; PAM type: NRG; PAM sequence: AAG
tacaaaatgcgagacaagca

SEQ ID NO: 128578 - DNA, 20 bp, Artificial Sequence
  Description of Artificial Sequence: Synthetic oligonucleotide
  Target: ATXN1; (+) strand; PAM type: NRG; PAM sequence: CAG
aatgcgagacaagcaaagcc

SEQ ID NO: 128579 - DNA, 20 bp, Artificial Sequence
  Description of Artificial Sequence: Synthetic oligonucleotide
  Target: ATXN1; (+) strand; PAM type: NRG; PAM sequence: AGG
atgcgagacaagcaaagccc

SEQ ID NO: 128580 - DNA, 20 bp, Artificial Sequence
  Description of Artificial Sequence: Synthetic oligonucleotide
  Target: ATXN1; (+) strand; PAM type: NRG; PAM sequence: GGG
tgcgagacaagcaaagccca

SEQ ID NO: 128581 - DNA, 20 bp, Artificial Sequence
  Description of Artificial Sequence: Synthetic oligonucleotide
  Target: ATXN1; (+) strand; PAM type: NRG; PAM sequence: GAG
cgagacaagcaaagcccagg

SEQ ID NO: 128582 - DNA, 20 bp, Artificial Sequence
  Description of Artificial Sequence: Synthetic oligonucleotide
  Target: ATXN1; (+) strand; PAM type: NRG; PAM sequence: GAG
caagcaaagcccagggagct

SEQ ID NO: 128583 - DNA, 20 bp, Artificial Sequence
  Description of Artificial Sequence: Synthetic oligonucleotide
  Target: ATXN1; (+) strand; PAM type: NRG; PAM sequence: TGG
aagcccagggagctgagctc

SEQ ID NO: 128584 - DNA, 20 bp, Artificial Sequence
  Description of Artificial Sequence: Synthetic oligonucleotide
  Target: ATXN1; (+) strand; PAM type: NRG; PAM sequence: TGG
cagggagctgagctctggcc

SEQ ID NO: 128585 - DNA, 20 bp, Artificial Sequence
  Description of Artificial Sequence: Synthetic oligonucleotide
  Target: ATXN1; (+) strand; PAM type: NRG; PAM sequence: GGG
agggagctgagctctggcct

SEQ ID NO: 128586 - DNA, 20 bp, Artificial Sequence
  Description of Artificial Sequence: Synthetic oligonucleotide
  Target: ATXN1; (+) strand; PAM type: NRG; PAM sequence: CAG
cattccttcccaccgtcccg

SEQ ID NO: 128587 - DNA, 20 bp, Artificial Sequence
  Description of Artificial Sequence: Synthetic oligonucleotide
  Target: ATXN1; (+) strand; PAM type: NRG; PAM sequence: CGG
ccaccacctctcattctgtg

SEQ ID NO: 128588 - DNA, 20 bp, Artificial Sequence
  Description of Artificial Sequence: Synthetic oligonucleotide
  Target: ATXN1; (+) strand; PAM type: NRG; PAM sequence: GGG
caccacctctcattctgtgc

SEQ ID NO: 128589 - DNA, 20 bp, Artificial Sequence
  Description of Artificial Sequence: Synthetic oligonucleotide
  Target: ATXN1; (+) strand; PAM type: NRG; PAM sequence: GAG
ccacctctcattctgtgcgg

SEQ ID NO: 128590 - DNA, 20 bp, Artificial Sequence
  Description of Artificial Sequence: Synthetic oligonucleotide
  Target: ATXN1; (+) strand; PAM type: NRG; PAM sequence: AGG
cacctctcattctgtgcggg

SEQ ID NO: 128591 - DNA, 20 bp, Artificial Sequence
  Description of Artificial Sequence: Synthetic oligonucleotide
  Target: ATXN1; (+) strand; PAM type: NRG; PAM sequence: GGG
acctctcattctgtgcggga

SEQ ID NO: 128592 - DNA, 20 bp, Artificial Sequence
  Description of Artificial Sequence: Synthetic oligonucleotide
  Target: ATXN1; (+) strand; PAM type: NRG; PAM sequence: GGG
cctctcattctgtgcgggag

SEQ ID NO: 128593 - DNA, 20 bp, Artificial Sequence
  Description of Artificial Sequence: Synthetic oligonucleotide
  Target: ATXN1; (+) strand; PAM type: NRG; PAM sequence: TGG
tctgtgcgggaggggacatg

SEQ ID NO: 128594 - DNA, 20 bp, Artificial Sequence
  Description of Artificial Sequence: Synthetic oligonucleotide
  Target: ATXN1; (+) strand; PAM type: NRG; PAM sequence: TAG
cgggaggggacatgtggccc

SEQ ID NO: 128595 - DNA, 20 bp, Artificial Sequence
  Description of Artificial Sequence: Synthetic oligonucleotide
  Target: ATXN1; (+) strand; PAM type: NRG; PAM sequence: AAG
accaccactttccttataaa

SEQ ID NO: 128596 - DNA, 20 bp, Artificial Sequence
  Description of Artificial Sequence: Synthetic oligonucleotide
  Target: ATXN1; (+) strand; PAM type: NRG; PAM sequence: TGG
tccttataaaaagtaattta

SEQ ID NO: 128597 - DNA, 20 bp, Artificial Sequence
  Description of Artificial Sequence: Synthetic oligonucleotide
  Target: ATXN1; (+) strand; PAM type: NRG; PAM sequence: CAG
tatggttccctttcccatga

SEQ ID NO: 128598 - DNA, 20 bp, Artificial Sequence
  Description of Artificial Sequence: Synthetic oligonucleotide
  Target: ATXN1; (+) strand; PAM type: NRG; PAM sequence: AGG
atggttccctttcccatgac

SEQ ID NO: 128599 - DNA, 20 bp, Artificial Sequence
  Description of Artificial Sequence: Synthetic oligonucleotide
  Target: ATXN1; (+) strand; PAM type: NRG; PAM sequence: TAG
tcccatgacaggaaaactga

SEQ ID NO: 128600 - DNA, 20 bp, Artificial Sequence
  Description of Artificial Sequence: Synthetic oligonucleotide
  Target: ATXN1; (+) strand; PAM type: NRG; PAM sequence: AAG
catgacaggaaaactgatag

SEQ ID NO: 128601 - DNA, 20 bp, Artificial Sequence
  Description of Artificial Sequence: Synthetic oligonucleotide
  Target: ATXN1; (+) strand; PAM type: NRG; PAM sequence: CAG
ggaaaactgatagaagttta

SEQ ID NO: 128602 - DNA, 20 bp, Artificial Sequence
  Description of Artificial Sequence: Synthetic oligonucleotide
  Target: ATXN1; (+) strand; PAM type: NRG; PAM sequence: AGG
gaaaactgatagaagtttac

SEQ ID NO: 128603 - DNA, 20 bp, Artificial Sequence
  Description of Artificial Sequence: Synthetic oligonucleotide
  Target: ATXN1; (+) strand; PAM type: NRG; PAM sequence: AAG
tgatagaagtttacaggcaa

SEQ ID NO: 128604 - DNA, 20 bp, Artificial Sequence
  Description of Artificial Sequence: Synthetic oligonucleotide
  Target: ATXN1; (+) strand; PAM type: NRG; PAM sequence: TGG
tatttctaattcttttcatt

SEQ ID NO: 128605 - DNA, 20 bp, Artificial Sequence
  Description of Artificial Sequence: Synthetic oligonucleotide
  Target: ATXN1; (+) strand; PAM type: NRG; PAM sequence: GGG
atttctaattcttttcattt

SEQ ID NO: 128606 - DNA, 20 bp, Artificial Sequence
  Description of Artificial Sequence: Synthetic oligonucleotide
  Target: ATXN1; (+) strand; PAM type: NRG; PAM sequence: GGG
tttctaattcttttcatttg

SEQ ID NO: 128607 - DNA, 20 bp, Artificial Sequence
  Description of Artificial Sequence: Synthetic oligonucleotide
  Target: ATXN1; (+) strand; PAM type: NRG; PAM sequence: AAG
aattcttttcatttggggat

SEQ ID NO: 128608 - DNA, 20 bp, Artificial Sequence
  Description of Artificial Sequence: Synthetic oligonucleotide
  Target: ATXN1; (+) strand; PAM type: NRG; PAM sequence: AAG
ttttcatttggggataagac

SEQ ID NO: 128609 - DNA, 20 bp, Artificial Sequence
  Description of Artificial Sequence: Synthetic oligonucleotide
  Target: ATXN1; (+) strand; PAM type: NRG; PAM sequence: TAG
ctctgtgtgtatttttaaaa

SEQ ID NO: 128610 - DNA, 20 bp, Artificial Sequence
  Description of Artificial Sequence: Synthetic oligonucleotide
  Target: ATXN1; (+) strand; PAM type: NRG; PAM sequence: CGG
tttaaatgaacatcctttat

SEQ ID NO: 128611 - DNA, 20 bp, Artificial Sequence
  Description of Artificial Sequence: Synthetic oligonucleotide
  Target: ATXN1; (+) strand; PAM type: NRG; PAM sequence: AAG
atcggcttgcacatatgcta

SEQ ID NO: 128612 - DNA, 20 bp, Artificial Sequence
  Description of Artificial Sequence: Synthetic oligonucleotide
  Target: ATXN1; (+) strand; PAM type: NRG; PAM sequence: AGG
tcggcttgcacatatgctaa

SEQ ID NO: 128613 - DNA, 20 bp, Artificial Sequence
  Description of Artificial Sequence: Synthetic oligonucleotide
  Target: ATXN1; (+) strand; PAM type: NRG; PAM sequence: CAG
gcttgcacatatgctaaagg

SEQ ID NO: 128614 - DNA, 20 bp, Artificial Sequence
  Description of Artificial Sequence: Synthetic oligonucleotide
  Target: ATXN1; (+) strand; PAM type: NRG; PAM sequence: AGG
cttgcacatatgctaaaggc

SEQ ID NO: 128615 - DNA, 20 bp, Artificial Sequence
  Description of Artificial Sequence: Synthetic oligonucleotide
  Target: ATXN1; (+) strand; PAM type: NRG; PAM sequence: GGG
ttgcacatatgctaaaggca

SEQ ID NO: 128616 - DNA, 20 bp, Artificial Sequence
  Description of Artificial Sequence: Synthetic oligonucleotide
  Target: ATXN1; (+) strand; PAM type: NRG; PAM sequence: AAG
atgctaaaggcagggcacat

SEQ ID NO: 128617 - DNA, 20 bp, Artificial Sequence
  Description of Artificial Sequence: Synthetic oligonucleotide
  Target: ATXN1; (+) strand; PAM type: NRG; PAM sequence: CAG
cagggcacataagactctta

SEQ ID NO: 128618 - DNA, 20 bp, Artificial Sequence
  Description of Artificial Sequence: Synthetic oligonucleotide
  Target: ATXN1; (+) strand; PAM type: NRG; PAM sequence: AGG
agggcacataagactcttac

SEQ ID NO: 128619 - DNA, 20 bp, Artificial Sequence
  Description of Artificial Sequence: Synthetic oligonucleotide
  Target: ATXN1; (+) strand; PAM type: NRG; PAM sequence: AAG
cacataagactcttacagga

SEQ ID NO: 128620 - DNA, 20 bp, Artificial Sequence
  Description of Artificial Sequence: Synthetic oligonucleotide
  Target: ATXN1; (+) strand; PAM type: NRG; PAM sequence: AAG
ctcttacaggaaagtatgcc

SEQ ID NO: 128621 - DNA, 20 bp, Artificial Sequence
  Description of Artificial Sequence: Synthetic oligonucleotide
  Target: ATXN1; (+) strand; PAM type: NRG; PAM sequence: GAG
cttacaggaaagtatgccaa

SEQ ID NO: 128622 - DNA, 20 bp, Artificial Sequence
  Description of Artificial Sequence: Synthetic oligonucleotide
  Target: ATXN1; (+) strand; PAM type: NRG; PAM sequence: AAG
gaaagtatgccaagagaaaa

SEQ ID NO: 128623 - DNA, 20 bp, Artificial Sequence
  Description of Artificial Sequence: Synthetic oligonucleotide
  Target: ATXN1; (+) strand; PAM type: NRG; PAM sequence: CAG
ctcctaaatatgccttaaac

SEQ ID NO: 128624 - DNA, 20 bp, Artificial Sequence
  Description of Artificial Sequence: Synthetic oligonucleotide
  Target: ATXN1; (+) strand; PAM type: NRG; PAM sequence: AGG
tcctaaatatgccttaaacc

SEQ ID NO: 128625 - DNA, 20 bp, Artificial Sequence
  Description of Artificial Sequence: Synthetic oligonucleotide
  Target: ATXN1; (+) strand; PAM type: NRG; PAM sequence: GGG
cctaaatatgccttaaacca

SEQ ID NO: 128626 - DNA, 20 bp, Artificial Sequence
  Description of Artificial Sequence: Synthetic oligonucleotide
  Target: ATXN1; (+) strand; PAM type: NRG; PAM sequence: GGG
ctaaatatgccttaaaccag

SEQ ID NO: 128627 - DNA, 20 bp, Artificial Sequence
  Description of Artificial Sequence: Synthetic oligonucleotide
  Target: ATXN1; (+) strand; PAM type: NRG; PAM sequence: CAG
gatacgtgaccaattttatt

SEQ ID NO: 128628 - DNA, 20 bp, Artificial Sequence
  Description of Artificial Sequence: Synthetic oligonucleotide
  Target: ATXN1; (+) strand; PAM type: NRG; PAM sequence: CAG
tgttctaaccactaccattt

SEQ ID NO: 128629 - DNA, 20 bp, Artificial Sequence
  Description of Artificial Sequence: Synthetic oligonucleotide
  Target: ATXN1; (+) strand; PAM type: NRG; PAM sequence: AAG
taaaaaaaaaaaaaaaaaaa

SEQ ID NO: 128630 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaaaaaaaaaaa

SEQ ID NO: 128631 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaaaaaaaaaga

SEQ ID NO: 128632 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaaaaaaagaga

SEQ ID NO: 128633 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaaaaagagaga

SEQ ID NO: 128634 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaaagagagaga

SEQ ID NO: 128635 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaagagagagaga

SEQ ID NO: 128636 - DNA, 20 bp, Artificial Sequence
  Description of Artificial Sequence: Synthetic oligonucleotide
  Target: ATXN1; (+) strand; PAM type: NRG; PAM sequence: AAG
aaaagagagagagagagttt

SEQ ID NO: 128637 - DNA, 20 bp, Artificial Sequence
  Description of Artificial Sequence: Synthetic oligonucleotide
  Target: ATXN1; (+) strand; PAM type: NRG; PAM sequence: TAG
agagagagtttaagcatgcc

SEQ ID NO: 128638 - DNA, 20 bp, Artificial Sequence
  Description of Artificial Sequence: Synthetic oligonucleotide
  Target: ATXN1; (+) strand; PAM type: NRG; PAM sequence: AGG
gagagagtttaagcatgcct

SEQ ID NO: 128639 - DNA, 20 bp, Artificial Sequence
  Description of Artificial Sequence: Synthetic oligonucleotide
  Target: ATXN1; (+) strand; PAM type: NRG; PAM sequence: GGG
agagagtttaagcatgccta

SEQ ID NO: 128640 - DNA, 20 bp, Artificial Sequence
  Description of Artificial Sequence: Synthetic oligonucleotide
  Target: ATXN1; (+) strand; PAM type: NRG; PAM sequence: CAG
gtttaagcatgcctagggct

SEQ ID NO: 128641 - DNA, 20 bp, Artificial Sequence
  Description of Artificial Sequence: Synthetic oligonucleotide
  Target: ATXN1; (+) strand; PAM type: NRG; PAM sequence: GAG
ttaagcatgcctagggctca

SEQ ID NO: 128642 - DNA, 20 bp, Artificial Sequence
  Description of Artificial Sequence: Synthetic oligonucleotide
  Target: ATXN1; (+) strand; PAM type: NRG; PAM sequence: AGG
taagcatgcctagggctcag

SEQ ID NO: 128643 - DNA, 20 bp, Artificial Sequence
  Description of Artificial Sequence: Synthetic oligonucleotide
  Target: ATXN1; (+) strand; PAM type: NRG; PAM sequence: TAG
gcctagggctcagaggaatt

SEQ ID NO: 128644 - DNA, 20 bp, Artificial Sequence
  Description of Artificial Sequence: Synthetic oligonucleotide
  Target: ATXN1; (+) strand; PAM type: NRG; PAM sequence: AAG
agaggaatttagatgttttc

SEQ ID NO: 128645 - DNA, 20 bp, Artificial Sequence
  Description of Artificial Sequence: Synthetic oligonucleotide
  Target: ATXN1; (+) strand; PAM type: NRG; PAM sequence: TAG
gcattactacttgatgcttt

SEQ ID NO: 128646 - DNA, 20 bp, Artificial Sequence
  Description of Artificial Sequence: Synthetic oligonucleotide
  Target: ATXN1; (+) strand; PAM type: NRG; PAM sequence: GAG
attactacttgatgctttta

SEQ ID NO: 128647 - DNA, 20 bp, Artificial Sequence
  Description of Artificial Sequence: Synthetic oligonucleotide
  Target: ATXN1; (+) strand; PAM type: NRG; PAM sequence: GAG
gcttttagagcttcatgctt

SEQ ID NO: 128648 - DNA, 20 bp, Artificial Sequence
  Description of Artificial Sequence: Synthetic oligonucleotide
  Target: ATXN1; (+) strand; PAM type: NRG; PAM sequence: AAG
agagcttcatgcttgagtta

SEQ ID NO: 128649 - DNA, 20 bp, Artificial Sequence
  Description of Artificial Sequence: Synthetic oligonucleotide
  Target: ATXN1; (+) strand; PAM type: NRG; PAM sequence: AGG
gagcttcatgcttgagttaa

SEQ ID NO: 128650 - DNA, 20 bp, Artificial Sequence
  Description of Artificial Sequence: Synthetic oligonucleotide
  Target: ATXN1; (+) strand; PAM type: NRG; PAM sequence: GAG
ttcatgcttgagttaaaggc

SEQ ID NO: 128651 - DNA, 20 bp, Artificial Sequence
  Description of Artificial Sequence: Synthetic oligonucleotide
  Target: ATXN1; (+) strand; PAM type: NRG; PAM sequence: TGG
taaaaattaactctaacctc

SEQ ID NO: 128652 - DNA, 20 bp, Artificial Sequence
  Description of Artificial Sequence: Synthetic oligonucleotide
  Target: ATXN1; (+) strand; PAM type: NRG; PAM sequence: GGG
aaaaattaactctaacctct

SEQ ID NO: 128653 - DNA, 20 bp, Artificial Sequence
  Description of Artificial Sequence: Synthetic oligonucleotide
  Target: ATXN1; (+) strand; PAM type: NRG; PAM sequence: TAG
ttaactctaacctctgggtt

SEQ ID NO: 128654 - DNA, 20 bp, Artificial Sequence
  Description of Artificial Sequence: Synthetic oligonucleotide
  Target: ATXN1; (+) strand; PAM type: NRG; PAM sequence: AGG
taactctaacctctgggttt

SEQ ID NO: 128655 - DNA, 20 bp, Artificial Sequence
  Description of Artificial Sequence: Synthetic oligonucleotide
  Target: ATXN1; (+) strand; PAM type: NRG; PAM sequence: GGG
aactctaacctctgggttta

SEQ ID NO: 128656 - DNA, 20 bp, Artificial Sequence
  Description of Artificial Sequence: Synthetic oligonucleotide
  Target: ATXN1; (+) strand; PAM type: NRG; PAM sequence: TAG
ctaacctctgggtttagggc

SEQ ID NO: 128657 - DNA, 20 bp, Artificial Sequence
  Description of Artificial Sequence: Synthetic oligonucleotide
  Target: ATXN1; (+) strand; PAM type: NRG; PAM sequence: AAG
acctctgggtttagggctag

SEQ ID NO: 128658 - DNA, 20 bp, Artificial Sequence
  Description of Artificial Sequence: Synthetic oligonucleotide
  Target: ATXN1; (+) strand; PAM type: NRG; PAM sequence: TAG
tagaagccaatgacttccca

SEQ ID NO: 128659 - DNA, 20 bp, Artificial Sequence
  Description of Artificial Sequence: Synthetic oligonucleotide
  Target: ATXN1; (+) strand; PAM type: NRG; PAM sequence: AGG
agaagccaatgacttcccat

SEQ ID NO: 128660 - DNA, 20 bp, Artificial Sequence
  Description of Artificial Sequence: Synthetic oligonucleotide
  Target: ATXN1; (+) strand; PAM type: NRG; PAM sequence: GGG
gaagccaatgacttcccata

SEQ ID NO: 128661 - DNA, 20 bp, Artificial Sequence
  Description of Artificial Sequence: Synthetic oligonucleotide
  Target: ATXN1; (+) strand; PAM type: NRG; PAM sequence: AAG
gacttcccatagggtcacta

SEQ ID NO: 128662 - DNA, 20 bp, Artificial Sequence
  Description of Artificial Sequence: Synthetic oligonucleotide
  Target: ATXN1; (+) strand; PAM type: NRG; PAM sequence: TGG
tcactaaagatgctatttgt

SEQ ID NO: 128663 - DNA, 20 bp, Artificial Sequence
  Description of Artificial Sequence: Synthetic oligonucleotide
  Target: ATXN1; (+) strand; PAM type: NRG; PAM sequence: TAG
taaagatgctatttgttggc

SEQ ID NO: 128664 - DNA, 20 bp, Artificial Sequence
  Description of Artificial Sequence: Synthetic oligonucleotide
  Target: ATXN1; (+) strand; PAM type: NRG; PAM sequence: TGG
tttgttggctagatttgtcc

SEQ ID NO: 128665 - DNA, 20 bp, Artificial Sequence
  Description of Artificial Sequence: Synthetic oligonucleotide
  Target: ATXN1; (+) strand; PAM type: NRG; PAM sequence: GGG
ttgttggctagatttgtcct

SEQ ID NO: 128666 - DNA, 20 bp, Artificial Sequence
  Description of Artificial Sequence: Synthetic oligonucleotide
  Target: ATXN1; (+) strand; PAM type: NRG; PAM sequence: GAG
gttggctagatttgtcctgg

SEQ ID NO: 128667 - DNA, 20 bp, Artificial Sequence
  Description of Artificial Sequence: Synthetic oligonucleotide
  Target: ATXN1; (+) strand; PAM type: NRG; PAM sequence: AAG
gatttgtcctgggagtactc

SEQ ID NO: 128668 - DNA, 20 bp, Artificial Sequence
  Description of Artificial Sequence: Synthetic oligonucleotide
  Target: ATXN1; (+) strand; PAM type: NRG; PAM sequence: AGG
atttgtcctgggagtactca

SEQ ID NO: 128669 - DNA, 20 bp, Artificial Sequence
  Description of Artificial Sequence: Synthetic oligonucleotide
  Target: ATXN1; (+) strand; PAM type: NRG; PAM sequence: GGG
tttgtcctgggagtactcaa

SEQ ID NO: 128670 - DNA, 20 bp, Artificial Sequence
  Description of Artificial Sequence: Synthetic oligonucleotide
  Target: ATXN1; (+) strand; PAM type: NRG; PAM sequence: AAG
actcaagggtctcgcaacaa

SEQ ID NO: 128671 - DNA, 20 bp, Artificial Sequence
  Description of Artificial Sequence: Synthetic oligonucleotide
  Target: ATXN1; (+) strand; PAM type: NRG; PAM sequence: CAG
gggtctcgcaacaaaagtaa

SEQ ID NO: 128672 - DNA, 20 bp, Artificial Sequence
  Description of Artificial Sequence: Synthetic oligonucleotide
  Target: ATXN1; (+) strand; PAM type: NRG; PAM sequence: AGG
ggtctcgcaacaaaagtaac

SEQ ID NO: 128673 - DNA, 20 bp, Artificial Sequence
  Description of Artificial Sequence: Synthetic oligonucleotide
  Target: ATXN1; (+) strand; PAM type: NRG; PAM sequence: GGG
gtctcgcaacaaaagtaaca

SEQ ID NO: 128674 - DNA, 20 bp, Artificial Sequence
  Description of Artificial Sequence: Synthetic oligonucleotide
  Target: ATXN1; (+) strand; PAM type: NRG; PAM sequence: AAG
gggttgtcacttcgaaccta

SEQ ID NO: 128675 - DNA, 20 bp, Artificial Sequence
  Description of Artificial Sequence: Synthetic oligonucleotide
  Target: ATXN1; (+) strand; PAM type: NRG; PAM sequence: CAG
cgaacctaaagactcgattg

SEQ ID NO: 128676 - DNA, 20 bp, Artificial Sequence
  Description of Artificial Sequence: Synthetic oligonucleotide
  Target: ATXN1; (+) strand; PAM type: NRG; PAM sequence: TGG
ctaaagactcgattgcagca

SEQ ID NO: 128677 - DNA, 20 bp, Artificial Sequence
  Description of Artificial Sequence: Synthetic oligonucleotide
  Target: ATXN1; (+) strand; PAM type: NRG; PAM sequence: GGG
taaagactcgattgcagcat

SEQ ID NO: 128678 - DNA, 20 bp, Artificial Sequence
  Description of Artificial Sequence: Synthetic oligonucleotide
  Target: ATXN1; (+) strand; PAM type: NRG; PAM sequence: AAG
caaaatataataatgttatc

SEQ ID NO: 128679 - DNA, 20 bp, Artificial Sequence
  Description of Artificial Sequence: Synthetic oligonucleotide
  Target: ATXN1; (+) strand; PAM type: NRG; PAM sequence: AAG
aagaatccttttttactatc

SEQ ID NO: 128680 - DNA, 20 bp, Artificial Sequence
  Description of Artificial Sequence: Synthetic oligonucleotide
  Target: ATXN1; (+) strand; PAM type: NRG; PAM sequence: AAG
cttttttactatcaagtctg

SEQ ID NO: 128681 - DNA, 20 bp, Artificial Sequence
  Description of Artificial Sequence: Synthetic oligonucleotide
  Target: ATXN1; (+) strand; PAM type: NRG; PAM sequence: TGG
tactatcaagtctgaagtac

SEQ ID NO: 128682 - DNA, 20 bp, Artificial Sequence
  Description of Artificial Sequence: Synthetic oligonucleotide
  Target: ATXN1; (+) strand; PAM type: NRG; PAM sequence: GAG
ctatcaagtctgaagtactg

SEQ ID NO: 128683 - DNA, 20 bp, Artificial Sequence
  Description of Artificial Sequence: Synthetic oligonucleotide
  Target: ATXN1; (+) strand; PAM type: NRG; PAM sequence: GAG
tctgaagtactggagatgat

SEQ ID NO: 128684 - DNA, 20 bp, Artificial Sequence
  Description of Artificial Sequence: Synthetic oligonucleotide
  Target: ATXN1; (+) strand; PAM type: NRG; PAM sequence: GAG
tgaagtactggagatgatga

SEQ ID NO: 128685 - DNA, 20 bp, Artificial Sequence
  Description of Artificial Sequence: Synthetic oligonucleotide
  Target: ATXN1; (+) strand; PAM type: NRG; PAM sequence: AGG
gaagtactggagatgatgag

SEQ ID NO: 128686 - DNA, 20 bp, Artificial Sequence
  Description of Artificial Sequence: Synthetic oligonucleotide
  Target: ATXN1; (+) strand; PAM type: NRG; PAM sequence: CAG
ggagatgatgagaggaacat

SEQ ID NO: 128687 - DNA, 20 bp, Artificial Sequence
  Description of Artificial Sequence: Synthetic oligonucleotide
  Target: ATXN1; (+) strand; PAM type: NRG; PAM sequence: AGG
gagatgatgagaggaacatc

SEQ ID NO: 128688 - DNA, 20 bp, Artificial Sequence
  Description of Artificial Sequence: Synthetic oligonucleotide
  Target: ATXN1; (+) strand; PAM type: NRG; PAM sequence: GGG
agatgatgagaggaacatca

SEQ ID NO: 128689 - DNA, 20 bp, Artificial Sequence
  Description of Artificial Sequence: Synthetic oligonucleotide
  Target: ATXN1; (+) strand; PAM type: NRG; PAM sequence: TGG
tgagaggaacatcagggtat

SEQ ID NO: 128690 - DNA, 20 bp, Artificial Sequence
  Description of Artificial Sequence: Synthetic oligonucleotide
  Target: ATXN1; (+) strand; PAM type: NRG; PAM sequence: AAG
catcagggtattggaccatg

SEQ ID NO: 128691 - DNA, 20 bp, Artificial Sequence
  Description of Artificial Sequence: Synthetic oligonucleotide
  Target: ATXN1; (+) strand; PAM type: NRG; PAM sequence: GAG
tcagggtattggaccatgaa

SEQ ID NO: 128692 - DNA, 20 bp, Artificial Sequence
  Description of Artificial Sequence: Synthetic oligonucleotide
  Target: ATXN1; (+) strand; PAM type: NRG; PAM sequence: CAG
ggaccatgaagagaaaattc

SEQ ID NO: 128693 - DNA, 20 bp, Artificial Sequence
  Description of Artificial Sequence: Synthetic oligonucleotide
  Target: ATXN1; (+) strand; PAM type: NRG; PAM sequence: TGG
tgaagagaaaattccagtcc

SEQ ID NO: 128694 - DNA, 20 bp, Artificial Sequence
  Description of Artificial Sequence: Synthetic oligonucleotide
  Target: ATXN1; (+) strand; PAM type: NRG; PAM sequence: GGG
gaagagaaaattccagtcct

SEQ ID NO: 128695 - DNA, 20 bp, Artificial Sequence
  Description of Artificial Sequence: Synthetic oligonucleotide
  Target: ATXN1; (+) strand; PAM type: NRG; PAM sequence: GAG
agtcctgggtgtgccatcct

SEQ ID NO: 128696 - DNA, 20 bp, Artificial Sequence
  Description of Artificial Sequence: Synthetic oligonucleotide
  Target: ATXN1; (+) strand; PAM type: NRG; PAM sequence: AAG
ctgggtgtgccatcctgagc

SEQ ID NO: 128697 - DNA, 20 bp, Artificial Sequence
  Description of Artificial Sequence: Synthetic oligonucleotide
  Target: ATXN1; (+) strand; PAM type: NRG; PAM sequence: TAG
gtgccatcctgagcaagtca

SEQ ID NO: 128698 - DNA, 20 bp, Artificial Sequence
  Description of Artificial Sequence: Synthetic oligonucleotide
  Target: ATXN1; (+) strand; PAM type: NRG; PAM sequence: CAG
catagctctcctctgcacct

SEQ ID NO: 128699 - DNA, 20 bp, Artificial Sequence
  Description of Artificial Sequence: Synthetic oligonucleotide
  Target: ATXN1; (+) strand; PAM type: NRG; PAM sequence: CAG
ctgcacctcagtttcctaat

SEQ ID NO: 128700 - DNA, 20 bp, Artificial Sequence
  Description of Artificial Sequence: Synthetic oligonucleotide
  Target: ATXN1; (+) strand; PAM type: NRG; PAM sequence: AAG
agtttcctaatcagtaaaac

SEQ ID NO: 128701 - DNA, 20 bp, Artificial Sequence
  Description of Artificial Sequence: Synthetic oligonucleotide
  Target: ATXN1; (+) strand; PAM type: NRG; PAM sequence: AGG
gtttcctaatcagtaaaaca

SEQ ID NO: 128702 - DNA, 20 bp, Artificial Sequence
  Description of Artificial Sequence: Synthetic oligonucleotide
  Target: ATXN1; (+) strand; PAM type: NRG; PAM sequence: GGG
tttcctaatcagtaaaacaa

SEQ ID NO: 128703 - DNA, 20 bp, Artificial Sequence
  Description of Artificial Sequence: Synthetic oligonucleotide
  Target: ATXN1; (+) strand; PAM type: NRG; PAM sequence: GAG
tcctaatcagtaaaacaagg

SEQ ID NO: 128704 - DNA, 20 bp, Artificial Sequence
  Description of Artificial Sequence: Synthetic oligonucleotide
  Target: ATXN1; (+) strand; PAM type: NRG; PAM sequence: TGG
aatcagtaaaacaagggagt

SEQ ID NO: 128705 - DNA, 20 bp, Artificial Sequence
  Description of Artificial Sequence: Synthetic oligonucleotide
  Target: ATXN1; (+) strand; PAM type: NRG; PAM sequence: AAG
agggagttggtgaatttctc

SEQ ID NO: 128706 - DNA, 20 bp, Artificial Sequence
  Description of Artificial Sequence: Synthetic oligonucleotide
  Target: ATXN1; (+) strand; PAM type: NRG; PAM sequence: CAG
ctcaagtccctcgcatgctc

SEQ ID NO: 128707 - DNA, 20 bp, Artificial Sequence
  Description of Artificial Sequence: Synthetic oligonucleotide
  Target: ATXN1; (+) strand; PAM type: NRG; PAM sequence: AGG
tcaagtccctcgcatgctcc

SEQ ID NO: 128708 - DNA, 20 bp, Artificial Sequence
  Description of Artificial Sequence: Synthetic oligonucleotide
  Target: ATXN1; (+) strand; PAM type: NRG; PAM sequence: CAG
ctcctcgtctttctctttgc

SEQ ID NO: 128709 - DNA, 20 bp, Artificial Sequence
  Description of Artificial Sequence: Synthetic oligonucleotide
  Target: ATXN1; (+) strand; PAM type: NRG; PAM sequence: CAG
ctcgtctttctctttgccag

SEQ ID NO: 128710 - DNA, 20 bp, Artificial Sequence
  Description of Artificial Sequence: Synthetic oligonucleotide
  Target: ATXN1; (+) strand; PAM type: NRG; PAM sequence: AGG
tcgtctttctctttgccagc

SEQ ID NO: 128711 - DNA, 20 bp, Artificial Sequence
  Description of Artificial Sequence: Synthetic oligonucleotide
  Target: ATXN1; (+) strand; PAM type: NRG; PAM sequence: GGG
cgtctttctctttgccagca

SEQ ID NO: 128712 - DNA, 20 bp, Artificial Sequence
  Description of Artificial Sequence: Synthetic oligonucleotide
  Target: ATXN1; (+) strand; PAM type: NRG; PAM sequence: GAG
tctctttgccagcagggact

SEQ ID NO: 128713 - DNA, 20 bp, Artificial Sequence
  Description of Artificial Sequence: Synthetic oligonucleotide
  Target: ATXN1; (+) strand; PAM type: NRG; PAM sequence: AAG
cagggactgagtgtgtgacg

SEQ ID NO: 128714 - DNA, 20 bp, Artificial Sequence
  Description of Artificial Sequence: Synthetic oligonucleotide
  Target: ATXN1; (+) strand; PAM type: NRG; PAM sequence: AGG
agggactgagtgtgtgacga

SEQ ID NO: 128715 - DNA, 20 bp, Artificial Sequence
  Description of Artificial Sequence: Synthetic oligonucleotide
  Target: ATXN1; (+) strand; PAM type: NRG; PAM sequence: CAG
gaaggttgtgcctttgacct

SEQ ID NO: 128716 - DNA, 20 bp, Artificial Sequence
  Description of Artificial Sequence: Synthetic oligonucleotide
  Target: ATXN1; (+) strand; PAM type: NRG; PAM sequence: GAG
aggttgtgcctttgacctca

SEQ ID NO: 128717 - DNA, 20 bp, Artificial Sequence
  Description of Artificial Sequence: Synthetic oligonucleotide
  Target: ATXN1; (+) strand; PAM type: NRG; PAM sequence: AGG
ggttgtgcctttgacctcag

SEQ ID NO: 128718 - DNA, 20 bp, Artificial Sequence
  Description of Artificial Sequence: Synthetic oligonucleotide
  Target: ATXN1; (+) strand; PAM type: NRG; PAM sequence: CGG
acctcagaggaatgtgacaa

SEQ ID NO: 128719 - DNA, 20 bp, Artificial Sequence
  Description of Artificial Sequence: Synthetic oligonucleotide
  Target: ATXN1; (+) strand; PAM type: NRG; PAM sequence: CAG
ccttccttgcattgttccca

SEQ ID NO: 128720 - DNA, 20 bp, Artificial Sequence
  Description of Artificial Sequence: Synthetic oligonucleotide
  Target: ATXN1; (+) strand; PAM type: NRG; PAM sequence: CAG
tgcattgttcccacagtaac

SEQ ID NO: 128721 - DNA, 20 bp, Artificial Sequence
  Description of Artificial Sequence: Synthetic oligonucleotide
  Target: ATXN1; (+) strand; PAM type: NRG; PAM sequence: GAG
cattgttcccacagtaacca

SEQ ID NO: 128722 - DNA, 20 bp, Artificial Sequence
  Description of Artificial Sequence: Synthetic oligonucleotide
  Target: ATXN1; (+) strand; PAM type: NRG; PAM sequence: CAG
gttcccacagtaaccagagc

SEQ ID NO: 128723 - DNA, 20 bp, Artificial Sequence
  Description of Artificial Sequence: Synthetic oligonucleotide
  Target: ATXN1; (+) strand; PAM type: NRG; PAM sequence: CAG
agtaaccagagccagctgtc

SEQ ID NO: 128724 - DNA, 20 bp, Artificial Sequence
  Description of Artificial Sequence: Synthetic oligonucleotide
  Target: ATXN1; (+) strand; PAM type: NRG; PAM sequence: AGG
gtaaccagagccagctgtcc

SEQ ID NO: 128725 - DNA, 20 bp, Artificial Sequence
  Description of Artificial Sequence: Synthetic oligonucleotide
  Target: ATXN1; (+) strand; PAM type: NRG; PAM sequence: CGG
ccagagccagctgtccaggc

SEQ ID NO: 128726 - DNA, 20 bp, Artificial Sequence
  Description of Artificial Sequence: Synthetic oligonucleotide
  Target: ATXN1; (+) strand; PAM type: NRG; PAM sequence: TGG
agccagctgtccaggccggc

SEQ ID NO: 128727 - DNA, 20 bp, Artificial Sequence
  Description of Artificial Sequence: Synthetic oligonucleotide
  Target: ATXN1; (+) strand; PAM type: NRG; PAM sequence: AAG
gctgtccaggccggctggcc

SEQ ID NO: 128728 - DNA, 20 bp, Artificial Sequence
  Description of Artificial Sequence: Synthetic oligonucleotide
  Target: ATXN1; (+) strand; PAM type: NRG; PAM sequence: TGG
caggccggctggccaagttg

SEQ ID NO: 128729 - DNA, 20 bp, Artificial Sequence
  Description of Artificial Sequence: Synthetic oligonucleotide
  Target: ATXN1; (+) strand; PAM type: NRG; PAM sequence: CAG
cggctggccaagttgtggcg

SEQ ID NO: 128730 - DNA, 20 bp, Artificial Sequence
  Description of Artificial Sequence: Synthetic oligonucleotide
  Target: ATXN1; (+) strand; PAM type: NRG; PAM sequence: AGG
ggctggccaagttgtggcgc

SEQ ID NO: 128731 - DNA, 20 bp, Artificial Sequence
  Description of Artificial Sequence: Synthetic oligonucleotide
  Target: ATXN1; (+) strand; PAM type: NRG; PAM sequence: AAG
tgtggcgcaggatcacacac

SEQ ID NO: 128732 - DNA, 20 bp, Artificial Sequence
  Description of Artificial Sequence: Synthetic oligonucleotide
  Target: ATXN1; (+) strand; PAM type: NRG; PAM sequence: TGG
gcgcaggatcacacacaagt

SEQ ID NO: 128733 - DNA, 20 bp, Artificial Sequence
  Description of Artificial Sequence: Synthetic oligonucleotide
  Target: ATXN1; (+) strand; PAM type: NRG; PAM sequence: GGG
cgcaggatcacacacaagtt

SEQ ID NO: 128734 - DNA, 20 bp, Artificial Sequence
  Description of Artificial Sequence: Synthetic oligonucleotide
  Target: ATXN1; (+) strand; PAM type: NRG; PAM sequence: GGG
gcaggatcacacacaagttg

SEQ ID NO: 128735 - DNA, 20 bp, Artificial Sequence
  Description of Artificial Sequence: Synthetic oligonucleotide
  Target: ATXN1; (+) strand; PAM type: NRG; PAM sequence: TGG
acacaagttggggctctgct

SEQ ID NO: 128736 - DNA, 20 bp, Artificial Sequence
  Description of Artificial Sequence: Synthetic oligonucleotide
  Target: ATXN1; (+) strand; PAM type: NRG; PAM sequence: GGG
cacaagttggggctctgctt

SEQ ID NO: 128737 - DNA, 20 bp, Artificial Sequence
  Description of Artificial Sequence: Synthetic oligonucleotide
  Target: ATXN1; (+) strand; PAM type: NRG; PAM sequence: GGG
acaagttggggctctgcttg

SEQ ID NO: 128738 - DNA, 20 bp, Artificial Sequence
  Description of Artificial Sequence: Synthetic oligonucleotide
  Target: ATXN1; (+) strand; PAM type: NRG; PAM sequence: GGG
caagttggggctctgcttgg

SEQ ID NO: 128739 - DNA, 20 bp, Artificial Sequence
  Description of Artificial Sequence: Synthetic oligonucleotide
  Target: ATXN1; (+) strand; PAM type: NRG; PAM sequence: AAG
tgcttgggggactccgcctc

SEQ ID NO: 128740 - DNA, 20 bp, Artificial Sequence
  Description of Artificial Sequence: Synthetic oligonucleotide
  Target: ATXN1; (+) strand; PAM type: NRG; PAM sequence: AGG
gcttgggggactccgcctca

SEQ ID NO: 128741 - DNA, 20 bp, Artificial Sequence
  Description of Artificial Sequence: Synthetic oligonucleotide
  Target: ATXN1; (+) strand; PAM type: NRG; PAM sequence: TAG
tcaaggcctcccccttcctc

SEQ ID NO: 128742 - DNA, 20 bp, Artificial Sequence
  Description of Artificial Sequence: Synthetic oligonucleotide
  Target: ATXN1; (+) strand; PAM type: NRG; PAM sequence: AGG
caaggcctcccccttcctct

SEQ ID NO: 128743 - DNA, 20 bp, Artificial Sequence
  Description of Artificial Sequence: Synthetic oligonucleotide
  Target: ATXN1; (+) strand; PAM type: NRG; PAM sequence: CAG
ttcctctaggtctttatccg

SEQ ID NO: 128744 - DNA, 20 bp, Artificial Sequence
  Description of Artificial Sequence: Synthetic oligonucleotide
  Target: ATXN1; (+) strand; PAM type: NRG; PAM sequence: AGG
tcctctaggtctttatccgc

SEQ ID NO: 128745 - DNA, 20 bp, Artificial Sequence
  Description of Artificial Sequence: Synthetic oligonucleotide
  Target: ATXN1; (+) strand; PAM type: NRG; PAM sequence: CGG
ctaggtctttatccgcaggt

SEQ ID NO: 128746 - DNA, 20 bp, Artificial Sequence
  Description of Artificial Sequence: Synthetic oligonucleotide
  Target: ATXN1; (+) strand; PAM type: NRG; PAM sequence: GGG
taggtctttatccgcaggtc

SEQ ID NO: 128747 - DNA, 20 bp, Artificial Sequence
  Description of Artificial Sequence: Synthetic oligonucleotide
  Target: ATXN1; (+) strand; PAM type: NRG; PAM sequence: AAG
ccgcaggtcgggaccctcct

SEQ ID NO: 128748 - DNA, 20 bp, Artificial Sequence
  Description of Artificial Sequence: Synthetic oligonucleotide
  Target: ATXN1; (+) strand; PAM type: NRG; PAM sequence: AAG
cgggaccctcctaagaacac

SEQ ID NO: 128749 - DNA, 20 bp, Artificial Sequence
  Description of Artificial Sequence: Synthetic oligonucleotide
  Target: ATXN1; (+) strand; PAM type: NRG; PAM sequence: GAG
cctcctaagaacacaagaat

SEQ ID NO: 128750 - DNA, 20 bp, Artificial Sequence
  Description of Artificial Sequence: Synthetic oligonucleotide
  Target: ATXN1; (+) strand; PAM type: NRG; PAM sequence: TGG
aatccttcctaaataacttt

SEQ ID NO: 128751 - DNA, 20 bp, Artificial Sequence
  Description of Artificial Sequence: Synthetic oligonucleotide
  Target: ATXN1; (+) strand; PAM type: NRG; PAM sequence: GGG
atccttcctaaataactttt

SEQ ID NO: 128752 - DNA, 20 bp, Artificial Sequence
  Description of Artificial Sequence: Synthetic oligonucleotide
  Target: ATXN1; (+) strand; PAM type: NRG; PAM sequence: GGG
tccttcctaaataacttttg

SEQ ID NO: 128753 - DNA, 20 bp, Artificial Sequence
  Description of Artificial Sequence: Synthetic oligonucleotide
  Target: ATXN1; (+) strand; PAM type: NRG; PAM sequence: GGG
ccttcctaaataacttttgg

SEQ ID NO: 128754 - DNA, 20 bp, Artificial Sequence
  Description of Artificial Sequence: Synthetic oligonucleotide
  Target: ATXN1; (+) strand; PAM type: NRG; PAM sequence: TGG
cttttgggggcttaaaatcc

SEQ ID NO: 128755 - DNA, 20 bp, Artificial Sequence
  Description of Artificial Sequence: Synthetic oligonucleotide
  Target: ATXN1; (+) strand; PAM type: NRG; PAM sequence: GGG
ttttgggggcttaaaatcct

SEQ ID NO: 128756 - DNA, 20 bp, Artificial Sequence
  Description of Artificial Sequence: Synthetic oligonucleotide
  Target: ATXN1; (+) strand; PAM type: NRG; PAM sequence: TAG
ggggcttaaaatcctgggtg

SEQ ID NO: 128757 - DNA, 20 bp, Artificial Sequence
  Description of Artificial Sequence: Synthetic oligonucleotide
  Target: ATXN1; (+) strand; PAM type: NRG; PAM sequence: CAG
tgtgaaactccccctaatga

SEQ ID NO: 128758 - DNA, 20 bp, Artificial Sequence
  Description of Artificial Sequence: Synthetic oligonucleotide
  Target: ATXN1; (+) strand; PAM type: NRG; PAM sequence: TAG
aaactccccctaatgacagc

SEQ ID NO: 128759 - DNA, 20 bp, Artificial Sequence
  Description of Artificial Sequence: Synthetic oligonucleotide
  Target: ATXN1; (+) strand; PAM type: NRG; PAM sequence: GAG
actccccctaatgacagcta

SEQ ID NO: 128760 - DNA, 20 bp, Artificial Sequence
  Description of Artificial Sequence: Synthetic oligonucleotide
  Target: ATXN1; (+) strand; PAM type: NRG; PAM sequence: AGG
ctccccctaatgacagctag

SEQ ID NO: 128761 - DNA, 20 bp, Artificial Sequence
  Description of Artificial Sequence: Synthetic oligonucleotide
  Target: ATXN1; (+) strand; PAM type: NRG; PAM sequence: TGG
ctaatgacagctagaggatt

SEQ ID NO: 128762 - DNA, 20 bp, Artificial Sequence
  Description of Artificial Sequence: Synthetic oligonucleotide
  Target: ATXN1; (+) strand; PAM type: NRG; PAM sequence: GGG
taatgacagctagaggattt

SEQ ID NO: 128763 - DNA, 20 bp, Artificial Sequence
  Description of Artificial Sequence: Synthetic oligonucleotide
  Target: ATXN1; (+) strand; PAM type: NRG; PAM sequence: GAG
gggtgtgtattcaattctct

SEQ ID NO: 128764 - DNA, 20 bp, Artificial Sequence
  Description of Artificial Sequence: Synthetic oligonucleotide
  Target: ATXN1; (+) strand; PAM type: NRG; PAM sequence: TGG
tgagtctatgaccctacatc

SEQ ID NO: 128765 - DNA, 20 bp, Artificial Sequence
  Description of Artificial Sequence: Synthetic oligonucleotide
  Target: ATXN1; (+) strand; PAM type: NRG; PAM sequence: GGG
gagtctatgaccctacatct

SEQ ID NO: 128766 - DNA, 20 bp, Artificial Sequence
  Description of Artificial Sequence: Synthetic oligonucleotide
  Target: ATXN1; (+) strand; PAM type: NRG; PAM sequence: TGG
accctacatctgggatgctg

SEQ ID NO: 128767 - DNA, 20 bp, Artificial Sequence
  Description of Artificial Sequence: Synthetic oligonucleotide
  Target: ATXN1; (+) strand; PAM type: NRG; PAM sequence: GGG
ccctacatctgggatgctgt

SEQ ID NO: 128768 - DNA, 20 bp, Artificial Sequence
  Description of Artificial Sequence: Synthetic oligonucleotide
  Target: ATXN1; (+) strand; PAM type: NRG; PAM sequence: GGG
cctacatctgggatgctgtg

SEQ ID NO: 128769 - DNA, 20 bp, Artificial Sequence
  Description of Artificial Sequence: Synthetic oligonucleotide
  Target: ATXN1; (+) strand; PAM type: NRG; PAM sequence: TAG
tgtggggtgcttgcaaccta

SEQ ID NO: 128770 - DNA, 20 bp, Artificial Sequence
  Description of Artificial Sequence: Synthetic oligonucleotide
  Target: ATXN1; (+) strand; PAM type: NRG; PAM sequence: CAG
gggtgcttgcaacctataga

SEQ ID NO: 128771 - DNA, 20 bp, Artificial Sequence
  Description of Artificial Sequence: Synthetic oligonucleotide
  Target: ATXN1; (+) strand; PAM type: NRG; PAM sequence: CAG
tgcttgcaacctatagacag

SEQ ID NO: 128772 - DNA, 20 bp, Artificial Sequence
  Description of Artificial Sequence: Synthetic oligonucleotide
  Target: ATXN1; (+) strand; PAM type: NRG; PAM sequence: AGG
gcttgcaacctatagacagc

SEQ ID NO: 128773 - DNA, 20 bp, Artificial Sequence
  Description of Artificial Sequence: Synthetic oligonucleotide
  Target: ATXN1; (+) strand; PAM type: NRG; PAM sequence: CAG
tatagacagcaggtgttttc

SEQ ID NO: 128774 - DNA, 20 bp, Artificial Sequence
  Description of Artificial Sequence: Synthetic oligonucleotide
  Target: ATXN1; (+) strand; PAM type: NRG; PAM sequence: AGG
atagacagcaggtgttttcc

SEQ ID NO: 128775 - DNA, 20 bp, Artificial Sequence
  Description of Artificial Sequence: Synthetic oligonucleotide
  Target: ATXN1; (+) strand; PAM type: NRG; PAM sequence: TGG
caggtgttttccaggcgcgt

SEQ ID NO: 128776 - DNA, 20 bp, Artificial Sequence
  Description of Artificial Sequence: Synthetic oligonucleotide
  Target: ATXN1; (+) strand; PAM type: NRG; PAM sequence: TGG
ccaggcgcgttggcgtgtta

SEQ ID NO: 128777 - DNA, 20 bp, Artificial Sequence
  Description of Artificial Sequence: Synthetic oligonucleotide
  Target: ATXN1; (+) strand; PAM type: NRG; PAM sequence: TGG
gcgttggcgtgttatggcac

SEQ ID NO: 128778 - DNA, 20 bp, Artificial Sequence
  Description of Artificial Sequence: Synthetic oligonucleotide
  Target: ATXN1; (+) strand; PAM type: NRG; PAM sequence: GGG
cgttggcgtgttatggcact

SEQ ID NO: 128779 - DNA, 20 bp, Artificial Sequence
  Description of Artificial Sequence: Synthetic oligonucleotide
  Target: ATXN1; (+) strand; PAM type: NRG; PAM sequence: AAG
gtgttatggcactgggattc

SEQ ID NO: 128780 - DNA, 20 bp, Artificial Sequence
  Description of Artificial Sequence: Synthetic oligonucleotide
  Target: ATXN1; (+) strand; PAM type: NRG; PAM sequence: GAG
tatggcactgggattcaagt

SEQ ID NO: 128781 - DNA, 20 bp, Artificial Sequence
  Description of Artificial Sequence: Synthetic oligonucleotide
  Target: ATXN1; (+) strand; PAM type: NRG; PAM sequence: AGG
atggcactgggattcaagtg

SEQ ID NO: 128782 - DNA, 20 bp, Artificial Sequence
  Description of Artificial Sequence: Synthetic oligonucleotide
  Target: ATXN1; (+) strand; PAM type: NRG; PAM sequence: AAG
tcaagtgaggatgaacatct

SEQ ID NO: 128783 - DNA, 20 bp, Artificial Sequence
  Description of Artificial Sequence: Synthetic oligonucleotide
  Target: ATXN1; (+) strand; PAM type: NRG; PAM sequence: GAG
tgaggatgaacatctaagat

SEQ ID NO: 128784 - DNA, 20 bp, Artificial Sequence
  Description of Artificial Sequence: Synthetic oligonucleotide
  Target: ATXN1; (+) strand; PAM type: NRG; PAM sequence: GAG
aggatgaacatctaagatga

SEQ ID NO: 128785 - DNA, 20 bp, Artificial Sequence
  Description of Artificial Sequence: Synthetic oligonucleotide
  Target: ATXN1; (+) strand; PAM type: NRG; PAM sequence: TGG
tgaacatctaagatgagagc

SEQ ID NO: 128786 - DNA, 20 bp, Artificial Sequence
  Description of Artificial Sequence: Synthetic oligonucleotide
  Target: ATXN1; (+) strand; PAM type: NRG; PAM sequence: GAG
aacatctaagatgagagctg

SEQ ID NO: 128787 - DNA, 20 bp, Artificial Sequence
  Description of Artificial Sequence: Synthetic oligonucleotide
  Target: ATXN1; (+) strand; PAM type: NRG; PAM sequence: GAG
tctaagatgagagctggagt

SEQ ID NO: 128788 - DNA, 20 bp, Artificial Sequence
  Description of Artificial Sequence: Synthetic oligonucleotide
  Target: ATXN1; (+) strand; PAM type: NRG; PAM sequence: CAG
agccacgatttgtaaccatg

SEQ ID NO: 128789 - DNA, 20 bp, Artificial Sequence
  Description of Artificial Sequence: Synthetic oligonucleotide
  Target: ATXN1; (+) strand; PAM type: NRG; PAM sequence: GAG
atttgtaaccatgcagatgt

SEQ ID NO: 128790 - DNA, 20 bp, Artificial Sequence
  Description of Artificial Sequence: Synthetic oligonucleotide
  Target: ATXN1; (+) strand; PAM type: NRG; PAM sequence: CAG
tgtaaccatgcagatgtgag

SEQ ID NO: 128791 - DNA, 20 bp, Artificial Sequence
  Description of Artificial Sequence: Synthetic oligonucleotide
  Target: ATXN1; (+) strand; PAM type: NRG; PAM sequence: CAG
aaccatgcagatgtgagcag

SEQ ID NO: 128792 - DNA, 20 bp, Artificial Sequence
  Description of Artificial Sequence: Synthetic oligonucleotide
  Target: ATXN1; (+) strand; PAM type: NRG; PAM sequence: CAG
tgtgagcagcagcgaccatg

SEQ ID NO: 128793 - DNA, 20 bp, Artificial Sequence
  Description of Artificial Sequence: Synthetic oligonucleotide
  Target: ATXN1; (+) strand; PAM type: NRG; PAM sequence: AGG
gtgagcagcagcgaccatgc

SEQ ID NO: 128794 - DNA, 20 bp, Artificial Sequence
  Description of Artificial Sequence: Synthetic oligonucleotide
  Target: ATXN1; (+) strand; PAM type: NRG; PAM sequence: CAG
caggctttcctccttgcctg

SEQ ID NO: 128795 - DNA, 20 bp, Artificial Sequence
  Description of Artificial Sequence: Synthetic oligonucleotide
  Target: ATXN1; (+) strand; PAM type: NRG; PAM sequence: GAG
cttgcctgcagcttgcatct

SEQ ID NO: 128796 - DNA, 20 bp, Artificial Sequence
  Description of Artificial Sequence: Synthetic oligonucleotide
  Target: ATXN1; (+) strand; PAM type: NRG; PAM sequence: AAG
cttgcatctgagatcctaat

SEQ ID NO: 128797 - DNA, 20 bp, Artificial Sequence
  Description of Artificial Sequence: Synthetic oligonucleotide
  Target: ATXN1; (+) strand; PAM type: NRG; PAM sequence: AGG
ttgcatctgagatcctaata

SEQ ID NO: 128798 - DNA, 20 bp, Artificial Sequence
  Description of Artificial Sequence: Synthetic oligonucleotide
  Target: ATXN1; (+) strand; PAM type: NRG; PAM sequence: GGG
tgcatctgagatcctaataa

SEQ ID NO: 128799 - DNA, 20 bp, Artificial Sequence
  Description of Artificial Sequence: Synthetic oligonucleotide
  Target: ATXN1; (+) strand; PAM type: NRG; PAM sequence: GAG
catctgagatcctaataagg

SEQ ID NO: 128800 - DNA, 20 bp, Artificial Sequence
  Description of Artificial Sequence: Synthetic oligonucleotide
  Target: ATXN1; (+) strand; PAM type: NRG; PAM sequence: AGG
atctgagatcctaataaggg

SEQ ID NO: 128801 - DNA, 20 bp, Artificial Sequence
  Description of Artificial Sequence: Synthetic oligonucleotide
  Target: ATXN1; (+) strand; PAM type: NRG; PAM sequence: TGG
tcctaataagggaggatcac

SEQ ID NO: 128802 - DNA, 20 bp, Artificial Sequence
  Description of Artificial Sequence: Synthetic oligonucleotide
  Target: ATXN1; (+) strand; PAM type: NRG; PAM sequence: AAG
aataagggaggatcactgga

SEQ ID NO: 128803 - DNA, 20 bp, Artificial Sequence
  Description of Artificial Sequence: Synthetic oligonucleotide
  Target: ATXN1; (+) strand; PAM type: NRG; PAM sequence: TAG
gaaagtattaccattatttt

SEQ ID NO: 128804 - DNA, 20 bp, Artificial Sequence
  Description of Artificial Sequence: Synthetic oligonucleotide
  Target: ATXN1; (+) strand; PAM type: NRG; PAM sequence: AAG
ccattatttttagcttttct

SEQ ID NO: 128805 - DNA, 20 bp, Artificial Sequence
  Description of Artificial Sequence: Synthetic oligonucleotide
  Target: ATXN1; (+) strand; PAM type: NRG; PAM sequence: AGG
cattatttttagcttttcta

SEQ ID NO: 128806 - DNA, 20 bp, Artificial Sequence
  Description of Artificial Sequence: Synthetic oligonucleotide
  Target: ATXN1; (+) strand; PAM type: NRG; PAM sequence: GGG
attatttttagcttttctaa

SEQ ID NO: 128807 - DNA, 20 bp, Artificial Sequence
  Description of Artificial Sequence: Synthetic oligonucleotide
  Target: ATXN1; (+) strand; PAM type: NRG; PAM sequence: GAG
tatttttagcttttctaagg

SEQ ID NO: 128808 - DNA, 20 bp, Artificial Sequence
  Description of Artificial Sequence: Synthetic oligonucleotide
  Target: ATXN1; (+) strand; PAM type: NRG; PAM sequence: AGG
atttttagcttttctaaggg

SEQ ID NO: 128809 - DNA, 20 bp, Artificial Sequence
  Description of Artificial Sequence: Synthetic oligonucleotide
  Target: ATXN1; (+) strand; PAM type: NRG; PAM sequence: GGG
tttttagcttttctaaggga

SEQ ID NO: 128810 - DNA, 20 bp, Artificial Sequence
  Description of Artificial Sequence: Synthetic oligonucleotide
  Target: ATXN1; (+) strand; PAM type: NRG; PAM sequence: GAG
tttagcttttctaagggagg

SEQ ID NO: 128811 - DNA, 20 bp, Artificial Sequence
  Description of Artificial Sequence: Synthetic oligonucleotide
  Target: ATXN1; (+) strand; PAM type: NRG; PAM sequence: AGG
ttagcttttctaagggaggg

SEQ ID NO: 128812 - DNA, 20 bp, Artificial Sequence
  Description of Artificial Sequence: Synthetic oligonucleotide
  Target: ATXN1; (+) strand; PAM type: NRG; PAM sequence: GAG
agcttttctaagggagggag

SEQ ID NO: 128813 - DNA, 20 bp, Artificial Sequence
  Description of Artificial Sequence: Synthetic oligonucleotide
  Target: ATXN1; (+) strand; PAM type: NRG; PAM sequence: AAG
agggagggaggagttttcga

SEQ ID NO: 128814 - DNA, 20 bp, Artificial Sequence
  Description of Artificial Sequence: Synthetic oligonucleotide
  Target: ATXN1; (+) strand; PAM type: NRG; PAM sequence: AGG
gggagggaggagttttcgaa

SEQ ID NO: 128815 - DNA, 20 bp, Artificial Sequence
  Description of Artificial Sequence: Synthetic oligonucleotide
  Target: ATXN1; (+) strand; PAM type: NRG; PAM sequence: TGG
gagttttcgaaaggacaaaa

SEQ ID NO: 128816 - DNA, 20 bp, Artificial Sequence
  Description of Artificial Sequence: Synthetic oligonucleotide
  Target: ATXN1; (+) strand; PAM type: NRG; PAM sequence: AAG
tttcgaaaggacaaaatgga

SEQ ID NO: 128817 - DNA, 20 bp, Artificial Sequence
  Description of Artificial Sequence: Synthetic oligonucleotide
  Target: ATXN1; (+) strand; PAM type: NRG; PAM sequence: AGG
ttcgaaaggacaaaatggaa

SEQ ID NO: 128818 - DNA, 20 bp, Artificial Sequence
  Description of Artificial Sequence: Synthetic oligonucleotide
  Target: ATXN1; (+) strand; PAM type: NRG; PAM sequence: TAG
ggacaaaatggaaaggaatt

SEQ ID NO: 128819 - DNA, 20 bp, Artificial Sequence
  Description of Artificial Sequence: Synthetic oligonucleotide
  Target: ATXN1; (+) strand; PAM type: NRG; PAM sequence: AGG
gacaaaatggaaaggaattt

SEQ ID NO: 128820 - DNA, 20 bp, Artificial Sequence
  Description of Artificial Sequence: Synthetic oligonucleotide
  Target: ATXN1; (+) strand; PAM type: NRG; PAM sequence: GGG
acaaaatggaaaggaattta

SEQ ID NO: 128821 - DNA, 20 bp, Artificial Sequence
  Description of Artificial Sequence: Synthetic oligonucleotide
  Target: ATXN1; (+) strand; PAM type: NRG; PAM sequence: AAG
aatggaaaggaatttagggc

SEQ ID NO: 128822 - DNA, 20 bp, Artificial Sequence
  Description of Artificial Sequence: Synthetic oligonucleotide
  Target: ATXN1; (+) strand; PAM type: NRG; PAM sequence: AGG
atggaaaggaatttagggca

SEQ ID NO: 128823 - DNA, 20 bp, Artificial Sequence
  Description of Artificial Sequence: Synthetic oligonucleotide
  Target: ATXN1; (+) strand; PAM type: NRG; PAM sequence: GGG
tggaaaggaatttagggcaa

SEQ ID NO: 128824 - DNA, 20 bp, Artificial Sequence
  Description of Artificial Sequence: Synthetic oligonucleotide
  Target: ATXN1; (+) strand; PAM type: NRG; PAM sequence: TAG
atttagggcaagggtgtgtg

SEQ ID NO: 128825 - DNA, 20 bp, Artificial Sequence
  Description of Artificial Sequence: Synthetic oligonucleotide
  Target: ATXN1; (+) strand; PAM type: NRG; PAM sequence: AGG
tttagggcaagggtgtgtgt

SEQ ID NO: 128826 - DNA, 20 bp, Artificial Sequence
  Description of Artificial Sequence: Synthetic oligonucleotide
  Target: ATXN1; (+) strand; PAM type: NRG; PAM sequence: TGG
agggcaagggtgtgtgtagg

SEQ ID NO: 128827 - DNA, 20 bp, Artificial Sequence
  Description of Artificial Sequence: Synthetic oligonucleotide
  Target: ATXN1; (+) strand; PAM type: NRG; PAM sequence: GGG
gggcaagggtgtgtgtaggt

SEQ ID NO: 128828 - DNA, 20 bp, Artificial Sequence
  Description of Artificial Sequence: Synthetic oligonucleotide
  Target: ATXN1; (+) strand; PAM type: NRG; PAM sequence: GGG
ggcaagggtgtgtgtaggtg

SEQ ID NO: 128829 - DNA, 20 bp, Artificial Sequence
  Description of Artificial Sequence: Synthetic oligonucleotide
  Target: ATXN1; (+) strand; PAM type: NRG; PAM sequence: GAG
caagggtgtgtgtaggtggg

SEQ ID NO: 128830 - DNA, 20 bp, Artificial Sequence
  Description of Artificial Sequence: Synthetic oligonucleotide
  Target: ATXN1; (+) strand; PAM type: NRG; PAM sequence: AGG
aagggtgtgtgtaggtgggg

SEQ ID NO: 128831 - DNA, 20 bp, Artificial Sequence
  Description of Artificial Sequence: Synthetic oligonucleotide
  Target: ATXN1; (+) strand; PAM type: NRG; PAM sequence: TGG
ggtgtgtgtaggtggggagg

SEQ ID NO: 128832 - DNA, 20 bp, Artificial Sequence
  Description of Artificial Sequence: Synthetic oligonucleotide
  Target: ATXN1; (+) strand; PAM type: NRG; PAM sequence: TGG
gtgtaggtggggaggtggtg

SEQ ID NO: 128833 - DNA, 20 bp, Artificial Sequence
  Description of Artificial Sequence: Synthetic oligonucleotide
  Target: ATXN1; (+) strand; PAM type: NRG; PAM sequence: AAG
taggtggggaggtggtgtgg

SEQ ID NO: 128834 - DNA, 20 bp, Artificial Sequence
  Description of Artificial Sequence: Synthetic oligonucleotide
  Target: ATXN1; (+) strand; PAM type: NRG; PAM sequence: AGG
aggtggggaggtggtgtgga

SEQ ID NO: 128835 - DNA, 20 bp, Artificial Sequence
  Description of Artificial Sequence: Synthetic oligonucleotide
  Target: ATXN1; (+) strand; PAM type: NRG; PAM sequence: GAG
gtggggaggtggtgtggaag

SEQ ID NO: 128836 - DNA, 20 bp, Artificial Sequence
  Description of Artificial Sequence: Synthetic oligonucleotide
  Target: ATXN1; (+) strand; PAM type: NRG; PAM sequence: AGG
tggggaggtggtgtggaagg

SEQ ID NO: 128837 - DNA, 20 bp, Artificial Sequence
  Description of Artificial Sequence: Synthetic oligonucleotide
  Target: ATXN1; (+) strand; PAM type: NRG; PAM sequence: GAG
gaggtggtgtggaaggaggc

SEQ ID NO: 128838 - DNA, 20 bp, Artificial Sequence
  Description of Artificial Sequence: Synthetic oligonucleotide
  Target: ATXN1; (+) strand; PAM type: NRG; PAM sequence: AAG
gtggtgtggaaggaggcgag

SEQ ID NO: 128839 - DNA, 20 bp, Artificial Sequence
  Description of Artificial Sequence: Synthetic oligonucleotide
  Target: ATXN1; (+) strand; PAM type: NRG; PAM sequence: GAG
gtggaaggaggcgagaagat

SEQ ID NO: 128840 - DNA, 20 bp, Artificial Sequence
  Description of Artificial Sequence: Synthetic oligonucleotide
  Target: ATXN1; (+) strand; PAM type: NRG; PAM sequence: TAG
gaaggaggcgagaagatgag

SEQ ID NO: 128841 - DNA, 20 bp, Artificial Sequence
  Description of Artificial Sequence: Synthetic oligonucleotide
  Target: ATXN1; (+) strand; PAM type: NRG; PAM sequence: AAG
gcgagaagatgagtagaaat

SEQ ID NO: 128842 - DNA, 20 bp, Artificial Sequence
  Description of Artificial Sequence: Synthetic oligonucleotide
  Target: ATXN1; (+) strand; PAM type: NRG; PAM sequence: CAG
atgagtagaaataagacttt

SEQ ID NO: 128843 - DNA, 20 bp, Artificial Sequence
  Description of Artificial Sequence: Synthetic oligonucleotide
  Target: ATXN1; (+) strand; PAM type: NRG; PAM sequence: AGG
tgagtagaaataagactttc

SEQ ID NO: 128844 - DNA, 20 bp, Artificial Sequence
  Description of Artificial Sequence: Synthetic oligonucleotide
  Target: ATXN1; (+) strand; PAM type: NRG; PAM sequence: CAG
tagaaataagactttcagga

SEQ ID NO: 128845 - DNA, 20 bp, Artificial Sequence
  Description of Artificial Sequence: Synthetic oligonucleotide
  Target: ATXN1; (+) strand; PAM type: NRG; PAM sequence: AAG
ataagactttcaggacagat

SEQ ID NO: 128846 - DNA, 20 bp, Artificial Sequence
  Description of Artificial Sequence: Synthetic oligonucleotide
  Target: ATXN1; (+) strand; PAM type: NRG; PAM sequence: CAG
agactttcaggacagataag

SEQ ID NO: 128847 - DNA, 20 bp, Artificial Sequence
  Description of Artificial Sequence: Synthetic oligonucleotide
  Target: ATXN1; (+) strand; PAM type: NRG; PAM sequence: TAG
gcttccttctccttccttaa

SEQ ID NO: 128848 - DNA, 20 bp, Artificial Sequence
  Description of Artificial Sequence: Synthetic oligonucleotide
  Target: ATXN1; (+) strand; PAM type: NRG; PAM sequence: CAG
ccttccttaatagatgatca

SEQ ID NO: 128849 - DNA, 20 bp, Artificial Sequence
  Description of Artificial Sequence: Synthetic oligonucleotide
  Target: ATXN1; (+) strand; PAM type: NRG; PAM sequence: CAG
ccttaatagatgatcacagc

SEQ ID NO: 128850 - DNA, 20 bp, Artificial Sequence
  Description of Artificial Sequence: Synthetic oligonucleotide
  Target: ATXN1; (+) strand; PAM type: NRG; PAM sequence: AGG
cttaatagatgatcacagcc

SEQ ID NO: 128851 - DNA, 20 bp, Artificial Sequence
  Description of Artificial Sequence: Synthetic oligonucleotide
  Target: ATXN1; (+) strand; PAM type: NRG; PAM sequence: CAG
gatgatcacagccaggcttc

SEQ ID NO: 128852 - DNA, 20 bp, Artificial Sequence
  Description of Artificial Sequence: Synthetic oligonucleotide
  Target: ATXN1; (+) strand; PAM type: NRG; PAM sequence: AGG
atgatcacagccaggcttcc

SEQ ID NO: 128853 - DNA, 20 bp, Artificial Sequence
  Description of Artificial Sequence: Synthetic oligonucleotide
  Target: ATXN1; (+) strand; PAM type: NRG; PAM sequence: GGG
tgatcacagccaggcttcca

SEQ ID NO: 128854 - DNA, 20 bp, Artificial Sequence
  Description of Artificial Sequence: Synthetic oligonucleotide
  Target: ATXN1; (+) strand; PAM type: NRG; PAM sequence: AAG
cagggttataaaacaacacc

SEQ ID NO: 128855 - DNA, 20 bp, Artificial Sequence
  Description of Artificial Sequence: Synthetic oligonucleotide
  Target: ATXN1; (+) strand; PAM type: NRG; PAM sequence: AGG
agggttataaaacaacacca

SEQ ID NO: 128856 - DNA, 20 bp, Artificial Sequence
  Description of Artificial Sequence: Synthetic oligonucleotide
  Target: ATXN1; (+) strand; PAM type: NRG; PAM sequence: CAG
taaaacaacaccaaggtctt

SEQ ID NO: 128857 - DNA, 20 bp, Artificial Sequence
  Description of Artificial Sequence: Synthetic oligonucleotide
  Target: ATXN1; (+) strand; PAM type: NRG; PAM sequence: AGG
aaaacaacaccaaggtcttc

SEQ ID NO: 128858 - DNA, 20 bp, Artificial Sequence
  Description of Artificial Sequence: Synthetic oligonucleotide
  Target: ATXN1; (+) strand; PAM type: NRG; PAM sequence: CAG
aacaccaaggtcttcaggtc

SEQ ID NO: 128859 - DNA, 20 bp, Artificial Sequence
  Description of Artificial Sequence: Synthetic oligonucleotide
  Target: ATXN1; (+) strand; PAM type: NRG; PAM sequence: AGG
acaccaaggtcttcaggtcc

SEQ ID NO: 128860 - DNA, 20 bp, Artificial Sequence
  Description of Artificial Sequence: Synthetic oligonucleotide
  Target: ATXN1; (+) strand; PAM type: NRG; PAM sequence: TAG
ggtcttcaggtccaggtatg

SEQ ID NO: 128861 - DNA, 20 bp, Artificial Sequence
  Description of Artificial Sequence: Synthetic oligonucleotide
  Target: ATXN1; (+) strand; PAM type: NRG; PAM sequence: GAG
tcttcaggtccaggtatgta

SEQ ID NO: 128862 - DNA, 20 bp, Artificial Sequence
  Description of Artificial Sequence: Synthetic oligonucleotide
  Target: ATXN1; (+) strand; PAM type: NRG; PAM sequence: AAG
ggtccaggtatgtagagaca

SEQ ID NO: 128863 - DNA, 20 bp, Artificial Sequence
  Description of Artificial Sequence: Synthetic oligonucleotide
  Target: ATXN1; (+) strand; PAM type: NRG; PAM sequence: AGG
gtccaggtatgtagagacaa

SEQ ID NO: 128864 - DNA, 20 bp, Artificial Sequence
  Description of Artificial Sequence: Synthetic oligonucleotide
  Target: ATXN1; (+) strand; PAM type: NRG; PAM sequence: GAG
ccaggtatgtagagacaaag

SEQ ID NO: 128865 - DNA, 20 bp, Artificial Sequence
  Description of Artificial Sequence: Synthetic oligonucleotide
  Target: ATXN1; (+) strand; PAM type: NRG; PAM sequence: AAG
agagacaaaggagtcttcgc

SEQ ID NO: 128866 - DNA, 20 bp, Artificial Sequence
  Description of Artificial Sequence: Synthetic oligonucleotide
  Target: ATXN1; (+) strand; PAM type: NRG; PAM sequence: AGG
gagacaaaggagtcttcgca

SEQ ID NO: 128867 - DNA, 20 bp, Artificial Sequence
  Description of Artificial Sequence: Synthetic oligonucleotide
  Target: ATXN1; (+) strand; PAM type: NRG; PAM sequence: AAG
cgcaaggaaaccatttttct

SEQ ID NO: 128868 - DNA, 20 bp, Artificial Sequence
  Description of Artificial Sequence: Synthetic oligonucleotide
  Target: ATXN1; (+) strand; PAM type: NRG; PAM sequence: GAG
caaggaaaccatttttctaa

SEQ ID NO: 128869 - DNA, 20 bp, Artificial Sequence
  Description of Artificial Sequence: Synthetic oligonucleotide
  Target: ATXN1; (+) strand; PAM type: NRG; PAM sequence: TGG
aaaccatttttctaagagca

SEQ ID NO: 128870 - DNA, 20 bp, Artificial Sequence
  Description of Artificial Sequence: Synthetic oligonucleotide
  Target: ATXN1; (+) strand; PAM type: NRG; PAM sequence: TGG
caaatacgcattccatgttg

SEQ ID NO: 128871 - DNA, 20 bp, Artificial Sequence
  Description of Artificial Sequence: Synthetic oligonucleotide
  Target: ATXN1; (+) strand; PAM type: NRG; PAM sequence: GGG
aaatacgcattccatgttgt

SEQ ID NO: 128872 - DNA, 20 bp, Artificial Sequence
  Description of Artificial Sequence: Synthetic oligonucleotide
  Target: ATXN1; (+) strand; PAM type: NRG; PAM sequence: TAG
caacttcctttcttgaaaca

SEQ ID NO: 128873 - DNA, 20 bp, Artificial Sequence
  Description of Artificial Sequence: Synthetic oligonucleotide
  Target: ATXN1; (+) strand; PAM type: NRG; PAM sequence: GAG
tttcttgaaacatagctgat

SEQ ID NO: 128874 - DNA, 20 bp, Artificial Sequence
  Description of Artificial Sequence: Synthetic oligonucleotide
  Target: ATXN1; (+) strand; PAM type: NRG; PAM sequence: AGG
ttcttgaaacatagctgatg

SEQ ID NO: 128875 - DNA, 20 bp, Artificial Sequence
  Description of Artificial Sequence: Synthetic oligonucleotide
  Target: ATXN1; (+) strand; PAM type: NRG; PAM sequence: TAG
atagctgatgaggccactaa

SEQ ID NO: 128876 - DNA, 20 bp, Artificial Sequence
  Description of Artificial Sequence: Synthetic oligonucleotide
  Target: ATXN1; (+) strand; PAM type: NRG; PAM sequence: AAG
gctgatgaggccactaatag

SEQ ID NO: 128877 - DNA, 20 bp, Artificial Sequence
  Description of Artificial Sequence: Synthetic oligonucleotide
  Target: ATXN1; (+) strand; PAM type: NRG; PAM sequence: TGG
ggccactaatagaagcttct

SEQ ID NO: 128878 - DNA, 20 bp, Artificial Sequence
  Description of Artificial Sequence: Synthetic oligonucleotide
  Target: ATXN1; (+) strand; PAM type: NRG; PAM sequence: AAG
ctaatagaagcttcttggaa

SEQ ID NO: 128879 - DNA, 20 bp, Artificial Sequence
  Description of Artificial Sequence: Synthetic oligonucleotide
  Target: ATXN1; (+) strand; PAM type: NRG; PAM sequence: GAG
aatagaagcttcttggaaaa

SEQ ID NO: 128880 - DNA, 20 bp, Artificial Sequence
  Description of Artificial Sequence: Synthetic oligonucleotide
  Target: ATXN1; (+) strand; PAM type: NRG; PAM sequence: AAG
cataattcacgtttgatttg

SEQ ID NO: 128881 - DNA, 20 bp, Artificial Sequence
  Description of Artificial Sequence: Synthetic oligonucleotide
  Target: ATXN1; (+) strand; PAM type: NRG; PAM sequence: AGG
ataattcacgtttgatttga

SEQ ID NO: 128882 - DNA, 20 bp, Artificial Sequence
  Description of Artificial Sequence: Synthetic oligonucleotide
  Target: ATXN1; (+) strand; PAM type: NRG; PAM sequence: CAG
attcacgtttgatttgaagg

SEQ ID NO: 128883 - DNA, 20 bp, Artificial Sequence
  Description of Artificial Sequence: Synthetic oligonucleotide
  Target: ATXN1; (+) strand; PAM type: NRG; PAM sequence: TGG
accccccaaaatgtcctctt

SEQ ID NO: 128884 - DNA, 20 bp, Artificial Sequence
  Description of Artificial Sequence: Synthetic oligonucleotide
  Target: ATXN1; (+) strand; PAM type: NRG; PAM sequence: CAG
aaatgtcctctttggtctta

SEQ ID NO: 128885 - DNA, 20 bp, Artificial Sequence
  Description of Artificial Sequence: Synthetic oligonucleotide
  Target: ATXN1; (+) strand; PAM type: NRG; PAM sequence: CAG
tacagcgatcatgaatgttc

SEQ ID NO: 128886 - DNA, 20 bp, Artificial Sequence
  Description of Artificial Sequence: Synthetic oligonucleotide
  Target: ATXN1; (+) strand; PAM type: NRG; PAM sequence: TAG
tcatgaatgttccagattaa

SEQ ID NO: 128887 - DNA, 20 bp, Artificial Sequence
  Description of Artificial Sequence: Synthetic oligonucleotide
  Target: ATXN1; (+) strand; PAM type: NRG; PAM sequence: AGG
catgaatgttccagattaat

SEQ ID NO: 128888 - DNA, 20 bp, Artificial Sequence
  Description of Artificial Sequence: Synthetic oligonucleotide
  Target: ATXN1; (+) strand; PAM type: NRG; PAM sequence: GAG
tgaatgttccagattaatag

SEQ ID NO: 128889 - DNA, 20 bp, Artificial Sequence
  Description of Artificial Sequence: Synthetic oligonucleotide
  Target: ATXN1; (+) strand; PAM type: NRG; PAM sequence: AAG
taaatgaccttaatatgttc

SEQ ID NO: 128890 - DNA, 20 bp, Artificial Sequence
  Description of Artificial Sequence: Synthetic oligonucleotide
  Target: ATXN1; (+) strand; PAM type: NRG; PAM sequence: TAG
atgaccttaatatgttcaag

SEQ ID NO: 128891 - DNA, 20 bp, Artificial Sequence
  Description of Artificial Sequence: Synthetic oligonucleotide
  Target: ATXN1; (+) strand; PAM type: NRG; PAM sequence: AAG
cttaatatgttcaagtagca

SEQ ID NO: 128892 - DNA, 20 bp, Artificial Sequence
  Description of Artificial Sequence: Synthetic oligonucleotide
  Target: ATXN1; (+) strand; PAM type: NRG; PAM sequence: TGG
aatatgttcaagtagcaaag

SEQ ID NO: 128893 - DNA, 20 bp, Artificial Sequence
  Description of Artificial Sequence: Synthetic oligonucleotide
  Target: ATXN1; (+) strand; PAM type: NRG; PAM sequence: GAG
tatgttcaagtagcaaagtg

SEQ ID NO: 128894 - DNA, 20 bp, Artificial Sequence
  Description of Artificial Sequence: Synthetic oligonucleotide
  Target: ATXN1; (+) strand; PAM type: NRG; PAM sequence: AGG
atgttcaagtagcaaagtgg

SEQ ID NO: 128895 - DNA, 20 bp, Artificial Sequence
  Description of Artificial Sequence: Synthetic oligonucleotide
  Target: ATXN1; (+) strand; PAM type: NRG; PAM sequence: GAG
aagtagcaaagtggaggttt

SEQ ID NO: 128896 - DNA, 20 bp, Artificial Sequence
  Description of Artificial Sequence: Synthetic oligonucleotide
  Target: ATXN1; (+) strand; PAM type: NRG; PAM sequence: CAG
gcaaagtggaggtttgagtc

SEQ ID NO: 128897 - DNA, 20 bp, Artificial Sequence
  Description of Artificial Sequence: Synthetic oligonucleotide
  Target: ATXN1; (+) strand; PAM type: NRG; PAM sequence: TGG
ggtttgagtccagtgacttc

SEQ ID NO: 128898 - DNA, 20 bp, Artificial Sequence
  Description of Artificial Sequence: Synthetic oligonucleotide
  Target: ATXN1; (+) strand; PAM type: NRG; PAM sequence: GGG
gtttgagtccagtgacttct

SEQ ID NO: 128899 - DNA, 20 bp, Artificial Sequence
  Description of Artificial Sequence: Synthetic oligonucleotide
  Target: ATXN1; (+) strand; PAM type: NRG; PAM sequence: GGG
tttgagtccagtgacttctg

SEQ ID NO: 128900 - DNA, 20 bp, Artificial Sequence
  Description of Artificial Sequence: Synthetic oligonucleotide
  Target: ATXN1; (+) strand; PAM type: NRG; PAM sequence: GAG
tgagtccagtgacttctggg

SEQ ID NO: 128901 - DNA, 20 bp, Artificial Sequence
  Description of Artificial Sequence: Synthetic oligonucleotide
  Target: ATXN1; (+) strand; PAM type: NRG; PAM sequence: CAG
tccagtgacttctggggaga

SEQ ID NO: 128902 - DNA, 20 bp, Artificial Sequence
  Description of Artificial Sequence: Synthetic oligonucleotide
  Target: ATXN1; (+) strand; PAM type: NRG; PAM sequence: TGG
cttctggggagacagttgta

SEQ ID NO: 128903 - DNA, 20 bp, Artificial Sequence
  Description of Artificial Sequence: Synthetic oligonucleotide
  Target: ATXN1; (+) strand; PAM type: NRG; PAM sequence: GGG
ttctggggagacagttgtat

SEQ ID NO: 128904 - DNA, 20 bp, Artificial Sequence
  Description of Artificial Sequence: Synthetic oligonucleotide
  Target: ATXN1; (+) strand; PAM type: NRG; PAM sequence: AAG
gggagacagttgtatgggct

SEQ ID NO: 128905 - DNA, 20 bp, Artificial Sequence
  Description of Artificial Sequence: Synthetic oligonucleotide
  Target: ATXN1; (+) strand; PAM type: NRG; PAM sequence: GAG
ctaagaacacataacatttt

SEQ ID NO: 128906 - DNA, 20 bp, Artificial Sequence
  Description of Artificial Sequence: Synthetic oligonucleotide
  Target: ATXN1; (+) strand; PAM type: NRG; PAM sequence: AGG
taagaacacataacattttg

SEQ ID NO: 128907 - DNA, 20 bp, Artificial Sequence
  Description of Artificial Sequence: Synthetic oligonucleotide
  Target: ATXN1; (+) strand; PAM type: NRG; PAM sequence: AAG
gaacacataacattttgagg

SEQ ID NO: 128908 - DNA, 20 bp, Artificial Sequence
  Description of Artificial Sequence: Synthetic oligonucleotide
  Target: ATXN1; (+) strand; PAM type: NRG; PAM sequence: AGG
aacacataacattttgagga

SEQ ID NO: 128909 - DNA, 20 bp, Artificial Sequence
  Description of Artificial Sequence: Synthetic oligonucleotide
  Target: ATXN1; (+) strand; PAM type: NRG; PAM sequence: TGG
tttcttgtcttttttttttt

SEQ ID NO: 128910 - DNA, 20 bp, Artificial Sequence
  Description of Artificial Sequence: Synthetic oligonucleotide
  Target: ATXN1; (+) strand; PAM type: NRG; PAM sequence: TAG
gtcttttttttttttggcaa

SEQ ID NO: 128911 - DNA, 20 bp, Artificial Sequence
  Description of Artificial Sequence: Synthetic oligonucleotide
  Target: ATXN1; (+) strand; PAM type: NRG; PAM sequence: AAG
tttttttttttggcaataga

SEQ ID NO: 128912 - DNA, 20 bp, Artificial Sequence
  Description of Artificial Sequence: Synthetic oligonucleotide
  Target: ATXN1; (+) strand; PAM type: NRG; PAM sequence: AAG
ttttggcaatagaaagtaaa

SEQ ID NO: 128913 - DNA, 20 bp, Artificial Sequence
  Description of Artificial Sequence: Synthetic oligonucleotide
  Target: ATXN1; (+) strand; PAM type: NRG; PAM sequence: GAG
tagaaagtaaaaagtttcct

SEQ ID NO: 128914 - DNA, 20 bp, Artificial Sequence
  Description of Artificial Sequence: Synthetic oligonucleotide
  Target: ATXN1; (+) strand; PAM type: NRG; PAM sequence: AAG
aaaaagtttcctgagctgaa

SEQ ID NO: 128915 - DNA, 20 bp, Artificial Sequence
  Description of Artificial Sequence: Synthetic oligonucleotide
  Target: ATXN1; (+) strand; PAM type: NRG; PAM sequence: AGG
aaaagtttcctgagctgaaa

SEQ ID NO: 128916 - DNA, 20 bp, Artificial Sequence
  Description of Artificial Sequence: Synthetic oligonucleotide
  Target: ATXN1; (+) strand; PAM type: NRG; PAM sequence: CAG
ttcctgagctgaaaaggcca

SEQ ID NO: 128917 - DNA, 20 bp, Artificial Sequence
  Description of Artificial Sequence: Synthetic oligonucleotide
  Target: ATXN1; (+) strand; PAM type: NRG; PAM sequence: CAG
acagcatgtattcttcaatt

SEQ ID NO: 128918 - DNA, 20 bp, Artificial Sequence
  Description of Artificial Sequence: Synthetic oligonucleotide
  Target: ATXN1; (+) strand; PAM type: NRG; PAM sequence: AGG
cagcatgtattcttcaattc

SEQ ID NO: 128919 - DNA, 20 bp, Artificial Sequence
  Description of Artificial Sequence: Synthetic oligonucleotide
  Target: ATXN1; (+) strand; PAM type: NRG; PAM sequence: GGG
agcatgtattcttcaattca

SEQ ID NO: 128920 - DNA, 20 bp, Artificial Sequence
  Description of Artificial Sequence: Synthetic oligonucleotide
  Target: ATXN1; (+) strand; PAM type: NRG; PAM sequence: TGG
tattcttcaattcagggtcc

SEQ ID NO: 128921 - DNA, 20 bp, Artificial Sequence
  Description of Artificial Sequence: Synthetic oligonucleotide
  Target: ATXN1; (+) strand; PAM type: NRG; PAM sequence: TGG
ttcagggtcctggtaatcac

SEQ ID NO: 128922 - DNA, 20 bp, Artificial Sequence
  Description of Artificial Sequence: Synthetic oligonucleotide
  Target: ATXN1; (+) strand; PAM type: NRG; PAM sequence: AAG
ctggtaatcactggaaccac

SEQ ID NO: 128923 - DNA, 20 bp, Artificial Sequence
  Description of Artificial Sequence: Synthetic oligonucleotide
  Target: ATXN1; (+) strand; PAM type: NRG; PAM sequence: TAG
ccacaagttcaaatgccatc

SEQ ID NO: 128924 - DNA, 20 bp, Artificial Sequence
  Description of Artificial Sequence: Synthetic oligonucleotide
  Target: ATXN1; (+) strand; PAM type: NRG; PAM sequence: AAG
tcaaatgccatctagaccat

SEQ ID NO: 128925 - DNA, 20 bp, Artificial Sequence
  Description of Artificial Sequence: Synthetic oligonucleotide
  Target: ATXN1; (+) strand; PAM type: NRG; PAM sequence: AGG
caaatgccatctagaccata

SEQ ID NO: 128926 - DNA, 20 bp, Artificial Sequence
  Description of Artificial Sequence: Synthetic oligonucleotide
  Target: ATXN1; (+) strand; PAM type: NRG; PAM sequence: TAG
caacaaacctatttgcctac

SEQ ID NO: 128927 - DNA, 20 bp, Artificial Sequence
  Description of Artificial Sequence: Synthetic oligonucleotide
  Target: ATXN1; (+) strand; PAM type: NRG; PAM sequence: AAG
tttgcctactagaactttta

SEQ ID NO: 128928 - DNA, 20 bp, Artificial Sequence
  Description of Artificial Sequence: Synthetic oligonucleotide
  Target: ATXN1; (+) strand; PAM type: NRG; PAM sequence: AAG
cctactagaacttttaaagc

SEQ ID NO: 128929 - DNA, 20 bp, Artificial Sequence
  Description of Artificial Sequence: Synthetic oligonucleotide
  Target: ATXN1; (+) strand; PAM type: NRG; PAM sequence: AGG
ctactagaacttttaaagca

SEQ ID NO: 128930 - DNA, 20 bp, Artificial Sequence
  Description of Artificial Sequence: Synthetic oligonucleotide
  Target: ATXN1; (+) strand; PAM type: NRG; PAM sequence: AAG
agcaaggctgcaaactattc

SEQ ID NO: 128931 - DNA, 20 bp, Artificial Sequence
  Description of Artificial Sequence: Synthetic oligonucleotide
  Target: ATXN1; (+) strand; PAM type: NRG; PAM sequence: TGG
tattcaagtaaacaaccttg

SEQ ID NO: 128932 - DNA, 20 bp, Artificial Sequence
  Description of Artificial Sequence: Synthetic oligonucleotide
  Target: ATXN1; (+) strand; PAM type: NRG; PAM sequence: GGG
attcaagtaaacaaccttgt

SEQ ID NO: 128933 - DNA, 20 bp, Artificial Sequence
  Description of Artificial Sequence: Synthetic oligonucleotide
  Target: ATXN1; (+) strand; PAM type: NRG; PAM sequence: GGG
ttcaagtaaacaaccttgtg

SEQ ID NO: 128934 - DNA, 20 bp, Artificial Sequence
  Description of Artificial Sequence: Synthetic oligonucleotide
  Target: ATXN1; (+) strand; PAM type: NRG; PAM sequence: TGG
aagtaaacaaccttgtgggg

SEQ ID NO: 128935 - DNA, 20 bp, Artificial Sequence
  Description of Artificial Sequence: Synthetic oligonucleotide
  Target: ATXN1; (+) strand; PAM type: NRG; PAM sequence: TGG
accttgtggggtggttgaca

SEQ ID NO: 128936 - DNA, 20 bp, Artificial Sequence
  Description of Artificial Sequence: Synthetic oligonucleotide
  Target: ATXN1; (+) strand; PAM type: NRG; PAM sequence: GAG
tggggtggttgacatggacc

SEQ ID NO: 128937 - DNA, 20 bp, Artificial Sequence
  Description of Artificial Sequence: Synthetic oligonucleotide
  Target: ATXN1; (+) strand; PAM type: NRG; PAM sequence: GAG
gggtggttgacatggaccga

SEQ ID NO: 128938 - DNA, 20 bp, Artificial Sequence
  Description of Artificial Sequence: Synthetic oligonucleotide
  Target: ATXN1; (+) strand; PAM type: NRG; PAM sequence: AAG
gacatggaccgagagctaac

SEQ ID NO: 128939 - DNA, 20 bp, Artificial Sequence
  Description of Artificial Sequence: Synthetic oligonucleotide
  Target: ATXN1; (+) strand; PAM type: NRG; PAM sequence: GAG
catggaccgagagctaacaa

SEQ ID NO: 128940 - DNA, 20 bp, Artificial Sequence
  Description of Artificial Sequence: Synthetic oligonucleotide
  Target: ATXN1; (+) strand; PAM type: NRG; PAM sequence: TGG
gagagctaacaagagaacac

SEQ ID NO: 128941 - DNA, 20 bp, Artificial Sequence
  Description of Artificial Sequence: Synthetic oligonucleotide
  Target: ATXN1; (+) strand; PAM type: NRG; PAM sequence: TAG
taacaagagaacactggaat

SEQ ID NO: 128942 - DNA, 20 bp, Artificial Sequence
  Description of Artificial Sequence: Synthetic oligonucleotide
  Target: ATXN1; (+) strand; PAM type: NRG; PAM sequence: CAG
gaacactggaattagcttct

SEQ ID NO: 128943 - DNA, 20 bp, Artificial Sequence
  Description of Artificial Sequence: Synthetic oligonucleotide
  Target: ATXN1; (+) strand; PAM type: NRG; PAM sequence: TAG
ttagcttctcagtttcaaaa

SEQ ID NO: 128944 - DNA, 20 bp, Artificial Sequence
  Description of Artificial Sequence: Synthetic oligonucleotide
  Target: ATXN1; (+) strand; PAM type: NRG; PAM sequence: AGG
tagcttctcagtttcaaaat

SEQ ID NO: 128945 - DNA, 20 bp, Artificial Sequence
  Description of Artificial Sequence: Synthetic oligonucleotide
  Target: ATXN1; (+) strand; PAM type: NRG; PAM sequence: AAG
cagtttcaaaataggaccta

SEQ ID NO: 128946 - DNA, 20 bp, Artificial Sequence
  Description of Artificial Sequence: Synthetic oligonucleotide
  Target: ATXN1; (+) strand; PAM type: NRG; PAM sequence: AGG
agtttcaaaataggacctaa

SEQ ID NO: 128947 - DNA, 20 bp, Artificial Sequence
  Description of Artificial Sequence: Synthetic oligonucleotide
  Target: ATXN1; (+) strand; PAM type: NRG; PAM sequence: GAG
tttcaaaataggacctaaag

SEQ ID NO: 128948 - DNA, 20 bp, Artificial Sequence
  Description of Artificial Sequence: Synthetic oligonucleotide
  Target: ATXN1; (+) strand; PAM type: NRG; PAM sequence: TAG
acctaaaggagtttgcgcta

SEQ ID NO: 128949 - DNA, 20 bp, Artificial Sequence
  Description of Artificial Sequence: Synthetic oligonucleotide
  Target: ATXN1; (+) strand; PAM type: NRG; PAM sequence: AGG
cctaaaggagtttgcgctat

SEQ ID NO: 128950 - DNA, 20 bp, Artificial Sequence
  Description of Artificial Sequence: Synthetic oligonucleotide
  Target: ATXN1; (+) strand; PAM type: NRG; PAM sequence: GAG
taaaggagtttgcgctatag

SEQ ID NO: 128951 - DNA, 20 bp, Artificial Sequence
  Description of Artificial Sequence: Synthetic oligonucleotide
  Target: ATXN1; (+) strand; PAM type: NRG; PAM sequence: AAG
aggagtttgcgctataggag

SEQ ID NO: 128952 - DNA, 20 bp, Artificial Sequence
  Description of Artificial Sequence: Synthetic oligonucleotide
  Target: ATXN1; (+) strand; PAM type: NRG; PAM sequence: GAG
gagtttgcgctataggagaa

SEQ ID NO: 128953 - DNA, 20 bp, Artificial Sequence
  Description of Artificial Sequence: Synthetic oligonucleotide
  Target: ATXN1; (+) strand; PAM type: NRG; PAM sequence: TGG
agttgctgcattttgtttaa

SEQ ID NO: 128954 - DNA, 20 bp, Artificial Sequence
  Description of Artificial Sequence: Synthetic oligonucleotide
  Target: ATXN1; (+) strand; PAM type: NRG; PAM sequence: GAG
tttgtgcccatttaaatcat

SEQ ID NO: 128955 - DNA, 20 bp, Artificial Sequence
  Description of Artificial Sequence: Synthetic oligonucleotide
  Target: ATXN1; (+) strand; PAM type: NRG; PAM sequence: CAG
gtgcccatttaaatcatgag

SEQ ID NO: 128956 - DNA, 20 bp, Artificial Sequence
  Description of Artificial Sequence: Synthetic oligonucleotide
  Target: ATXN1; (+) strand; PAM type: NRG; PAM sequence: AGG
tgcccatttaaatcatgagc

SEQ ID NO: 128957 - DNA, 20 bp, Artificial Sequence
  Description of Artificial Sequence: Synthetic oligonucleotide
  Target: ATXN1; (+) strand; PAM type: NRG; PAM sequence: TGG
ccatttaaatcatgagcagg

SEQ ID NO: 128958 - DNA, 20 bp, Artificial Sequence
  Description of Artificial Sequence: Synthetic oligonucleotide
  Target: ATXN1; (+) strand; PAM type: NRG; PAM sequence: TGG
aatcatgagcaggtggcact

SEQ ID NO: 128959 - DNA, 20 bp, Artificial Sequence
  Description of Artificial Sequence: Synthetic oligonucleotide
  Target: ATXN1; (+) strand; PAM type: NRG; PAM sequence: TAG
catgagcaggtggcacttgg

SEQ ID NO: 128960 - DNA, 20 bp, Artificial Sequence
  Description of Artificial Sequence: Synthetic oligonucleotide
  Target: ATXN1; (+) strand; PAM type: NRG; PAM sequence: AAG
gcaggtggcacttggtagca

SEQ ID NO: 128961 - DNA, 20 bp, Artificial Sequence
  Description of Artificial Sequence: Synthetic oligonucleotide
  Target: ATXN1; (+) strand; PAM type: NRG; PAM sequence: AAG
gtggcacttggtagcaaaga

SEQ ID NO: 128962 - DNA, 20 bp, Artificial Sequence
  Description of Artificial Sequence: Synthetic oligonucleotide
  Target: ATXN1; (+) strand; PAM type: NRG; PAM sequence: TAG
agcctgaaaatattcacatt

SEQ ID NO: 128963 - DNA, 20 bp, Artificial Sequence
  Description of Artificial Sequence: Synthetic oligonucleotide
  Target: ATXN1; (+) strand; PAM type: NRG; PAM sequence: CAG
atattcacatttagtgaatg

SEQ ID NO: 128964 - DNA, 20 bp, Artificial Sequence
  Description of Artificial Sequence: Synthetic oligonucleotide
  Target: ATXN1; (+) strand; PAM type: NRG; PAM sequence: TAG
aatgcagttgtatgtataat

SEQ ID NO: 128965 - DNA, 20 bp, Artificial Sequence
  Description of Artificial Sequence: Synthetic oligonucleotide
  Target: ATXN1; (+) strand; PAM type: NRG; PAM sequence: GAG
agttgtatgtataattagct

SEQ ID NO: 128966 - DNA, 20 bp, Artificial Sequence
  Description of Artificial Sequence: Synthetic oligonucleotide
  Target: ATXN1; (+) strand; PAM type: NRG; PAM sequence: AAG
attagctgagatttatttta

SEQ ID NO: 128967 - DNA, 20 bp, Artificial Sequence
  Description of Artificial Sequence: Synthetic oligonucleotide
  Target: ATXN1; (+) strand; PAM type: NRG; PAM sequence: TGG
ctcttttctacaattcaaac

SEQ ID NO: 128968 - DNA, 20 bp, Artificial Sequence
  Description of Artificial Sequence: Synthetic oligonucleotide
  Target: ATXN1; (+) strand; PAM type: NRG; PAM sequence: GAG
tttctacaattcaaactggt

SEQ ID NO: 128969 - DNA, 20 bp, Artificial Sequence
  Description of Artificial Sequence: Synthetic oligonucleotide
  Target: ATXN1; (+) strand; PAM type: NRG; PAM sequence: TAG
caattcaaactggtgagaaa

SEQ ID NO: 128970 - DNA, 20 bp, Artificial Sequence
  Description of Artificial Sequence: Synthetic oligonucleotide
  Target: ATXN1; (+) strand; PAM type: NRG; PAM sequence: GAG
attcaaactggtgagaaata

SEQ ID NO: 128971 - DNA, 20 bp, Artificial Sequence
  Description of Artificial Sequence: Synthetic oligonucleotide
  Target: ATXN1; (+) strand; PAM type: NRG; PAM sequence: GAG
tcaaactggtgagaaataga

SEQ ID NO: 128972 - DNA, 20 bp, Artificial Sequence
  Description of Artificial Sequence: Synthetic oligonucleotide
  Target: ATXN1; (+) strand; PAM type: NRG; PAM sequence: CAG
aactggtgagaaatagagag

SEQ ID NO: 128973 - DNA, 20 bp, Artificial Sequence
  Description of Artificial Sequence: Synthetic oligonucleotide
  Target: ATXN1; (+) strand; PAM type: NRG; PAM sequence: AAG
agcttttgaatttattatga

SEQ ID NO: 128974 - DNA, 20 bp, Artificial Sequence
  Description of Artificial Sequence: Synthetic oligonucleotide
  Target: ATXN1; (+) strand; PAM type: NRG; PAM sequence: CAG
ttgaatttattatgaaagca

SEQ ID NO: 128975 - DNA, 20 bp, Artificial Sequence
  Description of Artificial Sequence: Synthetic oligonucleotide
  Target: ATXN1; (+) strand; PAM type: NRG; PAM sequence: TAG
tgaaagcacagctatcgtat

SEQ ID NO: 128976 - DNA, 20 bp, Artificial Sequence
  Description of Artificial Sequence: Synthetic oligonucleotide
  Target: ATXN1; (+) strand; PAM type: NRG; PAM sequence: AAG
cagctatcgtattagctgtt

SEQ ID NO: 128977 - DNA, 20 bp, Artificial Sequence
  Description of Artificial Sequence: Synthetic oligonucleotide
  Target: ATXN1; (+) strand; PAM type: NRG; PAM sequence: TGG
agctgttaagaaataaaaaa

SEQ ID NO: 128978 - DNA, 20 bp, Artificial Sequence
  Description of Artificial Sequence: Synthetic oligonucleotide
  Target: ATXN1; (+) strand; PAM type: NRG; PAM sequence: GGG
gctgttaagaaataaaaaat

SEQ ID NO: 128979 - DNA, 20 bp, Artificial Sequence
  Description of Artificial Sequence: Synthetic oligonucleotide
  Target: ATXN1; (+) strand; PAM type: NRG; PAM sequence: GGG
ctgttaagaaataaaaaatg

SEQ ID NO: 128980 - DNA, 20 bp, Artificial Sequence
  Description of Artificial Sequence: Synthetic oligonucleotide
  Target: ATXN1; (+) strand; PAM type: NRG; PAM sequence: GAG
gttaagaaataaaaaatggg

SEQ ID NO: 128981 - DNA, 20 bp, Artificial Sequence
  Description of Artificial Sequence: Synthetic oligonucleotide
  Target: ATXN1; (+) strand; PAM type: NRG; PAM sequence: AGG
ttaagaaataaaaaatgggg

SEQ ID NO: 128982 - DNA, 20 bp, Artificial Sequence
  Description of Artificial Sequence: Synthetic oligonucleotide
  Target: ATXN1; (+) strand; PAM type: NRG; PAM sequence: GGG
taagaaataaaaaatgggga

SEQ ID NO: 128983 - DNA, 20 bp, Artificial Sequence
  Description of Artificial Sequence: Synthetic oligonucleotide
  Target: ATXN1; (+) strand; PAM type: NRG; PAM sequence: CGG
ataaaaaatggggagggtgt

SEQ ID NO: 128984 - DNA, 20 bp, Artificial Sequence
  Description of Artificial Sequence: Synthetic oligonucleotide
  Target: ATXN1; (+) strand; PAM type: NRG; PAM sequence: AAG
aaatggggagggtgtcggaa

SEQ ID NO: 128985 - DNA, 20 bp, Artificial Sequence
  Description of Artificial Sequence: Synthetic oligonucleotide
  Target: ATXN1; (+) strand; PAM type: NRG; PAM sequence: TAG
gtctctaataatatgtacat

SEQ ID NO: 128986 - DNA, 20 bp, Artificial Sequence
  Description of Artificial Sequence: Synthetic oligonucleotide
  Target: ATXN1; (+) strand; PAM type: NRG; PAM sequence: AGG
tctctaataatatgtacatt

SEQ ID NO: 128987 - DNA, 20 bp, Artificial Sequence
  Description of Artificial Sequence: Synthetic oligonucleotide
  Target: ATXN1; (+) strand; PAM type: NRG; PAM sequence: CAG
aataatatgtacattaggaa

SEQ ID NO: 128988 - DNA, 20 bp, Artificial Sequence
  Description of Artificial Sequence: Synthetic oligonucleotide
  Target: ATXN1; (+) strand; PAM type: NRG; PAM sequence: AAG
tgtacattaggaacagacca

SEQ ID NO: 128989 - DNA, 20 bp, Artificial Sequence
  Description of Artificial Sequence: Synthetic oligonucleotide
  Target: ATXN1; (+) strand; PAM type: NRG; PAM sequence: AAG
attaggaacagaccaaagca

SEQ ID NO: 128990 - DNA, 20 bp, Artificial Sequence
  Description of Artificial Sequence: Synthetic oligonucleotide
  Target: ATXN1; (+) strand; PAM type: NRG; PAM sequence: AGG
ttaggaacagaccaaagcaa

SEQ ID NO: 128991 - DNA, 20 bp, Artificial Sequence
  Description of Artificial Sequence: Synthetic oligonucleotide
  Target: ATXN1; (+) strand; PAM type: NRG; PAM sequence: GGG
taggaacagaccaaagcaaa

SEQ ID NO: 128992 - DNA, 20 bp, Artificial Sequence
  Description of Artificial Sequence: Synthetic oligonucleotide
  Target: ATXN1; (+) strand; PAM type: NRG; PAM sequence: CAG
gcaaagggctttctttcctt

SEQ ID NO: 128993 - DNA, 20 bp, Artificial Sequence
  Description of Artificial Sequence: Synthetic oligonucleotide
  Target: ATXN1; (+) strand; PAM type: NRG; PAM sequence: GAG
aaagggctttctttccttca

SEQ ID NO: 128994 - DNA, 20 bp, Artificial Sequence
  Description of Artificial Sequence: Synthetic oligonucleotide
  Target: ATXN1; (+) strand; PAM type: NRG; PAM sequence: TAG
gggctttctttccttcagag

SEQ ID NO: 128995 - DNA, 20 bp, Artificial Sequence
  Description of Artificial Sequence: Synthetic oligonucleotide
  Target: ATXN1; (+) strand; PAM type: NRG; PAM sequence: GAG
tttctttccttcagagtagt

SEQ ID NO: 128996 - DNA, 20 bp, Artificial Sequence
  Description of Artificial Sequence: Synthetic oligonucleotide
  Target: ATXN1; (+) strand; PAM type: NRG; PAM sequence: GAG
gtgagtctgctgctgttcct

SEQ ID NO: 128997 - DNA, 20 bp, Artificial Sequence
  Description of Artificial Sequence: Synthetic oligonucleotide
  Target: ATXN1; (+) strand; PAM type: NRG; PAM sequence: GAG
tgctgctgttcctgagaaat

SEQ ID NO: 128998 - DNA, 20 bp, Artificial Sequence
  Description of Artificial Sequence: Synthetic oligonucleotide
  Target: ATXN1; (+) strand; PAM type: NRG; PAM sequence: GAG
gctgttcctgagaaatgagt

SEQ ID NO: 128999 - DNA, 20 bp, Artificial Sequence
  Description of Artificial Sequence: Synthetic oligonucleotide
  Target: ATXN1; (+) strand; PAM type: NRG; PAM sequence: CAG
tgagaaatgagtgagctgca

SEQ ID NO: 129000 - DNA, 20 bp, Artificial Sequence
  Description of Artificial Sequence: Synthetic oligonucleotide
  Target: ATXN1; (+) strand; PAM type: NRG; PAM sequence: AGG
gagaaatgagtgagctgcac

SEQ ID NO: 129001 - DNA, 20 bp, Artificial Sequence
  Description of Artificial Sequence: Synthetic oligonucleotide
  Target: ATXN1; (+) strand; PAM type: NRG; PAM sequence: CAG
atgagtgagctgcacaggac

SEQ ID NO: 129002 - DNA, 20 bp, Artificial Sequence
  Description of Artificial Sequence: Synthetic oligonucleotide
  Target: ATXN1; (+) strand; PAM type: NRG; PAM sequence: CAG
gtgagctgcacaggaccagc

SEQ ID NO: 129003 - DNA, 20 bp, Artificial Sequence
  Description of Artificial Sequence: Synthetic oligonucleotide
  Target: ATXN1; (+) strand; PAM type: NRG; PAM sequence: TAG
agctgcacaggaccagccag

SEQ ID NO: 129004 - DNA, 20 bp, Artificial Sequence
  Description of Artificial Sequence: Synthetic oligonucleotide
  Target: ATXN1; (+) strand; PAM type: NRG; PAM sequence: AGG
gctgcacaggaccagccagt

SEQ ID NO: 129005 - DNA, 20 bp, Artificial Sequence
  Description of Artificial Sequence: Synthetic oligonucleotide
  Target: ATXN1; (+) strand; PAM type: NRG; PAM sequence: GAG
tgcacaggaccagccagtag

SEQ ID NO: 129006 - DNA, 20 bp, Artificial Sequence
  Description of Artificial Sequence: Synthetic oligonucleotide
  Target: ATXN1; (+) strand; PAM type: NRG; PAM sequence: AGG
gcacaggaccagccagtagg

SEQ ID NO: 129007 - DNA, 20 bp, Artificial Sequence
  Description of Artificial Sequence: Synthetic oligonucleotide
  Target: ATXN1; (+) strand; PAM type: NRG; PAM sequence: GGG
cacaggaccagccagtagga

SEQ ID NO: 129008 - DNA, 20 bp, Artificial Sequence
  Description of Artificial Sequence: Synthetic oligonucleotide
  Target: ATXN1; (+) strand; PAM type: NRG; PAM sequence: TGG
accagccagtaggagggcga

SEQ ID NO: 129009 - DNA, 20 bp, Artificial Sequence
  Description of Artificial Sequence: Synthetic oligonucleotide
  Target: ATXN1; (+) strand; PAM type: NRG; PAM sequence: GGG
ccagccagtaggagggcgat

SEQ ID NO: 129010 - DNA, 20 bp, Artificial Sequence
  Description of Artificial Sequence: Synthetic oligonucleotide
  Target: ATXN1; (+) strand; PAM type: NRG; PAM sequence: AAG
gccagtaggagggcgatggg

SEQ ID NO: 129011 - DNA, 20 bp, Artificial Sequence
  Description of Artificial Sequence: Synthetic oligonucleotide
  Target: ATXN1; (+) strand; PAM type: NRG; PAM sequence: AAG
ggagggcgatgggaagaatc

SEQ ID NO: 129012 - DNA, 20 bp, Artificial Sequence
  Description of Artificial Sequence: Synthetic oligonucleotide
  Target: ATXN1; (+) strand; PAM type: NRG; PAM sequence: AGG
gagggcgatgggaagaatca

SEQ ID NO: 129013 - DNA, 20 bp, Artificial Sequence
  Description of Artificial Sequence: Synthetic oligonucleotide
  Target: ATXN1; (+) strand; PAM type: NRG; PAM sequence: TAG
aagaatcaaggtgtgcattt

SEQ ID NO: 129014 - DNA, 20 bp, Artificial Sequence
  Description of Artificial Sequence: Synthetic oligonucleotide
  Target: ATXN1; (+) strand; PAM type: NRG; PAM sequence: AAG
aatcaaggtgtgcattttag

SEQ ID NO: 129015 - DNA, 20 bp, Artificial Sequence
  Description of Artificial Sequence: Synthetic oligonucleotide
  Target: ATXN1; (+) strand; PAM type: NRG; PAM sequence: CAG
caaggtgtgcattttagaag

SEQ ID NO: 129016 - DNA, 20 bp, Artificial Sequence
  Description of Artificial Sequence: Synthetic oligonucleotide
  Target: ATXN1; (+) strand; PAM type: NRG; PAM sequence: AAG
ggtgtgcattttagaagcag

SEQ ID NO: 129017 - DNA, 20 bp, Artificial Sequence
  Description of Artificial Sequence: Synthetic oligonucleotide
  Target: ATXN1; (+) strand; PAM type: NRG; PAM sequence: AGG
gtgtgcattttagaagcaga

SEQ ID NO: 129018 - DNA, 20 bp, Artificial Sequence
  Description of Artificial Sequence: Synthetic oligonucleotide
  Target: ATXN1; (+) strand; PAM type: NRG; PAM sequence: TGG
agaagcagaaggttttttca

SEQ ID NO: 129019 - DNA, 20 bp, Artificial Sequence
  Description of Artificial Sequence: Synthetic oligonucleotide
  Target: ATXN1; (+) strand; PAM type: NRG; PAM sequence: AAG
aaaattccaaacatgtacca

SEQ ID NO: 129020 - DNA, 20 bp, Artificial Sequence
  Description of Artificial Sequence: Synthetic oligonucleotide
  Target: ATXN1; (+) strand; PAM type: NRG; PAM sequence: TAG
catgtaccaaagactcacaa

SEQ ID NO: 129021 - DNA, 20 bp, Artificial Sequence
  Description of Artificial Sequence: Synthetic oligonucleotide
  Target: ATXN1; (+) strand; PAM type: NRG; PAM sequence: CAG
aacaccaaatatccattact

SEQ ID NO: 129022 - DNA, 20 bp, Artificial Sequence
  Description of Artificial Sequence: Synthetic oligonucleotide
  Target: ATXN1; (+) strand; PAM type: NRG; PAM sequence: CAG
tatccattactcagcatcaa

SEQ ID NO: 129023 - DNA, 20 bp, Artificial Sequence
  Description of Artificial Sequence: Synthetic oligonucleotide
  Target: ATXN1; (+) strand; PAM type: NRG; PAM sequence: TGG
gcatcaacagtgacaaacca

SEQ ID NO: 129024 - DNA, 20 bp, Artificial Sequence
  Description of Artificial Sequence: Synthetic oligonucleotide
  Target: ATXN1; (+) strand; PAM type: NRG; PAM sequence: AAG
ccatggctgattgtgtcttc

SEQ ID NO: 129025 - DNA, 20 bp, Artificial Sequence
  Description of Artificial Sequence: Synthetic oligonucleotide
  Target: ATXN1; (+) strand; PAM type: NRG; PAM sequence: CAG
ttgtgtcttcaagcaaatcc

SEQ ID NO: 129026 - DNA, 20 bp, Artificial Sequence
  Description of Artificial Sequence: Synthetic oligonucleotide
  Target: ATXN1; (+) strand; PAM type: NRG; PAM sequence: AAG
agaactgtaatttcatccct

SEQ ID NO: 129027 - DNA, 20 bp, Artificial Sequence
  Description of Artificial Sequence: Synthetic oligonucleotide
  Target: ATXN1; (+) strand; PAM type: NRG; PAM sequence: TAG
ttcatccctaagtatttcat

SEQ ID NO: 129028 - DNA, 20 bp, Artificial Sequence
  Description of Artificial Sequence: Synthetic oligonucleotide
  Target: ATXN1; (+) strand; PAM type: NRG; PAM sequence: AGG
tcatccctaagtatttcatt

SEQ ID NO: 129029 - DNA, 20 bp, Artificial Sequence
  Description of Artificial Sequence: Synthetic oligonucleotide
  Target: ATXN1; (+) strand; PAM type: NRG; PAM sequence: TAG
aagtatttcattaggaacca

SEQ ID NO: 129030 - DNA, 20 bp, Artificial Sequence
  Description of Artificial Sequence: Synthetic oligonucleotide
  Target: ATXN1; (+) strand; PAM type: NRG; PAM sequence: AAG
taggaaccatagaatttttt

SEQ ID NO: 129031 - DNA, 20 bp, Artificial Sequence
  Description of Artificial Sequence: Synthetic oligonucleotide
  Target: ATXN1; (+) strand; PAM type: NRG; PAM sequence: GAG
ttaagctccctcattttcct

SEQ ID NO: 129032 - DNA, 20 bp, Artificial Sequence
  Description of Artificial Sequence: Synthetic oligonucleotide
  Target: ATXN1; (+) strand; PAM type: NRG; PAM sequence: AGG
taagctccctcattttcctg

SEQ ID NO: 129033 - DNA, 20 bp, Artificial Sequence
  Description of Artificial Sequence: Synthetic oligonucleotide
  Target: ATXN1; (+) strand; PAM type: NRG; PAM sequence: AAG
cattttcctgaggtcctcaa

SEQ ID NO: 129034 - DNA, 20 bp, Artificial Sequence
  Description of Artificial Sequence: Synthetic oligonucleotide
  Target: ATXN1; (+) strand; PAM type: NRG; PAM sequence: CAG
tcctcaaaagtcaaatgacc

SEQ ID NO: 129035 - DNA, 20 bp, Artificial Sequence
  Description of Artificial Sequence: Synthetic oligonucleotide
  Target: ATXN1; (+) strand; PAM type: NRG; PAM sequence: AGG
cctcaaaagtcaaatgaccc

SEQ ID NO: 129036 - DNA, 20 bp, Artificial Sequence
  Description of Artificial Sequence: Synthetic oligonucleotide
  Target: ATXN1; (+) strand; PAM type: NRG; PAM sequence: GGG
ctcaaaagtcaaatgaccca

SEQ ID NO: 129037 - DNA, 20 bp, Artificial Sequence
  Description of Artificial Sequence: Synthetic oligonucleotide
  Target: ATXN1; (+) strand; PAM type: NRG; PAM sequence: GAG
ccatcatgtccaactgtgat

SEQ ID NO: 129038 - DNA, 20 bp, Artificial Sequence
  Description of Artificial Sequence: Synthetic oligonucleotide
  Target: ATXN1; (+) strand; PAM type: NRG; PAM sequence: AGG
catcatgtccaactgtgatg

SEQ ID NO: 129039 - DNA, 20 bp, Artificial Sequence
  Description of Artificial Sequence: Synthetic oligonucleotide
  Target: ATXN1; (+) strand; PAM type: NRG; PAM sequence: CAG
catgtccaactgtgatgagg

SEQ ID NO: 129040 - DNA, 20 bp, Artificial Sequence
  Description of Artificial Sequence: Synthetic oligonucleotide
  Target: ATXN1; (+) strand; PAM type: NRG; PAM sequence: AGG
atgtccaactgtgatgaggc

SEQ ID NO: 129041 - DNA, 20 bp, Artificial Sequence
  Description of Artificial Sequence: Synthetic oligonucleotide
  Target: ATXN1; (+) strand; PAM type: NRG; PAM sequence: GGG
tgtccaactgtgatgaggca

SEQ ID NO: 129042 - DNA, 20 bp, Artificial Sequence
  Description of Artificial Sequence: Synthetic oligonucleotide
  Target: ATXN1; (+) strand; PAM type: NRG; PAM sequence: TGG
caactgtgatgaggcagggc

SEQ ID NO: 129043 - DNA, 20 bp, Artificial Sequence
  Description of Artificial Sequence: Synthetic oligonucleotide
  Target: ATXN1; (+) strand; PAM type: NRG; PAM sequence: GAG
actgtgatgaggcagggctg

SEQ ID NO: 129044 - DNA, 20 bp, Artificial Sequence
  Description of Artificial Sequence: Synthetic oligonucleotide
  Target: ATXN1; (+) strand; PAM type: NRG; PAM sequence: CAG
gatgaggcagggctggagcc

SEQ ID NO: 129045 - DNA, 20 bp, Artificial Sequence
  Description of Artificial Sequence: Synthetic oligonucleotide
  Target: ATXN1; (+) strand; PAM type: NRG; PAM sequence: TGG
tggagcccagtcttgtcacc

SEQ ID NO: 129046 - DNA, 20 bp, Artificial Sequence
  Description of Artificial Sequence: Synthetic oligonucleotide
  Target: ATXN1; (+) strand; PAM type: NRG; PAM sequence: GGG
ggagcccagtcttgtcacct

SEQ ID NO: 129047 - DNA, 20 bp, Artificial Sequence
  Description of Artificial Sequence: Synthetic oligonucleotide
  Target: ATXN1; (+) strand; PAM type: NRG; PAM sequence: GGG
gagcccagtcttgtcacctg

SEQ ID NO: 129048 - DNA, 20 bp, Artificial Sequence
  Description of Artificial Sequence: Synthetic oligonucleotide
  Target: ATXN1; (+) strand; PAM type: NRG; PAM sequence: CAG
ccagtcttgtcacctggggc

SEQ ID NO: 129049 - DNA, 20 bp, Artificial Sequence
  Description of Artificial Sequence: Synthetic oligonucleotide
  Target: ATXN1; (+) strand; PAM type: NRG; PAM sequence: AGG
cagtcttgtcacctggggcc

SEQ ID NO: 129050 - DNA, 20 bp, Artificial Sequence
  Description of Artificial Sequence: Synthetic oligonucleotide
  Target: ATXN1; (+) strand; PAM type: NRG; PAM sequence: AAG
ggccaggtgtgctctccttc

SEQ ID NO: 129051 - DNA, 20 bp, Artificial Sequence
  Description of Artificial Sequence: Synthetic oligonucleotide
  Target: ATXN1; (+) strand; PAM type: NRG; PAM sequence: CAG
cttgtacttaccactccctt

SEQ ID NO: 129052 - DNA, 20 bp, Artificial Sequence
  Description of Artificial Sequence: Synthetic oligonucleotide
  Target: ATXN1; (+) strand; PAM type: NRG; PAM sequence: TGG
tcccttcagacgtttttaac

SEQ ID NO: 129053 - DNA, 20 bp, Artificial Sequence
  Description of Artificial Sequence: Synthetic oligonucleotide
  Target: ATXN1; (+) strand; PAM type: NRG; PAM sequence: GAG
gacgtttttaactggaccct

SEQ ID NO: 129054 - DNA, 20 bp, Artificial Sequence
  Description of Artificial Sequence: Synthetic oligonucleotide
  Target: ATXN1; (+) strand; PAM type: NRG; PAM sequence: CAG
cctgagccataaaattaaca

SEQ ID NO: 129055 - DNA, 20 bp, Artificial Sequence
  Description of Artificial Sequence: Synthetic oligonucleotide
  Target: ATXN1; (+) strand; PAM type: NRG; PAM sequence: GAG
ataaaattaacacagaaaat

SEQ ID NO: 129056 - DNA, 20 bp, Artificial Sequence
  Description of Artificial Sequence: Synthetic oligonucleotide
  Target: ATXN1; (+) strand; PAM type: NRG; PAM sequence: TGG
acagaaaatgagcatgacat

SEQ ID NO: 129057 - DNA, 20 bp, Artificial Sequence
  Description of Artificial Sequence: Synthetic oligonucleotide
  Target: ATXN1; (+) strand; PAM type: NRG; PAM sequence: TAG
aaaatgagcatgacattggc

SEQ ID NO: 129058 - DNA, 20 bp, Artificial Sequence
  Description of Artificial Sequence: Synthetic oligonucleotide
  Target: ATXN1; (+) strand; PAM type: NRG; PAM sequence: CAG
gcatgacattggctagaaat

SEQ ID NO: 129059 - DNA, 20 bp, Artificial Sequence
  Description of Artificial Sequence: Synthetic oligonucleotide
  Target: ATXN1; (+) strand; PAM type: NRG; PAM sequence: CAG
aaaatcctgaattttaatct

SEQ ID NO: 129060 - DNA, 20 bp, Artificial Sequence
  Description of Artificial Sequence: Synthetic oligonucleotide
  Target: ATXN1; (+) strand; PAM type: NRG; PAM sequence: GAG
ctcagctttgccatttttct

SEQ ID NO: 129061 - DNA, 20 bp, Artificial Sequence
  Description of Artificial Sequence: Synthetic oligonucleotide
  Target: ATXN1; (+) strand; PAM type: NRG; PAM sequence: AAG
gccttaattgtcccaactat

SEQ ID NO: 129062 - DNA, 20 bp, Artificial Sequence
  Description of Artificial Sequence: Synthetic oligonucleotide
  Target: ATXN1; (+) strand; PAM type: NRG; PAM sequence: TAG
ttaattgtcccaactataag

SEQ ID NO: 129063 - DNA, 20 bp, Artificial Sequence
  Description of Artificial Sequence: Synthetic oligonucleotide
  Target: ATXN1; (+) strand; PAM type: NRG; PAM sequence: GAG
aattgtcccaactataagta

SEQ ID NO: 129064 - DNA, 20 bp, Artificial Sequence
  Description of Artificial Sequence: Synthetic oligonucleotide
  Target: ATXN1; (+) strand; PAM type: NRG; PAM sequence: AAG
agatatgaaattgctactac

SEQ ID NO: 129065 - DNA, 20 bp, Artificial Sequence
  Description of Artificial Sequence: Synthetic oligonucleotide
  Target: ATXN1; (+) strand; PAM type: NRG; PAM sequence: AAG
acttctgacatacttataaa

SEQ ID NO: 129066 - DNA, 20 bp, Artificial Sequence
  Description of Artificial Sequence: Synthetic oligonucleotide
  Target: ATXN1; (+) strand; PAM type: NRG; PAM sequence: AGG
cttctgacatacttataaaa

SEQ ID NO: 129067 - DNA, 20 bp, Artificial Sequence
  Description of Artificial Sequence: Synthetic oligonucleotide
  Target: ATXN1; (+) strand; PAM type: NRG; PAM sequence: GGG
ttctgacatacttataaaaa

SEQ ID NO: 129068 - DNA, 20 bp, Artificial Sequence
  Description of Artificial Sequence: Synthetic oligonucleotide
  Target: ATXN1; (+) strand; PAM type: NRG; PAM sequence: CAG
ggttgactttcaacttgtaa

SEQ ID NO: 129069 - DNA, 20 bp, Artificial Sequence
  Description of Artificial Sequence: Synthetic oligonucleotide
  Target: ATXN1; (+) strand; PAM type: NRG; PAM sequence: AAG
aacttgtaacagttatgttt

SEQ ID NO: 129070 - DNA, 20 bp, Artificial Sequence
  Description of Artificial Sequence: Synthetic oligonucleotide
  Target: ATXN1; (+) strand; PAM type: NRG; PAM sequence: AGG
acttgtaacagttatgttta

SEQ ID NO: 129071 - DNA, 20 bp, Artificial Sequence
  Description of Artificial Sequence: Synthetic oligonucleotide
  Target: ATXN1; (+) strand; PAM type: NRG; PAM sequence: TGG
ttatgtttaaggtattttca

SEQ ID NO: 129072 - DNA, 20 bp, Artificial Sequence
  Description of Artificial Sequence: Synthetic oligonucleotide
  Target: ATXN1; (+) strand; PAM type: NRG; PAM sequence: GAG
atgtttaaggtattttcatg

SEQ ID NO: 129073 - DNA, 20 bp, Artificial Sequence
  Description of Artificial Sequence: Synthetic oligonucleotide
  Target: ATXN1; (+) strand; PAM type: NRG; PAM sequence: AAG
attttcatggagtttcgtaa

SEQ ID NO: 129074 - DNA, 20 bp, Artificial Sequence
  Description of Artificial Sequence: Synthetic oligonucleotide
  Target: ATXN1; (+) strand; PAM type: NRG; PAM sequence: TAG
tggagtttcgtaaaagctgt

SEQ ID NO: 129075 - DNA, 20 bp, Artificial Sequence
  Description of Artificial Sequence: Synthetic oligonucleotide
  Target: ATXN1; (+) strand; PAM type: NRG; PAM sequence: AAG
agtttcgtaaaagctgttag

SEQ ID NO: 129076 - DNA, 20 bp, Artificial Sequence
  Description of Artificial Sequence: Synthetic oligonucleotide
  Target: ATXN1; (+) strand; PAM type: NRG; PAM sequence: AAG
aaaagctgttagaagccata

SEQ ID NO: 129077 - DNA, 20 bp, Artificial Sequence
  Description of Artificial Sequence: Synthetic oligonucleotide
  Target: ATXN1; (+) strand; PAM type: NRG; PAM sequence: TAG
ctgttagaagccataaagct

SEQ ID NO: 129078 - DNA, 20 bp, Artificial Sequence
  Description of Artificial Sequence: Synthetic oligonucleotide
  Target: ATXN1; (+) strand; PAM type: NRG; PAM sequence: GAG
agccataaagcttagactat

SEQ ID NO: 129079 - DNA, 20 bp, Artificial Sequence
  Description of Artificial Sequence: Synthetic oligonucleotide
  Target: ATXN1; (+) strand; PAM type: NRG; PAM sequence: GAG
gactatgagatgacttccgt

SEQ ID NO: 129080 - DNA, 20 bp, Artificial Sequence
  Description of Artificial Sequence: Synthetic oligonucleotide
  Target: ATXN1; (+) strand; PAM type: NRG; PAM sequence: AGG
actatgagatgacttccgtg

SEQ ID NO: 129081 - DNA, 20 bp, Artificial Sequence
  Description of Artificial Sequence: Synthetic oligonucleotide
  Target: ATXN1; (+) strand; PAM type: NRG; PAM sequence: GAG
tgagatgacttccgtgaggt

SEQ ID NO: 129082 - DNA, 20 bp, Artificial Sequence
  Description of Artificial Sequence: Synthetic oligonucleotide
  Target: ATXN1; (+) strand; PAM type: NRG; PAM sequence: GAG
gtgagatctcctatgttaat

SEQ ID NO: 129083 - DNA, 20 bp, Artificial Sequence
  Description of Artificial Sequence: Synthetic oligonucleotide
  Target: ATXN1; (+) strand; PAM type: NRG; PAM sequence: TGG
agatctcctatgttaatgag

SEQ ID NO: 129084 - DNA, 20 bp, Artificial Sequence
  Description of Artificial Sequence: Synthetic oligonucleotide
  Target: ATXN1; (+) strand; PAM type: NRG; PAM sequence: TGG
tctcctatgttaatgagtgg

SEQ ID NO: 129085 - DNA, 20 bp, Artificial Sequence
  Description of Artificial Sequence: Synthetic oligonucleotide
  Target: ATXN1; (+) strand; PAM type: NRG; PAM sequence: GGG
ctcctatgttaatgagtggt

SEQ ID NO: 129086 - DNA, 20 bp, Artificial Sequence
  Description of Artificial Sequence: Synthetic oligonucleotide
  Target: ATXN1; (+) strand; PAM type: NRG; PAM sequence: GGG
tcctatgttaatgagtggtg

SEQ ID NO: 129087 - DNA, 20 bp, Artificial Sequence
  Description of Artificial Sequence: Synthetic oligonucleotide
  Target: ATXN1; (+) strand; PAM type: NRG; PAM sequence: GAG
ctatgttaatgagtggtggg

SEQ ID NO: 129088 - DNA, 20 bp, Artificial Sequence
  Description of Artificial Sequence: Synthetic oligonucleotide
  Target: ATXN1; (+) strand; PAM type: NRG; PAM sequence: AGG
tatgttaatgagtggtgggg

SEQ ID NO: 129089 - DNA, 20 bp, Artificial Sequence
  Description of Artificial Sequence: Synthetic oligonucleotide
  Target: ATXN1; (+) strand; PAM type: NRG; PAM sequence: TAG
gagtggtggggaggcataca

SEQ ID NO: 129090 - DNA, 20 bp, Artificial Sequence
  Description of Artificial Sequence: Synthetic oligonucleotide
  Target: ATXN1; (+) strand; PAM type: NRG; PAM sequence: GAG
ttattatgtaactgtaccct

SEQ ID NO: 129091 - DNA, 20 bp, Artificial Sequence
  Description of Artificial Sequence: Synthetic oligonucleotide
  Target: ATXN1; (+) strand; PAM type: NRG; PAM sequence: GAG
attatgtaactgtaccctga

SEQ ID NO: 129092 - DNA, 20 bp, Artificial Sequence
  Description of Artificial Sequence: Synthetic oligonucleotide
  Target: ATXN1; (+) strand; PAM type: NRG; PAM sequence: AAG
cctgagagtattgccacgac

SEQ ID NO: 129093 - DNA, 20 bp, Artificial Sequence
  Description of Artificial Sequence: Synthetic oligonucleotide
  Target: ATXN1; (+) strand; PAM type: NRG; PAM sequence: TAG
tttatttttcacataaaaat

SEQ ID NO: 129094 - DNA, 20 bp, Artificial Sequence
  Description of Artificial Sequence: Synthetic oligonucleotide
  Target: ATXN1; (+) strand; PAM type: NRG; PAM sequence: TGG
actatttcaacatgctgaaa

SEQ ID NO: 129095 - DNA, 20 bp, Artificial Sequence
  Description of Artificial Sequence: Synthetic oligonucleotide
  Target: ATXN1; (+) strand; PAM type: NRG; PAM sequence: AAG
atttcaacatgctgaaatgg

SEQ ID NO: 129096 - DNA, 20 bp, Artificial Sequence
  Description of Artificial Sequence: Synthetic oligonucleotide
  Target: ATXN1; (+) strand; PAM type: NRG; PAM sequence: AAG
aatataaatcaacatttccc

SEQ ID NO: 129097 - DNA, 20 bp, Artificial Sequence
  Description of Artificial Sequence: Synthetic oligonucleotide
  Target: ATXN1; (+) strand; PAM type: NRG; PAM sequence: AGG
atataaatcaacatttccca

SEQ ID NO: 129098 - DNA, 20 bp, Artificial Sequence
  Description of Artificial Sequence: Synthetic oligonucleotide
  Target: ATXN1; (+) strand; PAM type: NRG; PAM sequence: GAG
ataaatcaacatttcccaag

SEQ ID NO: 129099 - DNA, 20 bp, Artificial Sequence
  Description of Artificial Sequence: Synthetic oligonucleotide
  Target: ATXN1; (+) strand; PAM type: NRG; PAM sequence: AGG
taaatcaacatttcccaagg

SEQ ID NO: 129100 - DNA, 20 bp, Artificial Sequence
  Description of Artificial Sequence: Synthetic oligonucleotide
  Target: ATXN1; (+) strand; PAM type: NRG; PAM sequence: AAG
aacatttcccaaggaggaaa

SEQ ID NO: 129101 - DNA, 20 bp, Artificial Sequence
  Description of Artificial Sequence: Synthetic oligonucleotide
  Target: ATXN1; (+) strand; PAM type: NRG; PAM sequence: AGG
acatttcccaaggaggaaaa

SEQ ID NO: 129102 - DNA, 20 bp, Artificial Sequence
  Description of Artificial Sequence: Synthetic oligonucleotide
  Target: ATXN1; (+) strand; PAM type: NRG; PAM sequence: CAG
tttcccaaggaggaaaaagg

SEQ ID NO: 129103 - DNA, 20 bp, Artificial Sequence
  Description of Artificial Sequence: Synthetic oligonucleotide
  Target: ATXN1; (+) strand; PAM type: NRG; PAM sequence: AGG
ttcccaaggaggaaaaaggc

SEQ ID NO: 129104 - DNA, 20 bp, Artificial Sequence
  Description of Artificial Sequence: Synthetic oligonucleotide
  Target: ATXN1; (+) strand; PAM type: NRG; PAM sequence: TGG
aaaaaggcaggccctcccct

SEQ ID NO: 129105 - DNA, 20 bp, Artificial Sequence
  Description of Artificial Sequence: Synthetic oligonucleotide
  Target: ATXN1; (+) strand; PAM type: NRG; PAM sequence: GGG
aaaaggcaggccctcccctt

SEQ ID NO: 129106 - DNA, 20 bp, Artificial Sequence
  Description of Artificial Sequence: Synthetic oligonucleotide
  Target: ATXN1; (+) strand; PAM type: NRG; PAM sequence: GGG
aaaggcaggccctccccttg

SEQ ID NO: 129107 - DNA, 20 bp, Artificial Sequence
  Description of Artificial Sequence: Synthetic oligonucleotide
  Target: ATXN1; (+) strand; PAM type: NRG; PAM sequence: AAG
ggcaggccctccccttgggg

SEQ ID NO: 129108 - DNA, 20 bp, Artificial Sequence
  Description of Artificial Sequence: Synthetic oligonucleotide
  Target: ATXN1; (+) strand; PAM type: NRG; PAM sequence: TAG
ccctccccttggggaagttc

SEQ ID NO: 129109 - DNA, 20 bp, Artificial Sequence
  Description of Artificial Sequence: Synthetic oligonucleotide
  Target: ATXN1; (+) strand; PAM type: NRG; PAM sequence: CAG
ggggaagttctagcatcttt

SEQ ID NO: 129110 - DNA, 20 bp, Artificial Sequence
  Description of Artificial Sequence: Synthetic oligonucleotide
  Target: ATXN1; (+) strand; PAM type: NRG; PAM sequence: GAG
ggaagttctagcatctttca

SEQ ID NO: 129111 - DNA, 20 bp, Artificial Sequence
  Description of Artificial Sequence: Synthetic oligonucleotide
  Target: ATXN1; (+) strand; PAM type: NRG; PAM sequence: AAG
gttctagcatctttcagaga

SEQ ID NO: 129112 - DNA, 20 bp, Artificial Sequence
  Description of Artificial Sequence: Synthetic oligonucleotide
  Target: ATXN1; (+) strand; PAM type: NRG; PAM sequence: CAG
agcatctttcagagaaagaa

SEQ ID NO: 129113 - DNA, 20 bp, Artificial Sequence
  Description of Artificial Sequence: Synthetic oligonucleotide
  Target: ATXN1; (+) strand; PAM type: NRG; PAM sequence: AGG
gcatctttcagagaaagaac

SEQ ID NO: 129114 - DNA, 20 bp, Artificial Sequence
  Description of Artificial Sequence: Synthetic oligonucleotide
  Target: ATXN1; (+) strand; PAM type: NRG; PAM sequence: AAG
ctttcagagaaagaacaggc

SEQ ID NO: 129115 - DNA, 20 bp, Artificial Sequence
  Description of Artificial Sequence: Synthetic oligonucleotide
  Target: ATXN1; (+) strand; PAM type: NRG; PAM sequence: AAG
gagaaagaacaggcaagccc

SEQ ID NO: 129116 - DNA, 20 bp, Artificial Sequence
  Description of Artificial Sequence: Synthetic oligonucleotide
  Target: ATXN1; (+) strand; PAM type: NRG; PAM sequence: AGG
agaaagaacaggcaagccca

SEQ ID NO: 129117 - DNA, 20 bp, Artificial Sequence
  Description of Artificial Sequence: Synthetic oligonucleotide
  Target: ATXN1; (+) strand; PAM type: NRG; PAM sequence: AAG
agaacaggcaagcccaagga

SEQ ID NO: 129118 - DNA, 20 bp, Artificial Sequence
  Description of Artificial Sequence: Synthetic oligonucleotide
  Target: ATXN1; (+) strand; PAM type: NRG; PAM sequence: TGG
acaggcaagcccaaggaaag

SEQ ID NO: 129119 - DNA, 20 bp, Artificial Sequence
  Description of Artificial Sequence: Synthetic oligonucleotide
  Target: ATXN1; (+) strand; PAM type: NRG; PAM sequence: GGG
caggcaagcccaaggaaagt

SEQ ID NO: 129120 - DNA, 20 bp, Artificial Sequence
  Description of Artificial Sequence: Synthetic oligonucleotide
  Target: ATXN1; (+) strand; PAM type: NRG; PAM sequence: AAG
aagcccaaggaaagtgggaa

SEQ ID NO: 129121 - DNA, 20 bp, Artificial Sequence
  Description of Artificial Sequence: Synthetic oligonucleotide
  Target: ATXN1; (+) strand; PAM type: NRG; PAM sequence: AGG
agcccaaggaaagtgggaaa

SEQ ID NO: 129122 - DNA, 20 bp, Artificial Sequence
  Description of Artificial Sequence: Synthetic oligonucleotide
  Target: ATXN1; (+) strand; PAM type: NRG; PAM sequence: GGG
gcccaaggaaagtgggaaaa

SEQ ID NO: 129123 - DNA, 20 bp, Artificial Sequence
  Description of Artificial Sequence: Synthetic oligonucleotide
  Target: ATXN1; (+) strand; PAM type: NRG; PAM sequence: AAG
aggaaagtgggaaaagggaa

SEQ ID NO: 129124 - DNA, 20 bp, Artificial Sequence
  Description of Artificial Sequence: Synthetic oligonucleotide
  Target: ATXN1; (+) strand; PAM type: NRG; PAM sequence: TGG
aacattccctctctttgttg

SEQ ID NO: 129125 - DNA, 20 bp, Artificial Sequence
  Description of Artificial Sequence: Synthetic oligonucleotide
  Target: ATXN1; (+) strand; PAM type: NRG; PAM sequence: AAG
acttgccaaatccctgaccg

SEQ ID NO: 129126 - DNA, 20 bp, Artificial Sequence
  Description of Artificial Sequence: Synthetic oligonucleotide
  Target: ATXN1; (+) strand; PAM type: NRG; PAM sequence: TGG
tgccaaatccctgaccgaag

SEQ ID NO: 129127 - DNA, 20 bp, Artificial Sequence
  Description of Artificial Sequence: Synthetic oligonucleotide
  Target: ATXN1; (+) strand; PAM type: NRG; PAM sequence: CAG
tgaccgaagtggacttacaa

SEQ ID NO: 129128 - DNA, 20 bp, Artificial Sequence
  Description of Artificial Sequence: Synthetic oligonucleotide
  Target: ATXN1; (+) strand; PAM type: NRG; PAM sequence: AAG
aactgcaaatattctcacga

SEQ ID NO: 129129 - DNA, 20 bp, Artificial Sequence
  Description of Artificial Sequence: Synthetic oligonucleotide
  Target: ATXN1; (+) strand; PAM type: NRG; PAM sequence: AAG
atattctcacgaaagtgtcc

SEQ ID NO: 129130 - DNA, 20 bp, Artificial Sequence
  Description of Artificial Sequence: Synthetic oligonucleotide
  Target: ATXN1; (+) strand; PAM type: NRG; PAM sequence: TGG
ctcacgaaagtgtccaagcc

SEQ ID NO: 129131 - DNA, 20 bp, Artificial Sequence
  Description of Artificial Sequence: Synthetic oligonucleotide
  Target: ATXN1; (+) strand; PAM type: NRG; PAM sequence: AAG
gtgtccaagcctggaaaaat

SEQ ID NO: 129132 - DNA, 20 bp, Artificial Sequence
  Description of Artificial Sequence: Synthetic oligonucleotide
  Target: ATXN1; (+) strand; PAM type: NRG; PAM sequence: AAG
tccaagcctggaaaaataag

SEQ ID NO: 129133 - DNA, 20 bp, Artificial Sequence
  Description of Artificial Sequence: Synthetic oligonucleotide
  Target: ATXN1; (+) strand; PAM type: NRG; PAM sequence: AAG
gaaaaataagaagcaaataa

SEQ ID NO: 129134 - DNA, 20 bp, Artificial Sequence
  Description of Artificial Sequence: Synthetic oligonucleotide
  Target: ATXN1; (+) strand; PAM type: NRG; PAM sequence: AGG
aaaaataagaagcaaataaa

SEQ ID NO: 129135 - DNA, 20 bp, Artificial Sequence
  Description of Artificial Sequence: Synthetic oligonucleotide
  Target: ATXN1; (+) strand; PAM type: NRG; PAM sequence: CAG
aaataaaaggttttgcctaa

SEQ ID NO: 129136 - DNA, 20 bp, Artificial Sequence
  Description of Artificial Sequence: Synthetic oligonucleotide
  Target: ATXN1; (+) strand; PAM type: NRG; PAM sequence: CGG
aaaaggttttgcctaacaga

SEQ ID NO: 129137 - DNA, 20 bp, Artificial Sequence
  Description of Artificial Sequence: Synthetic oligonucleotide
  Target: ATXN1; (+) strand; PAM type: NRG; PAM sequence: AAG
tttccttccaaatgcacata

SEQ ID NO: 129138 - DNA, 20 bp, Artificial Sequence
  Description of Artificial Sequence: Synthetic oligonucleotide
  Target: ATXN1; (+) strand; PAM type: NRG; PAM sequence: CAG
tccaaatgcacataaagata

SEQ ID NO: 129139 - DNA, 20 bp, Artificial Sequence
  Description of Artificial Sequence: Synthetic oligonucleotide
  Target: ATXN1; (+) strand; PAM type: NRG; PAM sequence: TGG
gcacataaagatacagtatt

SEQ ID NO: 129140 - DNA, 20 bp, Artificial Sequence
  Description of Artificial Sequence: Synthetic oligonucleotide
  Target: ATXN1; (+) strand; PAM type: NRG; PAM sequence: GGG
cacataaagatacagtattt

SEQ ID NO: 129141 - DNA, 20 bp, Artificial Sequence
  Description of Artificial Sequence: Synthetic oligonucleotide
  Target: ATXN1; (+) strand; PAM type: NRG; PAM sequence: GGG
acataaagatacagtatttg

SEQ ID NO: 129142 - DNA, 20 bp, Artificial Sequence
  Description of Artificial Sequence: Synthetic oligonucleotide
  Target: ATXN1; (+) strand; PAM type: NRG; PAM sequence: GAG
ataaagatacagtatttggg

SEQ ID NO: 129143 - DNA, 20 bp, Artificial Sequence
  Description of Artificial Sequence: Synthetic oligonucleotide
  Target: ATXN1; (+) strand; PAM type: NRG; PAM sequence: AGG
taaagatacagtatttgggg

SEQ ID NO: 129144 - DNA, 20 bp, Artificial Sequence
  Description of Artificial Sequence: Synthetic oligonucleotide
  Target: ATXN1; (+) strand; PAM type: NRG; PAM sequence: TGG
tacagtatttggggaggtga

SEQ ID NO: 129145 - DNA, 20 bp, Artificial Sequence
  Description of Artificial Sequence: Synthetic oligonucleotide
  Target: ATXN1; (+) strand; PAM type: NRG; PAM sequence: GAG
tttggggaggtgatggcaat

SEQ ID NO: 129146 - DNA, 20 bp, Artificial Sequence
  Description of Artificial Sequence: Synthetic oligonucleotide
  Target: ATXN1; (+) strand; PAM type: NRG; PAM sequence: TAG
ggtgatggcaatgagacaat

SEQ ID NO: 129147 - DNA, 20 bp, Artificial Sequence
  Description of Artificial Sequence: Synthetic oligonucleotide
  Target: ATXN1; (+) strand; PAM type: NRG; PAM sequence: CAG
atgagacaattagaatgttt

SEQ ID NO: 129148 - DNA, 20 bp, Artificial Sequence
  Description of Artificial Sequence: Synthetic oligonucleotide
  Target: ATXN1; (+) strand; PAM type: NRG; PAM sequence: GAG
ctaaaccaaccccaaaccct

SEQ ID NO: 129149 - DNA, 20 bp, Artificial Sequence
  Description of Artificial Sequence: Synthetic oligonucleotide
  Target: ATXN1; (+) strand; PAM type: NRG; PAM sequence: TGG
caaccccaaaccctgagatt

SEQ ID NO: 129150 - DNA, 20 bp, Artificial Sequence
  Description of Artificial Sequence: Synthetic oligonucleotide
  Target: ATXN1; (+) strand; PAM type: NRG; PAM sequence: AAG
ttcaatgcacctgctttcaa

SEQ ID NO: 129151 - DNA, 20 bp, Artificial Sequence
  Description of Artificial Sequence: Synthetic oligonucleotide
  Target: ATXN1; (+) strand; PAM type: NRG; PAM sequence: CAG
cctgctttcaaaagtcaaac

SEQ ID NO: 129152 - DNA, 20 bp, Artificial Sequence
  Description of Artificial Sequence: Synthetic oligonucleotide
  Target: ATXN1; (+) strand; PAM type: NRG; PAM sequence: GAG
tgctttcaaaagtcaaacca

SEQ ID NO: 129153 - DNA, 20 bp, Artificial Sequence
  Description of Artificial Sequence: Synthetic oligonucleotide
  Target: ATXN1; (+) strand; PAM type: NRG; PAM sequence: AGG
gctttcaaaagtcaaaccag

SEQ ID NO: 129154 - DNA, 20 bp, Artificial Sequence
  Description of Artificial Sequence: Synthetic oligonucleotide
  Target: ATXN1; (+) strand; PAM type: NRG; PAM sequence: CAG
tcatttttaacatccaccgc

SEQ ID NO: 129155 - DNA, 20 bp, Artificial Sequence
  Description of Artificial Sequence: Synthetic oligonucleotide
  Target: ATXN1; (+) strand; PAM type: NRG; PAM sequence: TGG
gccagcaaatgcctaccatg

SEQ ID NO: 129156 - DNA, 20 bp, Artificial Sequence
  Description of Artificial Sequence: Synthetic oligonucleotide
  Target: ATXN1; (+) strand; PAM type: NRG; PAM sequence: GAG
cagcaaatgcctaccatgtg

SEQ ID NO: 129157 - DNA, 20 bp, Artificial Sequence
  Description of Artificial Sequence: Synthetic oligonucleotide
  Target: ATXN1; (+) strand; PAM type: NRG; PAM sequence: AAG
accatgtggagtctcaccac

SEQ ID NO: 129158 - DNA, 20 bp, Artificial Sequence
  Description of Artificial Sequence: Synthetic oligonucleotide
  Target: ATXN1; (+) strand; PAM type: NRG; PAM sequence: AAG
ggagtctcaccacaagaccc

SEQ ID NO: 129159 - DNA, 20 bp, Artificial Sequence
  Description of Artificial Sequence: Synthetic oligonucleotide
  Target: ATXN1; (+) strand; PAM type: NRG; PAM sequence: CAG
acaagacccaagctgtgcac

SEQ ID NO: 129160 - DNA, 20 bp, Artificial Sequence
  Description of Artificial Sequence: Synthetic oligonucleotide
  Target: ATXN1; (+) strand; PAM type: NRG; PAM sequence: AGG
caagacccaagctgtgcacc

SEQ ID NO: 129161 - DNA, 20 bp, Artificial Sequence
  Description of Artificial Sequence: Synthetic oligonucleotide
  Target: ATXN1; (+) strand; PAM type: NRG; PAM sequence: CAG
ccaagctgtgcaccaggcgt

SEQ ID NO: 129162 - DNA, 20 bp, Artificial Sequence
  Description of Artificial Sequence: Synthetic oligonucleotide
  Target: ATXN1; (+) strand; PAM type: NRG; PAM sequence: GAG
aagctgtgcaccaggcgtca

SEQ ID NO: 129163 - DNA, 20 bp, Artificial Sequence
  Description of Artificial Sequence: Synthetic oligonucleotide
  Target: ATXN1; (+) strand; PAM type: NRG; PAM sequence: GAG
gctgtgcaccaggcgtcaga

SEQ ID NO: 129164 - DNA, 20 bp, Artificial Sequence
  Description of Artificial Sequence: Synthetic oligonucleotide
  Target: ATXN1; (+) strand; PAM type: NRG; PAM sequence: AAG
gtgcaccaggcgtcagagag

SEQ ID NO: 129165 - DNA, 20 bp, Artificial Sequence
  Description of Artificial Sequence: Synthetic oligonucleotide
  Target: ATXN1; (+) strand; PAM type: NRG; PAM sequence: CGG
caccaggcgtcagagagaag

SEQ ID NO: 129166 - DNA, 20 bp, Artificial Sequence
  Description of Artificial Sequence: Synthetic oligonucleotide
  Target: ATXN1; (+) strand; PAM type: NRG; PAM sequence: TGG
caggcgtcagagagaagcgg

SEQ ID NO: 129167 - DNA, 20 bp, Artificial Sequence
  Description of Artificial Sequence: Synthetic oligonucleotide
  Target: ATXN1; (+) strand; PAM type: NRG; PAM sequence: TGG
gagagaagcggtggtgtgtg

SEQ ID NO: 129168 - DNA, 20 bp, Artificial Sequence
  Description of Artificial Sequence: Synthetic oligonucleotide
  Target: ATXN1; (+) strand; PAM type: NRG; PAM sequence: TGG
gaagcggtggtgtgtgtgga

SEQ ID NO: 129169 - DNA, 20 bp, Artificial Sequence
  Description of Artificial Sequence: Synthetic oligonucleotide
  Target: ATXN1; (+) strand; PAM type: NRG; PAM sequence: TAG
gatggtctacctgcctgtgt

SEQ ID NO: 129170 - DNA, 20 bp, Artificial Sequence
  Description of Artificial Sequence: Synthetic oligonucleotide
  Target: ATXN1; (+) strand; PAM type: NRG; PAM sequence: TGG
acctgcctgtgttagtttcc

SEQ ID NO: 129171 - DNA, 20 bp, Artificial Sequence
  Description of Artificial Sequence: Synthetic oligonucleotide
  Target: ATXN1; (+) strand; PAM type: NRG; PAM sequence: GGG
cctgcctgtgttagtttcct

SEQ ID NO: 129172 - DNA, 20 bp, Artificial Sequence
  Description of Artificial Sequence: Synthetic oligonucleotide
  Target: ATXN1; (+) strand; PAM type: NRG; PAM sequence: GGG
ctgcctgtgttagtttcctg

SEQ ID NO: 129173 - DNA, 20 bp, Artificial Sequence
  Description of Artificial Sequence: Synthetic oligonucleotide
  Target: ATXN1; (+) strand; PAM type: NRG; PAM sequence: CAG
ttcctggggttgcaataaca

SEQ ID NO: 129174 - DNA, 20 bp, Artificial Sequence
  Description of Artificial Sequence: Synthetic oligonucleotide
  Target: ATXN1; (+) strand; PAM type: NRG; PAM sequence: CAG
gttgcaataacacagtacca

SEQ ID NO: 129175 - DNA, 20 bp, Artificial Sequence
  Description of Artificial Sequence: Synthetic oligonucleotide
  Target: ATXN1; (+) strand; PAM type: NRG; PAM sequence: TGG
aataacacagtaccacagac

SEQ ID NO: 129176 - DNA, 20 bp, Artificial Sequence
  Description of Artificial Sequence: Synthetic oligonucleotide
  Target: ATXN1; (+) strand; PAM type: NRG; PAM sequence: GGG
ataacacagtaccacagact

SEQ ID NO: 129177 - DNA, 20 bp, Artificial Sequence
  Description of Artificial Sequence: Synthetic oligonucleotide
  Target: ATXN1; (+) strand; PAM type: NRG; PAM sequence: GGG
taacacagtaccacagactg

SEQ ID NO: 129178 - DNA, 20 bp, Artificial Sequence
  Description of Artificial Sequence: Synthetic oligonucleotide
  Target: ATXN1; (+) strand; PAM type: NRG; PAM sequence: GGG
aacacagtaccacagactgg

SEQ ID NO: 129179 - DNA, 20 bp, Artificial Sequence
  Description of Artificial Sequence: Synthetic oligonucleotide
  Target: ATXN1; (+) strand; PAM type: NRG; PAM sequence: GGG
acacagtaccacagactggg

SEQ ID NO: 129180 - DNA, 20 bp, Artificial Sequence
  Description of Artificial Sequence: Synthetic oligonucleotide
  Target: ATXN1; (+) strand; PAM type: NRG; PAM sequence: TAG
agactggggggcttcaacaa

SEQ ID NO: 129181 - DNA, 20 bp, Artificial Sequence
  Description of Artificial Sequence: Synthetic oligonucleotide
  Target: ATXN1; (+) strand; PAM type: NRG; PAM sequence: CAG
aatagaaatgcattgtctta

SEQ ID NO: 129182 - DNA, 20 bp, Artificial Sequence
  Description of Artificial Sequence: Synthetic oligonucleotide
  Target: ATXN1; (+) strand; PAM type: NRG; PAM sequence: TGG
aatgcattgtcttacagtcc

SEQ ID NO: 129183 - DNA, 20 bp, Artificial Sequence
  Description of Artificial Sequence: Synthetic oligonucleotide
  Target: ATXN1; (+) strand; PAM type: NRG; PAM sequence: GAG
tgcattgtcttacagtcctg

SEQ ID NO: 129184 - DNA, 20 bp, Artificial Sequence
  Description of Artificial Sequence: Synthetic oligonucleotide
  Target: ATXN1; (+) strand; PAM type: NRG; PAM sequence: AGG
gcattgtcttacagtcctgg

SEQ ID NO: 129185 - DNA, 20 bp, Artificial Sequence
  Description of Artificial Sequence: Synthetic oligonucleotide
  Target: ATXN1; (+) strand; PAM type: NRG; PAM sequence: TAG
tgtcttacagtcctggaggc

SEQ ID NO: 129186 - DNA, 20 bp, Artificial Sequence
  Description of Artificial Sequence: Synthetic oligonucleotide
  Target: ATXN1; (+) strand; PAM type: NRG; PAM sequence: GAG
gtcctggaggctagaaatcc

SEQ ID NO: 129187 - DNA, 20 bp, Artificial Sequence
  Description of Artificial Sequence: Synthetic oligonucleotide
  Target: ATXN1; (+) strand; PAM type: NRG; PAM sequence: AAG
gaggctagaaatccgagatc

SEQ ID NO: 129188 - DNA, 20 bp, Artificial Sequence
  Description of Artificial Sequence: Synthetic oligonucleotide
  Target: ATXN1; (+) strand; PAM type: NRG; PAM sequence: AGG
aggctagaaatccgagatca

SEQ ID NO: 129189 - DNA, 20 bp, Artificial Sequence
  Description of Artificial Sequence: Synthetic oligonucleotide
  Target: ATXN1; (+) strand; PAM type: NRG; PAM sequence: CAG
atccgagatcaaggtgtctg

SEQ ID NO: 129190 - DNA, 20 bp, Artificial Sequence
  Description of Artificial Sequence: Synthetic oligonucleotide
  Target: ATXN1; (+) strand; PAM type: NRG; PAM sequence: AGG
tccgagatcaaggtgtctgc

SEQ ID NO: 129191 - DNA, 20 bp, Artificial Sequence
  Description of Artificial Sequence: Synthetic oligonucleotide
  Target: ATXN1; (+) strand; PAM type: NRG; PAM sequence: GGG
ccgagatcaaggtgtctgca

SEQ ID NO: 129192 - DNA, 20 bp, Artificial Sequence
  Description of Artificial Sequence: Synthetic oligonucleotide
  Target: ATXN1; (+) strand; PAM type: NRG; PAM sequence: TGG
gatcaaggtgtctgcagggc

SEQ ID NO: 129193 - DNA, 20 bp, Artificial Sequence
  Description of Artificial Sequence: Synthetic oligonucleotide
  Target: ATXN1; (+) strand; PAM type: NRG; PAM sequence: CAG
tctgcagggctggttccttc

SEQ ID NO: 129194 - DNA, 20 bp, Artificial Sequence
  Description of Artificial Sequence: Synthetic oligonucleotide
  Target: ATXN1; (+) strand; PAM type: NRG; PAM sequence: AGG
ctgcagggctggttccttcc

SEQ ID NO: 129195 - DNA, 20 bp, Artificial Sequence
  Description of Artificial Sequence: Synthetic oligonucleotide
  Target: ATXN1; (+) strand; PAM type: NRG; PAM sequence: GAG
gcagggctggttccttccag

SEQ ID NO: 129196 - DNA, 20 bp, Artificial Sequence
  Description of Artificial Sequence: Synthetic oligonucleotide
  Target: ATXN1; (+) strand; PAM type: NRG; PAM sequence: AGG
cagggctggttccttccagg

SEQ ID NO: 129197 - DNA, 20 bp, Artificial Sequence
  Description of Artificial Sequence: Synthetic oligonucleotide
  Target: ATXN1; (+) strand; PAM type: NRG; PAM sequence: AAG
ggttccttccaggaggtgca

SEQ ID NO: 129198 - DNA, 20 bp, Artificial Sequence
  Description of Artificial Sequence: Synthetic oligonucleotide
  Target: ATXN1; (+) strand; PAM type: NRG; PAM sequence: AGG
gttccttccaggaggtgcaa

SEQ ID NO: 129199 - DNA, 20 bp, Artificial Sequence
  Description of Artificial Sequence: Synthetic oligonucleotide
  Target: ATXN1; (+) strand; PAM type: NRG; PAM sequence: GAG
tccttccaggaggtgcaaag

SEQ ID NO: 129200 - DNA, 20 bp, Artificial Sequence
  Description of Artificial Sequence: Synthetic oligonucleotide
  Target: ATXN1; (+) strand; PAM type: NRG; PAM sequence: CAG
tctgttccatgcccctctcc

SEQ ID NO: 129201 - DNA, 20 bp, Artificial Sequence
  Description of Artificial Sequence: Synthetic oligonucleotide
  Target: ATXN1; (+) strand; PAM type: NRG; PAM sequence: TGG
catgcccctctcccagcttc

SEQ ID NO: 129202 - DNA, 20 bp, Artificial Sequence
  Description of Artificial Sequence: Synthetic oligonucleotide
  Target: ATXN1; (+) strand; PAM type: NRG; PAM sequence: TGG
gcccctctcccagcttctgg

SEQ ID NO: 129203 - DNA, 20 bp, Artificial Sequence
  Description of Artificial Sequence: Synthetic oligonucleotide
  Target: ATXN1; (+) strand; PAM type: NRG; PAM sequence: CGG
cccagcttctggtggctttc

SEQ ID NO: 129204 - DNA, 20 bp, Artificial Sequence
  Description of Artificial Sequence: Synthetic oligonucleotide
  Target: ATXN1; (+) strand; PAM type: NRG; PAM sequence: TGG
ggtggctttccggatatctt

SEQ ID NO: 129205 - DNA, 20 bp, Artificial Sequence
  Description of Artificial Sequence: Synthetic oligonucleotide
  Target: ATXN1; (+) strand; PAM type: NRG; PAM sequence: TGG
cggatatctttggtgtttct

SEQ ID NO: 129206 - DNA, 20 bp, Artificial Sequence
  Description of Artificial Sequence: Synthetic oligonucleotide
  Target: ATXN1; (+) strand; PAM type: NRG; PAM sequence: TGG
tctttggtgtttcttggctt

SEQ ID NO: 129207 - DNA, 20 bp, Artificial Sequence
  Description of Artificial Sequence: Synthetic oligonucleotide
  Target: ATXN1; (+) strand; PAM type: NRG; PAM sequence: GGG
ctttggtgtttcttggcttt

SEQ ID NO: 129208 - DNA, 20 bp, Artificial Sequence
  Description of Artificial Sequence: Synthetic oligonucleotide
  Target: ATXN1; (+) strand; PAM type: NRG; PAM sequence: CAG
tggtgtttcttggctttggg

SEQ ID NO: 129209 - DNA, 20 bp, Artificial Sequence
  Description of Artificial Sequence: Synthetic oligonucleotide
  Target: ATXN1; (+) strand; PAM type: NRG; PAM sequence: CAG
ggctttgggcagcataactc

SEQ ID NO: 129210 - DNA, 20 bp, Artificial Sequence
  Description of Artificial Sequence: Synthetic oligonucleotide
  Target: ATXN1; (+) strand; PAM type: NRG; PAM sequence: CGG
gcataactccagtctttaca

SEQ ID NO: 129211 - DNA, 20 bp, Artificial Sequence
  Description of Artificial Sequence: Synthetic oligonucleotide
  Target: ATXN1; (+) strand; PAM type: NRG; PAM sequence: TAG
ctccagtctttacacggtaa

SEQ ID NO: 129212 - DNA, 20 bp, Artificial Sequence
  Description of Artificial Sequence: Synthetic oligonucleotide
  Target: ATXN1; (+) strand; PAM type: NRG; PAM sequence: CAG
tctttacacggtaatagcct

SEQ ID NO: 129213 - DNA, 20 bp, Artificial Sequence
  Description of Artificial Sequence: Synthetic oligonucleotide
  Target: ATXN1; (+) strand; PAM type: NRG; PAM sequence: GAG
tttacacggtaatagcctca

SEQ ID NO: 129214 - DNA, 20 bp, Artificial Sequence
  Description of Artificial Sequence: Synthetic oligonucleotide
  Target: ATXN1; (+) strand; PAM type: NRG; PAM sequence: AGG
ttacacggtaatagcctcag

SEQ ID NO: 129215 - DNA, 20 bp, Artificial Sequence
  Description of Artificial Sequence: Synthetic oligonucleotide
  Target: ATXN1; (+) strand; PAM type: NRG; PAM sequence: GGG
tacacggtaatagcctcaga

SEQ ID NO: 129216 - DNA, 20 bp, Artificial Sequence
  Description of Artificial Sequence: Synthetic oligonucleotide
  Target: ATXN1; (+) strand; PAM type: NRG; PAM sequence: GAG
cacggtaatagcctcagagg

SEQ ID NO: 129217 - DNA, 20 bp, Artificial Sequence
  Description of Artificial Sequence: Synthetic oligonucleotide
  Target: ATXN1; (+) strand; PAM type: NRG; PAM sequence: AGG
acggtaatagcctcagaggg

SEQ ID NO: 129218 - DNA, 20 bp, Artificial Sequence
  Description of Artificial Sequence: Synthetic oligonucleotide
  Target: ATXN1; (+) strand; PAM type: NRG; PAM sequence: GAG
ctcagagggaggctatctct

SEQ ID NO: 129219 - DNA, 20 bp, Artificial Sequence
  Description of Artificial Sequence: Synthetic oligonucleotide
  Target: ATXN1; (+) strand; PAM type: NRG; PAM sequence: AAG
gggaggctatctctgagccc

SEQ ID NO: 129220 - DNA, 20 bp, Artificial Sequence
  Description of Artificial Sequence: Synthetic oligonucleotide
  Target: ATXN1; (+) strand; PAM type: NRG; PAM sequence: AAG
cccaagtttcccctttttac

SEQ ID NO: 129221 - DNA, 20 bp, Artificial Sequence
  Description of Artificial Sequence: Synthetic oligonucleotide
  Target: ATXN1; (+) strand; PAM type: NRG; PAM sequence: AGG
ccaagtttcccctttttaca

SEQ ID NO: 129222 - DNA, 20 bp, Artificial Sequence
  Description of Artificial Sequence: Synthetic oligonucleotide
  Target: ATXN1; (+) strand; PAM type: NRG; PAM sequence: GAG
aagtttcccctttttacaag

SEQ ID NO: 129223 - DNA, 20 bp, Artificial Sequence
  Description of Artificial Sequence: Synthetic oligonucleotide
  Target: ATXN1; (+) strand; PAM type: NRG; PAM sequence: GAG
tcccctttttacaaggagat

SEQ ID NO: 129224 - DNA, 20 bp, Artificial Sequence
  Description of Artificial Sequence: Synthetic oligonucleotide
  Target: ATXN1; (+) strand; PAM type: NRG; PAM sequence: CAG
tacaaggagatgagtcatat

SEQ ID NO: 129225 - DNA, 20 bp, Artificial Sequence
  Description of Artificial Sequence: Synthetic oligonucleotide
  Target: ATXN1; (+) strand; PAM type: NRG; PAM sequence: TAG
ggagatgagtcatatcagat

SEQ ID NO: 129226 - DNA, 20 bp, Artificial Sequence
  Description of Artificial Sequence: Synthetic oligonucleotide
  Target: ATXN1; (+) strand; PAM type: NRG; PAM sequence: GAG
agatgagtcatatcagatta

SEQ ID NO: 129227 - DNA, 20 bp, Artificial Sequence
  Description of Artificial Sequence: Synthetic oligonucleotide
  Target: ATXN1; (+) strand; PAM type: NRG; PAM sequence: TGG
ctaataacctcatctgaact

SEQ ID NO: 129228 - DNA, 20 bp, Artificial Sequence
  Description of Artificial Sequence: Synthetic oligonucleotide
  Target: ATXN1; (+) strand; PAM type: NRG; PAM sequence: AAG
gcaaaatctccttccaaata

SEQ ID NO: 129229 - DNA, 20 bp, Artificial Sequence
  Description of Artificial Sequence: Synthetic oligonucleotide
  Target: ATXN1; (+) strand; PAM type: NRG; PAM sequence: TGG
ccaaataaagccattgttca

SEQ ID NO: 129230 - DNA, 20 bp, Artificial Sequence
  Description of Artificial Sequence: Synthetic oligonucleotide
  Target: ATXN1; (+) strand; PAM type: NRG; PAM sequence: TGG
aagccattgttcatggacac

SEQ ID NO: 129231 - DNA, 20 bp, Artificial Sequence
  Description of Artificial Sequence: Synthetic oligonucleotide
  Target: ATXN1; (+) strand; PAM type: NRG; PAM sequence: GGG
agccattgttcatggacact

SEQ ID NO: 129232 - DNA, 20 bp, Artificial Sequence
  Description of Artificial Sequence: Synthetic oligonucleotide
  Target: ATXN1; (+) strand; PAM type: NRG; PAM sequence: GAG
ccattgttcatggacactgg

SEQ ID NO: 129233 - DNA, 20 bp, Artificial Sequence
  Description of Artificial Sequence: Synthetic oligonucleotide
  Target: ATXN1; (+) strand; PAM type: NRG; PAM sequence: AGG
cattgttcatggacactggg

SEQ ID NO: 129234 - DNA, 20 bp, Artificial Sequence
  Description of Artificial Sequence: Synthetic oligonucleotide
  Target: ATXN1; (+) strand; PAM type: NRG; PAM sequence: TAG
ttcatggacactgggaggtt

SEQ ID NO: 129235 - DNA, 20 bp, Artificial Sequence
  Description of Artificial Sequence: Synthetic oligonucleotide
  Target: ATXN1; (+) strand; PAM type: NRG; PAM sequence: TGG
ggtttagcctgtcaacattt

SEQ ID NO: 129236 - DNA, 20 bp, Artificial Sequence
  Description of Artificial Sequence: Synthetic oligonucleotide
  Target: ATXN1; (+) strand; PAM type: NRG; PAM sequence: TGG
ttagcctgtcaacattttgg

SEQ ID NO: 129237 - DNA, 20 bp, Artificial Sequence
  Description of Artificial Sequence: Synthetic oligonucleotide
  Target: ATXN1; (+) strand; PAM type: NRG; PAM sequence: GGG
tagcctgtcaacattttggt

SEQ ID NO: 129238 - DNA, 20 bp, Artificial Sequence
  Description of Artificial Sequence: Synthetic oligonucleotide
  Target: ATXN1; (+) strand; PAM type: NRG; PAM sequence: GGG
agcctgtcaacattttggtg

SEQ ID NO: 129239 - DNA, 20 bp, Artificial Sequence
  Description of Artificial Sequence: Synthetic oligonucleotide
  Target: ATXN1; (+) strand; PAM type: NRG; PAM sequence: GGG
gcctgtcaacattttggtgg

SEQ ID NO: 129240 - DNA, 20 bp, Artificial Sequence
  Description of Artificial Sequence: Synthetic oligonucleotide
  Target: ATXN1; (+) strand; PAM type: NRG; PAM sequence: CAG
caacattttggtgggggaca

SEQ ID NO: 129241 - DNA, 20 bp, Artificial Sequence
  Description of Artificial Sequence: Synthetic oligonucleotide
  Target: ATXN1; (+) strand; PAM type: NRG; PAM sequence: CAG
gtgggggacacagtttaaca

SEQ ID NO: 129242 - DNA, 20 bp, Artificial Sequence
  Description of Artificial Sequence: Synthetic oligonucleotide
  Target: ATXN1; (+) strand; PAM type: NRG; PAM sequence: CAG
tacctcctcatcctcaccta

SEQ ID NO: 129243 - DNA, 20 bp, Artificial Sequence
  Description of Artificial Sequence: Synthetic oligonucleotide
  Target: ATXN1; (+) strand; PAM type: NRG; PAM sequence: AGG
acctcctcatcctcacctac

SEQ ID NO: 129244 - DNA, 20 bp, Artificial Sequence
  Description of Artificial Sequence: Synthetic oligonucleotide
  Target: ATXN1; (+) strand; PAM type: NRG; PAM sequence: TGG
cctcacctacaggcatgtgt

SEQ ID NO: 129245 - DNA, 20 bp, Artificial Sequence
  Description of Artificial Sequence: Synthetic oligonucleotide
  Target: ATXN1; (+) strand; PAM type: NRG; PAM sequence: GGG
ctcacctacaggcatgtgtt

SEQ ID NO: 129246 - DNA, 20 bp, Artificial Sequence
  Description of Artificial Sequence: Synthetic oligonucleotide
  Target: ATXN1; (+) strand; PAM type: NRG; PAM sequence: TAG
acctacaggcatgtgttggg

SEQ ID NO: 129247 - DNA, 20 bp, Artificial Sequence
  Description of Artificial Sequence: Synthetic oligonucleotide
  Target: ATXN1; (+) strand; PAM type: NRG; PAM sequence: CGG
tacaggcatgtgttgggtag

SEQ ID NO: 129248 - DNA, 20 bp, Artificial Sequence
  Description of Artificial Sequence: Synthetic oligonucleotide
  Target: ATXN1; (+) strand; PAM type: NRG; PAM sequence: TGG
aggcatgtgttgggtagcgg

SEQ ID NO: 129249 - DNA, 20 bp, Artificial Sequence
  Description of Artificial Sequence: Synthetic oligonucleotide
  Target: ATXN1; (+) strand; PAM type: NRG; PAM sequence: GGG
ggcatgtgttgggtagcggt

SEQ ID NO: 129250 - DNA, 20 bp, Artificial Sequence
  Description of Artificial Sequence: Synthetic oligonucleotide
  Target: ATXN1; (+) strand; PAM type: NRG; PAM sequence: GAG
gtagcggtgggctatgctct

SEQ ID NO: 129251 - DNA, 20 bp, Artificial Sequence
  Description of Artificial Sequence: Synthetic oligonucleotide
  Target: ATXN1; (+) strand; PAM type: NRG; PAM sequence: TAG
attctgttgtgtgaacatcg

SEQ ID NO: 129252 - DNA, 20 bp, Artificial Sequence
  Description of Artificial Sequence: Synthetic oligonucleotide
  Target: ATXN1; (+) strand; PAM type: NRG; PAM sequence: GAG
tctgttgtgtgaacatcgta

SEQ ID NO: 129253 - DNA, 20 bp, Artificial Sequence
  Description of Artificial Sequence: Synthetic oligonucleotide
  Target: ATXN1; (+) strand; PAM type: NRG; PAM sequence: TAG
agagtctactcacacaaacc

SEQ ID NO: 129254 - DNA, 20 bp, Artificial Sequence
  Description of Artificial Sequence: Synthetic oligonucleotide
  Target: ATXN1; (+) strand; PAM type: NRG; PAM sequence: TGG
tctactcacacaaacctaga

SEQ ID NO: 129255 - DNA, 20 bp, Artificial Sequence
  Description of Artificial Sequence: Synthetic oligonucleotide
  Target: ATXN1; (+) strand; PAM type: NRG; PAM sequence: GGG
ctactcacacaaacctagat

SEQ ID NO: 129256 - DNA, 20 bp, Artificial Sequence
  Description of Artificial Sequence: Synthetic oligonucleotide
  Target: ATXN1; (+) strand; PAM type: NRG; PAM sequence: CAG
tcacacaaacctagatggga

SEQ ID NO: 129257 - DNA, 20 bp, Artificial Sequence
  Description of Artificial Sequence: Synthetic oligonucleotide
  Target: ATXN1; (+) strand; PAM type: NRG; PAM sequence: TAG
gggacagcctactacacatc

SEQ ID NO: 129258 - DNA, 20 bp, Artificial Sequence
  Description of Artificial Sequence: Synthetic oligonucleotide
  Target: ATXN1; (+) strand; PAM type: NRG; PAM sequence: AGG
ggacagcctactacacatct

SEQ ID NO: 129259 - DNA, 20 bp, Artificial Sequence
  Description of Artificial Sequence: Synthetic oligonucleotide
  Target: ATXN1; (+) strand; PAM type: NRG; PAM sequence: TGG
tactacacatctaggctaca

SEQ ID NO: 129260 - DNA, 20 bp, Artificial Sequence
  Description of Artificial Sequence: Synthetic oligonucleotide
  Target: ATXN1; (+) strand; PAM type: NRG; PAM sequence: CGG
tggtacaatgtattgcttcc

SEQ ID NO: 129261 - DNA, 20 bp, Artificial Sequence
  Description of Artificial Sequence: Synthetic oligonucleotide
  Target: ATXN1; (+) strand; PAM type: NRG; PAM sequence: CAG
tgatactgtactgaatactg

SEQ ID NO: 129262 - DNA, 20 bp, Artificial Sequence
  Description of Artificial Sequence: Synthetic oligonucleotide
  Target: ATXN1; (+) strand; PAM type: NRG; PAM sequence: AGG
gatactgtactgaatactgc

SEQ ID NO: 129263 - DNA, 20 bp, Artificial Sequence
  Description of Artificial Sequence: Synthetic oligonucleotide
  Target: ATXN1; (+) strand; PAM type: NRG; PAM sequence: TGG
tgcaggcaaatgtattacaa

SEQ ID NO: 129264 - DNA, 20 bp, Artificial Sequence
  Description of Artificial Sequence: Synthetic oligonucleotide
  Target: ATXN1; (+) strand; PAM type: NRG; PAM sequence: AAG
ggcaaatgtattacaatggt

SEQ ID NO: 129265 - DNA, 20 bp, Artificial Sequence
  Description of Artificial Sequence: Synthetic oligonucleotide
  Target: ATXN1; (+) strand; PAM type: NRG; PAM sequence: TAG
cattcaaacatacctaaata

SEQ ID NO: 129266 - DNA, 20 bp, Artificial Sequence
  Description of Artificial Sequence: Synthetic oligonucleotide
  Target: ATXN1; (+) strand; PAM type: NRG; PAM sequence: AAG
aaacatacctaaatatagaa

SEQ ID NO: 129267 - DNA, 20 bp, Artificial Sequence
  Description of Artificial Sequence: Synthetic oligonucleotide
  Target: ATXN1; (+) strand; PAM type: NRG; PAM sequence: CAG
acctaaatatagaaaagata

SEQ ID NO: 129268 - DNA, 20 bp, Artificial Sequence
  Description of Artificial Sequence: Synthetic oligonucleotide
  Target: ATXN1; (+) strand; PAM type: NRG; PAM sequence: AAG
gaaaagatacagtcaaaatg

SEQ ID NO: 129269 - DNA, 20 bp, Artificial Sequence
  Description of Artificial Sequence: Synthetic oligonucleotide
  Target: ATXN1; (+) strand; PAM type: NRG; PAM sequence: CAG
aagatacagtcaaaatgaag

SEQ ID NO: 129270 - DNA, 20 bp, Artificial Sequence
  Description of Artificial Sequence: Synthetic oligonucleotide
  Target: ATXN1; (+) strand; PAM type: NRG; PAM sequence: AAG
acagtcaaaatgaagcagaa

SEQ ID NO: 129271 - DNA, 20 bp, Artificial Sequence
  Description of Artificial Sequence: Synthetic oligonucleotide
  Target: ATXN1; (+) strand; PAM type: NRG; PAM sequence: TGG
gaagcagaaaagataaaata

SEQ ID NO: 129272 - DNA, 20 bp, Artificial Sequence
  Description of Artificial Sequence: Synthetic oligonucleotide
  Target: ATXN1; (+) strand; PAM type: NRG; PAM sequence: TAG
taaaatatggtacacctgta

SEQ ID NO: 129273 - DNA, 20 bp, Artificial Sequence
  Description of Artificial Sequence: Synthetic oligonucleotide
  Target: ATXN1; (+) strand; PAM type: NRG; PAM sequence: AGG
aaaatatggtacacctgtat

SEQ ID NO: 129274 - DNA, 20 bp, Artificial Sequence
  Description of Artificial Sequence: Synthetic oligonucleotide
  Target: ATXN1; (+) strand; PAM type: NRG; PAM sequence: GGG
aaatatggtacacctgtata

SEQ ID NO: 129275 - DNA, 20 bp, Artificial Sequence
  Description of Artificial Sequence: Synthetic oligonucleotide
  Target: ATXN1; (+) strand; PAM type: NRG; PAM sequence: TGG
tatagggcacttcccatgaa

SEQ ID NO: 129276 - DNA, 20 bp, Artificial Sequence
  Description of Artificial Sequence: Synthetic oligonucleotide
  Target: ATXN1; (+) strand; PAM type: NRG; PAM sequence: GAG
tagggcacttcccatgaatg

SEQ ID NO: 129277 - DNA, 20 bp, Artificial Sequence
  Description of Artificial Sequence: Synthetic oligonucleotide
  Target: ATXN1; (+) strand; PAM type: NRG; PAM sequence: CAG
cttcccatgaatggagcttg

SEQ ID NO: 129278 - DNA, 20 bp, Artificial Sequence
  Description of Artificial Sequence: Synthetic oligonucleotide
  Target: ATXN1; (+) strand; PAM type: NRG; PAM sequence: AGG
ttcccatgaatggagcttgc

SEQ ID NO: 129279 - DNA, 20 bp, Artificial Sequence
  Description of Artificial Sequence: Synthetic oligonucleotide
  Target: ATXN1; (+) strand; PAM type: NRG; PAM sequence: TGG
atgaatggagcttgcaggat

SEQ ID NO: 129280 - DNA, 20 bp, Artificial Sequence
  Description of Artificial Sequence: Synthetic oligonucleotide
  Target: ATXN1; (+) strand; PAM type: NRG; PAM sequence: AAG
aatggagcttgcaggattgg

SEQ ID NO: 129281 - DNA, 20 bp, Artificial Sequence
  Description of Artificial Sequence: Synthetic oligonucleotide
  Target: ATXN1; (+) strand; PAM type: NRG; PAM sequence: TGG
tgcaggattggaagttgctc

SEQ ID NO: 129282 - DNA, 20 bp, Artificial Sequence
  Description of Artificial Sequence: Synthetic oligonucleotide
  Target: ATXN1; (+) strand; PAM type: NRG; PAM sequence: GGG
gcaggattggaagttgctct

SEQ ID NO: 129283 - DNA, 20 bp, Artificial Sequence
  Description of Artificial Sequence: Synthetic oligonucleotide
  Target: ATXN1; (+) strand; PAM type: NRG; PAM sequence: GAG
gattggaagttgctctgggt

SEQ ID NO: 129284 - DNA, 20 bp, Artificial Sequence
  Description of Artificial Sequence: Synthetic oligonucleotide
  Target: ATXN1; (+) strand; PAM type: NRG; PAM sequence: CAG
ggaagttgctctgggtgagt

SEQ ID NO: 129285 - DNA, 20 bp, Artificial Sequence
  Description of Artificial Sequence: Synthetic oligonucleotide
  Target: ATXN1; (+) strand; PAM type: NRG; PAM sequence: GAG
gttgctctgggtgagtcagt

SEQ ID NO: 129286 - DNA, 20 bp, Artificial Sequence
  Description of Artificial Sequence: Synthetic oligonucleotide
  Target: ATXN1; (+) strand; PAM type: NRG; PAM sequence: TGG
gctctgggtgagtcagtgag

SEQ ID NO: 129287 - DNA, 20 bp, Artificial Sequence
  Description of Artificial Sequence: Synthetic oligonucleotide
  Target: ATXN1; (+) strand; PAM type: NRG; PAM sequence: GGG
ctctgggtgagtcagtgagt

SEQ ID NO: 129288 - DNA, 20 bp, Artificial Sequence
  Description of Artificial Sequence: Synthetic oligonucleotide
  Target: ATXN1; (+) strand; PAM type: NRG; PAM sequence: TGG
tgggtgagtcagtgagtggg

SEQ ID NO: 129289 - DNA, 20 bp, Artificial Sequence
  Description of Artificial Sequence: Synthetic oligonucleotide
  Target: ATXN1; (+) strand; PAM type: NRG; PAM sequence: GAG
tgagtcagtgagtgggtggt

SEQ ID NO: 129290 - DNA, 20 bp, Artificial Sequence
  Description of Artificial Sequence: Synthetic oligonucleotide
  Target: ATXN1; (+) strand; PAM type: NRG; PAM sequence: AAG
gtgggtggtgagcgaatgtg

SEQ ID NO: 129291 - DNA, 20 bp, Artificial Sequence
  Description of Artificial Sequence: Synthetic oligonucleotide
  Target: ATXN1; (+) strand; PAM type: NRG; PAM sequence: AGG
tgggtggtgagcgaatgtga

SEQ ID NO: 129292 - DNA, 20 bp, Artificial Sequence
  Description of Artificial Sequence: Synthetic oligonucleotide
  Target: ATXN1; (+) strand; PAM type: NRG; PAM sequence: TAG
ggtgagcgaatgtgaaggcc

SEQ ID NO: 129293 - DNA, 20 bp, Artificial Sequence
  Description of Artificial Sequence: Synthetic oligonucleotide
  Target: ATXN1; (+) strand; PAM type: NRG; PAM sequence: AGG
gtgagcgaatgtgaaggcct

SEQ ID NO: 129294 - DNA, 20 bp, Artificial Sequence
  Description of Artificial Sequence: Synthetic oligonucleotide
  Target: ATXN1; (+) strand; PAM type: NRG; PAM sequence: CAG
gacattactgtacactactg

SEQ ID NO: 129295 - DNA, 20 bp, Artificial Sequence
  Description of Artificial Sequence: Synthetic oligonucleotide
  Target: ATXN1; (+) strand; PAM type: NRG; PAM sequence: TAG
ttataaacactgtatacact

SEQ ID NO: 129296 - DNA, 20 bp, Artificial Sequence
  Description of Artificial Sequence: Synthetic oligonucleotide
  Target: ATXN1; (+) strand; PAM type: NRG; PAM sequence: AGG
tataaacactgtatacactt

SEQ ID NO: 129297 - DNA, 20 bp, Artificial Sequence
  Description of Artificial Sequence: Synthetic oligonucleotide
  Target: ATXN1; (+) strand; PAM type: NRG; PAM sequence: TAG
cttcaataataaattaaact

SEQ ID NO: 129298 - DNA, 20 bp, Artificial Sequence
  Description of Artificial Sequence: Synthetic oligonucleotide
  Target: ATXN1; (+) strand; PAM type: NRG; PAM sequence: TAG
tcgactcttgtaataatact

SEQ ID NO: 129299 - DNA, 20 bp, Artificial Sequence
  Description of Artificial Sequence: Synthetic oligonucleotide
  Target: ATXN1; (+) strand; PAM type: NRG; PAM sequence: AAG
ttaaaacatcatccacttta

SEQ ID NO: 129300 - DNA, 20 bp, Artificial Sequence
  Description of Artificial Sequence: Synthetic oligonucleotide
  Target: ATXN1; (+) strand; PAM type: NRG; PAM sequence: AAG
tttttttttaaaacaatact

SEQ ID NO: 129301 - DNA, 20 bp, Artificial Sequence
  Description of Artificial Sequence: Synthetic oligonucleotide
  Target: ATXN1; (+) strand; PAM type: NRG; PAM sequence: AGG
ttttttttaaaacaatacta

SEQ ID NO: 129302 - DNA, 20 bp, Artificial Sequence
  Description of Artificial Sequence: Synthetic oligonucleotide
  Target: ATXN1; (+) strand; PAM type: NRG; PAM sequence: CAG
tttttaaaacaatactaagg

SEQ ID NO: 129303 - DNA, 20 bp, Artificial Sequence
  Description of Artificial Sequence: Synthetic oligonucleotide
  Target: ATXN1; (+) strand; PAM type: NRG; PAM sequence: AGG
ttttaaaacaatactaaggc

SEQ ID NO: 129304 - DNA, 20 bp, Artificial Sequence
  Description of Artificial Sequence: Synthetic oligonucleotide
  Target: ATXN1; (+) strand; PAM type: NRG; PAM sequence: GAG
ttaaaacaatactaaggcag

SEQ ID NO: 129305 - DNA, 20 bp, Artificial Sequence
  Description of Artificial Sequence: Synthetic oligonucleotide
  Target: ATXN1; (+) strand; PAM type: NRG; PAM sequence: CAG
aaacaatactaaggcaggag

SEQ ID NO: 129306 - DNA, 20 bp, Artificial Sequence
  Description of Artificial Sequence: Synthetic oligonucleotide
  Target: ATXN1; (+) strand; PAM type: NRG; PAM sequence: TGG
caatactaaggcaggagcag

SEQ ID NO: 129307 - DNA, 20 bp, Artificial Sequence
  Description of Artificial Sequence: Synthetic oligonucleotide
  Target: ATXN1; (+) strand; PAM type: NRG; PAM sequence: CAG
gtggtgcacacctgtaatcc

SEQ ID NO: 129308 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatcccagcactt

SEQ ID NO: 129309 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccagcacttt

SEQ ID NO: 129310 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 129311 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 129312 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggcc

SEQ ID NO: 129313 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggccg

SEQ ID NO: 129314 - DNA, 20 bp, Artificial Sequence
  Description of Artificial Sequence: Synthetic oligonucleotide
  Target: ATXN1; (+) strand; PAM type: NRG; PAM sequence: CGG
agcactttgggaggccgagg

SEQ ID NO: 129315 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccgaggc

SEQ ID NO: 129316 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccgaggcggg

SEQ ID NO: 129317 - DNA, 20 bp, Artificial Sequence
  Description of Artificial Sequence: Synthetic oligonucleotide
  Target: ATXN1; (+) strand; PAM type: NRG; PAM sequence: GAG
ccgaggcgggtggattgctt

SEQ ID NO: 129318 - DNA, 20 bp, Artificial Sequence
  Description of Artificial Sequence: Synthetic oligonucleotide
  Target: ATXN1; (+) strand; PAM type: NRG; PAM sequence: AGG
cgaggcgggtggattgcttg

SEQ ID NO: 129319 - DNA, 20 bp, Artificial Sequence
  Description of Artificial Sequence: Synthetic oligonucleotide
  Target: ATXN1; (+) strand; PAM type: NRG; PAM sequence: CAG
gcgggtggattgcttgaggc

SEQ ID NO: 129320 - DNA, 20 bp, Artificial Sequence
  Description of Artificial Sequence: Synthetic oligonucleotide
  Target: ATXN1; (+) strand; PAM type: NRG; PAM sequence: AGG
cgggtggattgcttgaggcc

SEQ ID NO: 129321 - DNA, 20 bp, Artificial Sequence
  Description of Artificial Sequence: Synthetic oligonucleotide
  Target: ATXN1; (+) strand; PAM type: NRG; PAM sequence: GAG
ggtggattgcttgaggccag

SEQ ID NO: 129322 - DNA, 20 bp, Artificial Sequence
  Description of Artificial Sequence: Synthetic oligonucleotide
  Target: ATXN1; (+) strand; PAM type: NRG; PAM sequence: GAG
ttgcttgaggccaggagttt

SEQ ID NO: 129323 - DNA, 20 bp, Artificial Sequence
  Description of Artificial Sequence: Synthetic oligonucleotide
  Target: ATXN1; (+) strand; PAM type: NRG; PAM sequence: CAG
tgaggccaggagtttgagac

SEQ ID NO: 129324 - DNA, 20 bp, Artificial Sequence
  Description of Artificial Sequence: Synthetic oligonucleotide
  Target: ATXN1; (+) strand; PAM type: NRG; PAM sequence: CAG
tttgagaccagcctgaccaa

SEQ ID NO: 129325 - DNA, 20 bp, Artificial Sequence
  Description of Artificial Sequence: Synthetic oligonucleotide
  Target: ATXN1; (+) strand; PAM type: NRG; PAM sequence: GAG
tgagaccagcctgaccaaca

SEQ ID NO: 129326 - DNA, 20 bp, Artificial Sequence
  Description of Artificial Sequence: Synthetic oligonucleotide
  Target: ATXN1; (+) strand; PAM type: NRG; PAM sequence: TAG
tctgctaaaaatacaaaaat

SEQ ID NO: 129327 - DNA, 20 bp, Artificial Sequence
  Description of Artificial Sequence: Synthetic oligonucleotide
  Target: ATXN1; (+) strand; PAM type: NRG; PAM sequence: CGG
ctaaaaatacaaaaattagc

SEQ ID NO: 129328 - DNA, 20 bp, Artificial Sequence
  Description of Artificial Sequence: Synthetic oligonucleotide
  Target: ATXN1; (+) strand; PAM type: NRG; PAM sequence: TGG
aatacaaaaattagccggcg

SEQ ID NO: 129329 - DNA, 20 bp, Artificial Sequence
  Description of Artificial Sequence: Synthetic oligonucleotide
  Target: ATXN1; (+) strand; PAM type: NRG; PAM sequence: TGG
acaaaaattagccggcgtgg

SEQ ID NO: 129330 - DNA, 20 bp, Artificial Sequence
  Description of Artificial Sequence: Synthetic oligonucleotide
  Target: ATXN1; (+) strand; PAM type: NRG; PAM sequence: CAG
gtggtgcatgcctgtaatcc

SEQ ID NO: 129331 - DNA, 20 bp, Artificial Sequence
  Description of Artificial Sequence: Synthetic oligonucleotide
  Target: ATXN1; (+) strand; PAM type: NRG; PAM sequence: CAG
tgcctgtaatcccagctact

SEQ ID NO: 129332 - DNA, 20 bp, Artificial Sequence
  Description of Artificial Sequence: Synthetic oligonucleotide
  Target: ATXN1; (+) strand; PAM type: NRG; PAM sequence: AGG
gcctgtaatcccagctactc

SEQ ID NO: 129333 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctactcag

SEQ ID NO: 129334 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctactcagg

SEQ ID NO: 129335 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcaggaggct

SEQ ID NO: 129336 - DNA, 20 bp, Artificial Sequence
  Description of Artificial Sequence: Synthetic oligonucleotide
  Target: ATXN1; (+) strand; PAM type: NRG; PAM sequence: AGG
cccagctactcaggaggctg

SEQ ID NO: 129337 - DNA, 20 bp, Artificial Sequence
  Description of Artificial Sequence: Synthetic oligonucleotide
  Target: ATXN1; (+) strand; PAM type: NRG; PAM sequence: CAG
agctactcaggaggctgagg

SEQ ID NO: 129338 - DNA, 20 bp, Artificial Sequence
  Description of Artificial Sequence: Synthetic oligonucleotide
  Target: ATXN1; (+) strand; PAM type: NRG; PAM sequence: AGG
gctactcaggaggctgaggc

SEQ ID NO: 129339 - DNA, 20 bp, Artificial Sequence
  Description of Artificial Sequence: Synthetic oligonucleotide
  Target: ATXN1; (+) strand; PAM type: NRG; PAM sequence: GAG
tactcaggaggctgaggcag

SEQ ID NO: 129340 - DNA, 20 bp, Artificial Sequence
  Description of Artificial Sequence: Synthetic oligonucleotide
  Target: ATXN1; (+) strand; PAM type: NRG; PAM sequence: TGG
aggaggctgaggcaggagaa

SEQ ID NO: 129341 - DNA, 20 bp, Artificial Sequence
  Description of Artificial Sequence: Synthetic oligonucleotide
  Target: ATXN1; (+) strand; PAM type: NRG; PAM sequence: CAG
gcaggagaatggcttgaacc

SEQ ID NO: 129342 - DNA, 20 bp, Artificial Sequence
  Description of Artificial Sequence: Synthetic oligonucleotide
  Target: ATXN1; (+) strand; PAM type: NRG; PAM sequence: AGG
caggagaatggcttgaaccc

SEQ ID NO: 129343 - DNA, 20 bp, Artificial Sequence
  Description of Artificial Sequence: Synthetic oligonucleotide
  Target: ATXN1; (+) strand; PAM type: NRG; PAM sequence: GAG
ggagaatggcttgaacccag

SEQ ID NO: 129344 - DNA, 20 bp, Artificial Sequence
  Description of Artificial Sequence: Synthetic oligonucleotide
  Target: ATXN1; (+) strand; PAM type: NRG; PAM sequence: AGG
gagaatggcttgaacccagg

SEQ ID NO: 129345 - DNA, 20 bp, Artificial Sequence
  Description of Artificial Sequence: Synthetic oligonucleotide
  Target: ATXN1; (+) strand; PAM type: NRG; PAM sequence: CAG
aatggcttgaacccaggagg

SEQ ID NO: 129346 - DNA, 20 bp, Artificial Sequence
  Description of Artificial Sequence: Synthetic oligonucleotide
  Target: ATXN1; (+) strand; PAM type: NRG; PAM sequence: GAG
tggcttgaacccaggaggca

SEQ ID NO: 129347 - DNA, 20 bp, Artificial Sequence
  Description of Artificial Sequence: Synthetic oligonucleotide
  Target: ATXN1; (+) strand; PAM type: NRG; PAM sequence: AGG
ggcttgaacccaggaggcag

SEQ ID NO: 129348 - DNA, 20 bp, Artificial Sequence
  Description of Artificial Sequence: Synthetic oligonucleotide
  Target: ATXN1; (+) strand; PAM type: NRG; PAM sequence: CAG
aacccaggaggcagaggttg

SEQ ID NO: 129349 - DNA, 20 bp, Artificial Sequence
  Description of Artificial Sequence: Synthetic oligonucleotide
  Target: ATXN1; (+) strand; PAM type: NRG; PAM sequence: GAG
caggaggcagaggttgcagt

SEQ ID NO: 129350 - DNA, 20 bp, Artificial Sequence
  Description of Artificial Sequence: Synthetic oligonucleotide
  Target: ATXN1; (+) strand; PAM type: NRG; PAM sequence: CAG
gaggcagaggttgcagtgag

SEQ ID NO: 129351 - DNA, 20 bp, Artificial Sequence
  Description of Artificial Sequence: Synthetic oligonucleotide
  Target: ATXN1; (+) strand; PAM type: NRG; PAM sequence: GAG
ggcagaggttgcagtgagca

SEQ ID NO: 129352 - DNA, 20 bp, Artificial Sequence
  Description of Artificial Sequence: Synthetic oligonucleotide
  Target: ATXN1; (+) strand; PAM type: NRG; PAM sequence: CAG
gagattgcaccactgcactc

SEQ ID NO: 129353 - DNA, 20 bp, Artificial Sequence
  Description of Artificial Sequence: Synthetic oligonucleotide
  Target: ATXN1; (+) strand; PAM type: NRG; PAM sequence: TGG
tgcaccactgcactccagcc

SEQ ID NO: 129354 - DNA, 20 bp, Artificial Sequence
  Description of Artificial Sequence: Synthetic oligonucleotide
  Target: ATXN1; (+) strand; PAM type: NRG; PAM sequence: GGG
gcaccactgcactccagcct

SEQ ID NO: 129355 - DNA, 20 bp, Artificial Sequence
  Description of Artificial Sequence: Synthetic oligonucleotide
  Target: ATXN1; (+) strand; PAM type: NRG; PAM sequence: AAG
gcactccagcctgggcgaca

SEQ ID NO: 129356 - DNA, 20 bp, Artificial Sequence
  Description of Artificial Sequence: Synthetic oligonucleotide
  Target: ATXN1; (+) strand; PAM type: NRG; PAM sequence: AAG
tccagcctgggcgacaaagt

SEQ ID NO: 129357 - DNA, 20 bp, Artificial Sequence
  Description of Artificial Sequence: Synthetic oligonucleotide
  Target: ATXN1; (+) strand; PAM type: NRG; PAM sequence: AGG
ccagcctgggcgacaaagta

SEQ ID NO: 129358 - DNA, 20 bp, Artificial Sequence
  Description of Artificial Sequence: Synthetic oligonucleotide
  Target: ATXN1; (+) strand; PAM type: NRG; PAM sequence: TAG
taaataaataaatacataaa

SEQ ID NO: 129359 - DNA, 20 bp, Artificial Sequence
  Description of Artificial Sequence: Synthetic oligonucleotide
  Target: ATXN1; (+) strand; PAM type: NRG; PAM sequence: AAG
agcaaacaaaataaaatact

SEQ ID NO: 129360 - DNA, 20 bp, Artificial Sequence
  Description of Artificial Sequence: Synthetic oligonucleotide
  Target: ATXN1; (+) strand; PAM type: NRG; PAM sequence: TAG
actaagaaacaaacacgcat

SEQ ID NO: 129361 - DNA, 20 bp, Artificial Sequence
  Description of Artificial Sequence: Synthetic oligonucleotide
  Target: ATXN1; (+) strand; PAM type: NRG; PAM sequence: TAG
gaaacaaacacgcattagtc

SEQ ID NO: 129362 - DNA, 20 bp, Artificial Sequence
  Description of Artificial Sequence: Synthetic oligonucleotide
  Target: ATXN1; (+) strand; PAM type: NRG; PAM sequence: AGG
aaacaaacacgcattagtct

SEQ ID NO: 129363 - DNA, 20 bp, Artificial Sequence
  Description of Artificial Sequence: Synthetic oligonucleotide
  Target: ATXN1; (+) strand; PAM type: NRG; PAM sequence: CAG
cgcattagtctaggcctata

SEQ ID NO: 129364 - DNA, 20 bp, Artificial Sequence
  Description of Artificial Sequence: Synthetic oligonucleotide
  Target: ATXN1; (+) strand; PAM type: NRG; PAM sequence: AGG
gcattagtctaggcctatac

SEQ ID NO: 129365 - DNA, 20 bp, Artificial Sequence
  Description of Artificial Sequence: Synthetic oligonucleotide
  Target: ATXN1; (+) strand; PAM type: NRG; PAM sequence: GGG
cattagtctaggcctataca

SEQ ID NO: 129366 - DNA, 20 bp, Artificial Sequence
  Description of Artificial Sequence: Synthetic oligonucleotide
  Target: ATXN1; (+) strand; PAM type: NRG; PAM sequence: CAG
agtctaggcctatacagggt

SEQ ID NO: 129367 - DNA, 20 bp, Artificial Sequence
  Description of Artificial Sequence: Synthetic oligonucleotide
  Target: ATXN1; (+) strand; PAM type: NRG; PAM sequence: AGG
gtctaggcctatacagggtc

SEQ ID NO: 129368 - DNA, 20 bp, Artificial Sequence
  Description of Artificial Sequence: Synthetic oligonucleotide
  Target: ATXN1; (+) strand; PAM type: NRG; PAM sequence: GAG
cctccacatcttgtcccact

SEQ ID NO: 129369 - DNA, 20 bp, Artificial Sequence
  Description of Artificial Sequence: Synthetic oligonucleotide
  Target: ATXN1; (+) strand; PAM type: NRG; PAM sequence: GAG
tccacatcttgtcccactga

SEQ ID NO: 129370 - DNA, 20 bp, Artificial Sequence
  Description of Artificial Sequence: Synthetic oligonucleotide
  Target: ATXN1; (+) strand; PAM type: NRG; PAM sequence: AGG
ccacatcttgtcccactgag

SEQ ID NO: 129371 - DNA, 20 bp, Artificial Sequence
  Description of Artificial Sequence: Synthetic oligonucleotide
  Target: ATXN1; (+) strand; PAM type: NRG; PAM sequence: CAG
ttgtcccactgagaggtctt

SEQ ID NO: 129372 - DNA, 20 bp, Artificial Sequence
  Description of Artificial Sequence: Synthetic oligonucleotide
  Target: ATXN1; (+) strand; PAM type: NRG; PAM sequence: AGG
tgtcccactgagaggtcttc

SEQ ID NO: 129373 - DNA, 20 bp, Artificial Sequence
  Description of Artificial Sequence: Synthetic oligonucleotide
  Target: ATXN1; (+) strand; PAM type: NRG; PAM sequence: GGG
gtcccactgagaggtcttca

SEQ ID NO: 129374 - DNA, 20 bp, Artificial Sequence
  Description of Artificial Sequence: Synthetic oligonucleotide
  Target: ATXN1; (+) strand; PAM type: NRG; PAM sequence: TGG
cttcagggcaataacacaca

SEQ ID NO: 129375 - DNA, 20 bp, Artificial Sequence
  Description of Artificial Sequence: Synthetic oligonucleotide
  Target: ATXN1; (+) strand; PAM type: NRG; PAM sequence: CAG
cctgtcatctcctatgacaa

SEQ ID NO: 129376 - DNA, 20 bp, Artificial Sequence
  Description of Artificial Sequence: Synthetic oligonucleotide
  Target: ATXN1; (+) strand; PAM type: NRG; PAM sequence: TGG
gccttcttcttacacatcta

SEQ ID NO: 129377 - DNA, 20 bp, Artificial Sequence
  Description of Artificial Sequence: Synthetic oligonucleotide
  Target: ATXN1; (+) strand; PAM type: NRG; PAM sequence: AAG
ttcttcttacacatctatgg

SEQ ID NO: 129378 - DNA, 20 bp, Artificial Sequence
  Description of Artificial Sequence: Synthetic oligonucleotide
  Target: ATXN1; (+) strand; PAM type: NRG; PAM sequence: AGG
tcttcttacacatctatgga

SEQ ID NO: 129379 - DNA, 20 bp, Artificial Sequence
  Description of Artificial Sequence: Synthetic oligonucleotide
  Target: ATXN1; (+) strand; PAM type: NRG; PAM sequence: AAG
tctatggaaggacctgcctg

SEQ ID NO: 129380 - DNA, 20 bp, Artificial Sequence
  Description of Artificial Sequence: Synthetic oligonucleotide
  Target: ATXN1; (+) strand; PAM type: NRG; PAM sequence: TGG
tggaaggacctgcctgaagt

SEQ ID NO: 129381 - DNA, 20 bp, Artificial Sequence
  Description of Artificial Sequence: Synthetic oligonucleotide
  Target: ATXN1; (+) strand; PAM type: NRG; PAM sequence: CAG
acctgcctgaagttggtttg

SEQ ID NO: 129382 - DNA, 20 bp, Artificial Sequence
  Description of Artificial Sequence: Synthetic oligonucleotide
  Target: ATXN1; (+) strand; PAM type: NRG; PAM sequence: AAG
taacttttttttttttaaat

SEQ ID NO: 129383 - DNA, 20 bp, Artificial Sequence
  Description of Artificial Sequence: Synthetic oligonucleotide
  Target: ATXN1; (+) strand; PAM type: NRG; PAM sequence: TAG
cttttttttttttaaataag

SEQ ID NO: 129384 - DNA, 20 bp, Artificial Sequence
  Description of Artificial Sequence: Synthetic oligonucleotide
  Target: ATXN1; (+) strand; PAM type: NRG; PAM sequence: AAG
ttttttttttaaataagtag

SEQ ID NO: 129385 - DNA, 20 bp, Artificial Sequence
  Description of Artificial Sequence: Synthetic oligonucleotide
  Target: ATXN1; (+) strand; PAM type: NRG; PAM sequence: CAG
ttaaataagtagaagaaata

SEQ ID NO: 129386 - DNA, 20 bp, Artificial Sequence
  Description of Artificial Sequence: Synthetic oligonucleotide
  Target: ATXN1; (+) strand; PAM type: NRG; PAM sequence: AAG
cagtctaaaacaatgatcaa

SEQ ID NO: 129387 - DNA, 20 bp, Artificial Sequence
  Description of Artificial Sequence: Synthetic oligonucleotide
  Target: ATXN1; (+) strand; PAM type: NRG; PAM sequence: TAG
taaaacaatgatcaaaagta

SEQ ID NO: 129388 - DNA, 20 bp, Artificial Sequence
  Description of Artificial Sequence: Synthetic oligonucleotide
  Target: ATXN1; (+) strand; PAM type: NRG; PAM sequence: TAG
caatgatcaaaagtatagta

SEQ ID NO: 129389 - DNA, 20 bp, Artificial Sequence
  Description of Artificial Sequence: Synthetic oligonucleotide
  Target: ATXN1; (+) strand; PAM type: NRG; PAM sequence: AAG
gatcaaaagtatagtatagt

SEQ ID NO: 129390 - DNA, 20 bp, Artificial Sequence
  Description of Artificial Sequence: Synthetic oligonucleotide
  Target: ATXN1; (+) strand; PAM type: NRG; PAM sequence: CAG
gtaagtgcataaaccaataa

SEQ ID NO: 129391 - DNA, 20 bp, Artificial Sequence
  Description of Artificial Sequence: Synthetic oligonucleotide
  Target: ATXN1; (+) strand; PAM type: NRG; PAM sequence: AAG
agttgtttattaccattatc

SEQ ID NO: 129392 - DNA, 20 bp, Artificial Sequence
  Description of Artificial Sequence: Synthetic oligonucleotide
  Target: ATXN1; (+) strand; PAM type: NRG; PAM sequence: TGG
gtgctctactcttacatgac

SEQ ID NO: 129393 - DNA, 20 bp, Artificial Sequence
  Description of Artificial Sequence: Synthetic oligonucleotide
  Target: ATXN1; (+) strand; PAM type: NRG; PAM sequence: CAG
ctctactcttacatgactgg

SEQ ID NO: 129394 - DNA, 20 bp, Artificial Sequence
  Description of Artificial Sequence: Synthetic oligonucleotide
  Target: ATXN1; (+) strand; PAM type: NRG; PAM sequence: CAG
ctcttacatgactggcagca

SEQ ID NO: 129395 - DNA, 20 bp, Artificial Sequence
  Description of Artificial Sequence: Synthetic oligonucleotide
  Target: ATXN1; (+) strand; PAM type: NRG; PAM sequence: TAG
ttacatgactggcagcacag

SEQ ID NO: 129396 - DNA, 20 bp, Artificial Sequence
  Description of Artificial Sequence: Synthetic oligonucleotide
  Target: ATXN1; (+) strand; PAM type: NRG; PAM sequence: AGG
tacatgactggcagcacagt

SEQ ID NO: 129397 - DNA, 20 bp, Artificial Sequence
  Description of Artificial Sequence: Synthetic oligonucleotide
  Target: ATXN1; (+) strand; PAM type: NRG; PAM sequence: GGG
acatgactggcagcacagta

SEQ ID NO: 129398 - DNA, 20 bp, Artificial Sequence
  Description of Artificial Sequence: Synthetic oligonucleotide
  Target: ATXN1; (+) strand; PAM type: NRG; PAM sequence: CAG
ctggcagcacagtagggttg

SEQ ID NO: 129399 - DNA, 20 bp, Artificial Sequence
  Description of Artificial Sequence: Synthetic oligonucleotide
  Target: ATXN1; (+) strand; PAM type: NRG; PAM sequence: CAG
acagtagggttgcagcatca

SEQ ID NO: 129400 - DNA, 20 bp, Artificial Sequence
  Description of Artificial Sequence: Synthetic oligonucleotide
  Target: ATXN1; (+) strand; PAM type: NRG; PAM sequence: GAG
cagcatcacagcaaacatat

SEQ ID NO: 129401 - DNA, 20 bp, Artificial Sequence
  Description of Artificial Sequence: Synthetic oligonucleotide
  Target: ATXN1; (+) strand; PAM type: NRG; PAM sequence: GAG
acagcaaacatatgagtaat

SEQ ID NO: 129402 - DNA, 20 bp, Artificial Sequence
  Description of Artificial Sequence: Synthetic oligonucleotide
  Target: ATXN1; (+) strand; PAM type: NRG; PAM sequence: TAG
atatgagtaatgagttgcac

SEQ ID NO: 129403 - DNA, 20 bp, Artificial Sequence
  Description of Artificial Sequence: Synthetic oligonucleotide
  Target: ATXN1; (+) strand; PAM type: NRG; PAM sequence: AGG
tatgagtaatgagttgcact

SEQ ID NO: 129404 - DNA, 20 bp, Artificial Sequence
  Description of Artificial Sequence: Synthetic oligonucleotide
  Target: ATXN1; (+) strand; PAM type: NRG; PAM sequence: TGG
gttgcactaggacattacaa

SEQ ID NO: 129405 - DNA, 20 bp, Artificial Sequence
  Description of Artificial Sequence: Synthetic oligonucleotide
  Target: ATXN1; (+) strand; PAM type: NRG; PAM sequence: TAG
tacaatggctacaacattac

SEQ ID NO: 129406 - DNA, 20 bp, Artificial Sequence
  Description of Artificial Sequence: Synthetic oligonucleotide
  Target: ATXN1; (+) strand; PAM type: NRG; PAM sequence: AGG
acaatggctacaacattact

SEQ ID NO: 129407 - DNA, 20 bp, Artificial Sequence
  Description of Artificial Sequence: Synthetic oligonucleotide
  Target: ATXN1; (+) strand; PAM type: NRG; PAM sequence: CAG
actaggcgataaaaattctt

SEQ ID NO: 129408 - DNA, 20 bp, Artificial Sequence
  Description of Artificial Sequence: Synthetic oligonucleotide
  Target: ATXN1; (+) strand; PAM type: NRG; PAM sequence: TGG
tcagcttcattataatctta

SEQ ID NO: 129409 - DNA, 20 bp, Artificial Sequence
  Description of Artificial Sequence: Synthetic oligonucleotide
  Target: ATXN1; (+) strand; PAM type: NRG; PAM sequence: GGG
cagcttcattataatcttat

SEQ ID NO: 129410 - DNA, 20 bp, Artificial Sequence
  Description of Artificial Sequence: Synthetic oligonucleotide
  Target: ATXN1; (+) strand; PAM type: NRG; PAM sequence: CGG
ttgacccaaatgtcgttatg

SEQ ID NO: 129411 - DNA, 20 bp, Artificial Sequence
  Description of Artificial Sequence: Synthetic oligonucleotide
  Target: ATXN1; (+) strand; PAM type: NRG; PAM sequence: TGG
aaatgtcgttatgcggcaca

SEQ ID NO: 129412 - DNA, 20 bp, Artificial Sequence
  Description of Artificial Sequence: Synthetic oligonucleotide
  Target: ATXN1; (+) strand; PAM type: NRG; PAM sequence: AAG
atgcggcacatggctgtaaa

SEQ ID NO: 129413 - DNA, 20 bp, Artificial Sequence
  Description of Artificial Sequence: Synthetic oligonucleotide
  Target: ATXN1; (+) strand; PAM type: NRG; PAM sequence: AAG
acatggctgtaaaaagccat

SEQ ID NO: 129414 - DNA, 20 bp, Artificial Sequence
  Description of Artificial Sequence: Synthetic oligonucleotide
  Target: ATXN1; (+) strand; PAM type: NRG; PAM sequence: GAG
ggctgtaaaaagccataagt

SEQ ID NO: 129415 - DNA, 20 bp, Artificial Sequence
  Description of Artificial Sequence: Synthetic oligonucleotide
  Target: ATXN1; (+) strand; PAM type: NRG; PAM sequence: AGG
gctgtaaaaagccataagtg

SEQ ID NO: 129416 - DNA, 20 bp, Artificial Sequence
  Description of Artificial Sequence: Synthetic oligonucleotide
  Target: ATXN1; (+) strand; PAM type: NRG; PAM sequence: GGG
ctgtaaaaagccataagtga

SEQ ID NO: 129417 - DNA, 20 bp, Artificial Sequence
  Description of Artificial Sequence: Synthetic oligonucleotide
  Target: ATXN1; (+) strand; PAM type: NRG; PAM sequence: AAG
taaaaagccataagtgaggg

SEQ ID NO: 129418 - DNA, 20 bp, Artificial Sequence
  Description of Artificial Sequence: Synthetic oligonucleotide
  Target: ATXN1; (+) strand; PAM type: NRG; PAM sequence: CGG
aaagccataagtgagggaag

SEQ ID NO: 129419 - DNA, 20 bp, Artificial Sequence
  Description of Artificial Sequence: Synthetic oligonucleotide
  Target: ATXN1; (+) strand; PAM type: NRG; PAM sequence: CAG
ataagtgagggaagcggaac

SEQ ID NO: 129420 - DNA, 20 bp, Artificial Sequence
  Description of Artificial Sequence: Synthetic oligonucleotide
  Target: ATXN1; (+) strand; PAM type: NRG; PAM sequence: TAG
aagcggaaccagctcccata

SEQ ID NO: 129421 - DNA, 20 bp, Artificial Sequence
  Description of Artificial Sequence: Synthetic oligonucleotide
  Target: ATXN1; (+) strand; PAM type: NRG; PAM sequence: AGG
agcggaaccagctcccatat

SEQ ID NO: 129422 - DNA, 20 bp, Artificial Sequence
  Description of Artificial Sequence: Synthetic oligonucleotide
  Target: ATXN1; (+) strand; PAM type: NRG; PAM sequence: CAG
tataggtgtctgttgtccca

SEQ ID NO: 129423 - DNA, 20 bp, Artificial Sequence
  Description of Artificial Sequence: Synthetic oligonucleotide
  Target: ATXN1; (+) strand; PAM type: NRG; PAM sequence: GAG
taggtgtctgttgtcccaca

SEQ ID NO: 129424 - DNA, 20 bp, Artificial Sequence
  Description of Artificial Sequence: Synthetic oligonucleotide
  Target: ATXN1; (+) strand; PAM type: NRG; PAM sequence: AGG
aggtgtctgttgtcccacag

SEQ ID NO: 129425 - DNA, 20 bp, Artificial Sequence
  Description of Artificial Sequence: Synthetic oligonucleotide
  Target: ATXN1; (+) strand; PAM type: NRG; PAM sequence: CAG
agaggataccaccgatgccc

SEQ ID NO: 129426 - DNA, 20 bp, Artificial Sequence
  Description of Artificial Sequence: Synthetic oligonucleotide
  Target: ATXN1; (+) strand; PAM type: NRG; PAM sequence: AGG
gaggataccaccgatgcccc

SEQ ID NO: 129427 - DNA, 20 bp, Artificial Sequence
  Description of Artificial Sequence: Synthetic oligonucleotide
  Target: ATXN1; (+) strand; PAM type: NRG; PAM sequence: AAG
aggttgtccactactgctta

SEQ ID NO: 129428 - DNA, 20 bp, Artificial Sequence
  Description of Artificial Sequence: Synthetic oligonucleotide
  Target: ATXN1; (+) strand; PAM type: NRG; PAM sequence: AGG
ggttgtccactactgcttaa

SEQ ID NO: 129429 - DNA, 20 bp, Artificial Sequence
  Description of Artificial Sequence: Synthetic oligonucleotide
  Target: ATXN1; (+) strand; PAM type: NRG; PAM sequence: GGG
gttgtccactactgcttaaa

SEQ ID NO: 129430 - DNA, 20 bp, Artificial Sequence
  Description of Artificial Sequence: Synthetic oligonucleotide
  Target: ATXN1; (+) strand; PAM type: NRG; PAM sequence: AAG
actgcttaaagggcacattc

SEQ ID NO: 129431 - DNA, 20 bp, Artificial Sequence
  Description of Artificial Sequence: Synthetic oligonucleotide
  Target: ATXN1; (+) strand; PAM type: NRG; PAM sequence: TAG
ttaaagggcacattcaagaa

SEQ ID NO: 129432 - DNA, 20 bp, Artificial Sequence
  Description of Artificial Sequence: Synthetic oligonucleotide
  Target: ATXN1; (+) strand; PAM type: NRG; PAM sequence: AGG
taaagggcacattcaagaat

SEQ ID NO: 129433 - DNA, 20 bp, Artificial Sequence
  Description of Artificial Sequence: Synthetic oligonucleotide
  Target: ATXN1; (+) strand; PAM type: NRG; PAM sequence: TGG
acattcaagaataggcatgc

SEQ ID NO: 129434 - DNA, 20 bp, Artificial Sequence
  Description of Artificial Sequence: Synthetic oligonucleotide
  Target: ATXN1; (+) strand; PAM type: NRG; PAM sequence: CAG
tcaagaataggcatgctggc

SEQ ID NO: 129435 - DNA, 20 bp, Artificial Sequence
  Description of Artificial Sequence: Synthetic oligonucleotide
  Target: ATXN1; (+) strand; PAM type: NRG; PAM sequence: AGG
caagaataggcatgctggcc

SEQ ID NO: 129436 - DNA, 20 bp, Artificial Sequence
  Description of Artificial Sequence: Synthetic oligonucleotide
  Target: ATXN1; (+) strand; PAM type: NRG; PAM sequence: CAG
ataggcatgctggccaggtg

SEQ ID NO: 129437 - DNA, 20 bp, Artificial Sequence
  Description of Artificial Sequence: Synthetic oligonucleotide
  Target: ATXN1; (+) strand; PAM type: NRG; PAM sequence: CGG
ggcatgctggccaggtgcag

SEQ ID NO: 129438 - DNA, 20 bp, Artificial Sequence
  Description of Artificial Sequence: Synthetic oligonucleotide
  Target: ATXN1; (+) strand; PAM type: NRG; PAM sequence: CAG
gcggcttacgcctgtaatcc

SEQ ID NO: 129439 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagcactt

SEQ ID NO: 129440 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 129441 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 129442 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 129443 - DNA, 20 bp, Artificial Sequence
  Description of Artificial Sequence: Synthetic oligonucleotide
  Target: ATXN1; (+) strand; PAM type: NRG; PAM sequence: CAG
aatcccagcactttgggagg

SEQ ID NO: 129444 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggca

SEQ ID NO: 129445 - DNA, 20 bp, Artificial Sequence
  Description of Artificial Sequence: Synthetic oligonucleotide
  Target: ATXN1; (+) strand; PAM type: NRG; PAM sequence: TGG
agcactttgggaggcagaga

SEQ ID NO: 129446 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggcagagat

SEQ ID NO: 129447 - DNA, 20 bp, Artificial Sequence
  Description of Artificial Sequence: Synthetic oligonucleotide
  Target: ATXN1; (+) strand; PAM type: NRG; PAM sequence: CGG
ctttgggaggcagagatggg

SEQ ID NO: 129448 - DNA, 20 bp, Artificial Sequence
  Description of Artificial Sequence: Synthetic oligonucleotide
  Target: ATXN1; (+) strand; PAM type: NRG; PAM sequence: GAG
cagagatgggcggatcacct

SEQ ID NO: 129449 - DNA, 20 bp, Artificial Sequence
  Description of Artificial Sequence: Synthetic oligonucleotide
  Target: ATXN1; (+) strand; PAM type: NRG; PAM sequence: AGG
agagatgggcggatcacctg

SEQ ID NO: 129450 - DNA, 20 bp, Artificial Sequence
  Description of Artificial Sequence: Synthetic oligonucleotide
  Target: ATXN1; (+) strand; PAM type: NRG; PAM sequence: TGG
atgggcggatcacctgaggc

SEQ ID NO: 129451 - DNA, 20 bp, Artificial Sequence
  Description of Artificial Sequence: Synthetic oligonucleotide
  Target: ATXN1; (+) strand; PAM type: NRG; PAM sequence: GGG
tgggcggatcacctgaggct

SEQ ID NO: 129452 - DNA, 20 bp, Artificial Sequence
  Description of Artificial Sequence: Synthetic oligonucleotide
  Target: ATXN1; (+) strand; PAM type: NRG; PAM sequence: GAG
ggcggatcacctgaggctgg

SEQ ID NO: 129453 - DNA, 20 bp, Artificial Sequence
  Description of Artificial Sequence: Synthetic oligonucleotide
  Target: ATXN1; (+) strand; PAM type: NRG; PAM sequence: GAG
tcacctgaggctgggagttc

SEQ ID NO: 129454 - DNA, 20 bp, Artificial Sequence
  Description of Artificial Sequence: Synthetic oligonucleotide
  Target: ATXN1; (+) strand; PAM type: NRG; PAM sequence: CAG
tgaggctgggagttcgagac

SEQ ID NO: 129455 - DNA, 20 bp, Artificial Sequence
  Description of Artificial Sequence: Synthetic oligonucleotide
  Target: ATXN1; (+) strand; PAM type: NRG; PAM sequence: TGG
cgagaccagcctgaccaaca

SEQ ID NO: 129456 - DNA, 20 bp, Artificial Sequence
  Description of Artificial Sequence: Synthetic oligonucleotide
  Target: ATXN1; (+) strand; PAM type: NRG; PAM sequence: TAG
ctctactaaaaatgcaaaat

SEQ ID NO: 129457 - DNA, 20 bp, Artificial Sequence
  Description of Artificial Sequence: Synthetic oligonucleotide
  Target: ATXN1; (+) strand; PAM type: NRG; PAM sequence: CAG
tactaaaaatgcaaaattag

SEQ ID NO: 129458 - DNA, 20 bp, Artificial Sequence
  Description of Artificial Sequence: Synthetic oligonucleotide
  Target: ATXN1; (+) strand; PAM type: NRG; PAM sequence: AGG
actaaaaatgcaaaattagc

SEQ ID NO: 129459 - DNA, 20 bp, Artificial Sequence
  Description of Artificial Sequence: Synthetic oligonucleotide
  Target: ATXN1; (+) strand; PAM type: NRG; PAM sequence: GGG
ctaaaaatgcaaaattagca

SEQ ID NO: 129460 - DNA, 20 bp, Artificial Sequence
  Description of Artificial Sequence: Synthetic oligonucleotide
  Target: ATXN1; (+) strand; PAM type: NRG; PAM sequence: TGG
aatgcaaaattagcagggca

SEQ ID NO: 129461 - DNA, 20 bp, Artificial Sequence
  Description of Artificial Sequence: Synthetic oligonucleotide
  Target: ATXN1; (+) strand; PAM type: NRG; PAM sequence: GAG
tgcaaaattagcagggcatg

SEQ ID NO: 129462 - DNA, 20 bp, Artificial Sequence
  Description of Artificial Sequence: Synthetic oligonucleotide
  Target: ATXN1; (+) strand; PAM type: NRG; PAM sequence: AGG
gcaaaattagcagggcatgg

SEQ ID NO: 129463 - DNA, 20 bp, Artificial Sequence
  Description of Artificial Sequence: Synthetic oligonucleotide
  Target: ATXN1; (+) strand; PAM type: NRG; PAM sequence: CAG
gaggtgcatgcccgtaatcc

SEQ ID NO: 129464 - DNA, 20 bp, Artificial Sequence
  Description of Artificial Sequence: Synthetic oligonucleotide
  Target: ATXN1; (+) strand; PAM type: NRG; PAM sequence: CAG
tgcccgtaatcccagctact

SEQ ID NO: 129465 - DNA, 20 bp, Artificial Sequence
  Description of Artificial Sequence: Synthetic oligonucleotide
  Target: ATXN1; (+) strand; PAM type: NRG; PAM sequence: AGG
gcccgtaatcccagctactc

SEQ ID NO: 129466 - DNA, 20 bp, Artificial Sequence
  Description of Artificial Sequence: Synthetic oligonucleotide
  Target: ATXN1; (+) strand; PAM type: NRG; PAM sequence: GAG
ccgtaatcccagctactcag

SEQ ID NO: 129467 - DNA, 20 bp, Artificial Sequence
  Description of Artificial Sequence: Synthetic oligonucleotide
  Target: ATXN1; (+) strand; PAM type: NRG; PAM sequence: AGG
cgtaatcccagctactcagg

SEQ ID NO: 129468 - DNA, 20 bp, Artificial Sequence
  Description of Artificial Sequence: Synthetic oligonucleotide
  Target: ATXN1; (+) strand; PAM type: NRG; PAM sequence: CAG
tcccagctactcaggaggct

SEQ ID NO: 129469 - DNA, 20 bp, Artificial Sequence
  Description of Artificial Sequence: Synthetic oligonucleotide
  Target: ATXN1; (+) strand; PAM type: NRG; PAM sequence: AGG
cccagctactcaggaggctc

SEQ ID NO: 129470 - DNA, 20 bp, Artificial Sequence
  Description of Artificial Sequence: Synthetic oligonucleotide
  Target: ATXN1; (+) strand; PAM type: NRG; PAM sequence: CAG
agctactcaggaggctcagg

SEQ ID NO: 129471 - DNA, 20 bp, Artificial Sequence
  Description of Artificial Sequence: Synthetic oligonucleotide
  Target: ATXN1; (+) strand; PAM type: NRG; PAM sequence: TAG
tactcaggaggctcaggcag

SEQ ID NO: 129472 - DNA, 20 bp, Artificial Sequence
  Description of Artificial Sequence: Synthetic oligonucleotide
  Target: ATXN1; (+) strand; PAM type: NRG; PAM sequence: CAG
gcagtagaataacttgaact

SEQ ID NO: 129473 - DNA, 20 bp, Artificial Sequence
  Description of Artificial Sequence: Synthetic oligonucleotide
  Target: ATXN1; (+) strand; PAM type: NRG; PAM sequence: AGG
cagtagaataacttgaactc

SEQ ID NO: 129474 - DNA, 20 bp, Artificial Sequence
  Description of Artificial Sequence: Synthetic oligonucleotide
  Target: ATXN1; (+) strand; PAM type: NRG; PAM sequence: GAG
gtagaataacttgaactcag

SEQ ID NO: 129475 - DNA, 20 bp, Artificial Sequence
  Description of Artificial Sequence: Synthetic oligonucleotide
  Target: ATXN1; (+) strand; PAM type: NRG; PAM sequence: AAG
ataacttgaactcaggagca

SEQ ID NO: 129476 - DNA, 20 bp, Artificial Sequence
  Description of Artificial Sequence: Synthetic oligonucleotide
  Target: ATXN1; (+) strand; PAM type: NRG; PAM sequence: TGG
gaactcaggagcaaagattg

SEQ ID NO: 129477 - DNA, 20 bp, Artificial Sequence
  Description of Artificial Sequence: Synthetic oligonucleotide
  Target: ATXN1; (+) strand; PAM type: NRG; PAM sequence: GAG
tcaggagcaaagattgtggt

SEQ ID NO: 129478 - DNA, 20 bp, Artificial Sequence
  Description of Artificial Sequence: Synthetic oligonucleotide
  Target: ATXN1; (+) strand; PAM type: NRG; PAM sequence: GAG
agcaaagattgtggtgagcc

SEQ ID NO: 129479 - DNA, 20 bp, Artificial Sequence
  Description of Artificial Sequence: Synthetic oligonucleotide
  Target: ATXN1; (+) strand; PAM type: NRG; PAM sequence: CAG
gagatcgcaccattgcactc

SEQ ID NO: 129480 - DNA, 20 bp, Artificial Sequence
  Description of Artificial Sequence: Synthetic oligonucleotide
  Target: ATXN1; (+) strand; PAM type: NRG; PAM sequence: TGG
cgcaccattgcactccagcc

SEQ ID NO: 129481 - DNA, 20 bp, Artificial Sequence
  Description of Artificial Sequence: Synthetic oligonucleotide
  Target: ATXN1; (+) strand; PAM type: NRG; PAM sequence: GGG
gcaccattgcactccagcct

SEQ ID NO: 129482 - DNA, 20 bp, Artificial Sequence
  Description of Artificial Sequence: Synthetic oligonucleotide
  Target: ATXN1; (+) strand; PAM type: NRG; PAM sequence: AAG
tgcactccagcctgggcaac

SEQ ID NO: 129483 - DNA, 20 bp, Artificial Sequence
  Description of Artificial Sequence: Synthetic oligonucleotide
  Target: ATXN1; (+) strand; PAM type: NRG; PAM sequence: GAG
cactccagcctgggcaacaa

SEQ ID NO: 129484 - DNA, 20 bp, Artificial Sequence
  Description of Artificial Sequence: Synthetic oligonucleotide
  Target: ATXN1; (+) strand; PAM type: NRG; PAM sequence: AAG
caaaaaaaaaaaaaaaaaaa

SEQ ID NO: 129485 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaaaaaaaaaaaaa

SEQ ID NO: 129486 - DNA, 20 bp, Artificial Sequence
  Description of Artificial Sequence: Synthetic oligonucleotide
  Target: ATXN1; (+) strand; PAM type: NRG; PAM sequence: TAG
aaaaaaaaaaaaaaaaggaa

SEQ ID NO: 129487 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaaaaaaaaggaat

SEQ ID NO: 129488 - DNA, 20 bp, Artificial Sequence
  Description of Artificial Sequence: Synthetic oligonucleotide
  Target: ATXN1; (+) strand; PAM type: NRG; PAM sequence: AAG
ggcatgccattctcactcat

SEQ ID NO: 129489 - DNA, 20 bp, Artificial Sequence
  Description of Artificial Sequence: Synthetic oligonucleotide
  Target: ATXN1; (+) strand; PAM type: NRG; PAM sequence: TGG
atgccattctcactcataag

SEQ ID NO: 129490 - DNA, 20 bp, Artificial Sequence
  Description of Artificial Sequence: Synthetic oligonucleotide
  Target: ATXN1; (+) strand; PAM type: NRG; PAM sequence: GGG
tgccattctcactcataagt

SEQ ID NO: 129491 - DNA, 20 bp, Artificial Sequence
  Description of Artificial Sequence: Synthetic oligonucleotide
  Target: ATXN1; (+) strand; PAM type: NRG; PAM sequence: GAG
ccattctcactcataagtgg

SEQ ID NO: 129492 - DNA, 20 bp, Artificial Sequence
  Description of Artificial Sequence: Synthetic oligonucleotide
  Target: ATXN1; (+) strand; PAM type: NRG; PAM sequence: GAG
ataagtgggagttgaaaaat

SEQ ID NO: 129493 - DNA, 20 bp, Artificial Sequence
  Description of Artificial Sequence: Synthetic oligonucleotide
  Target: ATXN1; (+) strand; PAM type: NRG; PAM sequence: TGG
agttgaaaaatgagaacaca

SEQ ID NO: 129494 - DNA, 20 bp, Artificial Sequence
  Description of Artificial Sequence: Synthetic oligonucleotide
  Target: ATXN1; (+) strand; PAM type: NRG; PAM sequence: CAG
aaaatgagaacacatggaca

SEQ ID NO: 129495 - DNA, 20 bp, Artificial Sequence
  Description of Artificial Sequence: Synthetic oligonucleotide
  Target: ATXN1; (+) strand; PAM type: NRG; PAM sequence: AGG
aaatgagaacacatggacac

SEQ ID NO: 129496 - DNA, 20 bp, Artificial Sequence
  Description of Artificial Sequence: Synthetic oligonucleotide
  Target: ATXN1; (+) strand; PAM type: NRG; PAM sequence: AAG
tgagaacacatggacacagg

SEQ ID NO: 129497 - DNA, 20 bp, Artificial Sequence
  Description of Artificial Sequence: Synthetic oligonucleotide
  Target: ATXN1; (+) strand; PAM type: NRG; PAM sequence: AGG
gagaacacatggacacagga

SEQ ID NO: 129498 - DNA, 20 bp, Artificial Sequence
  Description of Artificial Sequence: Synthetic oligonucleotide
  Target: ATXN1; (+) strand; PAM type: NRG; PAM sequence: GGG
agaacacatggacacaggaa

SEQ ID NO: 129499 - DNA, 20 bp, Artificial Sequence
  Description of Artificial Sequence: Synthetic oligonucleotide
  Target: ATXN1; (+) strand; PAM type: NRG; PAM sequence: GGG
gaacacatggacacaggaag

SEQ ID NO: 129500 - DNA, 20 bp, Artificial Sequence
  Description of Artificial Sequence: Synthetic oligonucleotide
  Target: ATXN1; (+) strand; PAM type: NRG; PAM sequence: CGG
ggaaggggaacaacacacac

SEQ ID NO: 129501 - DNA, 20 bp, Artificial Sequence
  Description of Artificial Sequence: Synthetic oligonucleotide
  Target: ATXN1; (+) strand; PAM type: NRG; PAM sequence: GGG
gaaggggaacaacacacacc

SEQ ID NO: 129502 - DNA, 20 bp, Artificial Sequence
  Description of Artificial Sequence: Synthetic oligonucleotide
  Target: ATXN1; (+) strand; PAM type: NRG; PAM sequence: GGG
aaggggaacaacacacaccg

SEQ ID NO: 129503 - DNA, 20 bp, Artificial Sequence
  Description of Artificial Sequence: Synthetic oligonucleotide
  Target: ATXN1; (+) strand; PAM type: NRG; PAM sequence: TGG
caacacacaccggggtctgt

SEQ ID NO: 129504 - DNA, 20 bp, Artificial Sequence
  Description of Artificial Sequence: Synthetic oligonucleotide
  Target: ATXN1; (+) strand; PAM type: NRG; PAM sequence: GGG
aacacacaccggggtctgtt

SEQ ID NO: 129505 - DNA, 20 bp, Artificial Sequence
  Description of Artificial Sequence: Synthetic oligonucleotide
  Target: ATXN1; (+) strand; PAM type: NRG; PAM sequence: GGG
acacacaccggggtctgttg

SEQ ID NO: 129506 - DNA, 20 bp, Artificial Sequence
  Description of Artificial Sequence: Synthetic oligonucleotide
  Target: ATXN1; (+) strand; PAM type: NRG; PAM sequence: TGG
caccggggtctgttggggac

SEQ ID NO: 129507 - DNA, 20 bp, Artificial Sequence
  Description of Artificial Sequence: Synthetic oligonucleotide
  Target: ATXN1; (+) strand; PAM type: NRG; PAM sequence: GGG
accggggtctgttggggact

SEQ ID NO: 129508 - DNA, 20 bp, Artificial Sequence
  Description of Artificial Sequence: Synthetic oligonucleotide
  Target: ATXN1; (+) strand; PAM type: NRG; PAM sequence: GGG
ccggggtctgttggggactg

SEQ ID NO: 129509 - DNA, 20 bp, Artificial Sequence
  Description of Artificial Sequence: Synthetic oligonucleotide
  Target: ATXN1; (+) strand; PAM type: NRG; PAM sequence: TGG
gggtctgttggggactgggg

SEQ ID NO: 129510 - DNA, 20 bp, Artificial Sequence
  Description of Artificial Sequence: Synthetic oligonucleotide
  Target: ATXN1; (+) strand; PAM type: NRG; PAM sequence: GGG
ggtctgttggggactggggt

SEQ ID NO: 129511 - DNA, 20 bp, Artificial Sequence
  Description of Artificial Sequence: Synthetic oligonucleotide
  Target: ATXN1; (+) strand; PAM type: NRG; PAM sequence: GGG
gtctgttggggactggggtg

SEQ ID NO: 129512 - DNA, 20 bp, Artificial Sequence
  Description of Artificial Sequence: Synthetic oligonucleotide
  Target: ATXN1; (+) strand; PAM type: NRG; PAM sequence: GAG
ctgttggggactggggtggg

SEQ ID NO: 129513 - DNA, 20 bp, Artificial Sequence
  Description of Artificial Sequence: Synthetic oligonucleotide
  Target: ATXN1; (+) strand; PAM type: NRG; PAM sequence: AGG
tgttggggactggggtgggg

SEQ ID NO: 129514 - DNA, 20 bp, Artificial Sequence
  Description of Artificial Sequence: Synthetic oligonucleotide
  Target: ATXN1; (+) strand; PAM type: NRG; PAM sequence: GGG
gttggggactggggtgggga

SEQ ID NO: 129515 - DNA, 20 bp, Artificial Sequence
  Description of Artificial Sequence: Synthetic oligonucleotide
  Target: ATXN1; (+) strand; PAM type: NRG; PAM sequence: GGG
ttggggactggggtggggag

SEQ ID NO: 129516 - DNA, 20 bp, Artificial Sequence
  Description of Artificial Sequence: Synthetic oligonucleotide
  Target: ATXN1; (+) strand; PAM type: NRG; PAM sequence: GAG
ggggactggggtggggaggg

SEQ ID NO: 129517 - DNA, 20 bp, Artificial Sequence
  Description of Artificial Sequence: Synthetic oligonucleotide
  Target: ATXN1; (+) strand; PAM type: NRG; PAM sequence: AGG
gggactggggtggggagggg

SEQ ID NO: 129518 - DNA, 20 bp, Artificial Sequence
  Description of Artificial Sequence: Synthetic oligonucleotide
  Target: ATXN1; (+) strand; PAM type: NRG; PAM sequence: GGG
ggactggggtggggagggga

SEQ ID NO: 129519 - DNA, 20 bp, Artificial Sequence
  Description of Artificial Sequence: Synthetic oligonucleotide
  Target: ATXN1; (+) strand; PAM type: NRG; PAM sequence: TAG
ggtggggaggggagggaacc

SEQ ID NO: 129520 - DNA, 20 bp, Artificial Sequence
  Description of Artificial Sequence: Synthetic oligonucleotide
  Target: ATXN1; (+) strand; PAM type: NRG; PAM sequence: CAG
aggggagggaacctagatga

SEQ ID NO: 129521 - DNA, 20 bp, Artificial Sequence
  Description of Artificial Sequence: Synthetic oligonucleotide
  Target: ATXN1; (+) strand; PAM type: NRG; PAM sequence: AGG
ggggagggaacctagatgac

SEQ ID NO: 129522 - DNA, 20 bp, Artificial Sequence
  Description of Artificial Sequence: Synthetic oligonucleotide
  Target: ATXN1; (+) strand; PAM type: NRG; PAM sequence: TAG
gaacctagatgacaggttaa

SEQ ID NO: 129523 - DNA, 20 bp, Artificial Sequence
  Description of Artificial Sequence: Synthetic oligonucleotide
  Target: ATXN1; (+) strand; PAM type: NRG; PAM sequence: AGG
aacctagatgacaggttaat

SEQ ID NO: 129524 - DNA, 20 bp, Artificial Sequence
  Description of Artificial Sequence: Synthetic oligonucleotide
  Target: ATXN1; (+) strand; PAM type: NRG; PAM sequence: CAG
agatgacaggttaataggtg

SEQ ID NO: 129525 - DNA, 20 bp, Artificial Sequence
  Description of Artificial Sequence: Synthetic oligonucleotide
  Target: ATXN1; (+) strand; PAM type: NRG; PAM sequence: CAG
taataggtgcagcaaaccac

SEQ ID NO: 129526 - DNA, 20 bp, Artificial Sequence
  Description of Artificial Sequence: Synthetic oligonucleotide
  Target: ATXN1; (+) strand; PAM type: NRG; PAM sequence: CAG
acacatgtatacctatgcaa

SEQ ID NO: 129527 - DNA, 20 bp, Artificial Sequence
  Description of Artificial Sequence: Synthetic oligonucleotide
  Target: ATXN1; (+) strand; PAM type: NRG; PAM sequence: CAG
catgttctacatatgtaccc

SEQ ID NO: 129528 - DNA, 20 bp, Artificial Sequence
  Description of Artificial Sequence: Synthetic oligonucleotide
  Target: ATXN1; (+) strand; PAM type: NRG; PAM sequence: AAG
catatgtaccccagaactta

SEQ ID NO: 129529 - DNA, 20 bp, Artificial Sequence
  Description of Artificial Sequence: Synthetic oligonucleotide
  Target: ATXN1; (+) strand; PAM type: NRG; PAM sequence: AAG
tacaaaaaaaaaaaaaaaaa

SEQ ID NO: 129530 - DNA, 20 bp, Artificial Sequence
  Description of Artificial Sequence: Synthetic oligonucleotide
  Target: ATXN1; (+) strand; PAM type: NRG; PAM sequence: TAG
aaaaaaaaaaaaaaaaagaa

SEQ ID NO: 129531 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaaaaaaaaagaat

SEQ ID NO: 129532 - DNA, 20 bp, Artificial Sequence
  Description of Artificial Sequence: Synthetic oligonucleotide
  Target: ATXN1; (+) strand; PAM type: NRG; PAM sequence: TGG
gaataggcatgcaatgctta

SEQ ID NO: 129533 - DNA, 20 bp, Artificial Sequence
  Description of Artificial Sequence: Synthetic oligonucleotide
  Target: ATXN1; (+) strand; PAM type: NRG; PAM sequence: TAG
caatgcttatggacacaccc

SEQ ID NO: 129534 - DNA, 20 bp, Artificial Sequence
  Description of Artificial Sequence: Synthetic oligonucleotide
  Target: ATXN1; (+) strand; PAM type: NRG; PAM sequence: AAG
gcttatggacacaccctagc

SEQ ID NO: 129535 - DNA, 20 bp, Artificial Sequence
  Description of Artificial Sequence: Synthetic oligonucleotide
  Target: ATXN1; (+) strand; PAM type: NRG; PAM sequence: TGG
tatggacacaccctagcaag

SEQ ID NO: 129536 - DNA, 20 bp, Artificial Sequence
  Description of Artificial Sequence: Synthetic oligonucleotide
  Target: ATXN1; (+) strand; PAM type: NRG; PAM sequence: TGG
acaccctagcaagtggtcac

SEQ ID NO: 129537 - DNA, 20 bp, Artificial Sequence
  Description of Artificial Sequence: Synthetic oligonucleotide
  Target: ATXN1; (+) strand; PAM type: NRG; PAM sequence: TGG
aagtggtcactggttttaca

SEQ ID NO: 129538 - DNA, 20 bp, Artificial Sequence
  Description of Artificial Sequence: Synthetic oligonucleotide
  Target: ATXN1; (+) strand; PAM type: NRG; PAM sequence: AAG
actggttttacatggatacc

SEQ ID NO: 129539 - DNA, 20 bp, Artificial Sequence
  Description of Artificial Sequence: Synthetic oligonucleotide
  Target: ATXN1; (+) strand; PAM type: NRG; PAM sequence: AGG
ctggttttacatggatacca

SEQ ID NO: 129540 - DNA, 20 bp, Artificial Sequence
  Description of Artificial Sequence: Synthetic oligonucleotide
  Target: ATXN1; (+) strand; PAM type: NRG; PAM sequence: CAG
ccttccctcctgcaccctct

SEQ ID NO: 129541 - DNA, 20 bp, Artificial Sequence
  Description of Artificial Sequence: Synthetic oligonucleotide
  Target: ATXN1; (+) strand; PAM type: NRG; PAM sequence: TGG
ctcctgcaccctctcagctc

SEQ ID NO: 129542 - DNA, 20 bp, Artificial Sequence
  Description of Artificial Sequence: Synthetic oligonucleotide
  Target: ATXN1; (+) strand; PAM type: NRG; PAM sequence: TGG
ccctctcagctctggcaatg

SEQ ID NO: 129543 - DNA, 20 bp, Artificial Sequence
  Description of Artificial Sequence: Synthetic oligonucleotide
  Target: ATXN1; (+) strand; PAM type: NRG; PAM sequence: TGG
acacaatctgcatgtcaaca

SEQ ID NO: 129544 - DNA, 20 bp, Artificial Sequence
  Description of Artificial Sequence: Synthetic oligonucleotide
  Target: ATXN1; (+) strand; PAM type: NRG; PAM sequence: CAG
tccatcctcttctgcatatt

SEQ ID NO: 129545 - DNA, 20 bp, Artificial Sequence
  Description of Artificial Sequence: Synthetic oligonucleotide
  Target: ATXN1; (+) strand; PAM type: NRG; PAM sequence: TGG
tctttcatcccttgtatatt

SEQ ID NO: 129546 - DNA, 20 bp, Artificial Sequence
  Description of Artificial Sequence: Synthetic oligonucleotide
  Target: ATXN1; (+) strand; PAM type: NRG; PAM sequence: GGG
ctttcatcccttgtatattt

SEQ ID NO: 129547 - DNA, 20 bp, Artificial Sequence
  Description of Artificial Sequence: Synthetic oligonucleotide
  Target: ATXN1; (+) strand; PAM type: NRG; PAM sequence: GAG
ttgtatatttgggacaatct

SEQ ID NO: 129548 - DNA, 20 bp, Artificial Sequence
  Description of Artificial Sequence: Synthetic oligonucleotide
  Target: ATXN1; (+) strand; PAM type: NRG; PAM sequence: GAG
gtatatttgggacaatctga

SEQ ID NO: 129549 - DNA, 20 bp, Artificial Sequence
  Description of Artificial Sequence: Synthetic oligonucleotide
  Target: ATXN1; (+) strand; PAM type: NRG; PAM sequence: AGG
tatatttgggacaatctgag

SEQ ID NO: 129550 - DNA, 20 bp, Artificial Sequence
  Description of Artificial Sequence: Synthetic oligonucleotide
  Target: ATXN1; (+) strand; PAM type: NRG; PAM sequence: GGG
atatttgggacaatctgaga

SEQ ID NO: 129551 - DNA, 20 bp, Artificial Sequence
  Description of Artificial Sequence: Synthetic oligonucleotide
  Target: ATXN1; (+) strand; PAM type: NRG; PAM sequence: TAG
gacaatctgagagggtatcc

SEQ ID NO: 129552 - DNA, 20 bp, Artificial Sequence
  Description of Artificial Sequence: Synthetic oligonucleotide
  Target: ATXN1; (+) strand; PAM type: NRG; PAM sequence: AAG
tctgagagggtatcctagaa

SEQ ID NO: 129553 - DNA, 20 bp, Artificial Sequence
  Description of Artificial Sequence: Synthetic oligonucleotide
  Target: ATXN1; (+) strand; PAM type: NRG; PAM sequence: AGG
ctgagagggtatcctagaaa

SEQ ID NO: 129554 - DNA, 20 bp, Artificial Sequence
  Description of Artificial Sequence: Synthetic oligonucleotide
  Target: ATXN1; (+) strand; PAM type: NRG; PAM sequence: GGG
tgagagggtatcctagaaaa

SEQ ID NO: 129555 - DNA, 20 bp, Artificial Sequence
  Description of Artificial Sequence: Synthetic oligonucleotide
  Target: ATXN1; (+) strand; PAM type: NRG; PAM sequence: CAG
tacattttgatctatttcta

SEQ ID NO: 129556 - DNA, 20 bp, Artificial Sequence
  Description of Artificial Sequence: Synthetic oligonucleotide
  Target: ATXN1; (+) strand; PAM type: NRG; PAM sequence: TAG
attttgatctatttctacag

SEQ ID NO: 129557 - DNA, 20 bp, Artificial Sequence
  Description of Artificial Sequence: Synthetic oligonucleotide
  Target: ATXN1; (+) strand; PAM type: NRG; PAM sequence: AGG
ttttgatctatttctacagt

SEQ ID NO: 129558 - DNA, 20 bp, Artificial Sequence
  Description of Artificial Sequence: Synthetic oligonucleotide
  Target: ATXN1; (+) strand; PAM type: NRG; PAM sequence: TAG
tctacagtaggcataattat

SEQ ID NO: 129559 - DNA, 20 bp, Artificial Sequence
  Description of Artificial Sequence: Synthetic oligonucleotide
  Target: ATXN1; (+) strand; PAM type: NRG; PAM sequence: AGG
ctacagtaggcataattatt

SEQ ID NO: 129560 - DNA, 20 bp, Artificial Sequence
  Description of Artificial Sequence: Synthetic oligonucleotide
  Target: ATXN1; (+) strand; PAM type: NRG; PAM sequence: AAG
aggcataattattaggccat

SEQ ID NO: 129561 - DNA, 20 bp, Artificial Sequence
  Description of Artificial Sequence: Synthetic oligonucleotide
  Target: ATXN1; (+) strand; PAM type: NRG; PAM sequence: GAG
ataattattaggccataagt

SEQ ID NO: 129562 - DNA, 20 bp, Artificial Sequence
  Description of Artificial Sequence: Synthetic oligonucleotide
  Target: ATXN1; (+) strand; PAM type: NRG; PAM sequence: TGG
ggccataagtgagaccatga

SEQ ID NO: 129563 - DNA, 20 bp, Artificial Sequence
  Description of Artificial Sequence: Synthetic oligonucleotide
  Target: ATXN1; (+) strand; PAM type: NRG; PAM sequence: TAG
ctgttgactatgctcttctg

SEQ ID NO: 129564 - DNA, 20 bp, Artificial Sequence
  Description of Artificial Sequence: Synthetic oligonucleotide
  Target: ATXN1; (+) strand; PAM type: NRG; PAM sequence: AAG
atgctcttctgtagttttaa

SEQ ID NO: 129565 - DNA, 20 bp, Artificial Sequence
  Description of Artificial Sequence: Synthetic oligonucleotide
  Target: ATXN1; (+) strand; PAM type: NRG; PAM sequence: TAG
aaagtgcctttcatgcataa

SEQ ID NO: 129566 - DNA, 20 bp, Artificial Sequence
  Description of Artificial Sequence: Synthetic oligonucleotide
  Target: ATXN1; (+) strand; PAM type: NRG; PAM sequence: CAG
cctttcatgcataatagttg

SEQ ID NO: 129567 - DNA, 20 bp, Artificial Sequence
  Description of Artificial Sequence: Synthetic oligonucleotide
  Target: ATXN1; (+) strand; PAM type: NRG; PAM sequence: TAG
tacttaacaaccctaataaa

SEQ ID NO: 129568 - DNA, 20 bp, Artificial Sequence
  Description of Artificial Sequence: Synthetic oligonucleotide
  Target: ATXN1; (+) strand; PAM type: NRG; PAM sequence: TAG
acataattattcccaattta

SEQ ID NO: 129569 - DNA, 20 bp, Artificial Sequence
  Description of Artificial Sequence: Synthetic oligonucleotide
  Target: ATXN1; (+) strand; PAM type: NRG; PAM sequence: AAG
attattcccaatttatagaa

SEQ ID NO: 129570 - DNA, 20 bp, Artificial Sequence
  Description of Artificial Sequence: Synthetic oligonucleotide
  Target: ATXN1; (+) strand; PAM type: NRG; PAM sequence: AAG
aatttatagaaaagaaactg

SEQ ID NO: 129571 - DNA, 20 bp, Artificial Sequence
  Description of Artificial Sequence: Synthetic oligonucleotide
  Target: ATXN1; (+) strand; PAM type: NRG; PAM sequence: AAG
aaaagaaactgaagctcaaa

SEQ ID NO: 129572 - DNA, 20 bp, Artificial Sequence
  Description of Artificial Sequence: Synthetic oligonucleotide
  Target: ATXN1; (+) strand; PAM type: NRG; PAM sequence: AGG
aaagaaactgaagctcaaaa

SEQ ID NO: 129573 - DNA, 20 bp, Artificial Sequence
  Description of Artificial Sequence: Synthetic oligonucleotide
  Target: ATXN1; (+) strand; PAM type: NRG; PAM sequence: TAG
aaactgaagctcaaaaaggt

SEQ ID NO: 129574 - DNA, 20 bp, Artificial Sequence
  Description of Artificial Sequence: Synthetic oligonucleotide
  Target: ATXN1; (+) strand; PAM type: NRG; PAM sequence: AGG
aactgaagctcaaaaaggtt

SEQ ID NO: 129575 - DNA, 20 bp, Artificial Sequence
  Description of Artificial Sequence: Synthetic oligonucleotide
  Target: ATXN1; (+) strand; PAM type: NRG; PAM sequence: AAG
gaagctcaaaaaggttaggt

SEQ ID NO: 129576 - DNA, 20 bp, Artificial Sequence
  Description of Artificial Sequence: Synthetic oligonucleotide
  Target: ATXN1; (+) strand; PAM type: NRG; PAM sequence: CAG
ctcaaaaaggttaggtaagt

SEQ ID NO: 129577 - DNA, 20 bp, Artificial Sequence
  Description of Artificial Sequence: Synthetic oligonucleotide
  Target: ATXN1; (+) strand; PAM type: NRG; PAM sequence: TGG
aaggttaggtaagtcagcca

SEQ ID NO: 129578 - DNA, 20 bp, Artificial Sequence
  Description of Artificial Sequence: Synthetic oligonucleotide
  Target: ATXN1; (+) strand; PAM type: NRG; PAM sequence: CAG
gtaagtcagccatggacaca

SEQ ID NO: 129579 - DNA, 20 bp, Artificial Sequence
  Description of Artificial Sequence: Synthetic oligonucleotide
  Target: ATXN1; (+) strand; PAM type: NRG; PAM sequence: CAG
gacacacagctaataaacca

SEQ ID NO: 129580 - DNA, 20 bp, Artificial Sequence
  Description of Artificial Sequence: Synthetic oligonucleotide
  Target: ATXN1; (+) strand; PAM type: NRG; PAM sequence: GAG
cacacagctaataaaccaca

SEQ ID NO: 129581 - DNA, 20 bp, Artificial Sequence
  Description of Artificial Sequence: Synthetic oligonucleotide
  Target: ATXN1; (+) strand; PAM type: NRG; PAM sequence: AAG
tactcatctcttcgaatgtc

SEQ ID NO: 129582 - DNA, 20 bp, Artificial Sequence
  Description of Artificial Sequence: Synthetic oligonucleotide
  Target: ATXN1; (+) strand; PAM type: NRG; PAM sequence: TAG
tatacattttttgcaacata

SEQ ID NO: 129583 - DNA, 20 bp, Artificial Sequence
  Description of Artificial Sequence: Synthetic oligonucleotide
  Target: ATXN1; (+) strand; PAM type: NRG; PAM sequence: CAG
ttgcaacatatagtatgaca

SEQ ID NO: 129584 - DNA, 20 bp, Artificial Sequence
  Description of Artificial Sequence: Synthetic oligonucleotide
  Target: ATXN1; (+) strand; PAM type: NRG; PAM sequence: TAG
tagtatgacacagtctgtat

SEQ ID NO: 129585 - DNA, 20 bp, Artificial Sequence
  Description of Artificial Sequence: Synthetic oligonucleotide
  Target: ATXN1; (+) strand; PAM type: NRG; PAM sequence: AAG
gtctgtattagattatcaaa

SEQ ID NO: 129586 - DNA, 20 bp, Artificial Sequence
  Description of Artificial Sequence: Synthetic oligonucleotide
  Target: ATXN1; (+) strand; PAM type: NRG; PAM sequence: AGG
tctgtattagattatcaaaa

SEQ ID NO: 129587 - DNA, 20 bp, Artificial Sequence
  Description of Artificial Sequence: Synthetic oligonucleotide
  Target: ATXN1; (+) strand; PAM type: NRG; PAM sequence: AAG
ttagattatcaaaaaggatt

SEQ ID NO: 129588 - DNA, 20 bp, Artificial Sequence
  Description of Artificial Sequence: Synthetic oligonucleotide
  Target: ATXN1; (+) strand; PAM type: NRG; PAM sequence: AAG
taagtttttttcttgactat

SEQ ID NO: 129589 - DNA, 20 bp, Artificial Sequence
  Description of Artificial Sequence: Synthetic oligonucleotide
  Target: ATXN1; (+) strand; PAM type: NRG; PAM sequence: TGG
tttcttgactataagcaata

SEQ ID NO: 129590 - DNA, 20 bp, Artificial Sequence
  Description of Artificial Sequence: Synthetic oligonucleotide
  Target: ATXN1; (+) strand; PAM type: NRG; PAM sequence: TAG
cttgactataagcaatatgg

SEQ ID NO: 129591 - DNA, 20 bp, Artificial Sequence
  Description of Artificial Sequence: Synthetic oligonucleotide
  Target: ATXN1; (+) strand; PAM type: NRG; PAM sequence: CAG
tttccaaaatgttttaactt

SEQ ID NO: 129592 - DNA, 20 bp, Artificial Sequence
  Description of Artificial Sequence: Synthetic oligonucleotide
  Target: ATXN1; (+) strand; PAM type: NRG; PAM sequence: AGG
ttccaaaatgttttaacttc

SEQ ID NO: 129593 - DNA, 20 bp, Artificial Sequence
  Description of Artificial Sequence: Synthetic oligonucleotide
  Target: ATXN1; (+) strand; PAM type: NRG; PAM sequence: GAG
tttttccttataaaaatcat

SEQ ID NO: 129594 - DNA, 20 bp, Artificial Sequence
  Description of Artificial Sequence: Synthetic oligonucleotide
  Target: ATXN1; (+) strand; PAM type: NRG; PAM sequence: TAG
taaaaatcatgagttactcc

SEQ ID NO: 129595 - DNA, 20 bp, Artificial Sequence
  Description of Artificial Sequence: Synthetic oligonucleotide
  Target: ATXN1; (+) strand; PAM type: NRG; PAM sequence: CAG
ttactcctagccccatttta

SEQ ID NO: 129596 - DNA, 20 bp, Artificial Sequence
  Description of Artificial Sequence: Synthetic oligonucleotide
  Target: ATXN1; (+) strand; PAM type: NRG; PAM sequence: AAG
cattttacagatgataaatt

SEQ ID NO: 129597 - DNA, 20 bp, Artificial Sequence
  Description of Artificial Sequence: Synthetic oligonucleotide
  Target: ATXN1; (+) strand; PAM type: NRG; PAM sequence: AGG
attttacagatgataaatta

SEQ ID NO: 129598 - DNA, 20 bp, Artificial Sequence
  Description of Artificial Sequence: Synthetic oligonucleotide
  Target: ATXN1; (+) strand; PAM type: NRG; PAM sequence: CAG
ttacagatgataaattaagg

SEQ ID NO: 129599 - DNA, 20 bp, Artificial Sequence
  Description of Artificial Sequence: Synthetic oligonucleotide
  Target: ATXN1; (+) strand; PAM type: NRG; PAM sequence: GAG
acagatgataaattaaggca

SEQ ID NO: 129600 - DNA, 20 bp, Artificial Sequence
  Description of Artificial Sequence: Synthetic oligonucleotide
  Target: ATXN1; (+) strand; PAM type: NRG; PAM sequence: AGG
cagatgataaattaaggcag

SEQ ID NO: 129601 - DNA, 20 bp, Artificial Sequence
  Description of Artificial Sequence: Synthetic oligonucleotide
  Target: ATXN1; (+) strand; PAM type: NRG; PAM sequence: GAG
acttgcctaaataaactaat

SEQ ID NO: 129602 - DNA, 20 bp, Artificial Sequence
  Description of Artificial Sequence: Synthetic oligonucleotide
  Target: ATXN1; (+) strand; PAM type: NRG; PAM sequence: CAG
taaataaactaatgagttga

SEQ ID NO: 129603 - DNA, 20 bp, Artificial Sequence
  Description of Artificial Sequence: Synthetic oligonucleotide
  Target: ATXN1; (+) strand; PAM type: NRG; PAM sequence: TGG
ataaactaatgagttgacag

SEQ ID NO: 129604 - DNA, 20 bp, Artificial Sequence
  Description of Artificial Sequence: Synthetic oligonucleotide
  Target: ATXN1; (+) strand; PAM type: NRG; PAM sequence: AAG
atgagttgacagtggacctg

SEQ ID NO: 129605 - DNA, 20 bp, Artificial Sequence
  Description of Artificial Sequence: Synthetic oligonucleotide
  Target: ATXN1; (+) strand; PAM type: NRG; PAM sequence: TAG
gttgacagtggacctgaagt

SEQ ID NO: 129606 - DNA, 20 bp, Artificial Sequence
  Description of Artificial Sequence: Synthetic oligonucleotide
  Target: ATXN1; (+) strand; PAM type: NRG; PAM sequence: TAG
ctgcatcctaattcaaaaac

SEQ ID NO: 129607 - DNA, 20 bp, Artificial Sequence
  Description of Artificial Sequence: Synthetic oligonucleotide
  Target: ATXN1; (+) strand; PAM type: NRG; PAM sequence: TGG
tcctaattcaaaaactagta

SEQ ID NO: 129608 - DNA, 20 bp, Artificial Sequence
  Description of Artificial Sequence: Synthetic oligonucleotide
  Target: ATXN1; (+) strand; PAM type: NRG; PAM sequence: CAG
caaaaactagtatggctttt

SEQ ID NO: 129609 - DNA, 20 bp, Artificial Sequence
  Description of Artificial Sequence: Synthetic oligonucleotide
  Target: ATXN1; (+) strand; PAM type: NRG; PAM sequence: GAG
aaaactagtatggcttttca

SEQ ID NO: 129610 - DNA, 20 bp, Artificial Sequence
  Description of Artificial Sequence: Synthetic oligonucleotide
  Target: ATXN1; (+) strand; PAM type: NRG; PAM sequence: AGG
aaactagtatggcttttcag

SEQ ID NO: 129611 - DNA, 20 bp, Artificial Sequence
  Description of Artificial Sequence: Synthetic oligonucleotide
  Target: ATXN1; (+) strand; PAM type: NRG; PAM sequence: GGG
aactagtatggcttttcaga

SEQ ID NO: 129612 - DNA, 20 bp, Artificial Sequence
  Description of Artificial Sequence: Synthetic oligonucleotide
  Target: ATXN1; (+) strand; PAM type: NRG; PAM sequence: GGG
actagtatggcttttcagag

SEQ ID NO: 129613 - DNA, 20 bp, Artificial Sequence
  Description of Artificial Sequence: Synthetic oligonucleotide
  Target: ATXN1; (+) strand; PAM type: NRG; PAM sequence: TGG
ataattcaacctaacatcct

SEQ ID NO: 129614 - DNA, 20 bp, Artificial Sequence
  Description of Artificial Sequence: Synthetic oligonucleotide
  Target: ATXN1; (+) strand; PAM type: NRG; PAM sequence: GAG
aattcaacctaacatccttg

SEQ ID NO: 129615 - DNA, 20 bp, Artificial Sequence
  Description of Artificial Sequence: Synthetic oligonucleotide
  Target: ATXN1; (+) strand; PAM type: NRG; PAM sequence: TGG
catccttggagacataacac

SEQ ID NO: 129616 - DNA, 20 bp, Artificial Sequence
  Description of Artificial Sequence: Synthetic oligonucleotide
  Target: ATXN1; (+) strand; PAM type: NRG; PAM sequence: GAG
tccttggagacataacactg

SEQ ID NO: 129617 - DNA, 20 bp, Artificial Sequence
  Description of Artificial Sequence: Synthetic oligonucleotide
  Target: ATXN1; (+) strand; PAM type: NRG; PAM sequence: AAG
gagataaaataacataaatg

SEQ ID NO: 129618 - DNA, 20 bp, Artificial Sequence
  Description of Artificial Sequence: Synthetic oligonucleotide
  Target: ATXN1; (+) strand; PAM type: NRG; PAM sequence: AAG
taacataaatgaagaataaa

SEQ ID NO: 129619 - DNA, 20 bp, Artificial Sequence
  Description of Artificial Sequence: Synthetic oligonucleotide
  Target: ATXN1; (+) strand; PAM type: NRG; PAM sequence: TGG
aagaataaaaagaaaaatct

SEQ ID NO: 129620 - DNA, 20 bp, Artificial Sequence
  Description of Artificial Sequence: Synthetic oligonucleotide
  Target: ATXN1; (+) strand; PAM type: NRG; PAM sequence: AAG
taaaaagaaaaatcttggat

SEQ ID NO: 129621 - DNA, 20 bp, Artificial Sequence
  Description of Artificial Sequence: Synthetic oligonucleotide
  Target: ATXN1; (+) strand; PAM type: NRG; PAM sequence: CAG
agttcctacatattttactg

SEQ ID NO: 129622 - DNA, 20 bp, Artificial Sequence
  Description of Artificial Sequence: Synthetic oligonucleotide
  Target: ATXN1; (+) strand; PAM type: NRG; PAM sequence: AGG
gttcctacatattttactgc

SEQ ID NO: 129623 - DNA, 20 bp, Artificial Sequence
  Description of Artificial Sequence: Synthetic oligonucleotide
  Target: ATXN1; (+) strand; PAM type: NRG; PAM sequence: AAG
cctacatattttactgcagg

SEQ ID NO: 129624 - DNA, 20 bp, Artificial Sequence
  Description of Artificial Sequence: Synthetic oligonucleotide
  Target: ATXN1; (+) strand; PAM type: NRG; PAM sequence: AAG
acatattttactgcaggaag

SEQ ID NO: 129625 - DNA, 20 bp, Artificial Sequence
  Description of Artificial Sequence: Synthetic oligonucleotide
  Target: ATXN1; (+) strand; PAM type: NRG; PAM sequence: TGG
agccacatgtatttctgtga

SEQ ID NO: 129626 - DNA, 20 bp, Artificial Sequence
  Description of Artificial Sequence: Synthetic oligonucleotide
  Target: ATXN1; (+) strand; PAM type: NRG; PAM sequence: GGG
gccacatgtatttctgtgat

SEQ ID NO: 129627 - DNA, 20 bp, Artificial Sequence
  Description of Artificial Sequence: Synthetic oligonucleotide
  Target: ATXN1; (+) strand; PAM type: NRG; PAM sequence: CAG
gtatttctgtgatgggtttg

SEQ ID NO: 129628 - DNA, 20 bp, Artificial Sequence
  Description of Artificial Sequence: Synthetic oligonucleotide
  Target: ATXN1; (+) strand; PAM type: NRG; PAM sequence: CGG
tctgtgatgggtttgcagaa

SEQ ID NO: 129629 - DNA, 20 bp, Artificial Sequence
  Description of Artificial Sequence: Synthetic oligonucleotide
  Target: ATXN1; (+) strand; PAM type: NRG; PAM sequence: CAG
tgggtttgcagaacggatcc

SEQ ID NO: 129630 - DNA, 20 bp, Artificial Sequence
  Description of Artificial Sequence: Synthetic oligonucleotide
  Target: ATXN1; (+) strand; PAM type: NRG; PAM sequence: AAG
gaacggatcccagcgctgtg

SEQ ID NO: 129631 - DNA, 20 bp, Artificial Sequence
  Description of Artificial Sequence: Synthetic oligonucleotide
  Target: ATXN1; (+) strand; PAM type: NRG; PAM sequence: AGG
aacggatcccagcgctgtga

SEQ ID NO: 129632 - DNA, 20 bp, Artificial Sequence
  Description of Artificial Sequence: Synthetic oligonucleotide
  Target: ATXN1; (+) strand; PAM type: NRG; PAM sequence: GAG
cggatcccagcgctgtgaag

SEQ ID NO: 129633 - DNA, 20 bp, Artificial Sequence
  Description of Artificial Sequence: Synthetic oligonucleotide
  Target: ATXN1; (+) strand; PAM type: NRG; PAM sequence: AGG
ggatcccagcgctgtgaagg

SEQ ID NO: 129634 - DNA, 20 bp, Artificial Sequence
  Description of Artificial Sequence: Synthetic oligonucleotide
  Target: ATXN1; (+) strand; PAM type: NRG; PAM sequence: CAG
cccagcgctgtgaaggaggc

SEQ ID NO: 129635 - DNA, 20 bp, Artificial Sequence
  Description of Artificial Sequence: Synthetic oligonucleotide
  Target: ATXN1; (+) strand; PAM type: NRG; PAM sequence: TAG
cgctgtgaaggaggccagtc

SEQ ID NO: 129636 - DNA, 20 bp, Artificial Sequence
  Description of Artificial Sequence: Synthetic oligonucleotide
  Target: ATXN1; (+) strand; PAM type: NRG; PAM sequence: CGG
gtgaaggaggccagtctaga

SEQ ID NO: 129637 - DNA, 20 bp, Artificial Sequence
  Description of Artificial Sequence: Synthetic oligonucleotide
  Target: ATXN1; (+) strand; PAM type: NRG; PAM sequence: GGG
tgaaggaggccagtctagac

SEQ ID NO: 129638 - DNA, 20 bp, Artificial Sequence
  Description of Artificial Sequence: Synthetic oligonucleotide
  Target: ATXN1; (+) strand; PAM type: NRG; PAM sequence: TAG
agacgggctcccatatccct

SEQ ID NO: 129639 - DNA, 20 bp, Artificial Sequence
  Description of Artificial Sequence: Synthetic oligonucleotide
  Target: ATXN1; (+) strand; PAM type: NRG; PAM sequence: AAG
catatcccttagaacacata

SEQ ID NO: 129640 - DNA, 20 bp, Artificial Sequence
  Description of Artificial Sequence: Synthetic oligonucleotide
  Target: ATXN1; (+) strand; PAM type: NRG; PAM sequence: AGG
atatcccttagaacacataa

SEQ ID NO: 129641 - DNA, 20 bp, Artificial Sequence
  Description of Artificial Sequence: Synthetic oligonucleotide
  Target: ATXN1; (+) strand; PAM type: NRG; PAM sequence: AAG
tcccttagaacacataaagg

SEQ ID NO: 129642 - DNA, 20 bp, Artificial Sequence
  Description of Artificial Sequence: Synthetic oligonucleotide
  Target: ATXN1; (+) strand; PAM type: NRG; PAM sequence: TAG
acacataaaggaagctattc

SEQ ID NO: 129643 - DNA, 20 bp, Artificial Sequence
  Description of Artificial Sequence: Synthetic oligonucleotide
  Target: ATXN1; (+) strand; PAM type: NRG; PAM sequence: AGG
cacataaaggaagctattct

SEQ ID NO: 129644 - DNA, 20 bp, Artificial Sequence
  Description of Artificial Sequence: Synthetic oligonucleotide
  Target: ATXN1; (+) strand; PAM type: NRG; PAM sequence: AAG
taaaggaagctattctaggc

SEQ ID NO: 129645 - DNA, 20 bp, Artificial Sequence
  Description of Artificial Sequence: Synthetic oligonucleotide
  Target: ATXN1; (+) strand; PAM type: NRG; PAM sequence: AAG
ctattctaggcaagtcatac

SEQ ID NO: 129646 - DNA, 20 bp, Artificial Sequence
  Description of Artificial Sequence: Synthetic oligonucleotide
  Target: ATXN1; (+) strand; PAM type: NRG; PAM sequence: TGG
agtcatacaagacttgtgat

SEQ ID NO: 129647 - DNA, 20 bp, Artificial Sequence
  Description of Artificial Sequence: Synthetic oligonucleotide
  Target: ATXN1; (+) strand; PAM type: NRG; PAM sequence: CAG
agacttgtgattggtgaaaa

SEQ ID NO: 129648 - DNA, 20 bp, Artificial Sequence
  Description of Artificial Sequence: Synthetic oligonucleotide
  Target: ATXN1; (+) strand; PAM type: NRG; PAM sequence: GAG
acttgtgattggtgaaaaca

SEQ ID NO: 129649 - DNA, 20 bp, Artificial Sequence
  Description of Artificial Sequence: Synthetic oligonucleotide
  Target: ATXN1; (+) strand; PAM type: NRG; PAM sequence: CAG
atatattttctaattcatga

SEQ ID NO: 129650 - DNA, 20 bp, Artificial Sequence
  Description of Artificial Sequence: Synthetic oligonucleotide
  Target: ATXN1; (+) strand; PAM type: NRG; PAM sequence: AGG
tatattttctaattcatgac

SEQ ID NO: 129651 - DNA, 20 bp, Artificial Sequence
  Description of Artificial Sequence: Synthetic oligonucleotide
  Target: ATXN1; (+) strand; PAM type: NRG; PAM sequence: TGG
acaggccccaacattccctt

SEQ ID NO: 129652 - DNA, 20 bp, Artificial Sequence
  Description of Artificial Sequence: Synthetic oligonucleotide
  Target: ATXN1; (+) strand; PAM type: NRG; PAM sequence: AAG
ttcacgatctgaattcatga

SEQ ID NO: 129653 - DNA, 20 bp, Artificial Sequence
  Description of Artificial Sequence: Synthetic oligonucleotide
  Target: ATXN1; (+) strand; PAM type: NRG; PAM sequence: AAG
cgatctgaattcatgaaaga

SEQ ID NO: 129654 - DNA, 20 bp, Artificial Sequence
  Description of Artificial Sequence: Synthetic oligonucleotide
  Target: ATXN1; (+) strand; PAM type: NRG; PAM sequence: CAG
aattcatgaaagaaagattc

SEQ ID NO: 129655 - DNA, 20 bp, Artificial Sequence
  Description of Artificial Sequence: Synthetic oligonucleotide
  Target: ATXN1; (+) strand; PAM type: NRG; PAM sequence: AAG
tcatgaaagaaagattccag

SEQ ID NO: 129656 - DNA, 20 bp, Artificial Sequence
  Description of Artificial Sequence: Synthetic oligonucleotide
  Target: ATXN1; (+) strand; PAM type: NRG; PAM sequence: AGG
catgaaagaaagattccaga

SEQ ID NO: 129657 - DNA, 20 bp, Artificial Sequence
  Description of Artificial Sequence: Synthetic oligonucleotide
  Target: ATXN1; (+) strand; PAM type: NRG; PAM sequence: AAG
gaaagaaagattccagaagg

SEQ ID NO: 129658 - DNA, 20 bp, Artificial Sequence
  Description of Artificial Sequence: Synthetic oligonucleotide
  Target: ATXN1; (+) strand; PAM type: NRG; PAM sequence: TGG
agaaagattccagaaggaag

SEQ ID NO: 129659 - DNA, 20 bp, Artificial Sequence
  Description of Artificial Sequence: Synthetic oligonucleotide
  Target: ATXN1; (+) strand; PAM type: NRG; PAM sequence: GAG
tccagaaggaagtggaatct

SEQ ID NO: 129660 - DNA, 20 bp, Artificial Sequence
  Description of Artificial Sequence: Synthetic oligonucleotide
  Target: ATXN1; (+) strand; PAM type: NRG; PAM sequence: AAG
tggaatctgagctaatgcta

SEQ ID NO: 129661 - DNA, 20 bp, Artificial Sequence
  Description of Artificial Sequence: Synthetic oligonucleotide
  Target: ATXN1; (+) strand; PAM type: NRG; PAM sequence: CAG
ctaatgctaaagaaataaaa

SEQ ID NO: 129662 - DNA, 20 bp, Artificial Sequence
  Description of Artificial Sequence: Synthetic oligonucleotide
  Target: ATXN1; (+) strand; PAM type: NRG; PAM sequence: GAG
ctaaagaaataaaacagctt

SEQ ID NO: 129663 - DNA, 20 bp, Artificial Sequence
  Description of Artificial Sequence: Synthetic oligonucleotide
  Target: ATXN1; (+) strand; PAM type: NRG; PAM sequence: AAG
aaataaaacagcttgagaaa

SEQ ID NO: 129664 - DNA, 20 bp, Artificial Sequence
  Description of Artificial Sequence: Synthetic oligonucleotide
  Target: ATXN1; (+) strand; PAM type: NRG; PAM sequence: TGG
taaaacagcttgagaaaaag

SEQ ID NO: 129665 - DNA, 20 bp, Artificial Sequence
  Description of Artificial Sequence: Synthetic oligonucleotide
  Target: ATXN1; (+) strand; PAM type: NRG; PAM sequence: GGG
aaaacagcttgagaaaaagt

SEQ ID NO: 129666 - DNA, 20 bp, Artificial Sequence
  Description of Artificial Sequence: Synthetic oligonucleotide
  Target: ATXN1; (+) strand; PAM type: NRG; PAM sequence: AAG
acagcttgagaaaaagtggg

SEQ ID NO: 129667 - DNA, 20 bp, Artificial Sequence
  Description of Artificial Sequence: Synthetic oligonucleotide
  Target: ATXN1; (+) strand; PAM type: NRG; PAM sequence: AAG
aaacgtgtgctaatatgttc

SEQ ID NO: 129668 - DNA, 20 bp, Artificial Sequence
  Description of Artificial Sequence: Synthetic oligonucleotide
  Target: ATXN1; (+) strand; PAM type: NRG; PAM sequence: GAG
acgtgtgctaatatgttcaa

SEQ ID NO: 129669 - DNA, 20 bp, Artificial Sequence
  Description of Artificial Sequence: Synthetic oligonucleotide
  Target: ATXN1; (+) strand; PAM type: NRG; PAM sequence: CGG
atatgttcaagagaccattg

SEQ ID NO: 129670 - DNA, 20 bp, Artificial Sequence
  Description of Artificial Sequence: Synthetic oligonucleotide
  Target: ATXN1; (+) strand; PAM type: NRG; PAM sequence: TGG
gttcaagagaccattgcggt

SEQ ID NO: 129671 - DNA, 20 bp, Artificial Sequence
  Description of Artificial Sequence: Synthetic oligonucleotide
  Target: ATXN1; (+) strand; PAM type: NRG; PAM sequence: GAG
tcaagagaccattgcggttg

SEQ ID NO: 129672 - DNA, 20 bp, Artificial Sequence
  Description of Artificial Sequence: Synthetic oligonucleotide
  Target: ATXN1; (+) strand; PAM type: NRG; PAM sequence: AGG
caagagaccattgcggttgg

SEQ ID NO: 129673 - DNA, 20 bp, Artificial Sequence
  Description of Artificial Sequence: Synthetic oligonucleotide
  Target: ATXN1; (+) strand; PAM type: NRG; PAM sequence: TGG
cggttggaggtgtatgtgtg

SEQ ID NO: 129674 - DNA, 20 bp, Artificial Sequence
  Description of Artificial Sequence: Synthetic oligonucleotide
  Target: ATXN1; (+) strand; PAM type: NRG; PAM sequence: GGG
ggttggaggtgtatgtgtgt

SEQ ID NO: 129675 - DNA, 20 bp, Artificial Sequence
  Description of Artificial Sequence: Synthetic oligonucleotide
  Target: ATXN1; (+) strand; PAM type: NRG; PAM sequence: GGG
gttggaggtgtatgtgtgtg

SEQ ID NO: 129676 - DNA, 20 bp, Artificial Sequence
  Description of Artificial Sequence: Synthetic oligonucleotide
  Target: ATXN1; (+) strand; PAM type: NRG; PAM sequence: GAG
tggaggtgtatgtgtgtggg

SEQ ID NO: 129677 - DNA, 20 bp, Artificial Sequence
  Description of Artificial Sequence: Synthetic oligonucleotide
  Target: ATXN1; (+) strand; PAM type: NRG; PAM sequence: CAG
ggtgtatgtgtgtggggaga

SEQ ID NO: 129678 - DNA, 20 bp, Artificial Sequence
  Description of Artificial Sequence: Synthetic oligonucleotide
  Target: ATXN1; (+) strand; PAM type: NRG; PAM sequence: AAG
gtatgtgtgtggggagacag

SEQ ID NO: 129679 - DNA, 20 bp, Artificial Sequence
  Description of Artificial Sequence: Synthetic oligonucleotide
  Target: ATXN1; (+) strand; PAM type: NRG; PAM sequence: TGG
tgtgtgtggggagacagaag

SEQ ID NO: 129680 - DNA, 20 bp, Artificial Sequence
  Description of Artificial Sequence: Synthetic oligonucleotide
  Target: ATXN1; (+) strand; PAM type: NRG; PAM sequence: GGG
gtgtgtggggagacagaagt

SEQ ID NO: 129681 - DNA, 20 bp, Artificial Sequence
  Description of Artificial Sequence: Synthetic oligonucleotide
  Target: ATXN1; (+) strand; PAM type: NRG; PAM sequence: GAG
gtgtggggagacagaagtgg

SEQ ID NO: 129682 - DNA, 20 bp, Artificial Sequence
  Description of Artificial Sequence: Synthetic oligonucleotide
  Target: ATXN1; (+) strand; PAM type: NRG; PAM sequence: GAG
gtggggagacagaagtggga

SEQ ID NO: 129683 - DNA, 20 bp, Artificial Sequence
  Description of Artificial Sequence: Synthetic oligonucleotide
  Target: ATXN1; (+) strand; PAM type: NRG; PAM sequence: AGG
tggggagacagaagtgggag

SEQ ID NO: 129684 - DNA, 20 bp, Artificial Sequence
  Description of Artificial Sequence: Synthetic oligonucleotide
  Target: ATXN1; (+) strand; PAM type: NRG; PAM sequence: GAG
gggagacagaagtgggagag

SEQ ID NO: 129685 - DNA, 20 bp, Artificial Sequence
  Description of Artificial Sequence: Synthetic oligonucleotide
  Target: ATXN1; (+) strand; PAM type: NRG; PAM sequence: AGG
ggagacagaagtgggagagg

SEQ ID NO: 129686 - DNA, 20 bp, Artificial Sequence
  Description of Artificial Sequence: Synthetic oligonucleotide
  Target: ATXN1; (+) strand; PAM type: NRG; PAM sequence: AAG
acagaagtgggagaggagga

SEQ ID NO: 129687 - DNA, 20 bp, Artificial Sequence
  Description of Artificial Sequence: Synthetic oligonucleotide
  Target: ATXN1; (+) strand; PAM type: NRG; PAM sequence: AAG
gaagtgggagaggaggaaag

SEQ ID NO: 129688 - DNA, 20 bp, Artificial Sequence
  Description of Artificial Sequence: Synthetic oligonucleotide
  Target: ATXN1; (+) strand; PAM type: NRG; PAM sequence: GAG
agtgggagaggaggaaagaa

SEQ ID NO: 129689 - DNA, 20 bp, Artificial Sequence
  Description of Artificial Sequence: Synthetic oligonucleotide
  Target: ATXN1; (+) strand; PAM type: NRG; PAM sequence: AGG
gtgggagaggaggaaagaag

SEQ ID NO: 129690 - DNA, 20 bp, Artificial Sequence
  Description of Artificial Sequence: Synthetic oligonucleotide
  Target: ATXN1; (+) strand; PAM type: NRG; PAM sequence: TGG
ggaggaaagaagaggttaca

SEQ ID NO: 129691 - DNA, 20 bp, Artificial Sequence
  Description of Artificial Sequence: Synthetic oligonucleotide
  Target: ATXN1; (+) strand; PAM type: NRG; PAM sequence: TGG
ggaaagaagaggttacatgg

SEQ ID NO: 129692 - DNA, 20 bp, Artificial Sequence
  Description of Artificial Sequence: Synthetic oligonucleotide
  Target: ATXN1; (+) strand; PAM type: NRG; PAM sequence: GAG
aaagaagaggttacatggtg

SEQ ID NO: 129693 - DNA, 20 bp, Artificial Sequence
  Description of Artificial Sequence: Synthetic oligonucleotide
  Target: ATXN1; (+) strand; PAM type: NRG; PAM sequence: AGG
aagaagaggttacatggtgg

SEQ ID NO: 129694 - DNA, 20 bp, Artificial Sequence
  Description of Artificial Sequence: Synthetic oligonucleotide
  Target: ATXN1; (+) strand; PAM type: NRG; PAM sequence: GGG
agaagaggttacatggtgga

SEQ ID NO: 129695 - DNA, 20 bp, Artificial Sequence
  Description of Artificial Sequence: Synthetic oligonucleotide
  Target: ATXN1; (+) strand; PAM type: NRG; PAM sequence: AAG
ttacatggtggagggtgtca

SEQ ID NO: 129696 - DNA, 20 bp, Artificial Sequence
  Description of Artificial Sequence: Synthetic oligonucleotide
  Target: ATXN1; (+) strand; PAM type: NRG; PAM sequence: AGG
tacatggtggagggtgtcaa

SEQ ID NO: 129697 - DNA, 20 bp, Artificial Sequence
  Description of Artificial Sequence: Synthetic oligonucleotide
  Target: ATXN1; (+) strand; PAM type: NRG; PAM sequence: GAG
agggtgtcaaaggtcttgct

SEQ ID NO: 129698 - DNA, 20 bp, Artificial Sequence
  Description of Artificial Sequence: Synthetic oligonucleotide
  Target: ATXN1; (+) strand; PAM type: NRG; PAM sequence: GAG
aaggtcttgctgagtaattt

SEQ ID NO: 129699 - DNA, 20 bp, Artificial Sequence
  Description of Artificial Sequence: Synthetic oligonucleotide
  Target: ATXN1; (+) strand; PAM type: NRG; PAM sequence: GAG
gagttgattctgtaaaatct

SEQ ID NO: 129700 - DNA, 20 bp, Artificial Sequence
  Description of Artificial Sequence: Synthetic oligonucleotide
  Target: ATXN1; (+) strand; PAM type: NRG; PAM sequence: AGG
agttgattctgtaaaatctg

SEQ ID NO: 129701 - DNA, 20 bp, Artificial Sequence
  Description of Artificial Sequence: Synthetic oligonucleotide
  Target: ATXN1; (+) strand; PAM type: NRG; PAM sequence: GGG
gttgattctgtaaaatctga

SEQ ID NO: 129702 - DNA, 20 bp, Artificial Sequence
  Description of Artificial Sequence: Synthetic oligonucleotide
  Target: ATXN1; (+) strand; PAM type: NRG; PAM sequence: AAG
taaaatctgagggacttctg

SEQ ID NO: 129703 - DNA, 20 bp, Artificial Sequence
  Description of Artificial Sequence: Synthetic oligonucleotide
  Target: ATXN1; (+) strand; PAM type: NRG; PAM sequence: GAG
agggacttctgaagatttcc

SEQ ID NO: 129704 - DNA, 20 bp, Artificial Sequence
  Description of Artificial Sequence: Synthetic oligonucleotide
  Target: ATXN1; (+) strand; PAM type: NRG; PAM sequence: CAG
gacttctgaagatttccgag

SEQ ID NO: 129705 - DNA, 20 bp, Artificial Sequence
  Description of Artificial Sequence: Synthetic oligonucleotide
  Target: ATXN1; (+) strand; PAM type: NRG; PAM sequence: AGG
acttctgaagatttccgagc

SEQ ID NO: 129706 - DNA, 20 bp, Artificial Sequence
  Description of Artificial Sequence: Synthetic oligonucleotide
  Target: ATXN1; (+) strand; PAM type: NRG; PAM sequence: GGG
cttctgaagatttccgagca

SEQ ID NO: 129707 - DNA, 20 bp, Artificial Sequence
  Description of Artificial Sequence: Synthetic oligonucleotide
  Target: ATXN1; (+) strand; PAM type: NRG; PAM sequence: GGG
ttctgaagatttccgagcag

SEQ ID NO: 129708 - DNA, 20 bp, Artificial Sequence
  Description of Artificial Sequence: Synthetic oligonucleotide
  Target: ATXN1; (+) strand; PAM type: NRG; PAM sequence: TAG
gagcaggggaatgctttcat

SEQ ID NO: 129709 - DNA, 20 bp, Artificial Sequence
  Description of Artificial Sequence: Synthetic oligonucleotide
  Target: ATXN1; (+) strand; PAM type: NRG; PAM sequence: AAG
gtactatgtctactgcttct

SEQ ID NO: 129710 - DNA, 20 bp, Artificial Sequence
  Description of Artificial Sequence: Synthetic oligonucleotide
  Target: ATXN1; (+) strand; PAM type: NRG; PAM sequence: GAG
tatgtctactgcttctaagt

SEQ ID NO: 129711 - DNA, 20 bp, Artificial Sequence
  Description of Artificial Sequence: Synthetic oligonucleotide
  Target: ATXN1; (+) strand; PAM type: NRG; PAM sequence: AAG
tgagtgactctgaaatccac

SEQ ID NO: 129712 - DNA, 20 bp, Artificial Sequence
  Description of Artificial Sequence: Synthetic oligonucleotide
  Target: ATXN1; (+) strand; PAM type: NRG; PAM sequence: GAG
gactctgaaatccacaagtc

SEQ ID NO: 129713 - DNA, 20 bp, Artificial Sequence
  Description of Artificial Sequence: Synthetic oligonucleotide
  Target: ATXN1; (+) strand; PAM type: NRG; PAM sequence: AAG
gagccctgacctctctttcc

SEQ ID NO: 129714 - DNA, 20 bp, Artificial Sequence
  Description of Artificial Sequence: Synthetic oligonucleotide
  Target: ATXN1; (+) strand; PAM type: NRG; PAM sequence: CAG
tgacctctctttccaagatg

SEQ ID NO: 129715 - DNA, 20 bp, Artificial Sequence
  Description of Artificial Sequence: Synthetic oligonucleotide
  Target: ATXN1; (+) strand; PAM type: NRG; PAM sequence: CAG
gcctgctgcacgtctctaca

SEQ ID NO: 129716 - DNA, 20 bp, Artificial Sequence
  Description of Artificial Sequence: Synthetic oligonucleotide
  Target: ATXN1; (+) strand; PAM type: NRG; PAM sequence: TGG
tctacacagctatcctgctg

SEQ ID NO: 129717 - DNA, 20 bp, Artificial Sequence
  Description of Artificial Sequence: Synthetic oligonucleotide
  Target: ATXN1; (+) strand; PAM type: NRG; PAM sequence: CAG
ctatcctgctgtggcgcttc

SEQ ID NO: 129718 - DNA, 20 bp, Artificial Sequence
  Description of Artificial Sequence: Synthetic oligonucleotide
  Target: ATXN1; (+) strand; PAM type: NRG; PAM sequence: TGG
cctgctgtggcgcttccagc

SEQ ID NO: 129719 - DNA, 20 bp, Artificial Sequence
  Description of Artificial Sequence: Synthetic oligonucleotide
  Target: ATXN1; (+) strand; PAM type: NRG; PAM sequence: GGG
ctgctgtggcgcttccagct

SEQ ID NO: 129720 - DNA, 20 bp, Artificial Sequence
  Description of Artificial Sequence: Synthetic oligonucleotide
  Target: ATXN1; (+) strand; PAM type: NRG; PAM sequence: TAG
gcgcttccagctgggcatgt

SEQ ID NO: 129721 - DNA, 20 bp, Artificial Sequence
  Description of Artificial Sequence: Synthetic oligonucleotide
  Target: ATXN1; (+) strand; PAM type: NRG; PAM sequence: CAG
ctgggcatgttagatctcta

SEQ ID NO: 129722 - DNA, 20 bp, Artificial Sequence
  Description of Artificial Sequence: Synthetic oligonucleotide
  Target: ATXN1; (+) strand; PAM type: NRG; PAM sequence: TGG
tagatctctacagtccctaa

SEQ ID NO: 129723 - DNA, 20 bp, Artificial Sequence
  Description of Artificial Sequence: Synthetic oligonucleotide
  Target: ATXN1; (+) strand; PAM type: NRG; PAM sequence: TAG
tccctaatggtctgtgattc

SEQ ID NO: 129724 - DNA, 20 bp, Artificial Sequence
  Description of Artificial Sequence: Synthetic oligonucleotide
  Target: ATXN1; (+) strand; PAM type: NRG; PAM sequence: CAG
ctaatggtctgtgattctag

SEQ ID NO: 129725 - DNA, 20 bp, Artificial Sequence
  Description of Artificial Sequence: Synthetic oligonucleotide
  Target: ATXN1; (+) strand; PAM type: NRG; PAM sequence: AAG
atggtctgtgattctagcag

SEQ ID NO: 129726 - DNA, 20 bp, Artificial Sequence
  Description of Artificial Sequence: Synthetic oligonucleotide
  Target: ATXN1; (+) strand; PAM type: NRG; PAM sequence: CGG
tgtgattctagcagaagtta

SEQ ID NO: 129727 - DNA, 20 bp, Artificial Sequence
  Description of Artificial Sequence: Synthetic oligonucleotide
  Target: ATXN1; (+) strand; PAM type: NRG; PAM sequence: GGG
gtgattctagcagaagttac

SEQ ID NO: 129728 - DNA, 20 bp, Artificial Sequence
  Description of Artificial Sequence: Synthetic oligonucleotide
  Target: ATXN1; (+) strand; PAM type: NRG; PAM sequence: AAG
cccttgaaaacactgaaaat

SEQ ID NO: 129729 - DNA, 20 bp, Artificial Sequence
  Description of Artificial Sequence: Synthetic oligonucleotide
  Target: ATXN1; (+) strand; PAM type: NRG; PAM sequence: AGG
ccttgaaaacactgaaaata

SEQ ID NO: 129730 - DNA, 20 bp, Artificial Sequence
  Description of Artificial Sequence: Synthetic oligonucleotide
  Target: ATXN1; (+) strand; PAM type: NRG; PAM sequence: AAG
aaaacactgaaaataaggaa

SEQ ID NO: 129731 - DNA, 20 bp, Artificial Sequence
  Description of Artificial Sequence: Synthetic oligonucleotide
  Target: ATXN1; (+) strand; PAM type: NRG; PAM sequence: AAG
actgaaaataaggaaaagaa

SEQ ID NO: 129732 - DNA, 20 bp, Artificial Sequence
  Description of Artificial Sequence: Synthetic oligonucleotide
  Target: ATXN1; (+) strand; PAM type: NRG; PAM sequence: AAG
ggaaaagaaaagtcatattc

SEQ ID NO: 129733 - DNA, 20 bp, Artificial Sequence
  Description of Artificial Sequence: Synthetic oligonucleotide
  Target: ATXN1; (+) strand; PAM type: NRG; PAM sequence: GAG
aaaagaaaagtcatattcaa

SEQ ID NO: 129734 - DNA, 20 bp, Artificial Sequence
  Description of Artificial Sequence: Synthetic oligonucleotide
  Target: ATXN1; (+) strand; PAM type: NRG; PAM sequence: AGG
aaagaaaagtcatattcaag

SEQ ID NO: 129735 - DNA, 20 bp, Artificial Sequence
  Description of Artificial Sequence: Synthetic oligonucleotide
  Target: ATXN1; (+) strand; PAM type: NRG; PAM sequence: AAG
gaaaagtcatattcaagagg

SEQ ID NO: 129736 - DNA, 20 bp, Artificial Sequence
  Description of Artificial Sequence: Synthetic oligonucleotide
  Target: ATXN1; (+) strand; PAM type: NRG; PAM sequence: GAG
aaagtcatattcaagaggaa

SEQ ID NO: 129737 - DNA, 20 bp, Artificial Sequence
  Description of Artificial Sequence: Synthetic oligonucleotide
  Target: ATXN1; (+) strand; PAM type: NRG; PAM sequence: AAG
tattcaagaggaagagcaaa

SEQ ID NO: 129738 - DNA, 20 bp, Artificial Sequence
  Description of Artificial Sequence: Synthetic oligonucleotide
  Target: ATXN1; (+) strand; PAM type: NRG; PAM sequence: GAG
ttcaagaggaagagcaaaaa

SEQ ID NO: 129739 - DNA, 20 bp, Artificial Sequence
  Description of Artificial Sequence: Synthetic oligonucleotide
  Target: ATXN1; (+) strand; PAM type: NRG; PAM sequence: AGG
tcaagaggaagagcaaaaag

SEQ ID NO: 129740 - DNA, 20 bp, Artificial Sequence
  Description of Artificial Sequence: Synthetic oligonucleotide
  Target: ATXN1; (+) strand; PAM type: NRG; PAM sequence: GAG
aagaggaagagcaaaaagag

SEQ ID NO: 129741 - DNA, 20 bp, Artificial Sequence
  Description of Artificial Sequence: Synthetic oligonucleotide
  Target: ATXN1; (+) strand; PAM type: NRG; PAM sequence: AAG
cgtctttaaatcgaaaaatc

SEQ ID NO: 129742 - DNA, 20 bp, Artificial Sequence
  Description of Artificial Sequence: Synthetic oligonucleotide
  Target: ATXN1; (+) strand; PAM type: NRG; PAM sequence: TAG
tcgaaaaatcaagtctatgt

SEQ ID NO: 129743 - DNA, 20 bp, Artificial Sequence
  Description of Artificial Sequence: Synthetic oligonucleotide
  Target: ATXN1; (+) strand; PAM type: NRG; PAM sequence: TGG
ctatgttagtcatttctctc

SEQ ID NO: 129744 - DNA, 20 bp, Artificial Sequence
  Description of Artificial Sequence: Synthetic oligonucleotide
  Target: ATXN1; (+) strand; PAM type: NRG; PAM sequence: CGG
catttctctctggctgtgct

SEQ ID NO: 129745 - DNA, 20 bp, Artificial Sequence
  Description of Artificial Sequence: Synthetic oligonucleotide
  Target: ATXN1; (+) strand; PAM type: NRG; PAM sequence: GGG
atttctctctggctgtgctc

SEQ ID NO: 129746 - DNA, 20 bp, Artificial Sequence
  Description of Artificial Sequence: Synthetic oligonucleotide
  Target: ATXN1; (+) strand; PAM type: NRG; PAM sequence: AAG
tgctcgggctgtgaaactgc

SEQ ID NO: 129747 - DNA, 20 bp, Artificial Sequence
  Description of Artificial Sequence: Synthetic oligonucleotide
  Target: ATXN1; (+) strand; PAM type: NRG; PAM sequence: TAG
aagatgcacctgtgtgcgta

SEQ ID NO: 129748 - DNA, 20 bp, Artificial Sequence
  Description of Artificial Sequence: Synthetic oligonucleotide
  Target: ATXN1; (+) strand; PAM type: NRG; PAM sequence: AGG
agatgcacctgtgtgcgtat

SEQ ID NO: 129749 - DNA, 20 bp, Artificial Sequence
  Description of Artificial Sequence: Synthetic oligonucleotide
  Target: ATXN1; (+) strand; PAM type: NRG; PAM sequence: TGG
gcacctgtgtgcgtatagga

SEQ ID NO: 129750 - DNA, 20 bp, Artificial Sequence
  Description of Artificial Sequence: Synthetic oligonucleotide
  Target: ATXN1; (+) strand; PAM type: NRG; PAM sequence: TGG
cctgtgtgcgtataggatgg

SEQ ID NO: 129751 - DNA, 20 bp, Artificial Sequence
  Description of Artificial Sequence: Synthetic oligonucleotide
  Target: ATXN1; (+) strand; PAM type: NRG; PAM sequence: TAG
taggatggtggacgtgtgca

SEQ ID NO: 129752 - DNA, 20 bp, Artificial Sequence
  Description of Artificial Sequence: Synthetic oligonucleotide
  Target: ATXN1; (+) strand; PAM type: NRG; PAM sequence: AGG
aggatggtggacgtgtgcat

SEQ ID NO: 129753 - DNA, 20 bp, Artificial Sequence
  Description of Artificial Sequence: Synthetic oligonucleotide
  Target: ATXN1; (+) strand; PAM type: NRG; PAM sequence: TGG
atggtggacgtgtgcatagg

SEQ ID NO: 129754 - DNA, 20 bp, Artificial Sequence
  Description of Artificial Sequence: Synthetic oligonucleotide
  Target: ATXN1; (+) strand; PAM type: NRG; PAM sequence: TGG
gcataggtggatatgtgtcg

SEQ ID NO: 129755 - DNA, 20 bp, Artificial Sequence
  Description of Artificial Sequence: Synthetic oligonucleotide
  Target: ATXN1; (+) strand; PAM type: NRG; PAM sequence: GGG
cataggtggatatgtgtcgt

SEQ ID NO: 129756 - DNA, 20 bp, Artificial Sequence
  Description of Artificial Sequence: Synthetic oligonucleotide
  Target: ATXN1; (+) strand; PAM type: NRG; PAM sequence: GAG
taggtggatatgtgtcgtgg

SEQ ID NO: 129757 - DNA, 20 bp, Artificial Sequence
  Description of Artificial Sequence: Synthetic oligonucleotide
  Target: ATXN1; (+) strand; PAM type: NRG; PAM sequence: AGG
aggtggatatgtgtcgtggg

SEQ ID NO: 129758 - DNA, 20 bp, Artificial Sequence
  Description of Artificial Sequence: Synthetic oligonucleotide
  Target: ATXN1; (+) strand; PAM type: NRG; PAM sequence: CAG
atatgtgtcgtgggaggaca

SEQ ID NO: 129759 - DNA, 20 bp, Artificial Sequence
  Description of Artificial Sequence: Synthetic oligonucleotide
  Target: ATXN1; (+) strand; PAM type: NRG; PAM sequence: AGG
tatgtgtcgtgggaggacac

SEQ ID NO: 129760 - DNA, 20 bp, Artificial Sequence
  Description of Artificial Sequence: Synthetic oligonucleotide
  Target: ATXN1; (+) strand; PAM type: NRG; PAM sequence: GAG
tgtgtcgtgggaggacacag

SEQ ID NO: 129761 - DNA, 20 bp, Artificial Sequence
  Description of Artificial Sequence: Synthetic oligonucleotide
  Target: ATXN1; (+) strand; PAM type: NRG; PAM sequence: AGG
gtgtcgtgggaggacacagg

SEQ ID NO: 129762 - DNA, 20 bp, Artificial Sequence
  Description of Artificial Sequence: Synthetic oligonucleotide
  Target: ATXN1; (+) strand; PAM type: NRG; PAM sequence: AAG
aggacacaggaggtactgct

SEQ ID NO: 129763 - DNA, 20 bp, Artificial Sequence
  Description of Artificial Sequence: Synthetic oligonucleotide
  Target: ATXN1; (+) strand; PAM type: NRG; PAM sequence: AGG
ggacacaggaggtactgcta

SEQ ID NO: 129764 - DNA, 20 bp, Artificial Sequence
  Description of Artificial Sequence: Synthetic oligonucleotide
  Target: ATXN1; (+) strand; PAM type: NRG; PAM sequence: AAG
gtactgctaaggcactctcc

SEQ ID NO: 129765 - DNA, 20 bp, Artificial Sequence
  Description of Artificial Sequence: Synthetic oligonucleotide
  Target: ATXN1; (+) strand; PAM type: NRG; PAM sequence: AGG
tactgctaaggcactctcca

SEQ ID NO: 129766 - DNA, 20 bp, Artificial Sequence
  Description of Artificial Sequence: Synthetic oligonucleotide
  Target: ATXN1; (+) strand; PAM type: NRG; PAM sequence: CAG
acatgctctcaatgacaacc

SEQ ID NO: 129767 - DNA, 20 bp, Artificial Sequence
  Description of Artificial Sequence: Synthetic oligonucleotide
  Target: ATXN1; (+) strand; PAM type: NRG; PAM sequence: TGG
ctctcaatgacaacccagaa

SEQ ID NO: 129768 - DNA, 20 bp, Artificial Sequence
  Description of Artificial Sequence: Synthetic oligonucleotide
  Target: ATXN1; (+) strand; PAM type: NRG; PAM sequence: AAG
aatggttttcttgccactca

SEQ ID NO: 129769 - DNA, 20 bp, Artificial Sequence
  Description of Artificial Sequence: Synthetic oligonucleotide
  Target: ATXN1; (+) strand; PAM type: NRG; PAM sequence: TGG
tcaaagatgctactcacacg

SEQ ID NO: 129770 - DNA, 20 bp, Artificial Sequence
  Description of Artificial Sequence: Synthetic oligonucleotide
  Target: ATXN1; (+) strand; PAM type: NRG; PAM sequence: GAG
aaagatgctactcacacgtg

SEQ ID NO: 129771 - DNA, 20 bp, Artificial Sequence
  Description of Artificial Sequence: Synthetic oligonucleotide
  Target: ATXN1; (+) strand; PAM type: NRG; PAM sequence: GAG
agatgctactcacacgtgga

SEQ ID NO: 129772 - DNA, 20 bp, Artificial Sequence
  Description of Artificial Sequence: Synthetic oligonucleotide
  Target: ATXN1; (+) strand; PAM type: NRG; PAM sequence: AGG
gatgctactcacacgtggag

SEQ ID NO: 129773 - DNA, 20 bp, Artificial Sequence
  Description of Artificial Sequence: Synthetic oligonucleotide
  Target: ATXN1; (+) strand; PAM type: NRG; PAM sequence: TGG
ctactcacacgtggagaggc

SEQ ID NO: 129774 - DNA, 20 bp, Artificial Sequence
  Description of Artificial Sequence: Synthetic oligonucleotide
  Target: ATXN1; (+) strand; PAM type: NRG; PAM sequence: TAG
acacgtggagaggctggctc

SEQ ID NO: 129775 - DNA, 20 bp, Artificial Sequence
  Description of Artificial Sequence: Synthetic oligonucleotide
  Target: ATXN1; (+) strand; PAM type: NRG; PAM sequence: AAG
gctggctctagaaacaatta

SEQ ID NO: 129776 - DNA, 20 bp, Artificial Sequence
  Description of Artificial Sequence: Synthetic oligonucleotide
  Target: ATXN1; (+) strand; PAM type: NRG; PAM sequence: CAG
ctctagaaacaattaaagtc

SEQ ID NO: 129777 - DNA, 20 bp, Artificial Sequence
  Description of Artificial Sequence: Synthetic oligonucleotide
  Target: ATXN1; (+) strand; PAM type: NRG; PAM sequence: AAG
aaacaattaaagtccagaat

SEQ ID NO: 129778 - DNA, 20 bp, Artificial Sequence
  Description of Artificial Sequence: Synthetic oligonucleotide
  Target: ATXN1; (+) strand; PAM type: NRG; PAM sequence: AGG
aacaattaaagtccagaata

SEQ ID NO: 129779 - DNA, 20 bp, Artificial Sequence
  Description of Artificial Sequence: Synthetic oligonucleotide
  Target: ATXN1; (+) strand; PAM type: NRG; PAM sequence: CAG
ctcacacttgtctttctaac

SEQ ID NO: 129780 - DNA, 20 bp, Artificial Sequence
  Description of Artificial Sequence: Synthetic oligonucleotide
  Target: ATXN1; (+) strand; PAM type: NRG; PAM sequence: GAG
cagctcactctatgtctaat

SEQ ID NO: 129781 - DNA, 20 bp, Artificial Sequence
  Description of Artificial Sequence: Synthetic oligonucleotide
  Target: ATXN1; (+) strand; PAM type: NRG; PAM sequence: AAG
tcactctatgtctaatgagc

SEQ ID NO: 129782 - DNA, 20 bp, Artificial Sequence
  Description of Artificial Sequence: Synthetic oligonucleotide
  Target: ATXN1; (+) strand; PAM type: NRG; PAM sequence: AAG
gtcatccctaaatccttatg

SEQ ID NO: 129783 - DNA, 20 bp, Artificial Sequence
  Description of Artificial Sequence: Synthetic oligonucleotide
  Target: ATXN1; (+) strand; PAM type: NRG; PAM sequence: TAG
taaatccttatgaagccatg

SEQ ID NO: 129784 - DNA, 20 bp, Artificial Sequence
  Description of Artificial Sequence: Synthetic oligonucleotide
  Target: ATXN1; (+) strand; PAM type: NRG; PAM sequence: TGG
atccttatgaagccatgtag

SEQ ID NO: 129785 - DNA, 20 bp, Artificial Sequence
  Description of Artificial Sequence: Synthetic oligonucleotide
  Target: ATXN1; (+) strand; PAM type: NRG; PAM sequence: GGG
tccttatgaagccatgtagt

SEQ ID NO: 129786 - DNA, 20 bp, Artificial Sequence
  Description of Artificial Sequence: Synthetic oligonucleotide
  Target: ATXN1; (+) strand; PAM type: NRG; PAM sequence: GGG
ccttatgaagccatgtagtg

SEQ ID NO: 129787 - DNA, 20 bp, Artificial Sequence
  Description of Artificial Sequence: Synthetic oligonucleotide
  Target: ATXN1; (+) strand; PAM type: NRG; PAM sequence: GAG
ttatgaagccatgtagtggg

SEQ ID NO: 129788 - DNA, 20 bp, Artificial Sequence
  Description of Artificial Sequence: Synthetic oligonucleotide
  Target: ATXN1; (+) strand; PAM type: NRG; PAM sequence: AAG
agtggggagtgtcccccata

SEQ ID NO: 129789 - DNA, 20 bp, Artificial Sequence
  Description of Artificial Sequence: Synthetic oligonucleotide
  Target: ATXN1; (+) strand; PAM type: NRG; PAM sequence: CAG
gggagtgtcccccataaaga

SEQ ID NO: 129790 - DNA, 20 bp, Artificial Sequence
  Description of Artificial Sequence: Synthetic oligonucleotide
  Target: ATXN1; (+) strand; PAM type: NRG; PAM sequence: AGG
ggagtgtcccccataaagac

SEQ ID NO: 129791 - DNA, 20 bp, Artificial Sequence
  Description of Artificial Sequence: Synthetic oligonucleotide
  Target: ATXN1; (+) strand; PAM type: NRG; PAM sequence: AAG
gtcccccataaagacaggtg

SEQ ID NO: 129792 - DNA, 20 bp, Artificial Sequence
  Description of Artificial Sequence: Synthetic oligonucleotide
  Target: ATXN1; (+) strand; PAM type: NRG; PAM sequence: AAG
aaagacaggtgaagaactcc

SEQ ID NO: 129793 - DNA, 20 bp, Artificial Sequence
  Description of Artificial Sequence: Synthetic oligonucleotide
  Target: ATXN1; (+) strand; PAM type: NRG; PAM sequence: CAG
actccaagatactcctttaa

SEQ ID NO: 129794 - DNA, 20 bp, Artificial Sequence
  Description of Artificial Sequence: Synthetic oligonucleotide
  Target: ATXN1; (+) strand; PAM type: NRG; PAM sequence: AGG
ctccaagatactcctttaac

SEQ ID NO: 129795 - DNA, 20 bp, Artificial Sequence
  Description of Artificial Sequence: Synthetic oligonucleotide
  Target: ATXN1; (+) strand; PAM type: NRG; PAM sequence: GAG
ccaagatactcctttaacag

SEQ ID NO: 129796 - DNA, 20 bp, Artificial Sequence
  Description of Artificial Sequence: Synthetic oligonucleotide
  Target: ATXN1; (+) strand; PAM type: NRG; PAM sequence: AAG
atactcctttaacaggagta

SEQ ID NO: 129797 - DNA, 20 bp, Artificial Sequence
  Description of Artificial Sequence: Synthetic oligonucleotide
  Target: ATXN1; (+) strand; PAM type: NRG; PAM sequence: AGG
tactcctttaacaggagtaa

SEQ ID NO: 129798 - DNA, 20 bp, Artificial Sequence
  Description of Artificial Sequence: Synthetic oligonucleotide
  Target: ATXN1; (+) strand; PAM type: NRG; PAM sequence: AAG
atgtccttctgctgcttcaa

SEQ ID NO: 129799 - DNA, 20 bp, Artificial Sequence
  Description of Artificial Sequence: Synthetic oligonucleotide
  Target: ATXN1; (+) strand; PAM type: NRG; PAM sequence: TAG
tattgtgcacaacgttacgt

SEQ ID NO: 129800 - DNA, 20 bp, Artificial Sequence
  Description of Artificial Sequence: Synthetic oligonucleotide
  Target: ATXN1; (+) strand; PAM type: NRG; PAM sequence: CAG
tgtgcacaacgttacgttag

SEQ ID NO: 129801 - DNA, 20 bp, Artificial Sequence
  Description of Artificial Sequence: Synthetic oligonucleotide
  Target: ATXN1; (+) strand; PAM type: NRG; PAM sequence: GAG
tgcacaacgttacgttagca

SEQ ID NO: 129802 - DNA, 20 bp, Artificial Sequence
  Description of Artificial Sequence: Synthetic oligonucleotide
  Target: ATXN1; (+) strand; PAM type: NRG; PAM sequence: GAG
cacaacgttacgttagcaga

SEQ ID NO: 129803 - DNA, 20 bp, Artificial Sequence
  Description of Artificial Sequence: Synthetic oligonucleotide
  Target: ATXN1; (+) strand; PAM type: NRG; PAM sequence: AAG
aacgttacgttagcagagag

SEQ ID NO: 129804 - DNA, 20 bp, Artificial Sequence
  Description of Artificial Sequence: Synthetic oligonucleotide
  Target: ATXN1; (+) strand; PAM type: NRG; PAM sequence: AAG
acgttagcagagagaagacg

SEQ ID NO: 129805 - DNA, 20 bp, Artificial Sequence
  Description of Artificial Sequence: Synthetic oligonucleotide
  Target: ATXN1; (+) strand; PAM type: NRG; PAM sequence: CAG
ttagcagagagaagacgaag

SEQ ID NO: 129806 - DNA, 20 bp, Artificial Sequence
  Description of Artificial Sequence: Synthetic oligonucleotide
  Target: ATXN1; (+) strand; PAM type: NRG; PAM sequence: CAG
aagcagcaccttcattcaca

SEQ ID NO: 129807 - DNA, 20 bp, Artificial Sequence
  Description of Artificial Sequence: Synthetic oligonucleotide
  Target: ATXN1; (+) strand; PAM type: NRG; PAM sequence: AAG
tcacacagtgtgttttgaat

SEQ ID NO: 129808 - DNA, 20 bp, Artificial Sequence
  Description of Artificial Sequence: Synthetic oligonucleotide
  Target: ATXN1; (+) strand; PAM type: NRG; PAM sequence: AGG
cacacagtgtgttttgaata

SEQ ID NO: 129809 - DNA, 20 bp, Artificial Sequence
  Description of Artificial Sequence: Synthetic oligonucleotide
  Target: ATXN1; (+) strand; PAM type: NRG; PAM sequence: CAG
ttgaataaggtgtaatttat

SEQ ID NO: 129810 - DNA, 20 bp, Artificial Sequence
  Description of Artificial Sequence: Synthetic oligonucleotide
  Target: ATXN1; (+) strand; PAM type: NRG; PAM sequence: AGG
tgaataaggtgtaatttatc

SEQ ID NO: 129811 - DNA, 20 bp, Artificial Sequence
  Description of Artificial Sequence: Synthetic oligonucleotide
  Target: ATXN1; (+) strand; PAM type: NRG; PAM sequence: TAG
ataaggtgtaatttatcagg

SEQ ID NO: 129812 - DNA, 20 bp, Artificial Sequence
  Description of Artificial Sequence: Synthetic oligonucleotide
  Target: ATXN1; (+) strand; PAM type: NRG; PAM sequence: GAG
aaggtgtaatttatcaggta

SEQ ID NO: 129813 - DNA, 20 bp, Artificial Sequence
  Description of Artificial Sequence: Synthetic oligonucleotide
  Target: ATXN1; (+) strand; PAM type: NRG; PAM sequence: TGG
gaaatttctcttctcttttc

SEQ ID NO: 129814 - DNA, 20 bp, Artificial Sequence
  Description of Artificial Sequence: Synthetic oligonucleotide
  Target: ATXN1; (+) strand; PAM type: NRG; PAM sequence: TAG
tctcttctcttttctggaca

SEQ ID NO: 129815 - DNA, 20 bp, Artificial Sequence
  Description of Artificial Sequence: Synthetic oligonucleotide
  Target: ATXN1; (+) strand; PAM type: NRG; PAM sequence: CAG
tttctggacatagcttccaa

SEQ ID NO: 129816 - DNA, 20 bp, Artificial Sequence
  Description of Artificial Sequence: Synthetic oligonucleotide
  Target: ATXN1; (+) strand; PAM type: NRG; PAM sequence: TAG
tagcttccaacagcaaaaat

SEQ ID NO: 129817 - DNA, 20 bp, Artificial Sequence
  Description of Artificial Sequence: Synthetic oligonucleotide
  Target: ATXN1; (+) strand; PAM type: NRG; PAM sequence: AAG
cttccaacagcaaaaattag

SEQ ID NO: 129818 - DNA, 20 bp, Artificial Sequence
  Description of Artificial Sequence: Synthetic oligonucleotide
  Target: ATXN1; (+) strand; PAM type: NRG; PAM sequence: TAG
aacagcaaaaattagaagtg

SEQ ID NO: 129819 - DNA, 20 bp, Artificial Sequence
  Description of Artificial Sequence: Synthetic oligonucleotide
  Target: ATXN1; (+) strand; PAM type: NRG; PAM sequence: AGG
acagcaaaaattagaagtgt

SEQ ID NO: 129820 - DNA, 20 bp, Artificial Sequence
  Description of Artificial Sequence: Synthetic oligonucleotide
  Target: ATXN1; (+) strand; PAM type: NRG; PAM sequence: TGG
gcaaaaattagaagtgtagg

SEQ ID NO: 129821 - DNA, 20 bp, Artificial Sequence
  Description of Artificial Sequence: Synthetic oligonucleotide
  Target: ATXN1; (+) strand; PAM type: NRG; PAM sequence: GGG
caaaaattagaagtgtaggt

SEQ ID NO: 129822 - DNA, 20 bp, Artificial Sequence
  Description of Artificial Sequence: Synthetic oligonucleotide
  Target: ATXN1; (+) strand; PAM type: NRG; PAM sequence: AAG
tccactcactaaatttataa

SEQ ID NO: 129823 - DNA, 20 bp, Artificial Sequence
  Description of Artificial Sequence: Synthetic oligonucleotide
  Target: ATXN1; (+) strand; PAM type: NRG; PAM sequence: AAG
aaatttataaaagatactca

SEQ ID NO: 129824 - DNA, 20 bp, Artificial Sequence
  Description of Artificial Sequence: Synthetic oligonucleotide
  Target: ATXN1; (+) strand; PAM type: NRG; PAM sequence: AAG
aagatactcacacttttcac

SEQ ID NO: 129825 - DNA, 20 bp, Artificial Sequence
  Description of Artificial Sequence: Synthetic oligonucleotide
  Target: ATXN1; (+) strand; PAM type: NRG; PAM sequence: CAG
tacccccatctgcccacatc

SEQ ID NO: 129826 - DNA, 20 bp, Artificial Sequence
  Description of Artificial Sequence: Synthetic oligonucleotide
  Target: ATXN1; (+) strand; PAM type: NRG; PAM sequence: CAG
agcatctatcttcgctgtga

SEQ ID NO: 129827 - DNA, 20 bp, Artificial Sequence
  Description of Artificial Sequence: Synthetic oligonucleotide
  Target: ATXN1; (+) strand; PAM type: NRG; PAM sequence: CAG
aataattactatccgctgta

SEQ ID NO: 129828 - DNA, 20 bp, Artificial Sequence
  Description of Artificial Sequence: Synthetic oligonucleotide
  Target: ATXN1; (+) strand; PAM type: NRG; PAM sequence: TGG
atccgctgtacagccttgac

SEQ ID NO: 129829 - DNA, 20 bp, Artificial Sequence
  Description of Artificial Sequence: Synthetic oligonucleotide
  Target: ATXN1; (+) strand; PAM type: NRG; PAM sequence: CGG
cgctgtacagccttgactgg

SEQ ID NO: 129830 - DNA, 20 bp, Artificial Sequence
  Description of Artificial Sequence: Synthetic oligonucleotide
  Target: ATXN1; (+) strand; PAM type: NRG; PAM sequence: GAG
ctgtacagccttgactggcg

SEQ ID NO: 129831 - DNA, 20 bp, Artificial Sequence
  Description of Artificial Sequence: Synthetic oligonucleotide
  Target: ATXN1; (+) strand; PAM type: NRG; PAM sequence: TGG
acagccttgactggcggagc

SEQ ID NO: 129832 - DNA, 20 bp, Artificial Sequence
  Description of Artificial Sequence: Synthetic oligonucleotide
  Target: ATXN1; (+) strand; PAM type: NRG; PAM sequence: CAG
ccttgactggcggagctggc

SEQ ID NO: 129833 - DNA, 20 bp, Artificial Sequence
  Description of Artificial Sequence: Synthetic oligonucleotide
  Target: ATXN1; (+) strand; PAM type: NRG; PAM sequence: CGG
ctggccagaacattgcctta

SEQ ID NO: 129834 - DNA, 20 bp, Artificial Sequence
  Description of Artificial Sequence: Synthetic oligonucleotide
  Target: ATXN1; (+) strand; PAM type: NRG; PAM sequence: GGG
tggccagaacattgccttac

SEQ ID NO: 129835 - DNA, 20 bp, Artificial Sequence
  Description of Artificial Sequence: Synthetic oligonucleotide
  Target: ATXN1; (+) strand; PAM type: NRG; PAM sequence: GGG
ggccagaacattgccttacg

SEQ ID NO: 129836 - DNA, 20 bp, Artificial Sequence
  Description of Artificial Sequence: Synthetic oligonucleotide
  Target: ATXN1; (+) strand; PAM type: NRG; PAM sequence: GGG
gccagaacattgccttacgg

SEQ ID NO: 129837 - DNA, 20 bp, Artificial Sequence
  Description of Artificial Sequence: Synthetic oligonucleotide
  Target: ATXN1; (+) strand; PAM type: NRG; PAM sequence: AAG
tacgggggtgtatcaccttg

SEQ ID NO: 129838 - DNA, 20 bp, Artificial Sequence
  Description of Artificial Sequence: Synthetic oligonucleotide
  Target: ATXN1; (+) strand; PAM type: NRG; PAM sequence: TGG
cttgaagtctgtttacctgc

SEQ ID NO: 129839 - DNA, 20 bp, Artificial Sequence
  Description of Artificial Sequence: Synthetic oligonucleotide
  Target: ATXN1; (+) strand; PAM type: NRG; PAM sequence: CAG
tggtccatgtcaatgatgtt

SEQ ID NO: 129840 - DNA, 20 bp, Artificial Sequence
  Description of Artificial Sequence: Synthetic oligonucleotide
  Target: ATXN1; (+) strand; PAM type: NRG; PAM sequence: CAG
actcatactaaattctactc

SEQ ID NO: 129841 - DNA, 20 bp, Artificial Sequence
  Description of Artificial Sequence: Synthetic oligonucleotide
  Target: ATXN1; (+) strand; PAM type: NRG; PAM sequence: GAG
tcatactaaattctactcca

SEQ ID NO: 129842 - DNA, 20 bp, Artificial Sequence
  Description of Artificial Sequence: Synthetic oligonucleotide
  Target: ATXN1; (+) strand; PAM type: NRG; PAM sequence: TGG
aattctactccagagcaacg

SEQ ID NO: 129843 - DNA, 20 bp, Artificial Sequence
  Description of Artificial Sequence: Synthetic oligonucleotide
  Target: ATXN1; (+) strand; PAM type: NRG; PAM sequence: TGG
ctactccagagcaacgtggc

SEQ ID NO: 129844 - DNA, 20 bp, Artificial Sequence
  Description of Artificial Sequence: Synthetic oligonucleotide
  Target: ATXN1; (+) strand; PAM type: NRG; PAM sequence: GGG
tactccagagcaacgtggct

SEQ ID NO: 129845 - DNA, 20 bp, Artificial Sequence
  Description of Artificial Sequence: Synthetic oligonucleotide
  Target: ATXN1; (+) strand; PAM type: NRG; PAM sequence: AAG
tggctgggcctcttctgtct

SEQ ID NO: 129846 - DNA, 20 bp, Artificial Sequence
  Description of Artificial Sequence: Synthetic oligonucleotide
  Target: ATXN1; (+) strand; PAM type: NRG; PAM sequence: AGG
ggctgggcctcttctgtcta

SEQ ID NO: 129847 - DNA, 20 bp, Artificial Sequence
  Description of Artificial Sequence: Synthetic oligonucleotide
  Target: ATXN1; (+) strand; PAM type: NRG; PAM sequence: TGG
gcctcttctgtctaaggatg

SEQ ID NO: 129848 - DNA, 20 bp, Artificial Sequence
  Description of Artificial Sequence: Synthetic oligonucleotide
  Target: ATXN1; (+) strand; PAM type: NRG; PAM sequence: CAG
gctccacgtatttccgatga

SEQ ID NO: 129849 - DNA, 20 bp, Artificial Sequence
  Description of Artificial Sequence: Synthetic oligonucleotide
  Target: ATXN1; (+) strand; PAM type: NRG; PAM sequence: TAG
acgtatttccgatgacagaa

SEQ ID NO: 129850 - DNA, 20 bp, Artificial Sequence
  Description of Artificial Sequence: Synthetic oligonucleotide
  Target: ATXN1; (+) strand; PAM type: NRG; PAM sequence: CAG
atagcaaatcattaaaacgc

SEQ ID NO: 129851 - DNA, 20 bp, Artificial Sequence
  Description of Artificial Sequence: Synthetic oligonucleotide
  Target: ATXN1; (+) strand; PAM type: NRG; PAM sequence: GAG
agcaaatcattaaaacgcca

SEQ ID NO: 129852 - DNA, 20 bp, Artificial Sequence
  Description of Artificial Sequence: Synthetic oligonucleotide
  Target: ATXN1; (+) strand; PAM type: NRG; PAM sequence: AAG
attaaaacgccagagaacca

SEQ ID NO: 129853 - DNA, 20 bp, Artificial Sequence
  Description of Artificial Sequence: Synthetic oligonucleotide
  Target: ATXN1; (+) strand; PAM type: NRG; PAM sequence: AGG
ttaaaacgccagagaaccaa

SEQ ID NO: 129854 - DNA, 20 bp, Artificial Sequence
  Description of Artificial Sequence: Synthetic oligonucleotide
  Target: ATXN1; (+) strand; PAM type: NRG; PAM sequence: GGG
taaaacgccagagaaccaaa

SEQ ID NO: 129855 - DNA, 20 bp, Artificial Sequence
  Description of Artificial Sequence: Synthetic oligonucleotide
  Target: ATXN1; (+) strand; PAM type: NRG; PAM sequence: CAG
gaaccaaagggcttcgactt

SEQ ID NO: 129856 - DNA, 20 bp, Artificial Sequence
  Description of Artificial Sequence: Synthetic oligonucleotide
  Target: ATXN1; (+) strand; PAM type: NRG; PAM sequence: AGG
aaccaaagggcttcgacttc

SEQ ID NO: 129857 - DNA, 20 bp, Artificial Sequence
  Description of Artificial Sequence: Synthetic oligonucleotide
  Target: ATXN1; (+) strand; PAM type: NRG; PAM sequence: GAG
ccaaagggcttcgacttcag

SEQ ID NO: 129858 - DNA, 20 bp, Artificial Sequence
  Description of Artificial Sequence: Synthetic oligonucleotide
  Target: ATXN1; (+) strand; PAM type: NRG; PAM sequence: TGG
gacttcaggagacctccttg

SEQ ID NO: 129859 - DNA, 20 bp, Artificial Sequence
  Description of Artificial Sequence: Synthetic oligonucleotide
  Target: ATXN1; (+) strand; PAM type: NRG; PAM sequence: GGG
acttcaggagacctccttgt

SEQ ID NO: 129860 - DNA, 20 bp, Artificial Sequence
  Description of Artificial Sequence: Synthetic oligonucleotide
  Target: ATXN1; (+) strand; PAM type: NRG; PAM sequence: CAG
cctccttgtgggcaatcgca

SEQ ID NO: 129861 - DNA, 20 bp, Artificial Sequence
  Description of Artificial Sequence: Synthetic oligonucleotide
  Target: ATXN1; (+) strand; PAM type: NRG; PAM sequence: CGG
ccatgactttccaatctttt

SEQ ID NO: 129862 - DNA, 20 bp, Artificial Sequence
  Description of Artificial Sequence: Synthetic oligonucleotide
  Target: ATXN1; (+) strand; PAM type: NRG; PAM sequence: GAG
atgactttccaatcttttcg

SEQ ID NO: 129863 - DNA, 20 bp, Artificial Sequence
  Description of Artificial Sequence: Synthetic oligonucleotide
  Target: ATXN1; (+) strand; PAM type: NRG; PAM sequence: AGG
tgactttccaatcttttcgg

SEQ ID NO: 129864 - DNA, 20 bp, Artificial Sequence
  Description of Artificial Sequence: Synthetic oligonucleotide
  Target: ATXN1; (+) strand; PAM type: NRG; PAM sequence: CAG
gttcaaattccgctttcgtt

SEQ ID NO: 129865 - DNA, 20 bp, Artificial Sequence
  Description of Artificial Sequence: Synthetic oligonucleotide
  Target: ATXN1; (+) strand; PAM type: NRG; PAM sequence: AGG
ttcaaattccgctttcgttc

SEQ ID NO: 129866 - DNA, 20 bp, Artificial Sequence
  Description of Artificial Sequence: Synthetic oligonucleotide
  Target: ATXN1; (+) strand; PAM type: NRG; PAM sequence: TAG
tcgttcaggctatgcgcctc

SEQ ID NO: 129867 - DNA, 20 bp, Artificial Sequence
  Description of Artificial Sequence: Synthetic oligonucleotide
  Target: ATXN1; (+) strand; PAM type: NRG; PAM sequence: AGG
cgttcaggctatgcgcctct

SEQ ID NO: 129868 - DNA, 20 bp, Artificial Sequence
  Description of Artificial Sequence: Synthetic oligonucleotide
  Target: ATXN1; (+) strand; PAM type: NRG; PAM sequence: GAG
ttcaggctatgcgcctctag

SEQ ID NO: 129869 - DNA, 20 bp, Artificial Sequence
  Description of Artificial Sequence: Synthetic oligonucleotide
  Target: ATXN1; (+) strand; PAM type: NRG; PAM sequence: AGG
tcaggctatgcgcctctagg

SEQ ID NO: 129870 - DNA, 20 bp, Artificial Sequence
  Description of Artificial Sequence: Synthetic oligonucleotide
  Target: ATXN1; (+) strand; PAM type: NRG; PAM sequence: TGG
ggctatgcgcctctaggagg

SEQ ID NO: 129871 - DNA, 20 bp, Artificial Sequence
  Description of Artificial Sequence: Synthetic oligonucleotide
  Target: ATXN1; (+) strand; PAM type: NRG; PAM sequence: TGG
taggaggtggcctctctacg

SEQ ID NO: 129872 - DNA, 20 bp, Artificial Sequence
  Description of Artificial Sequence: Synthetic oligonucleotide
  Target: ATXN1; (+) strand; PAM type: NRG; PAM sequence: TGG
tctacgtggctaccctgcca

SEQ ID NO: 129873 - DNA, 20 bp, Artificial Sequence
  Description of Artificial Sequence: Synthetic oligonucleotide
  Target: ATXN1; (+) strand; PAM type: NRG; PAM sequence: CAG
ctaccctgccatggcccttc

SEQ ID NO: 129874 - DNA, 20 bp, Artificial Sequence
  Description of Artificial Sequence: Synthetic oligonucleotide
  Target: ATXN1; (+) strand; PAM type: NRG; PAM sequence: TGG
cctgccatggcccttccagc

SEQ ID NO: 129875 - DNA, 20 bp, Artificial Sequence
  Description of Artificial Sequence: Synthetic oligonucleotide
  Target: ATXN1; (+) strand; PAM type: NRG; PAM sequence: TGG
tggcccttccagctggccat

SEQ ID NO: 129876 - DNA, 20 bp, Artificial Sequence
  Description of Artificial Sequence: Synthetic oligonucleotide
  Target: ATXN1; (+) strand; PAM type: NRG; PAM sequence: CAG
cccttccagctggccattgg

SEQ ID NO: 129877 - DNA, 20 bp, Artificial Sequence
  Description of Artificial Sequence: Synthetic oligonucleotide
  Target: ATXN1; (+) strand; PAM type: NRG; PAM sequence: CAG
cagctggccattggcagcgc

SEQ ID NO: 129878 - DNA, 20 bp, Artificial Sequence
  Description of Artificial Sequence: Synthetic oligonucleotide
  Target: ATXN1; (+) strand; PAM type: NRG; PAM sequence: AGG
agctggccattggcagcgcc

SEQ ID NO: 129879 - DNA, 20 bp, Artificial Sequence
  Description of Artificial Sequence: Synthetic oligonucleotide
  Target: ATXN1; (+) strand; PAM type: NRG; PAM sequence: CAG
ccattggcagcgccaggaca

SEQ ID NO: 129880 - DNA, 20 bp, Artificial Sequence
  Description of Artificial Sequence: Synthetic oligonucleotide
  Target: ATXN1; (+) strand; PAM type: NRG; PAM sequence: AAG
cagcgccaggacacagcata

SEQ ID NO: 129881 - DNA, 20 bp, Artificial Sequence
  Description of Artificial Sequence: Synthetic oligonucleotide
  Target: ATXN1; (+) strand; PAM type: NRG; PAM sequence: TGG
acacagcataaagaaaactg

SEQ ID NO: 129882 - DNA, 20 bp, Artificial Sequence
  Description of Artificial Sequence: Synthetic oligonucleotide
  Target: ATXN1; (+) strand; PAM type: NRG; PAM sequence: TGG
gcataaagaaaactgtggtt

SEQ ID NO: 129883 - DNA, 20 bp, Artificial Sequence
  Description of Artificial Sequence: Synthetic oligonucleotide
  Target: ATXN1; (+) strand; PAM type: NRG; PAM sequence: GGG
cataaagaaaactgtggttt

SEQ ID NO: 129884 - DNA, 20 bp, Artificial Sequence
  Description of Artificial Sequence: Synthetic oligonucleotide
  Target: ATXN1; (+) strand; PAM type: NRG; PAM sequence: AAG
aactgtggtttgggtcttat

SEQ ID NO: 129885 - DNA, 20 bp, Artificial Sequence
  Description of Artificial Sequence: Synthetic oligonucleotide
  Target: ATXN1; (+) strand; PAM type: NRG; PAM sequence: CAG
gggtcttataagatcactga

SEQ ID NO: 129886 - DNA, 20 bp, Artificial Sequence
  Description of Artificial Sequence: Synthetic oligonucleotide
  Target: ATXN1; (+) strand; PAM type: NRG; PAM sequence: AAG
ttataagatcactgacagcc

SEQ ID NO: 129887 - DNA, 20 bp, Artificial Sequence
  Description of Artificial Sequence: Synthetic oligonucleotide
  Target: ATXN1; (+) strand; PAM type: NRG; PAM sequence: AAG
tccaaatactgtatgactca

SEQ ID NO: 129888 - DNA, 20 bp, Artificial Sequence
  Description of Artificial Sequence: Synthetic oligonucleotide
  Target: ATXN1; (+) strand; PAM type: NRG; PAM sequence: AGG
ccaaatactgtatgactcaa

SEQ ID NO: 129889 - DNA, 20 bp, Artificial Sequence
  Description of Artificial Sequence: Synthetic oligonucleotide
  Target: ATXN1; (+) strand; PAM type: NRG; PAM sequence: TAG
taatactccatttttccttc

SEQ ID NO: 129890 - DNA, 20 bp, Artificial Sequence
  Description of Artificial Sequence: Synthetic oligonucleotide
  Target: ATXN1; (+) strand; PAM type: NRG; PAM sequence: AAG
ccatttttccttctagatta

SEQ ID NO: 129891 - DNA, 20 bp, Artificial Sequence
  Description of Artificial Sequence: Synthetic oligonucleotide
  Target: ATXN1; (+) strand; PAM type: NRG; PAM sequence: TGG
attaaagactatccctttca

SEQ ID NO: 129892 - DNA, 20 bp, Artificial Sequence
  Description of Artificial Sequence: Synthetic oligonucleotide
  Target: ATXN1; (+) strand; PAM type: NRG; PAM sequence: AAG
atttcaccccaaacctctct

SEQ ID NO: 129893 - DNA, 20 bp, Artificial Sequence
  Description of Artificial Sequence: Synthetic oligonucleotide
  Target: ATXN1; (+) strand; PAM type: NRG; PAM sequence: AGG
tttcaccccaaacctctcta

SEQ ID NO: 129894 - DNA, 20 bp, Artificial Sequence
  Description of Artificial Sequence: Synthetic oligonucleotide
  Target: ATXN1; (+) strand; PAM type: NRG; PAM sequence: TAG
caccccaaacctctctaagg

SEQ ID NO: 129895 - DNA, 20 bp, Artificial Sequence
  Description of Artificial Sequence: Synthetic oligonucleotide
  Target: ATXN1; (+) strand; PAM type: NRG; PAM sequence: CGG
aggtagatcttgctcctgtc

SEQ ID NO: 129896 - DNA, 20 bp, Artificial Sequence
  Description of Artificial Sequence: Synthetic oligonucleotide
  Target: ATXN1; (+) strand; PAM type: NRG; PAM sequence: GGG
ggtagatcttgctcctgtcc

SEQ ID NO: 129897 - DNA, 20 bp, Artificial Sequence
  Description of Artificial Sequence: Synthetic oligonucleotide
  Target: ATXN1; (+) strand; PAM type: NRG; PAM sequence: CAG
atcttgctcctgtccgggtt

SEQ ID NO: 129898 - DNA, 20 bp, Artificial Sequence
  Description of Artificial Sequence: Synthetic oligonucleotide
  Target: ATXN1; (+) strand; PAM type: NRG; PAM sequence: AGG
tcttgctcctgtccgggttc

SEQ ID NO: 129899 - DNA, 20 bp, Artificial Sequence
  Description of Artificial Sequence: Synthetic oligonucleotide
  Target: ATXN1; (+) strand; PAM type: NRG; PAM sequence: TGG
caggaaactcttgaccctca

SEQ ID NO: 129900 - DNA, 20 bp, Artificial Sequence
  Description of Artificial Sequence: Synthetic oligonucleotide
  Target: ATXN1; (+) strand; PAM type: NRG; PAM sequence: AAG
gaaactcttgaccctcatgg

SEQ ID NO: 129901 - DNA, 20 bp, Artificial Sequence
  Description of Artificial Sequence: Synthetic oligonucleotide
  Target: ATXN1; (+) strand; PAM type: NRG; PAM sequence: TGG
accctcatggaagtcctgca

SEQ ID NO: 129902 - DNA, 20 bp, Artificial Sequence
  Description of Artificial Sequence: Synthetic oligonucleotide
  Target: ATXN1; (+) strand; PAM type: NRG; PAM sequence: AAG
gaagtcctgcatggccttcc

SEQ ID NO: 129903 - DNA, 20 bp, Artificial Sequence
  Description of Artificial Sequence: Synthetic oligonucleotide
  Target: ATXN1; (+) strand; PAM type: NRG; PAM sequence: GAG
tcctgcatggccttccaagt

SEQ ID NO: 129904 - DNA, 20 bp, Artificial Sequence
  Description of Artificial Sequence: Synthetic oligonucleotide
  Target: ATXN1; (+) strand; PAM type: NRG; PAM sequence: AGG
cctgcatggccttccaagtg

SEQ ID NO: 129905 - DNA, 20 bp, Artificial Sequence
  Description of Artificial Sequence: Synthetic oligonucleotide
  Target: ATXN1; (+) strand; PAM type: NRG; PAM sequence: GGG
ctgcatggccttccaagtga

SEQ ID NO: 129906 - DNA, 20 bp, Artificial Sequence
  Description of Artificial Sequence: Synthetic oligonucleotide
  Target: ATXN1; (+) strand; PAM type: NRG; PAM sequence: CAG
atggccttccaagtgagggt

SEQ ID NO: 129907 - DNA, 20 bp, Artificial Sequence
  Description of Artificial Sequence: Synthetic oligonucleotide
  Target: ATXN1; (+) strand; PAM type: NRG; PAM sequence: CAG
gtgagggtcagttgtcactc

SEQ ID NO: 129908 - DNA, 20 bp, Artificial Sequence
  Description of Artificial Sequence: Synthetic oligonucleotide
  Target: ATXN1; (+) strand; PAM type: NRG; PAM sequence: AGG
tgagggtcagttgtcactcc

SEQ ID NO: 129909 - DNA, 20 bp, Artificial Sequence
  Description of Artificial Sequence: Synthetic oligonucleotide
  Target: ATXN1; (+) strand; PAM type: NRG; PAM sequence: CAG
tactttgtatttccgtctca

SEQ ID NO: 129910 - DNA, 20 bp, Artificial Sequence
  Description of Artificial Sequence: Synthetic oligonucleotide
  Target: ATXN1; (+) strand; PAM type: NRG; PAM sequence: CAG
ccgtctcacagtacctttct

SEQ ID NO: 129911 - DNA, 20 bp, Artificial Sequence
  Description of Artificial Sequence: Synthetic oligonucleotide
  Target: ATXN1; (+) strand; PAM type: NRG; PAM sequence: CGG
acagtacctttctcagtgca

SEQ ID NO: 129912 - DNA, 20 bp, Artificial Sequence
  Description of Artificial Sequence: Synthetic oligonucleotide
  Target: ATXN1; (+) strand; PAM type: NRG; PAM sequence: TAG
ctcagtgcacggtaattgac

SEQ ID NO: 129913 - DNA, 20 bp, Artificial Sequence
  Description of Artificial Sequence: Synthetic oligonucleotide
  Target: ATXN1; (+) strand; PAM type: NRG; PAM sequence: TAG
ctcctataataactataatg

SEQ ID NO: 129914 - DNA, 20 bp, Artificial Sequence
  Description of Artificial Sequence: Synthetic oligonucleotide
  Target: ATXN1; (+) strand; PAM type: NRG; PAM sequence: TGG
aactataatgtagtgccatg

SEQ ID NO: 129915 - DNA, 20 bp, Artificial Sequence
  Description of Artificial Sequence: Synthetic oligonucleotide
  Target: ATXN1; (+) strand; PAM type: NRG; PAM sequence: GGG
actataatgtagtgccatgt

SEQ ID NO: 129916 - DNA, 20 bp, Artificial Sequence
  Description of Artificial Sequence: Synthetic oligonucleotide
  Target: ATXN1; (+) strand; PAM type: NRG; PAM sequence: TAG
ataatgtagtgccatgtggg

SEQ ID NO: 129917 - DNA, 20 bp, Artificial Sequence
  Description of Artificial Sequence: Synthetic oligonucleotide
  Target: ATXN1; (+) strand; PAM type: NRG; PAM sequence: AGG
taatgtagtgccatgtgggt

SEQ ID NO: 129918 - DNA, 20 bp, Artificial Sequence
  Description of Artificial Sequence: Synthetic oligonucleotide
  Target: ATXN1; (+) strand; PAM type: NRG; PAM sequence: GGG
aatgtagtgccatgtgggta

SEQ ID NO: 129919 - DNA, 20 bp, Artificial Sequence
  Description of Artificial Sequence: Synthetic oligonucleotide
  Target: ATXN1; (+) strand; PAM type: NRG; PAM sequence: GGG
atgtagtgccatgtgggtag

SEQ ID NO: 129920 - DNA, 20 bp, Artificial Sequence
  Description of Artificial Sequence: Synthetic oligonucleotide
  Target: ATXN1; (+) strand; PAM type: NRG; PAM sequence: TAG
catttttatcttgtctacct

SEQ ID NO: 129921 - DNA, 20 bp, Artificial Sequence
  Description of Artificial Sequence: Synthetic oligonucleotide
  Target: ATXN1; (+) strand; PAM type: NRG; PAM sequence: CAG
cttgtctaccttagtatctt

SEQ ID NO: 129922 - DNA, 20 bp, Artificial Sequence
  Description of Artificial Sequence: Synthetic oligonucleotide
  Target: ATXN1; (+) strand; PAM type: NRG; PAM sequence: TAG
accttagtatcttcagaact

SEQ ID NO: 129923 - DNA, 20 bp, Artificial Sequence
  Description of Artificial Sequence: Synthetic oligonucleotide
  Target: ATXN1; (+) strand; PAM type: NRG; PAM sequence: TGG
tcagaacttagcactctgct

SEQ ID NO: 129924 - DNA, 20 bp, Artificial Sequence
  Description of Artificial Sequence: Synthetic oligonucleotide
  Target: ATXN1; (+) strand; PAM type: NRG; PAM sequence: TGG
ttagcactctgcttggtaca

SEQ ID NO: 129925 - DNA, 20 bp, Artificial Sequence
  Description of Artificial Sequence: Synthetic oligonucleotide
  Target: ATXN1; (+) strand; PAM type: NRG; PAM sequence: CAG
gcactctgcttggtacatgg

SEQ ID NO: 129926 - DNA, 20 bp, Artificial Sequence
  Description of Artificial Sequence: Synthetic oligonucleotide
  Target: ATXN1; (+) strand; PAM type: NRG; PAM sequence: CAG
tggcagactctcaaaaatat

SEQ ID NO: 129927 - DNA, 20 bp, Artificial Sequence
  Description of Artificial Sequence: Synthetic oligonucleotide
  Target: ATXN1; (+) strand; PAM type: NRG; PAM sequence: CAG
ctctcaaaaatatcagttga

SEQ ID NO: 129928 - DNA, 20 bp, Artificial Sequence
  Description of Artificial Sequence: Synthetic oligonucleotide
  Target: ATXN1; (+) strand; PAM type: NRG; PAM sequence: TAG
gttgacagactgattgaaaa

SEQ ID NO: 129929 - DNA, 20 bp, Artificial Sequence
  Description of Artificial Sequence: Synthetic oligonucleotide
  Target: ATXN1; (+) strand; PAM type: NRG; PAM sequence: TGG
ctgattgaaaatagaatccg

SEQ ID NO: 129930 - DNA, 20 bp, Artificial Sequence
  Description of Artificial Sequence: Synthetic oligonucleotide
  Target: ATXN1; (+) strand; PAM type: NRG; PAM sequence: TGG
gaatccgtggttctgaataa

SEQ ID NO: 129931 - DNA, 20 bp, Artificial Sequence
  Description of Artificial Sequence: Synthetic oligonucleotide
  Target: ATXN1; (+) strand; PAM type: NRG; PAM sequence: CAG
taatggctatttactcaccc

SEQ ID NO: 129932 - DNA, 20 bp, Artificial Sequence
  Description of Artificial Sequence: Synthetic oligonucleotide
  Target: ATXN1; (+) strand; PAM type: NRG; PAM sequence: CAG
gctatttactcaccccagtc

SEQ ID NO: 129933 - DNA, 20 bp, Artificial Sequence
  Description of Artificial Sequence: Synthetic oligonucleotide
  Target: ATXN1; (+) strand; PAM type: NRG; PAM sequence: TGG
taccactgtctgttaccgca

SEQ ID NO: 129934 - DNA, 20 bp, Artificial Sequence
  Description of Artificial Sequence: Synthetic oligonucleotide
  Target: ATXN1; (+) strand; PAM type: NRG; PAM sequence: GGG
accactgtctgttaccgcat

SEQ ID NO: 129935 - DNA, 20 bp, Artificial Sequence
  Description of Artificial Sequence: Synthetic oligonucleotide
  Target: ATXN1; (+) strand; PAM type: NRG; PAM sequence: TGG
taccgcatgggccctcacca

SEQ ID NO: 129936 - DNA, 20 bp, Artificial Sequence
  Description of Artificial Sequence: Synthetic oligonucleotide
  Target: ATXN1; (+) strand; PAM type: NRG; PAM sequence: CAG
gccctcaccatggccctcaa

SEQ ID NO: 129937 - DNA, 20 bp, Artificial Sequence
  Description of Artificial Sequence: Synthetic oligonucleotide
  Target: ATXN1; (+) strand; PAM type: NRG; PAM sequence: TGG
ccatggccctcaacagccca

SEQ ID NO: 129938 - DNA, 20 bp, Artificial Sequence
  Description of Artificial Sequence: Synthetic oligonucleotide
  Target: ATXN1; (+) strand; PAM type: NRG; PAM sequence: CAG
ccctcaacagcccatggcca

SEQ ID NO: 129939 - DNA, 20 bp, Artificial Sequence
  Description of Artificial Sequence: Synthetic oligonucleotide
  Target: ATXN1; (+) strand; PAM type: NRG; PAM sequence: TGG
ccatggccacagctattgcc

SEQ ID NO: 129940 - DNA, 20 bp, Artificial Sequence
  Description of Artificial Sequence: Synthetic oligonucleotide
  Target: ATXN1; (+) strand; PAM type: NRG; PAM sequence: GGG
catggccacagctattgcct

SEQ ID NO: 129941 - DNA, 20 bp, Artificial Sequence
  Description of Artificial Sequence: Synthetic oligonucleotide
  Target: ATXN1; (+) strand; PAM type: NRG; PAM sequence: TAG
ctgggactgaccatccctac

SEQ ID NO: 129942 - DNA, 20 bp, Artificial Sequence
  Description of Artificial Sequence: Synthetic oligonucleotide
  Target: ATXN1; (+) strand; PAM type: NRG; PAM sequence: AGG
tgggactgaccatccctact

SEQ ID NO: 129943 - DNA, 20 bp, Artificial Sequence
  Description of Artificial Sequence: Synthetic oligonucleotide
  Target: ATXN1; (+) strand; PAM type: NRG; PAM sequence: GAG
aatgtgtcacgcccctaaat

SEQ ID NO: 129944 - DNA, 20 bp, Artificial Sequence
  Description of Artificial Sequence: Synthetic oligonucleotide
  Target: ATXN1; (+) strand; PAM type: NRG; PAM sequence: GAG
acgcccctaaatgagactgt

SEQ ID NO: 129945 - DNA, 20 bp, Artificial Sequence
  Description of Artificial Sequence: Synthetic oligonucleotide
  Target: ATXN1; (+) strand; PAM type: NRG; PAM sequence: AAG
ctgtgagttttctctgctta

SEQ ID NO: 129946 - DNA, 20 bp, Artificial Sequence
  Description of Artificial Sequence: Synthetic oligonucleotide
  Target: ATXN1; (+) strand; PAM type: NRG; PAM sequence: CAG
tttctctgcttaaagacaat

SEQ ID NO: 129947 - DNA, 20 bp, Artificial Sequence
  Description of Artificial Sequence: Synthetic oligonucleotide
  Target: ATXN1; (+) strand; PAM type: NRG; PAM sequence: AAG
taaagacaatcagaaaccaa

SEQ ID NO: 129948 - DNA, 20 bp, Artificial Sequence
  Description of Artificial Sequence: Synthetic oligonucleotide
  Target: ATXN1; (+) strand; PAM type: NRG; PAM sequence: TAG
tcagaaaccaaaagctatta

SEQ ID NO: 129949 - DNA, 20 bp, Artificial Sequence
  Description of Artificial Sequence: Synthetic oligonucleotide
  Target: ATXN1; (+) strand; PAM type: NRG; PAM sequence: CAG
ctattatagctttctccttc

SEQ ID NO: 129950 - DNA, 20 bp, Artificial Sequence
  Description of Artificial Sequence: Synthetic oligonucleotide
  Target: ATXN1; (+) strand; PAM type: NRG; PAM sequence: GAG
attatagctttctccttcca

SEQ ID NO: 129951 - DNA, 20 bp, Artificial Sequence
  Description of Artificial Sequence: Synthetic oligonucleotide
  Target: ATXN1; (+) strand; PAM type: NRG; PAM sequence: AAG
ctttctccttccagagatcc

SEQ ID NO: 129952 - DNA, 20 bp, Artificial Sequence
  Description of Artificial Sequence: Synthetic oligonucleotide
  Target: ATXN1; (+) strand; PAM type: NRG; PAM sequence: AGG
tttctccttccagagatcca

SEQ ID NO: 129953 - DNA, 20 bp, Artificial Sequence
  Description of Artificial Sequence: Synthetic oligonucleotide
  Target: ATXN1; (+) strand; PAM type: NRG; PAM sequence: GGG
ttctccttccagagatccaa

SEQ ID NO: 129954 - DNA, 20 bp, Artificial Sequence
  Description of Artificial Sequence: Synthetic oligonucleotide
  Target: ATXN1; (+) strand; PAM type: NRG; PAM sequence: GGG
tctccttccagagatccaag

SEQ ID NO: 129955 - DNA, 20 bp, Artificial Sequence
  Description of Artificial Sequence: Synthetic oligonucleotide
  Target: ATXN1; (+) strand; PAM type: NRG; PAM sequence: TAG
ggcctcaaaaaatcttaaaa

SEQ ID NO: 129956 - DNA, 20 bp, Artificial Sequence
  Description of Artificial Sequence: Synthetic oligonucleotide
  Target: ATXN1; (+) strand; PAM type: NRG; PAM sequence: AGG
gcctcaaaaaatcttaaaat

SEQ ID NO: 129957 - DNA, 20 bp, Artificial Sequence
  Description of Artificial Sequence: Synthetic oligonucleotide
  Target: ATXN1; (+) strand; PAM type: NRG; PAM sequence: GGG
cctcaaaaaatcttaaaata

SEQ ID NO: 129958 - DNA, 20 bp, Artificial Sequence
  Description of Artificial Sequence: Synthetic oligonucleotide
  Target: ATXN1; (+) strand; PAM type: NRG; PAM sequence: AAG
aaaaaatcttaaaataggga

SEQ ID NO: 129959 - DNA, 20 bp, Artificial Sequence
  Description of Artificial Sequence: Synthetic oligonucleotide
  Target: ATXN1; (+) strand; PAM type: NRG; PAM sequence: AAG
taaaatagggaaagctttga

SEQ ID NO: 129960 - DNA, 20 bp, Artificial Sequence
  Description of Artificial Sequence: Synthetic oligonucleotide
  Target: ATXN1; (+) strand; PAM type: NRG; PAM sequence: AGG
aaaatagggaaagctttgaa

SEQ ID NO: 129961 - DNA, 20 bp, Artificial Sequence
  Description of Artificial Sequence: Synthetic oligonucleotide
  Target: ATXN1; (+) strand; PAM type: NRG; PAM sequence: CAG
atagggaaagctttgaaagg

SEQ ID NO: 129962 - DNA, 20 bp, Artificial Sequence
  Description of Artificial Sequence: Synthetic oligonucleotide
  Target: ATXN1; (+) strand; PAM type: NRG; PAM sequence: TAG
gaaagctttgaaaggcagta

SEQ ID NO: 129963 - DNA, 20 bp, Artificial Sequence
  Description of Artificial Sequence: Synthetic oligonucleotide
  Target: ATXN1; (+) strand; PAM type: NRG; PAM sequence: AGG
aaagctttgaaaggcagtat

SEQ ID NO: 129964 - DNA, 20 bp, Artificial Sequence
  Description of Artificial Sequence: Synthetic oligonucleotide
  Target: ATXN1; (+) strand; PAM type: NRG; PAM sequence: AAG
tttgaaaggcagtataggca

SEQ ID NO: 129965 - DNA, 20 bp, Artificial Sequence
  Description of Artificial Sequence: Synthetic oligonucleotide
  Target: ATXN1; (+) strand; PAM type: NRG; PAM sequence: AAG
ggcagtataggcaaagccta

SEQ ID NO: 129966 - DNA, 20 bp, Artificial Sequence
  Description of Artificial Sequence: Synthetic oligonucleotide
  Target: ATXN1; (+) strand; PAM type: NRG; PAM sequence: TAG
taggcaaagcctaaagcatt

SEQ ID NO: 129967 - DNA, 20 bp, Artificial Sequence
  Description of Artificial Sequence: Synthetic oligonucleotide
  Target: ATXN1; (+) strand; PAM type: NRG; PAM sequence: AGG
aggcaaagcctaaagcattt

SEQ ID NO: 129968 - DNA, 20 bp, Artificial Sequence
  Description of Artificial Sequence: Synthetic oligonucleotide
  Target: ATXN1; (+) strand; PAM type: NRG; PAM sequence: GGG
ggcaaagcctaaagcattta

SEQ ID NO: 129969 - DNA, 20 bp, Artificial Sequence
  Description of Artificial Sequence: Synthetic oligonucleotide
  Target: ATXN1; (+) strand; PAM type: NRG; PAM sequence: GGG
gcaaagcctaaagcatttag

SEQ ID NO: 129970 - DNA, 20 bp, Artificial Sequence
  Description of Artificial Sequence: Synthetic oligonucleotide
  Target: ATXN1; (+) strand; PAM type: NRG; PAM sequence: TGG
aagcctaaagcatttagggg

SEQ ID NO: 129971 - DNA, 20 bp, Artificial Sequence
  Description of Artificial Sequence: Synthetic oligonucleotide
  Target: ATXN1; (+) strand; PAM type: NRG; PAM sequence: GGG
agcctaaagcatttaggggt

SEQ ID NO: 129972 - DNA, 20 bp, Artificial Sequence
  Description of Artificial Sequence: Synthetic oligonucleotide
  Target: ATXN1; (+) strand; PAM type: NRG; PAM sequence: CAG
aaagcatttaggggtgggaa

SEQ ID NO: 129973 - DNA, 20 bp, Artificial Sequence
  Description of Artificial Sequence: Synthetic oligonucleotide
  Target: ATXN1; (+) strand; PAM type: NRG; PAM sequence: AAG
tttgtacataaacatctttg

SEQ ID NO: 129974 - DNA, 20 bp, Artificial Sequence
  Description of Artificial Sequence: Synthetic oligonucleotide
  Target: ATXN1; (+) strand; PAM type: NRG; PAM sequence: AGG
ttgtacataaacatctttga

SEQ ID NO: 129975 - DNA, 20 bp, Artificial Sequence
  Description of Artificial Sequence: Synthetic oligonucleotide
  Target: ATXN1; (+) strand; PAM type: NRG; PAM sequence: CAG
acataaacatctttgaagga

SEQ ID NO: 129976 - DNA, 20 bp, Artificial Sequence
  Description of Artificial Sequence: Synthetic oligonucleotide
  Target: ATXN1; (+) strand; PAM type: NRG; PAM sequence: AGG
cataaacatctttgaaggac

SEQ ID NO: 129977 - DNA, 20 bp, Artificial Sequence
  Description of Artificial Sequence: Synthetic oligonucleotide
  Target: ATXN1; (+) strand; PAM type: NRG; PAM sequence: GGG
ataaacatctttgaaggaca

SEQ ID NO: 129978 - DNA, 20 bp, Artificial Sequence
  Description of Artificial Sequence: Synthetic oligonucleotide
  Target: ATXN1; (+) strand; PAM type: NRG; PAM sequence: CAG
aacatctttgaaggacaggg

SEQ ID NO: 129979 - DNA, 20 bp, Artificial Sequence
  Description of Artificial Sequence: Synthetic oligonucleotide
  Target: ATXN1; (+) strand; PAM type: NRG; PAM sequence: GAG
gaaggacagggcagcactgt

SEQ ID NO: 129980 - DNA, 20 bp, Artificial Sequence
  Description of Artificial Sequence: Synthetic oligonucleotide
  Target: ATXN1; (+) strand; PAM type: NRG; PAM sequence: TGG
actgtgagtctccattttca

SEQ ID NO: 129981 - DNA, 20 bp, Artificial Sequence
  Description of Artificial Sequence: Synthetic oligonucleotide
  Target: ATXN1; (+) strand; PAM type: NRG; PAM sequence: GAG
tgtgagtctccattttcatg

SEQ ID NO: 129982 - DNA, 20 bp, Artificial Sequence
  Description of Artificial Sequence: Synthetic oligonucleotide
  Target: ATXN1; (+) strand; PAM type: NRG; PAM sequence: TAG
tctccattttcatggagtgc

SEQ ID NO: 129983 - DNA, 20 bp, Artificial Sequence
  Description of Artificial Sequence: Synthetic oligonucleotide
  Target: ATXN1; (+) strand; PAM type: NRG; PAM sequence: AGG
ctccattttcatggagtgct

SEQ ID NO: 129984 - DNA, 20 bp, Artificial Sequence
  Description of Artificial Sequence: Synthetic oligonucleotide
  Target: ATXN1; (+) strand; PAM type: NRG; PAM sequence: TAG
attttcatggagtgctaggc

SEQ ID NO: 129985 - DNA, 20 bp, Artificial Sequence
  Description of Artificial Sequence: Synthetic oligonucleotide
  Target: ATXN1; (+) strand; PAM type: NRG; PAM sequence: AAG
tgctaggctagcatatttta

SEQ ID NO: 129986 - DNA, 20 bp, Artificial Sequence
  Description of Artificial Sequence: Synthetic oligonucleotide
  Target: ATXN1; (+) strand; PAM type: NRG; PAM sequence: AAG
taggctagcatattttaaag

SEQ ID NO: 129987 - DNA, 20 bp, Artificial Sequence
  Description of Artificial Sequence: Synthetic oligonucleotide
  Target: ATXN1; (+) strand; PAM type: NRG; PAM sequence: AAG
gctagcatattttaaagaag

SEQ ID NO: 129988 - DNA, 20 bp, Artificial Sequence
  Description of Artificial Sequence: Synthetic oligonucleotide
  Target: ATXN1; (+) strand; PAM type: NRG; PAM sequence: CAG
agaagatatcttttatgaca

SEQ ID NO: 129989 - DNA, 20 bp, Artificial Sequence
  Description of Artificial Sequence: Synthetic oligonucleotide
  Target: ATXN1; (+) strand; PAM type: NRG; PAM sequence: AAG
atacttgcaccataaattgt

SEQ ID NO: 129990 - DNA, 20 bp, Artificial Sequence
  Description of Artificial Sequence: Synthetic oligonucleotide
  Target: ATXN1; (+) strand; PAM type: NRG; PAM sequence: TAG
cttgcaccataaattgtaag

SEQ ID NO: 129991 - DNA, 20 bp, Artificial Sequence
  Description of Artificial Sequence: Synthetic oligonucleotide
  Target: ATXN1; (+) strand; PAM type: NRG; PAM sequence: TAG
accataaattgtaagtagat

SEQ ID NO: 129992 - DNA, 20 bp, Artificial Sequence
  Description of Artificial Sequence: Synthetic oligonucleotide
  Target: ATXN1; (+) strand; PAM type: NRG; PAM sequence: AGG
ccataaattgtaagtagatt

SEQ ID NO: 129993 - DNA, 20 bp, Artificial Sequence
  Description of Artificial Sequence: Synthetic oligonucleotide
  Target: ATXN1; (+) strand; PAM type: NRG; PAM sequence: AAG
gccacaacacacaatcgttt

SEQ ID NO: 129994 - DNA, 20 bp, Artificial Sequence
  Description of Artificial Sequence: Synthetic oligonucleotide
  Target: ATXN1; (+) strand; PAM type: NRG; PAM sequence: GAG
tcgtttaagatgatgtaatc

SEQ ID NO: 129995 - DNA, 20 bp, Artificial Sequence
  Description of Artificial Sequence: Synthetic oligonucleotide
  Target: ATXN1; (+) strand; PAM type: NRG; PAM sequence: AGG
cgtttaagatgatgtaatcg

SEQ ID NO: 129996 - DNA, 20 bp, Artificial Sequence
  Description of Artificial Sequence: Synthetic oligonucleotide
  Target: ATXN1; (+) strand; PAM type: NRG; PAM sequence: GGG
gtttaagatgatgtaatcga

SEQ ID NO: 129997 - DNA, 20 bp, Artificial Sequence
  Description of Artificial Sequence: Synthetic oligonucleotide
  Target: ATXN1; (+) strand; PAM type: NRG; PAM sequence: TGG
atcgagggacaaaaataatt

SEQ ID NO: 129998 - DNA, 20 bp, Artificial Sequence
  Description of Artificial Sequence: Synthetic oligonucleotide
  Target: ATXN1; (+) strand; PAM type: NRG; PAM sequence: GGG
tcgagggacaaaaataattt

SEQ ID NO: 129999 - DNA, 20 bp, Artificial Sequence
  Description of Artificial Sequence: Synthetic oligonucleotide
  Target: ATXN1; (+) strand; PAM type: NRG; PAM sequence: GGG
cgagggacaaaaataatttg

SEQ ID NO: 130000 - DNA, 20 bp, Artificial Sequence
  Description of Artificial Sequence: Synthetic oligonucleotide
  Target: ATXN1; (+) strand; PAM type: NRG; PAM sequence: GGG
gagggacaaaaataatttgg

SEQ ID NO: 130001 - DNA, 20 bp, Artificial Sequence
  Description of Artificial Sequence: Synthetic oligonucleotide
  Target: ATXN1; (+) strand; PAM type: NRG; PAM sequence: AAG
taaaatgatcaactccacac

SEQ ID NO: 130002 - DNA, 20 bp, Artificial Sequence
  Description of Artificial Sequence: Synthetic oligonucleotide
  Target: ATXN1; (+) strand; PAM type: NRG; PAM sequence: TGG
acacaagaataatctactaa

SEQ ID NO: 130003 - DNA, 20 bp, Artificial Sequence
  Description of Artificial Sequence: Synthetic oligonucleotide
  Target: ATXN1; (+) strand; PAM type: NRG; PAM sequence: AAG
taatctactaatggtataac

SEQ ID NO: 130004 - DNA, 20 bp, Artificial Sequence
  Description of Artificial Sequence: Synthetic oligonucleotide
  Target: ATXN1; (+) strand; PAM type: NRG; PAM sequence: TGG
atggtataacaagtgattca

SEQ ID NO: 130005 - DNA, 20 bp, Artificial Sequence
  Description of Artificial Sequence: Synthetic oligonucleotide
  Target: ATXN1; (+) strand; PAM type: NRG; PAM sequence: AAG
ataacaagtgattcatggaa

SEQ ID NO: 130006 - DNA, 20 bp, Artificial Sequence
  Description of Artificial Sequence: Synthetic oligonucleotide
  Target: ATXN1; (+) strand; PAM type: NRG; PAM sequence: TGG
attcatggaaaagatgatcc

SEQ ID NO: 130007 - DNA, 20 bp, Artificial Sequence
  Description of Artificial Sequence: Synthetic oligonucleotide
  Target: ATXN1; (+) strand; PAM type: NRG; PAM sequence: AAG
caaaacaataacttttgttc

SEQ ID NO: 130008 - DNA, 20 bp, Artificial Sequence
  Description of Artificial Sequence: Synthetic oligonucleotide
  Target: ATXN1; (+) strand; PAM type: NRG; PAM sequence: AGG
aaaacaataacttttgttca

SEQ ID NO: 130009 - DNA, 20 bp, Artificial Sequence
  Description of Artificial Sequence: Synthetic oligonucleotide
  Target: ATXN1; (+) strand; PAM type: NRG; PAM sequence: AAG
aacttttgttcaaggccatc

SEQ ID NO: 130010 - DNA, 20 bp, Artificial Sequence
  Description of Artificial Sequence: Synthetic oligonucleotide
  Target: ATXN1; (+) strand; PAM type: NRG; PAM sequence: GAG
cttttgttcaaggccatcaa

SEQ ID NO: 130011 - DNA, 20 bp, Artificial Sequence
  Description of Artificial Sequence: Synthetic oligonucleotide
  Target: ATXN1; (+) strand; PAM type: NRG; PAM sequence: AGG
ttttgttcaaggccatcaag

SEQ ID NO: 130012 - DNA, 20 bp, Artificial Sequence
  Description of Artificial Sequence: Synthetic oligonucleotide
  Target: ATXN1; (+) strand; PAM type: NRG; PAM sequence: TAG
ctaaaaatctactatgcgtt

SEQ ID NO: 130013 - DNA, 20 bp, Artificial Sequence
  Description of Artificial Sequence: Synthetic oligonucleotide
  Target: ATXN1; (+) strand; PAM type: NRG; PAM sequence: AAG
tatgcgtttagccctgtgct

SEQ ID NO: 130014 - DNA, 20 bp, Artificial Sequence
  Description of Artificial Sequence: Synthetic oligonucleotide
  Target: ATXN1; (+) strand; PAM type: NRG; PAM sequence: TGG
tagccctgtgctaagatttg

SEQ ID NO: 130015 - DNA, 20 bp, Artificial Sequence
  Description of Artificial Sequence: Synthetic oligonucleotide
  Target: ATXN1; (+) strand; PAM type: NRG; PAM sequence: TGG
gctaagatttgtggaaaata

SEQ ID NO: 130016 - DNA, 20 bp, Artificial Sequence
  Description of Artificial Sequence: Synthetic oligonucleotide
  Target: ATXN1; (+) strand; PAM type: NRG; PAM sequence: AAG
aagatttgtggaaaatatgg

SEQ ID NO: 130017 - DNA, 20 bp, Artificial Sequence
  Description of Artificial Sequence: Synthetic oligonucleotide
  Target: ATXN1; (+) strand; PAM type: NRG; PAM sequence: TGG
tatggaagaaatcattaccc

SEQ ID NO: 130018 - DNA, 20 bp, Artificial Sequence
  Description of Artificial Sequence: Synthetic oligonucleotide
  Target: ATXN1; (+) strand; PAM type: NRG; PAM sequence: GGG
atggaagaaatcattaccct

SEQ ID NO: 130019 - DNA, 20 bp, Artificial Sequence
  Description of Artificial Sequence: Synthetic oligonucleotide
  Target: ATXN1; (+) strand; PAM type: NRG; PAM sequence: CAG
aagaaatcattaccctgggc

SEQ ID NO: 130020 - DNA, 20 bp, Artificial Sequence
  Description of Artificial Sequence: Synthetic oligonucleotide
  Target: ATXN1; (+) strand; PAM type: NRG; PAM sequence: GAG
gaaatcattaccctgggcca

SEQ ID NO: 130021 - DNA, 20 bp, Artificial Sequence
  Description of Artificial Sequence: Synthetic oligonucleotide
  Target: ATXN1; (+) strand; PAM type: NRG; PAM sequence: GAG
cccaatctctaaacccaccc

SEQ ID NO: 130022 - DNA, 20 bp, Artificial Sequence
  Description of Artificial Sequence: Synthetic oligonucleotide
  Target: ATXN1; (+) strand; PAM type: NRG; PAM sequence: GAG
caatctctaaacccacccga

SEQ ID NO: 130023 - DNA, 20 bp, Artificial Sequence
  Description of Artificial Sequence: Synthetic oligonucleotide
  Target: ATXN1; (+) strand; PAM type: NRG; PAM sequence: CAG
aatgctgtccctcatgtcta

SEQ ID NO: 130024 - DNA, 20 bp, Artificial Sequence
  Description of Artificial Sequence: Synthetic oligonucleotide
  Target: ATXN1; (+) strand; PAM type: NRG; PAM sequence: GAG
ctacagcttttttatttttt

SEQ ID NO: 130025 - DNA, 20 bp, Artificial Sequence
  Description of Artificial Sequence: Synthetic oligonucleotide
  Target: ATXN1; (+) strand; PAM type: NRG; PAM sequence: TGG
agcttttttattttttgaga

SEQ ID NO: 130026 - DNA, 20 bp, Artificial Sequence
  Description of Artificial Sequence: Synthetic oligonucleotide
  Target: ATXN1; (+) strand; PAM type: NRG; PAM sequence: GAG
cttttttattttttgagatg

SEQ ID NO: 130027 - DNA, 20 bp, Artificial Sequence
  Description of Artificial Sequence: Synthetic oligonucleotide
  Target: ATXN1; (+) strand; PAM type: NRG; PAM sequence: TGG
ttattttttgagatggagtt

SEQ ID NO: 130028 - DNA, 20 bp, Artificial Sequence
  Description of Artificial Sequence: Synthetic oligonucleotide
  Target: ATXN1; (+) strand; PAM type: NRG; PAM sequence: CAG
ggagtttggttcttgtcgcc

SEQ ID NO: 130029 - DNA, 20 bp, Artificial Sequence
  Description of Artificial Sequence: Synthetic oligonucleotide
  Target: ATXN1; (+) strand; PAM type: NRG; PAM sequence: AGG
gagtttggttcttgtcgccc

SEQ ID NO: 130030 - DNA, 20 bp, Artificial Sequence
  Description of Artificial Sequence: Synthetic oligonucleotide
  Target: ATXN1; (+) strand; PAM type: NRG; PAM sequence: TGG
ttggttcttgtcgcccaggc

SEQ ID NO: 130031 - DNA, 20 bp, Artificial Sequence
  Description of Artificial Sequence: Synthetic oligonucleotide
  Target: ATXN1; (+) strand; PAM type: NRG; PAM sequence: GAG
ggttcttgtcgcccaggctg

SEQ ID NO: 130032 - DNA, 20 bp, Artificial Sequence
  Description of Artificial Sequence: Synthetic oligonucleotide
  Target: ATXN1; (+) strand; PAM type: NRG; PAM sequence: TGG
tcgcccaggctggagtgcaa

SEQ ID NO: 130033 - DNA, 20 bp, Artificial Sequence
  Description of Artificial Sequence: Synthetic oligonucleotide
  Target: ATXN1; (+) strand; PAM type: NRG; PAM sequence: CGG
caggctggagtgcaatggtg

SEQ ID NO: 130034 - DNA, 20 bp, Artificial Sequence
  Description of Artificial Sequence: Synthetic oligonucleotide
  Target: ATXN1; (+) strand; PAM type: NRG; PAM sequence: TGG
ggagtgcaatggtgcggtct

SEQ ID NO: 130035 - DNA, 20 bp, Artificial Sequence
  Description of Artificial Sequence: Synthetic oligonucleotide
  Target: ATXN1; (+) strand; PAM type: NRG; PAM sequence: CAG
tcttggctcactgcaacctc

SEQ ID NO: 130036 - DNA, 20 bp, Artificial Sequence
  Description of Artificial Sequence: Synthetic oligonucleotide
  Target: ATXN1; (+) strand; PAM type: NRG; PAM sequence: CAG
tcactgcaacctccagctcc

SEQ ID NO: 130037 - DNA, 20 bp, Artificial Sequence
  Description of Artificial Sequence: Synthetic oligonucleotide
  Target: ATXN1; (+) strand; PAM type: NRG; PAM sequence: AAG
aacctccagctcccagattc

SEQ ID NO: 130038 - DNA, 20 bp, Artificial Sequence
  Description of Artificial Sequence: Synthetic oligonucleotide
  Target: ATXN1; (+) strand; PAM type: NRG; PAM sequence: CAG
ttcaagcaattctcctgcct

SEQ ID NO: 130039 - DNA, 20 bp, Artificial Sequence
  Description of Artificial Sequence: Synthetic oligonucleotide
  Target: ATXN1; (+) strand; PAM type: NRG; PAM sequence: GAG
ttctcctgcctcagcctcct

SEQ ID NO: 130040 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcctgag

SEQ ID NO: 130041 - DNA, 20 bp, Artificial Sequence
  Description of Artificial Sequence: Synthetic oligonucleotide
  Target: ATXN1; (+) strand; PAM type: NRG; PAM sequence: GAG
cctcagcctcctgagtagct

SEQ ID NO: 130042 - DNA, 20 bp, Artificial Sequence
  Description of Artificial Sequence: Synthetic oligonucleotide
  Target: ATXN1; (+) strand; PAM type: NRG; PAM sequence: CAG
ctcctgagtagctgagatta

SEQ ID NO: 130043 - DNA, 20 bp, Artificial Sequence
  Description of Artificial Sequence: Synthetic oligonucleotide
  Target: ATXN1; (+) strand; PAM type: NRG; PAM sequence: AGG
tcctgagtagctgagattac

SEQ ID NO: 130044 - DNA, 20 bp, Artificial Sequence
  Description of Artificial Sequence: Synthetic oligonucleotide
  Target: ATXN1; (+) strand; PAM type: NRG; PAM sequence: CGG
caggcgcccgccaccacgcc

SEQ ID NO: 130045 - DNA, 20 bp, Artificial Sequence
  Description of Artificial Sequence: Synthetic oligonucleotide
  Target: ATXN1; (+) strand; PAM type: NRG; PAM sequence: TAG
ggctaatttttttgtatttt

SEQ ID NO: 130046 - DNA, 20 bp, Artificial Sequence
  Description of Artificial Sequence: Synthetic oligonucleotide
  Target: ATXN1; (+) strand; PAM type: NRG; PAM sequence: TAG
taatttttttgtatttttag

SEQ ID NO: 130047 - DNA, 20 bp, Artificial Sequence
  Description of Artificial Sequence: Synthetic oligonucleotide
  Target: ATXN1; (+) strand; PAM type: NRG; PAM sequence: GAG
atttttttgtatttttagta

SEQ ID NO: 130048 - DNA, 20 bp, Artificial Sequence
  Description of Artificial Sequence: Synthetic oligonucleotide
  Target: ATXN1; (+) strand; PAM type: NRG; PAM sequence: TGG
ttttgtatttttagtagaga

SEQ ID NO: 130049 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtagagat

SEQ ID NO: 130050 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagatg

SEQ ID NO: 130051 - DNA, 20 bp, Artificial Sequence
  Description of Artificial Sequence: Synthetic oligonucleotide
  Target: ATXN1; (+) strand; PAM type: NRG; PAM sequence: TGG
gagatggggtttcaccatgt

SEQ ID NO: 130052 - DNA, 20 bp, Artificial Sequence
  Description of Artificial Sequence: Synthetic oligonucleotide
  Target: ATXN1; (+) strand; PAM type: NRG; PAM sequence: CAG
tggggtttcaccatgttggc

SEQ ID NO: 130053 - DNA, 20 bp, Artificial Sequence
  Description of Artificial Sequence: Synthetic oligonucleotide
  Target: ATXN1; (+) strand; PAM type: NRG; PAM sequence: AGG
ggggtttcaccatgttggcc

SEQ ID NO: 130054 - DNA, 20 bp, Artificial Sequence
  Description of Artificial Sequence: Synthetic oligonucleotide
  Target: ATXN1; (+) strand; PAM type: NRG; PAM sequence: TAG
tttcaccatgttggccaggc

SEQ ID NO: 130055 - DNA, 20 bp, Artificial Sequence
  Description of Artificial Sequence: Synthetic oligonucleotide
  Target: ATXN1; (+) strand; PAM type: NRG; PAM sequence: CAG
tagtctcgaactcctgacct

SEQ ID NO: 130056 - DNA, 20 bp, Artificial Sequence
  Description of Artificial Sequence: Synthetic oligonucleotide
  Target: ATXN1; (+) strand; PAM type: NRG; PAM sequence: AGG
agtctcgaactcctgacctc

SEQ ID NO: 130057 - DNA, 20 bp, Artificial Sequence
  Description of Artificial Sequence: Synthetic oligonucleotide
  Target: ATXN1; (+) strand; PAM type: NRG; PAM sequence: CAG
ctcaggtgatgcacccacct

SEQ ID NO: 130058 - DNA, 20 bp, Artificial Sequence
  Description of Artificial Sequence: Synthetic oligonucleotide
  Target: ATXN1; (+) strand; PAM type: NRG; PAM sequence: AAG
gcacccacctcagcgtccca

SEQ ID NO: 130059 - DNA, 20 bp, Artificial Sequence
  Description of Artificial Sequence: Synthetic oligonucleotide
  Target: ATXN1; (+) strand; PAM type: NRG; PAM sequence: TGG
acctcagcgtcccaaagtgc

SEQ ID NO: 130060 - DNA, 20 bp, Artificial Sequence
  Description of Artificial Sequence: Synthetic oligonucleotide
  Target: ATXN1; (+) strand; PAM type: NRG; PAM sequence: GGG
cctcagcgtcccaaagtgct

SEQ ID NO: 130061 - DNA, 20 bp, Artificial Sequence
  Description of Artificial Sequence: Synthetic oligonucleotide
  Target: ATXN1; (+) strand; PAM type: NRG; PAM sequence: CAG
gtcccaaagtgctgggatta

SEQ ID NO: 130062 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 130063 - DNA, 20 bp, Artificial Sequence
  Description of Artificial Sequence: Synthetic oligonucleotide
  Target: ATXN1; (+) strand; PAM type: NRG; PAM sequence: CGG
caggcacatgccaccacgcc

SEQ ID NO: 130064 - DNA, 20 bp, Artificial Sequence
  Description of Artificial Sequence: Synthetic oligonucleotide
  Target: ATXN1; (+) strand; PAM type: NRG; PAM sequence: TAG
ggctaatttttttgtatttt

SEQ ID NO: 130065 - DNA, 20 bp, Artificial Sequence
  Description of Artificial Sequence: Synthetic oligonucleotide
  Target: ATXN1; (+) strand; PAM type: NRG; PAM sequence: TAG
taatttttttgtatttttag

SEQ ID NO: 130066 - DNA, 20 bp, Artificial Sequence
  Description of Artificial Sequence: Synthetic oligonucleotide
  Target: ATXN1; (+) strand; PAM type: NRG; PAM sequence: GAG
atttttttgtatttttagta

SEQ ID NO: 130067 - DNA, 20 bp, Artificial Sequence
  Description of Artificial Sequence: Synthetic oligonucleotide
  Target: ATXN1; (+) strand; PAM type: NRG; PAM sequence: TAG
ttttgtatttttagtagaga

SEQ ID NO: 130068 - DNA, 20 bp, Artificial Sequence
  Description of Artificial Sequence: Synthetic oligonucleotide
  Target: ATXN1; (+) strand; PAM type: NRG; PAM sequence: AGG
tttgtatttttagtagagat

SEQ ID NO: 130069 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagata

SEQ ID NO: 130070 - DNA, 20 bp, Artificial Sequence
  Description of Artificial Sequence: Synthetic oligonucleotide
  Target: ATXN1; (+) strand; PAM type: NRG; PAM sequence: TGG
gagatagggtttcaccatgt

SEQ ID NO: 130071 - DNA, 20 bp, Artificial Sequence
  Description of Artificial Sequence: Synthetic oligonucleotide
  Target: ATXN1; (+) strand; PAM type: NRG; PAM sequence: TAG
tagggtttcaccatgttggc

SEQ ID NO: 130072 - DNA, 20 bp, Artificial Sequence
  Description of Artificial Sequence: Synthetic oligonucleotide
  Target: ATXN1; (+) strand; PAM type: NRG; PAM sequence: AGG
agggtttcaccatgttggct

SEQ ID NO: 130073 - DNA, 20 bp, Artificial Sequence
  Description of Artificial Sequence: Synthetic oligonucleotide
  Target: ATXN1; (+) strand; PAM type: NRG; PAM sequence: TGG
tttcaccatgttggctaggc

SEQ ID NO: 130074 - DNA, 20 bp, Artificial Sequence
  Description of Artificial Sequence: Synthetic oligonucleotide
  Target: ATXN1; (+) strand; PAM type: NRG; PAM sequence: CAG
tggtctcgaactcctgacct

SEQ ID NO: 130075 - DNA, 20 bp, Artificial Sequence
  Description of Artificial Sequence: Synthetic oligonucleotide
  Target: ATXN1; (+) strand; PAM type: NRG; PAM sequence: AGG
ggtctcgaactcctgacctc

SEQ ID NO: 130076 - DNA, 20 bp, Artificial Sequence
  Description of Artificial Sequence: Synthetic oligonucleotide
  Target: ATXN1; (+) strand; PAM type: NRG; PAM sequence: CAG
ctcaggtgatgcacccgcct

SEQ ID NO: 130077 - DNA, 20 bp, Artificial Sequence
  Description of Artificial Sequence: Synthetic oligonucleotide
  Target: ATXN1; (+) strand; PAM type: NRG; PAM sequence: AAG
gcacccgcctcagcctccca

SEQ ID NO: 130078 - DNA, 20 bp, Artificial Sequence
  Description of Artificial Sequence: Synthetic oligonucleotide
  Target: ATXN1; (+) strand; PAM type: NRG; PAM sequence: GAG
cctcagcctcccaaagtgct

SEQ ID NO: 130079 - DNA, 20 bp, Artificial Sequence
  Description of Artificial Sequence: Synthetic oligonucleotide
  Target: ATXN1; (+) strand; PAM type: NRG; PAM sequence: AAG
tcccaaagtgctgagattac

SEQ ID NO: 130080 - DNA, 20 bp, Artificial Sequence
  Description of Artificial Sequence: Synthetic oligonucleotide
  Target: ATXN1; (+) strand; PAM type: NRG; PAM sequence: GAG
agtgctgagattacaagcat

SEQ ID NO: 130081 - DNA, 20 bp, Artificial Sequence
  Description of Artificial Sequence: Synthetic oligonucleotide
  Target: ATXN1; (+) strand; PAM type: NRG; PAM sequence: TGG
caagcatgagccactatgcc

SEQ ID NO: 130082 - DNA, 20 bp, Artificial Sequence
  Description of Artificial Sequence: Synthetic oligonucleotide
  Target: ATXN1; (+) strand; PAM type: NRG; PAM sequence: CAG
actatgcctggccatgtcta

SEQ ID NO: 130083 - DNA, 20 bp, Artificial Sequence
  Description of Artificial Sequence: Synthetic oligonucleotide
  Target: ATXN1; (+) strand; PAM type: NRG; PAM sequence: TAG
actctccatcatcgtgacta

SEQ ID NO: 130084 - DNA, 20 bp, Artificial Sequence
  Description of Artificial Sequence: Synthetic oligonucleotide
  Target: ATXN1; (+) strand; PAM type: NRG; PAM sequence: CAG
catcgtgactatagtctgaa

SEQ ID NO: 130085 - DNA, 20 bp, Artificial Sequence
  Description of Artificial Sequence: Synthetic oligonucleotide
  Target: ATXN1; (+) strand; PAM type: NRG; PAM sequence: AGG
atcgtgactatagtctgaac

SEQ ID NO: 130086 - DNA, 20 bp, Artificial Sequence
  Description of Artificial Sequence: Synthetic oligonucleotide
  Target: ATXN1; (+) strand; PAM type: NRG; PAM sequence: GAG
atagtctgaacaggatacac

SEQ ID NO: 130087 - DNA, 20 bp, Artificial Sequence
  Description of Artificial Sequence: Synthetic oligonucleotide
  Target: ATXN1; (+) strand; PAM type: NRG; PAM sequence: TGG
gtccccactcaatcccacgc

SEQ ID NO: 130088 - DNA, 20 bp, Artificial Sequence
  Description of Artificial Sequence: Synthetic oligonucleotide
  Target: ATXN1; (+) strand; PAM type: NRG; PAM sequence: GAG
ctcatctgtcctgtctcaat

SEQ ID NO: 130089 - DNA, 20 bp, Artificial Sequence
  Description of Artificial Sequence: Synthetic oligonucleotide
  Target: ATXN1; (+) strand; PAM type: NRG; PAM sequence: TGG
aaactccccatctcataccc

SEQ ID NO: 130090 - DNA, 20 bp, Artificial Sequence
  Description of Artificial Sequence: Synthetic oligonucleotide
  Target: ATXN1; (+) strand; PAM type: NRG; PAM sequence: GGG
aactccccatctcataccct

SEQ ID NO: 130091 - DNA, 20 bp, Artificial Sequence
  Description of Artificial Sequence: Synthetic oligonucleotide
  Target: ATXN1; (+) strand; PAM type: NRG; PAM sequence: GAG
ccatctcataccctgggact

SEQ ID NO: 130092 - DNA, 20 bp, Artificial Sequence
  Description of Artificial Sequence: Synthetic oligonucleotide
  Target: ATXN1; (+) strand; PAM type: NRG; PAM sequence: CAG
gactgagccatgctctacta

SEQ ID NO: 130093 - DNA, 20 bp, Artificial Sequence
  Description of Artificial Sequence: Synthetic oligonucleotide
  Target: ATXN1; (+) strand; PAM type: NRG; PAM sequence: TGG
catgctctactacagttccc

SEQ ID NO: 130094 - DNA, 20 bp, Artificial Sequence
  Description of Artificial Sequence: Synthetic oligonucleotide
  Target: ATXN1; (+) strand; PAM type: NRG; PAM sequence: GGG
atgctctactacagttccct

SEQ ID NO: 130095 - DNA, 20 bp, Artificial Sequence
  Description of Artificial Sequence: Synthetic oligonucleotide
  Target: ATXN1; (+) strand; PAM type: NRG; PAM sequence: AAG
ctacagttccctgggtttca

SEQ ID NO: 130096 - DNA, 20 bp, Artificial Sequence
  Description of Artificial Sequence: Synthetic oligonucleotide
  Target: ATXN1; (+) strand; PAM type: NRG; PAM sequence: TAG
aaatgctgcccttctatgct

SEQ ID NO: 130097 - DNA, 20 bp, Artificial Sequence
  Description of Artificial Sequence: Synthetic oligonucleotide
  Target: ATXN1; (+) strand; PAM type: NRG; PAM sequence: AAG
tgctgcccttctatgcttag

SEQ ID NO: 130098 - DNA, 20 bp, Artificial Sequence
  Description of Artificial Sequence: Synthetic oligonucleotide
  Target: ATXN1; (+) strand; PAM type: NRG; PAM sequence: AAG
tatgcttagaagcacttccc

SEQ ID NO: 130099 - DNA, 20 bp, Artificial Sequence
  Description of Artificial Sequence: Synthetic oligonucleotide
  Target: ATXN1; (+) strand; PAM type: NRG; PAM sequence: CGG
atccatctcaaccatcatct

SEQ ID NO: 130100 - DNA, 20 bp, Artificial Sequence
  Description of Artificial Sequence: Synthetic oligonucleotide
  Target: ATXN1; (+) strand; PAM type: NRG; PAM sequence: GAG
ccatctcaaccatcatctcg

SEQ ID NO: 130101 - DNA, 20 bp, Artificial Sequence
  Description of Artificial Sequence: Synthetic oligonucleotide
  Target: ATXN1; (+) strand; PAM type: NRG; PAM sequence: AGG
catctcaaccatcatctcgg

SEQ ID NO: 130102 - DNA, 20 bp, Artificial Sequence
  Description of Artificial Sequence: Synthetic oligonucleotide
  Target: ATXN1; (+) strand; PAM type: NRG; PAM sequence: TGG
tacaaacactccttcatcct

SEQ ID NO: 130103 - DNA, 20 bp, Artificial Sequence
  Description of Artificial Sequence: Synthetic oligonucleotide
  Target: ATXN1; (+) strand; PAM type: NRG; PAM sequence: GAG
tccacttacaaacactgcct

SEQ ID NO: 130104 - DNA, 20 bp, Artificial Sequence
  Description of Artificial Sequence: Synthetic oligonucleotide
  Target: ATXN1; (+) strand; PAM type: NRG; PAM sequence: AAG
cctgagcaactgctctctac

SEQ ID NO: 130105 - DNA, 20 bp, Artificial Sequence
  Description of Artificial Sequence: Synthetic oligonucleotide
  Target: ATXN1; (+) strand; PAM type: NRG; PAM sequence: GAG
gctctctacaagccccatgt

SEQ ID NO: 130106 - DNA, 20 bp, Artificial Sequence
  Description of Artificial Sequence: Synthetic oligonucleotide
  Target: ATXN1; (+) strand; PAM type: NRG; PAM sequence: AGG
ctctctacaagccccatgtg

SEQ ID NO: 130107 - DNA, 20 bp, Artificial Sequence
  Description of Artificial Sequence: Synthetic oligonucleotide
  Target: ATXN1; (+) strand; PAM type: NRG; PAM sequence: TAG
acaagccccatgtgaggtgc

SEQ ID NO: 130108 - DNA, 20 bp, Artificial Sequence
  Description of Artificial Sequence: Synthetic oligonucleotide
  Target: ATXN1; (+) strand; PAM type: NRG; PAM sequence: AAG
ctagatgtacaacatctcat

SEQ ID NO: 130109 - DNA, 20 bp, Artificial Sequence
  Description of Artificial Sequence: Synthetic oligonucleotide
  Target: ATXN1; (+) strand; PAM type: NRG; PAM sequence: AAG
catctcataagtacatacaa

SEQ ID NO: 130110 - DNA, 20 bp, Artificial Sequence
  Description of Artificial Sequence: Synthetic oligonucleotide
  Target: ATXN1; (+) strand; PAM type: NRG; PAM sequence: TAG
catacaaaagccgtgaactg

SEQ ID NO: 130111 - DNA, 20 bp, Artificial Sequence
  Description of Artificial Sequence: Synthetic oligonucleotide
  Target: ATXN1; (+) strand; PAM type: NRG; PAM sequence: AGG
atacaaaagccgtgaactgt

SEQ ID NO: 130112 - DNA, 20 bp, Artificial Sequence
  Description of Artificial Sequence: Synthetic oligonucleotide
  Target: ATXN1; (+) strand; PAM type: NRG; PAM sequence: CAG
tgaactgtaggcattacttg

SEQ ID NO: 130113 - DNA, 20 bp, Artificial Sequence
  Description of Artificial Sequence: Synthetic oligonucleotide
  Target: ATXN1; (+) strand; PAM type: NRG; PAM sequence: TAG
attacttgcagatgacaaac

SEQ ID NO: 130114 - DNA, 20 bp, Artificial Sequence
  Description of Artificial Sequence: Synthetic oligonucleotide
  Target: ATXN1; (+) strand; PAM type: NRG; PAM sequence: AGG
ttacttgcagatgacaaact

SEQ ID NO: 130115 - DNA, 20 bp, Artificial Sequence
  Description of Artificial Sequence: Synthetic oligonucleotide
  Target: ATXN1; (+) strand; PAM type: NRG; PAM sequence: CAG
tgcagatgacaaactaggct

SEQ ID NO: 130116 - DNA, 20 bp, Artificial Sequence
  Description of Artificial Sequence: Synthetic oligonucleotide
  Target: ATXN1; (+) strand; PAM type: NRG; PAM sequence: AAG
atgacaaactaggctcagaa

SEQ ID NO: 130117 - DNA, 20 bp, Artificial Sequence
  Description of Artificial Sequence: Synthetic oligonucleotide
  Target: ATXN1; (+) strand; PAM type: NRG; PAM sequence: CAG
aaactaggctcagaaaagtt

SEQ ID NO: 130118 - DNA, 20 bp, Artificial Sequence
  Description of Artificial Sequence: Synthetic oligonucleotide
  Target: ATXN1; (+) strand; PAM type: NRG; PAM sequence: TAG
ctaggctcagaaaagttcag

SEQ ID NO: 130119 - DNA, 20 bp, Artificial Sequence
  Description of Artificial Sequence: Synthetic oligonucleotide
  Target: ATXN1; (+) strand; PAM type: NRG; PAM sequence: TGG
ctcagaaaagttcagtagct

SEQ ID NO: 130120 - DNA, 20 bp, Artificial Sequence
  Description of Artificial Sequence: Synthetic oligonucleotide
  Target: ATXN1; (+) strand; PAM type: NRG; PAM sequence: AAG
aaaagttcagtagcttggtc

SEQ ID NO: 130121 - DNA, 20 bp, Artificial Sequence
  Description of Artificial Sequence: Synthetic oligonucleotide
  Target: ATXN1; (+) strand; PAM type: NRG; PAM sequence: CAG
gtagcttggtcaagttcaca

SEQ ID NO: 130122 - DNA, 20 bp, Artificial Sequence
  Description of Artificial Sequence: Synthetic oligonucleotide
  Target: ATXN1; (+) strand; PAM type: NRG; PAM sequence: CAG
cttggtcaagttcacacagc

SEQ ID NO: 130123 - DNA, 20 bp, Artificial Sequence
  Description of Artificial Sequence: Synthetic oligonucleotide
  Target: ATXN1; (+) strand; PAM type: NRG; PAM sequence: GAG
gtcaagttcacacagccagt

SEQ ID NO: 130124 - DNA, 20 bp, Artificial Sequence
  Description of Artificial Sequence: Synthetic oligonucleotide
  Target: ATXN1; (+) strand; PAM type: NRG; PAM sequence: TGG
gccagtgagctccatgcttt

SEQ ID NO: 130125 - DNA, 20 bp, Artificial Sequence
  Description of Artificial Sequence: Synthetic oligonucleotide
  Target: ATXN1; (+) strand; PAM type: NRG; PAM sequence: GAG
agctccatgcttttggctct

SEQ ID NO: 130126 - DNA, 20 bp, Artificial Sequence
  Description of Artificial Sequence: Synthetic oligonucleotide
  Target: ATXN1; (+) strand; PAM type: NRG; PAM sequence: AGG
gctccatgcttttggctctg

SEQ ID NO: 130127 - DNA, 20 bp, Artificial Sequence
  Description of Artificial Sequence: Synthetic oligonucleotide
  Target: ATXN1; (+) strand; PAM type: NRG; PAM sequence: TGG
tgcttttggctctgaggccc

SEQ ID NO: 130128 - DNA, 20 bp, Artificial Sequence
  Description of Artificial Sequence: Synthetic oligonucleotide
  Target: ATXN1; (+) strand; PAM type: NRG; PAM sequence: TGG
tttggctctgaggccctggt

SEQ ID NO: 130129 - DNA, 20 bp, Artificial Sequence
  Description of Artificial Sequence: Synthetic oligonucleotide
  Target: ATXN1; (+) strand; PAM type: NRG; PAM sequence: AAG
catatgtcaaactcaacact

SEQ ID NO: 130130 - DNA, 20 bp, Artificial Sequence
  Description of Artificial Sequence: Synthetic oligonucleotide
  Target: ATXN1; (+) strand; PAM type: NRG; PAM sequence: AGG
atatgtcaaactcaacacta

SEQ ID NO: 130131 - DNA, 20 bp, Artificial Sequence
  Description of Artificial Sequence: Synthetic oligonucleotide
  Target: ATXN1; (+) strand; PAM type: NRG; PAM sequence: CAG
tgtcaaactcaacactaagg

SEQ ID NO: 130132 - DNA, 20 bp, Artificial Sequence
  Description of Artificial Sequence: Synthetic oligonucleotide
  Target: ATXN1; (+) strand; PAM type: NRG; PAM sequence: AAG
acactaaggcagactcgcct

SEQ ID NO: 130133 - DNA, 20 bp, Artificial Sequence
  Description of Artificial Sequence: Synthetic oligonucleotide
  Target: ATXN1; (+) strand; PAM type: NRG; PAM sequence: CAG
actcgcctaagacacccacc

SEQ ID NO: 130134 - DNA, 20 bp, Artificial Sequence
  Description of Artificial Sequence: Synthetic oligonucleotide
  Target: ATXN1; (+) strand; PAM type: NRG; PAM sequence: GAG
tcgcctaagacacccaccca

SEQ ID NO: 130135 - DNA, 20 bp, Artificial Sequence
  Description of Artificial Sequence: Synthetic oligonucleotide
  Target: ATXN1; (+) strand; PAM type: NRG; PAM sequence: CAG
taagacacccacccagagcc

SEQ ID NO: 130136 - DNA, 20 bp, Artificial Sequence
  Description of Artificial Sequence: Synthetic oligonucleotide
  Target: ATXN1; (+) strand; PAM type: NRG; PAM sequence: TGG
gacacccacccagagcccag

SEQ ID NO: 130137 - DNA, 20 bp, Artificial Sequence
  Description of Artificial Sequence: Synthetic oligonucleotide
  Target: ATXN1; (+) strand; PAM type: NRG; PAM sequence: CGG
agcccagtggttcctacaat

SEQ ID NO: 130138 - DNA, 20 bp, Artificial Sequence
  Description of Artificial Sequence: Synthetic oligonucleotide
  Target: ATXN1; (+) strand; PAM type: NRG; PAM sequence: AAG
acaatcggaaaatcacataa

SEQ ID NO: 130139 - DNA, 20 bp, Artificial Sequence
  Description of Artificial Sequence: Synthetic oligonucleotide
  Target: ATXN1; (+) strand; PAM type: NRG; PAM sequence: AAG
tcggaaaatcacataaaaga

SEQ ID NO: 130140 - DNA, 20 bp, Artificial Sequence
  Description of Artificial Sequence: Synthetic oligonucleotide
  Target: ATXN1; (+) strand; PAM type: NRG; PAM sequence: GAG
ataaaagaaagttttgacat

SEQ ID NO: 130141 - DNA, 20 bp, Artificial Sequence
  Description of Artificial Sequence: Synthetic oligonucleotide
  Target: ATXN1; (+) strand; PAM type: NRG; PAM sequence: CGG
agaaagttttgacatgagac

SEQ ID NO: 130142 - DNA, 20 bp, Artificial Sequence
  Description of Artificial Sequence: Synthetic oligonucleotide
  Target: ATXN1; (+) strand; PAM type: NRG; PAM sequence: TAG
acatgagaccggctgtcaaa

SEQ ID NO: 130143 - DNA, 20 bp, Artificial Sequence
  Description of Artificial Sequence: Synthetic oligonucleotide
  Target: ATXN1; (+) strand; PAM type: NRG; PAM sequence: CAG
ctgtcaaatagacacctctg

SEQ ID NO: 130144 - DNA, 20 bp, Artificial Sequence
  Description of Artificial Sequence: Synthetic oligonucleotide
  Target: ATXN1; (+) strand; PAM type: NRG; PAM sequence: AGG
tgtcaaatagacacctctgc

SEQ ID NO: 130145 - DNA, 20 bp, Artificial Sequence
  Description of Artificial Sequence: Synthetic oligonucleotide
  Target: ATXN1; (+) strand; PAM type: NRG; PAM sequence: CAG
aaatagacacctctgcaggc

SEQ ID NO: 130146 - DNA, 20 bp, Artificial Sequence
  Description of Artificial Sequence: Synthetic oligonucleotide
  Target: ATXN1; (+) strand; PAM type: NRG; PAM sequence: AGG
aatagacacctctgcaggcc

SEQ ID NO: 130147 - DNA, 20 bp, Artificial Sequence
  Description of Artificial Sequence: Synthetic oligonucleotide
  Target: ATXN1; (+) strand; PAM type: NRG; PAM sequence: GGG
atagacacctctgcaggcca

SEQ ID NO: 130148 - DNA, 20 bp, Artificial Sequence
  Description of Artificial Sequence: Synthetic oligonucleotide
  Target: ATXN1; (+) strand; PAM type: NRG; PAM sequence: GGG
tagacacctctgcaggccag

SEQ ID NO: 130149 - DNA, 20 bp, Artificial Sequence
  Description of Artificial Sequence: Synthetic oligonucleotide
  Target: ATXN1; (+) strand; PAM type: NRG; PAM sequence: TGG
tgtgtgtgtctaaaaccaac

SEQ ID NO: 130150 - DNA, 20 bp, Artificial Sequence
  Description of Artificial Sequence: Synthetic oligonucleotide
  Target: ATXN1; (+) strand; PAM type: NRG; PAM sequence: GGG
gtgtgtgtctaaaaccaact

SEQ ID NO: 130151 - DNA, 20 bp, Artificial Sequence
  Description of Artificial Sequence: Synthetic oligonucleotide
  Target: ATXN1; (+) strand; PAM type: NRG; PAM sequence: TGG
tgtgtctaaaaccaactggg

SEQ ID NO: 130152 - DNA, 20 bp, Artificial Sequence
  Description of Artificial Sequence: Synthetic oligonucleotide
  Target: ATXN1; (+) strand; PAM type: NRG; PAM sequence: CAG
tgggtggccacattgttctg

SEQ ID NO: 130153 - DNA, 20 bp, Artificial Sequence
  Description of Artificial Sequence: Synthetic oligonucleotide
  Target: ATXN1; (+) strand; PAM type: NRG; PAM sequence: CAG
tctgcagtctgtttgccttc

SEQ ID NO: 130154 - DNA, 20 bp, Artificial Sequence
  Description of Artificial Sequence: Synthetic oligonucleotide
  Target: ATXN1; (+) strand; PAM type: NRG; PAM sequence: CAG
tttctttcctgcctgtcatg

SEQ ID NO: 130155 - DNA, 20 bp, Artificial Sequence
  Description of Artificial Sequence: Synthetic oligonucleotide
  Target: ATXN1; (+) strand; PAM type: NRG; PAM sequence: TAG
ctgtcatgcagataattgtg

SEQ ID NO: 130156 - DNA, 20 bp, Artificial Sequence
  Description of Artificial Sequence: Synthetic oligonucleotide
  Target: ATXN1; (+) strand; PAM type: NRG; PAM sequence: AAG
ataattgtgtagtgtgtccc

SEQ ID NO: 130157 - DNA, 20 bp, Artificial Sequence
  Description of Artificial Sequence: Synthetic oligonucleotide
  Target: ATXN1; (+) strand; PAM type: NRG; PAM sequence: CAG
gtgtagtgtgtcccaagcaa

SEQ ID NO: 130158 - DNA, 20 bp, Artificial Sequence
  Description of Artificial Sequence: Synthetic oligonucleotide
  Target: ATXN1; (+) strand; PAM type: NRG; PAM sequence: AGG
tgtagtgtgtcccaagcaac

SEQ ID NO: 130159 - DNA, 20 bp, Artificial Sequence
  Description of Artificial Sequence: Synthetic oligonucleotide
  Target: ATXN1; (+) strand; PAM type: NRG; PAM sequence: CAG
tcccaagcaacaggacgcat

SEQ ID NO: 130160 - DNA, 20 bp, Artificial Sequence
  Description of Artificial Sequence: Synthetic oligonucleotide
  Target: ATXN1; (+) strand; PAM type: NRG; PAM sequence: TGG
gcatcagtttccctaattta

SEQ ID NO: 130161 - DNA, 20 bp, Artificial Sequence
  Description of Artificial Sequence: Synthetic oligonucleotide
  Target: ATXN1; (+) strand; PAM type: NRG; PAM sequence: GAG
atcagtttccctaatttatg

SEQ ID NO: 130162 - DNA, 20 bp, Artificial Sequence
  Description of Artificial Sequence: Synthetic oligonucleotide
  Target: ATXN1; (+) strand; PAM type: NRG; PAM sequence: CAG
gtttccctaatttatggagt

SEQ ID NO: 130163 - DNA, 20 bp, Artificial Sequence
  Description of Artificial Sequence: Synthetic oligonucleotide
  Target: ATXN1; (+) strand; PAM type: NRG; PAM sequence: TAG
aacacactaactctgtatgt

SEQ ID NO: 130164 - DNA, 20 bp, Artificial Sequence
  Description of Artificial Sequence: Synthetic oligonucleotide
  Target: ATXN1; (+) strand; PAM type: NRG; PAM sequence: AAG
gtatgttagatgtttccaac

SEQ ID NO: 130165 - DNA, 20 bp, Artificial Sequence
  Description of Artificial Sequence: Synthetic oligonucleotide
  Target: ATXN1; (+) strand; PAM type: NRG; PAM sequence: AAG
gatgtttccaacaagcatca

SEQ ID NO: 130166 - DNA, 20 bp, Artificial Sequence
  Description of Artificial Sequence: Synthetic oligonucleotide
  Target: ATXN1; (+) strand; PAM type: NRG; PAM sequence: CAG
ctgtcttttgttttgttttc

SEQ ID NO: 130167 - DNA, 20 bp, Artificial Sequence
  Description of Artificial Sequence: Synthetic oligonucleotide
  Target: ATXN1; (+) strand; PAM type: NRG; PAM sequence: AAG
ttttccagttctgctaatgc

SEQ ID NO: 130168 - DNA, 20 bp, Artificial Sequence
  Description of Artificial Sequence: Synthetic oligonucleotide
  Target: ATXN1; (+) strand; PAM type: NRG; PAM sequence: AGG
tttccagttctgctaatgca

SEQ ID NO: 130169 - DNA, 20 bp, Artificial Sequence
  Description of Artificial Sequence: Synthetic oligonucleotide
  Target: ATXN1; (+) strand; PAM type: NRG; PAM sequence: GGG
ttccagttctgctaatgcaa

SEQ ID NO: 130170 - DNA, 20 bp, Artificial Sequence
  Description of Artificial Sequence: Synthetic oligonucleotide
  Target: ATXN1; (+) strand; PAM type: NRG; PAM sequence: CAG
agttctgctaatgcaaggga

SEQ ID NO: 130171 - DNA, 20 bp, Artificial Sequence
  Description of Artificial Sequence: Synthetic oligonucleotide
  Target: ATXN1; (+) strand; PAM type: NRG; PAM sequence: TGG
atgcaagggacagcctgtcc

SEQ ID NO: 130172 - DNA, 20 bp, Artificial Sequence
  Description of Artificial Sequence: Synthetic oligonucleotide
  Target: ATXN1; (+) strand; PAM type: NRG; PAM sequence: TAG
cctgtcctggtatttattac

SEQ ID NO: 130173 - DNA, 20 bp, Artificial Sequence
  Description of Artificial Sequence: Synthetic oligonucleotide
  Target: ATXN1; (+) strand; PAM type: NRG; PAM sequence: GAG
tgtcctggtatttattacta

SEQ ID NO: 130174 - DNA, 20 bp, Artificial Sequence
  Description of Artificial Sequence: Synthetic oligonucleotide
  Target: ATXN1; (+) strand; PAM type: NRG; PAM sequence: CAG
atttattactagagtaatgt

SEQ ID NO: 130175 - DNA, 20 bp, Artificial Sequence
  Description of Artificial Sequence: Synthetic oligonucleotide
  Target: ATXN1; (+) strand; PAM type: NRG; PAM sequence: AGG
tttattactagagtaatgtc

SEQ ID NO: 130176 - DNA, 20 bp, Artificial Sequence
  Description of Artificial Sequence: Synthetic oligonucleotide
  Target: ATXN1; (+) strand; PAM type: NRG; PAM sequence: TGG
tactagagtaatgtcaggtt

SEQ ID NO: 130177 - DNA, 20 bp, Artificial Sequence
  Description of Artificial Sequence: Synthetic oligonucleotide
  Target: ATXN1; (+) strand; PAM type: NRG; PAM sequence: GGG
actagagtaatgtcaggttt

SEQ ID NO: 130178 - DNA, 20 bp, Artificial Sequence
  Description of Artificial Sequence: Synthetic oligonucleotide
  Target: ATXN1; (+) strand; PAM type: NRG; PAM sequence: GGG
ctagagtaatgtcaggtttg

SEQ ID NO: 130179 - DNA, 20 bp, Artificial Sequence
  Description of Artificial Sequence: Synthetic oligonucleotide
  Target: ATXN1; (+) strand; PAM type: NRG; PAM sequence: TAG
agtaatgtcaggtttggggt

SEQ ID NO: 130180 - DNA, 20 bp, Artificial Sequence
  Description of Artificial Sequence: Synthetic oligonucleotide
  Target: ATXN1; (+) strand; PAM type: NRG; PAM sequence: TAG
tagctcataaaatacctctc

SEQ ID NO: 130181 - DNA, 20 bp, Artificial Sequence
  Description of Artificial Sequence: Synthetic oligonucleotide
  Target: ATXN1; (+) strand; PAM type: NRG; PAM sequence: TGG
cataaaatacctctctagtt

SEQ ID NO: 130182 - DNA, 20 bp, Artificial Sequence
  Description of Artificial Sequence: Synthetic oligonucleotide
  Target: ATXN1; (+) strand; PAM type: NRG; PAM sequence: AAG
tctagtttggctttctttgc

SEQ ID NO: 130183 - DNA, 20 bp, Artificial Sequence
  Description of Artificial Sequence: Synthetic oligonucleotide
  Target: ATXN1; (+) strand; PAM type: NRG; PAM sequence: GAG
tagtttggctttctttgcaa

SEQ ID NO: 130184 - DNA, 20 bp, Artificial Sequence
  Description of Artificial Sequence: Synthetic oligonucleotide
  Target: ATXN1; (+) strand; PAM type: NRG; PAM sequence: TGG
aaacattcttttttctttaa

SEQ ID NO: 130185 - DNA, 20 bp, Artificial Sequence
  Description of Artificial Sequence: Synthetic oligonucleotide
  Target: ATXN1; (+) strand; PAM type: NRG; PAM sequence: AAG
tctttaatggcaccatcaaa

SEQ ID NO: 130186 - DNA, 20 bp, Artificial Sequence
  Description of Artificial Sequence: Synthetic oligonucleotide
  Target: ATXN1; (+) strand; PAM type: NRG; PAM sequence: TAG
aacatataaacatgtttcaa

SEQ ID NO: 130187 - DNA, 20 bp, Artificial Sequence
  Description of Artificial Sequence: Synthetic oligonucleotide
  Target: ATXN1; (+) strand; PAM type: NRG; PAM sequence: AGG
acatataaacatgtttcaat

SEQ ID NO: 130188 - DNA, 20 bp, Artificial Sequence
  Description of Artificial Sequence: Synthetic oligonucleotide
  Target: ATXN1; (+) strand; PAM type: NRG; PAM sequence: TGG
aggcattctttttcctcttg

SEQ ID NO: 130189 - DNA, 20 bp, Artificial Sequence
  Description of Artificial Sequence: Synthetic oligonucleotide
  Target: ATXN1; (+) strand; PAM type: NRG; PAM sequence: CAG
tttttcctcttgtggtttct

SEQ ID NO: 130190 - DNA, 20 bp, Artificial Sequence
  Description of Artificial Sequence: Synthetic oligonucleotide
  Target: ATXN1; (+) strand; PAM type: NRG; PAM sequence: TGG
tcttgtggtttctcagtatt

SEQ ID NO: 130191 - DNA, 20 bp, Artificial Sequence
  Description of Artificial Sequence: Synthetic oligonucleotide
  Target: ATXN1; (+) strand; PAM type: NRG; PAM sequence: AAG
atatttcactattttcttgc

SEQ ID NO: 130192 - DNA, 20 bp, Artificial Sequence
  Description of Artificial Sequence: Synthetic oligonucleotide
  Target: ATXN1; (+) strand; PAM type: NRG; PAM sequence: CGG
tattttcttgcaagcctttt

SEQ ID NO: 130193 - DNA, 20 bp, Artificial Sequence
  Description of Artificial Sequence: Synthetic oligonucleotide
  Target: ATXN1; (+) strand; PAM type: NRG; PAM sequence: GAG
ttttcttgcaagccttttcg

SEQ ID NO: 130194 - DNA, 20 bp, Artificial Sequence
  Description of Artificial Sequence: Synthetic oligonucleotide
  Target: ATXN1; (+) strand; PAM type: NRG; PAM sequence: TGG
tcggagactctttatcattt

SEQ ID NO: 130195 - DNA, 20 bp, Artificial Sequence
  Description of Artificial Sequence: Synthetic oligonucleotide
  Target: ATXN1; (+) strand; PAM type: NRG; PAM sequence: TAG
ttatcattttggttgacaat

SEQ ID NO: 130196 - DNA, 20 bp, Artificial Sequence
  Description of Artificial Sequence: Synthetic oligonucleotide
  Target: ATXN1; (+) strand; PAM type: NRG; PAM sequence: TGG
tagtgttttgtgtcattttt

SEQ ID NO: 130197 - DNA, 20 bp, Artificial Sequence
  Description of Artificial Sequence: Synthetic oligonucleotide
  Target: ATXN1; (+) strand; PAM type: NRG; PAM sequence: TGG
attttttggtaataatattt

SEQ ID NO: 130198 - DNA, 20 bp, Artificial Sequence
  Description of Artificial Sequence: Synthetic oligonucleotide
  Target: ATXN1; (+) strand; PAM type: NRG; PAM sequence: GGG
ttttttggtaataatatttt

SEQ ID NO: 130199 - DNA, 20 bp, Artificial Sequence
  Description of Artificial Sequence: Synthetic oligonucleotide
  Target: ATXN1; (+) strand; PAM type: NRG; PAM sequence: GGG
tttttggtaataatattttg

SEQ ID NO: 130200 - DNA, 20 bp, Artificial Sequence
  Description of Artificial Sequence: Synthetic oligonucleotide
  Target: ATXN1; (+) strand; PAM type: NRG; PAM sequence: TAG
tttggggaaaaaaactaccc

SEQ ID NO: 130201 - DNA, 20 bp, Artificial Sequence
  Description of Artificial Sequence: Synthetic oligonucleotide
  Target: ATXN1; (+) strand; PAM type: NRG; PAM sequence: TGG
aaaactaccctagtaatatt

SEQ ID NO: 130202 - DNA, 20 bp, Artificial Sequence
  Description of Artificial Sequence: Synthetic oligonucleotide
  Target: ATXN1; (+) strand; PAM type: NRG; PAM sequence: CAG
cctagtaatatttggtttat

SEQ ID NO: 130203 - DNA, 20 bp, Artificial Sequence
  Description of Artificial Sequence: Synthetic oligonucleotide
  Target: ATXN1; (+) strand; PAM type: NRG; PAM sequence: AGG
ctagtaatatttggtttatc

SEQ ID NO: 130204 - DNA, 20 bp, Artificial Sequence
  Description of Artificial Sequence: Synthetic oligonucleotide
  Target: ATXN1; (+) strand; PAM type: NRG; PAM sequence: TGG
gtttatcaggtgacttgatc

SEQ ID NO: 130205 - DNA, 20 bp, Artificial Sequence
  Description of Artificial Sequence: Synthetic oligonucleotide
  Target: ATXN1; (+) strand; PAM type: NRG; PAM sequence: GGG
tttatcaggtgacttgatct

SEQ ID NO: 130206 - DNA, 20 bp, Artificial Sequence
  Description of Artificial Sequence: Synthetic oligonucleotide
  Target: ATXN1; (+) strand; PAM type: NRG; PAM sequence: GGG
ttatcaggtgacttgatctg

SEQ ID NO: 130207 - DNA, 20 bp, Artificial Sequence
  Description of Artificial Sequence: Synthetic oligonucleotide
  Target: ATXN1; (+) strand; PAM type: NRG; PAM sequence: GGG
tatcaggtgacttgatctgg

SEQ ID NO: 130208 - DNA, 20 bp, Artificial Sequence
  Description of Artificial Sequence: Synthetic oligonucleotide
  Target: ATXN1; (+) strand; PAM type: NRG; PAM sequence: GGG
atcaggtgacttgatctggg

SEQ ID NO: 130209 - DNA, 20 bp, Artificial Sequence
  Description of Artificial Sequence: Synthetic oligonucleotide
  Target: ATXN1; (+) strand; PAM type: NRG; PAM sequence: GAG
acttgatctggggggacgct

SEQ ID NO: 130210 - DNA, 20 bp, Artificial Sequence
  Description of Artificial Sequence: Synthetic oligonucleotide
  Target: ATXN1; (+) strand; PAM type: NRG; PAM sequence: AGG
cttgatctggggggacgctg

SEQ ID NO: 130211 - DNA, 20 bp, Artificial Sequence
  Description of Artificial Sequence: Synthetic oligonucleotide
  Target: ATXN1; (+) strand; PAM type: NRG; PAM sequence: GAG
ggggggacgctgaggaaaat

SEQ ID NO: 130212 - DNA, 20 bp, Artificial Sequence
  Description of Artificial Sequence: Synthetic oligonucleotide
  Target: ATXN1; (+) strand; PAM type: NRG; PAM sequence: AGG
gggggacgctgaggaaaatg

SEQ ID NO: 130213 - DNA, 20 bp, Artificial Sequence
  Description of Artificial Sequence: Synthetic oligonucleotide
  Target: ATXN1; (+) strand; PAM type: NRG; PAM sequence: TAG
cctttcttccttttctctct

SEQ ID NO: 130214 - DNA, 20 bp, Artificial Sequence
  Description of Artificial Sequence: Synthetic oligonucleotide
  Target: ATXN1; (+) strand; PAM type: NRG; PAM sequence: AAG
ttccttttctctcttagcaa

SEQ ID NO: 130215 - DNA, 20 bp, Artificial Sequence
  Description of Artificial Sequence: Synthetic oligonucleotide
  Target: ATXN1; (+) strand; PAM type: NRG; PAM sequence: TAG
gcctttactacatattccta

SEQ ID NO: 130216 - DNA, 20 bp, Artificial Sequence
  Description of Artificial Sequence: Synthetic oligonucleotide
  Target: ATXN1; (+) strand; PAM type: NRG; PAM sequence: TAG
tacatattcctatagcttct

SEQ ID NO: 130217 - DNA, 20 bp, Artificial Sequence
  Description of Artificial Sequence: Synthetic oligonucleotide
  Target: ATXN1; (+) strand; PAM type: NRG; PAM sequence: TGG
tcttagtctttttacttcgt

SEQ ID NO: 130218 - DNA, 20 bp, Artificial Sequence
  Description of Artificial Sequence: Synthetic oligonucleotide
  Target: ATXN1; (+) strand; PAM type: NRG; PAM sequence: AAG
tctttttacttcgttggcaa

SEQ ID NO: 130219 - DNA, 20 bp, Artificial Sequence
  Description of Artificial Sequence: Synthetic oligonucleotide
  Target: ATXN1; (+) strand; PAM type: NRG; PAM sequence: TAG
cttcgttggcaaaagaaaaa

SEQ ID NO: 130220 - DNA, 20 bp, Artificial Sequence
  Description of Artificial Sequence: Synthetic oligonucleotide
  Target: ATXN1; (+) strand; PAM type: NRG; PAM sequence: GAG
tggcaaaagaaaaatagcat

SEQ ID NO: 130221 - DNA, 20 bp, Artificial Sequence
  Description of Artificial Sequence: Synthetic oligonucleotide
  Target: ATXN1; (+) strand; PAM type: NRG; PAM sequence: TAG
attgctgccttcttccttta

SEQ ID NO: 130222 - DNA, 20 bp, Artificial Sequence
  Description of Artificial Sequence: Synthetic oligonucleotide
  Target: ATXN1; (+) strand; PAM type: NRG; PAM sequence: CAG
tgccttcttcctttatagca

SEQ ID NO: 130223 - DNA, 20 bp, Artificial Sequence
  Description of Artificial Sequence: Synthetic oligonucleotide
  Target: ATXN1; (+) strand; PAM type: NRG; PAM sequence: TGG
tcataaactcctgtcaatgc

SEQ ID NO: 130224 - DNA, 20 bp, Artificial Sequence
  Description of Artificial Sequence: Synthetic oligonucleotide
  Target: ATXN1; (+) strand; PAM type: NRG; PAM sequence: AAG
aaactcctgtcaatgctggt

SEQ ID NO: 130225 - DNA, 20 bp, Artificial Sequence
  Description of Artificial Sequence: Synthetic oligonucleotide
  Target: ATXN1; (+) strand; PAM type: NRG; PAM sequence: CAG
tcaatgctggtaagaaaaat

SEQ ID NO: 130226 - DNA, 20 bp, Artificial Sequence
  Description of Artificial Sequence: Synthetic oligonucleotide
  Target: ATXN1; (+) strand; PAM type: NRG; PAM sequence: CGG
agactactattttatcactg

SEQ ID NO: 130227 - DNA, 20 bp, Artificial Sequence
  Description of Artificial Sequence: Synthetic oligonucleotide
  Target: ATXN1; (+) strand; PAM type: NRG; PAM sequence: GGG
gactactattttatcactgc

SEQ ID NO: 130228 - DNA, 20 bp, Artificial Sequence
  Description of Artificial Sequence: Synthetic oligonucleotide
  Target: ATXN1; (+) strand; PAM type: NRG; PAM sequence: GAG
ctactattttatcactgcgg

SEQ ID NO: 130229 - DNA, 20 bp, Artificial Sequence
  Description of Artificial Sequence: Synthetic oligonucleotide
  Target: ATXN1; (+) strand; PAM type: NRG; PAM sequence: CAG
tcactgcgggagaactaaca

SEQ ID NO: 130230 - DNA, 20 bp, Artificial Sequence
  Description of Artificial Sequence: Synthetic oligonucleotide
  Target: ATXN1; (+) strand; PAM type: NRG; PAM sequence: CAG
ctttctgcaaataattccgt

SEQ ID NO: 130231 - DNA, 20 bp, Artificial Sequence
  Description of Artificial Sequence: Synthetic oligonucleotide
  Target: ATXN1; (+) strand; PAM type: NRG; PAM sequence: CAG
gcaaataattccgtcagatt

SEQ ID NO: 130232 - DNA, 20 bp, Artificial Sequence
  Description of Artificial Sequence: Synthetic oligonucleotide
  Target: ATXN1; (+) strand; PAM type: NRG; PAM sequence: AAG
acgttttctactcattataa

SEQ ID NO: 130233 - DNA, 20 bp, Artificial Sequence
  Description of Artificial Sequence: Synthetic oligonucleotide
  Target: ATXN1; (+) strand; PAM type: NRG; PAM sequence: TGG
aaagccctacaaacgccaaa

SEQ ID NO: 130234 - DNA, 20 bp, Artificial Sequence
  Description of Artificial Sequence: Synthetic oligonucleotide
  Target: ATXN1; (+) strand; PAM type: NRG; PAM sequence: CAG
aacgccaaatggacaataaa

SEQ ID NO: 130235 - DNA, 20 bp, Artificial Sequence
  Description of Artificial Sequence: Synthetic oligonucleotide
  Target: ATXN1; (+) strand; PAM type: NRG; PAM sequence: AGG
acgccaaatggacaataaac

SEQ ID NO: 130236 - DNA, 20 bp, Artificial Sequence
  Description of Artificial Sequence: Synthetic oligonucleotide
  Target: ATXN1; (+) strand; PAM type: NRG; PAM sequence: AAG
aataaacaggctccacccca

SEQ ID NO: 130237 - DNA, 20 bp, Artificial Sequence
  Description of Artificial Sequence: Synthetic oligonucleotide
  Target: ATXN1; (+) strand; PAM type: NRG; PAM sequence: AGG
ataaacaggctccaccccaa

SEQ ID NO: 130238 - DNA, 20 bp, Artificial Sequence
  Description of Artificial Sequence: Synthetic oligonucleotide
  Target: ATXN1; (+) strand; PAM type: NRG; PAM sequence: CAG
aacaggctccaccccaaagg

SEQ ID NO: 130239 - DNA, 20 bp, Artificial Sequence
  Description of Artificial Sequence: Synthetic oligonucleotide
  Target: ATXN1; (+) strand; PAM type: NRG; PAM sequence: AGG
acaggctccaccccaaaggc

SEQ ID NO: 130240 - DNA, 20 bp, Artificial Sequence
  Description of Artificial Sequence: Synthetic oligonucleotide
  Target: ATXN1; (+) strand; PAM type: NRG; PAM sequence: TGG
aaaggcaggctcactgttaa

SEQ ID NO: 130241 - DNA, 20 bp, Artificial Sequence
  Description of Artificial Sequence: Synthetic oligonucleotide
  Target: ATXN1; (+) strand; PAM type: NRG; PAM sequence: GGG
aaggcaggctcactgttaat

SEQ ID NO: 130242 - DNA, 20 bp, Artificial Sequence
  Description of Artificial Sequence: Synthetic oligonucleotide
  Target: ATXN1; (+) strand; PAM type: NRG; PAM sequence: GGG
aggcaggctcactgttaatg

SEQ ID NO: 130243 - DNA, 20 bp, Artificial Sequence
  Description of Artificial Sequence: Synthetic oligonucleotide
  Target: ATXN1; (+) strand; PAM type: NRG; PAM sequence: GGG
ggcaggctcactgttaatgg

SEQ ID NO: 130244 - DNA, 20 bp, Artificial Sequence
  Description of Artificial Sequence: Synthetic oligonucleotide
  Target: ATXN1; (+) strand; PAM type: NRG; PAM sequence: GAG
cactgttaatgggggaacat

SEQ ID NO: 130245 - DNA, 20 bp, Artificial Sequence
  Description of Artificial Sequence: Synthetic oligonucleotide
  Target: ATXN1; (+) strand; PAM type: NRG; PAM sequence: AAG
tgttaatgggggaacatgag

SEQ ID NO: 130246 - DNA, 20 bp, Artificial Sequence
  Description of Artificial Sequence: Synthetic oligonucleotide
  Target: ATXN1; (+) strand; PAM type: NRG; PAM sequence: TAG
gagaagcatcccattaaaaa

SEQ ID NO: 130247 - DNA, 20 bp, Artificial Sequence
  Description of Artificial Sequence: Synthetic oligonucleotide
  Target: ATXN1; (+) strand; PAM type: NRG; PAM sequence: AGG
agaagcatcccattaaaaat

SEQ ID NO: 130248 - DNA, 20 bp, Artificial Sequence
  Description of Artificial Sequence: Synthetic oligonucleotide
  Target: ATXN1; (+) strand; PAM type: NRG; PAM sequence: GAG
attaaaaataggaacaacat

SEQ ID NO: 130249 - DNA, 20 bp, Artificial Sequence
  Description of Artificial Sequence: Synthetic oligonucleotide
  Target: ATXN1; (+) strand; PAM type: NRG; PAM sequence: AGG
ttaaaaataggaacaacatg

SEQ ID NO: 130250 - DNA, 20 bp, Artificial Sequence
  Description of Artificial Sequence: Synthetic oligonucleotide
  Target: ATXN1; (+) strand; PAM type: NRG; PAM sequence: TAG
taacactgatctgttaaact

SEQ ID NO: 130251 - DNA, 20 bp, Artificial Sequence
  Description of Artificial Sequence: Synthetic oligonucleotide
  Target: ATXN1; (+) strand; PAM type: NRG; PAM sequence: AAG
cttagccaatttaactgcat

SEQ ID NO: 130252 - DNA, 20 bp, Artificial Sequence
  Description of Artificial Sequence: Synthetic oligonucleotide
  Target: ATXN1; (+) strand; PAM type: NRG; PAM sequence: GAG
tagccaatttaactgcataa

SEQ ID NO: 130253 - DNA, 20 bp, Artificial Sequence
  Description of Artificial Sequence: Synthetic oligonucleotide
  Target: ATXN1; (+) strand; PAM type: NRG; PAM sequence: AAG
actgcataagagaaataaat

SEQ ID NO: 130254 - DNA, 20 bp, Artificial Sequence
  Description of Artificial Sequence: Synthetic oligonucleotide
  Target: ATXN1; (+) strand; PAM type: NRG; PAM sequence: AGG
ctgcataagagaaataaata

SEQ ID NO: 130255 - DNA, 20 bp, Artificial Sequence
  Description of Artificial Sequence: Synthetic oligonucleotide
  Target: ATXN1; (+) strand; PAM type: NRG; PAM sequence: GGG
tgcataagagaaataaataa

SEQ ID NO: 130256 - DNA, 20 bp, Artificial Sequence
  Description of Artificial Sequence: Synthetic oligonucleotide
  Target: ATXN1; (+) strand; PAM type: NRG; PAM sequence: CAG
aagggatataaaaattataa

SEQ ID NO: 130257 - DNA, 20 bp, Artificial Sequence
  Description of Artificial Sequence: Synthetic oligonucleotide
  Target: ATXN1; (+) strand; PAM type: NRG; PAM sequence: AGG
agggatataaaaattataac

SEQ ID NO: 130258 - DNA, 20 bp, Artificial Sequence
  Description of Artificial Sequence: Synthetic oligonucleotide
  Target: ATXN1; (+) strand; PAM type: NRG; PAM sequence: CAG
gatataaaaattataacagg

SEQ ID NO: 130259 - DNA, 20 bp, Artificial Sequence
  Description of Artificial Sequence: Synthetic oligonucleotide
  Target: ATXN1; (+) strand; PAM type: NRG; PAM sequence: GAG
atttataaatgctatgatct

SEQ ID NO: 130260 - DNA, 20 bp, Artificial Sequence
  Description of Artificial Sequence: Synthetic oligonucleotide
  Target: ATXN1; (+) strand; PAM type: NRG; PAM sequence: AAG
ataaatgctatgatctgagc

SEQ ID NO: 130261 - DNA, 20 bp, Artificial Sequence
  Description of Artificial Sequence: Synthetic oligonucleotide
  Target: ATXN1; (+) strand; PAM type: NRG; PAM sequence: TAG
caattgaacaacttattaat

SEQ ID NO: 130262 - DNA, 20 bp, Artificial Sequence
  Description of Artificial Sequence: Synthetic oligonucleotide
  Target: ATXN1; (+) strand; PAM type: NRG; PAM sequence: GAG
attgaacaacttattaatta

SEQ ID NO: 130263 - DNA, 20 bp, Artificial Sequence
  Description of Artificial Sequence: Synthetic oligonucleotide
  Target: ATXN1; (+) strand; PAM type: NRG; PAM sequence: TAG
ttattaattagagaattctg

SEQ ID NO: 130264 - DNA, 20 bp, Artificial Sequence
  Description of Artificial Sequence: Synthetic oligonucleotide
  Target: ATXN1; (+) strand; PAM type: NRG; PAM sequence: AGG
tattaattagagaattctgt

SEQ ID NO: 130265 - DNA, 20 bp, Artificial Sequence
  Description of Artificial Sequence: Synthetic oligonucleotide
  Target: ATXN1; (+) strand; PAM type: NRG; PAM sequence: GGG
attaattagagaattctgta

SEQ ID NO: 130266 - DNA, 20 bp, Artificial Sequence
  Description of Artificial Sequence: Synthetic oligonucleotide
  Target: ATXN1; (+) strand; PAM type: NRG; PAM sequence: AAG
ctgtagggtaactgaaacaa

SEQ ID NO: 130267 - DNA, 20 bp, Artificial Sequence
  Description of Artificial Sequence: Synthetic oligonucleotide
  Target: ATXN1; (+) strand; PAM type: NRG; PAM sequence: AAG
aaaaatcaataacctttcta

SEQ ID NO: 130268 - DNA, 20 bp, Artificial Sequence
  Description of Artificial Sequence: Synthetic oligonucleotide
  Target: ATXN1; (+) strand; PAM type: NRG; PAM sequence: AGG
aaaatcaataacctttctaa

SEQ ID NO: 130269 - DNA, 20 bp, Artificial Sequence
  Description of Artificial Sequence: Synthetic oligonucleotide
  Target: ATXN1; (+) strand; PAM type: NRG; PAM sequence: CAG
taacctttctaaaggacaac

SEQ ID NO: 130270 - DNA, 20 bp, Artificial Sequence
  Description of Artificial Sequence: Synthetic oligonucleotide
  Target: ATXN1; (+) strand; PAM type: NRG; PAM sequence: AAG
tctaaaggacaaccagtaaa

SEQ ID NO: 130271 - DNA, 20 bp, Artificial Sequence
  Description of Artificial Sequence: Synthetic oligonucleotide
  Target: ATXN1; (+) strand; PAM type: NRG; PAM sequence: AGG
ctaaaggacaaccagtaaaa

SEQ ID NO: 130272 - DNA, 20 bp, Artificial Sequence
  Description of Artificial Sequence: Synthetic oligonucleotide
  Target: ATXN1; (+) strand; PAM type: NRG; PAM sequence: TAG
caacaaaaatataaaatgcc

SEQ ID NO: 130273 - DNA, 20 bp, Artificial Sequence
  Description of Artificial Sequence: Synthetic oligonucleotide
  Target: ATXN1; (+) strand; PAM type: NRG; PAM sequence: AGG
aacaaaaatataaaatgcct

SEQ ID NO: 130274 - DNA, 20 bp, Artificial Sequence
  Description of Artificial Sequence: Synthetic oligonucleotide
  Target: ATXN1; (+) strand; PAM type: NRG; PAM sequence: GGG
acaaaaatataaaatgccta

SEQ ID NO: 130275 - DNA, 20 bp, Artificial Sequence
  Description of Artificial Sequence: Synthetic oligonucleotide
  Target: ATXN1; (+) strand; PAM type: NRG; PAM sequence: AAG
aaatgcctagggataaactg

SEQ ID NO: 130276 - DNA, 20 bp, Artificial Sequence
  Description of Artificial Sequence: Synthetic oligonucleotide
  Target: ATXN1; (+) strand; PAM type: NRG; PAM sequence: AGG
aatgcctagggataaactga

SEQ ID NO: 130277 - DNA, 20 bp, Artificial Sequence
  Description of Artificial Sequence: Synthetic oligonucleotide
  Target: ATXN1; (+) strand; PAM type: NRG; PAM sequence: GAG
tgcctagggataaactgaag

SEQ ID NO: 130278 - DNA, 20 bp, Artificial Sequence
  Description of Artificial Sequence: Synthetic oligonucleotide
  Target: ATXN1; (+) strand; PAM type: NRG; PAM sequence: AGG
gcctagggataaactgaagg

SEQ ID NO: 130279 - DNA, 20 bp, Artificial Sequence
  Description of Artificial Sequence: Synthetic oligonucleotide
  Target: ATXN1; (+) strand; PAM type: NRG; PAM sequence: AAG
actgaaggaggactatatgc

SEQ ID NO: 130280 - DNA, 20 bp, Artificial Sequence
  Description of Artificial Sequence: Synthetic oligonucleotide
  Target: ATXN1; (+) strand; PAM type: NRG; PAM sequence: AAG
ctatatgcaagatctacata

SEQ ID NO: 130281 - DNA, 20 bp, Artificial Sequence
  Description of Artificial Sequence: Synthetic oligonucleotide
  Target: ATXN1; (+) strand; PAM type: NRG; PAM sequence: GAG
atatgcaagatctacataaa

SEQ ID NO: 130282 - DNA, 20 bp, Artificial Sequence
  Description of Artificial Sequence: Synthetic oligonucleotide
  Target: ATXN1; (+) strand; PAM type: NRG; PAM sequence: AGG
tatgcaagatctacataaag

SEQ ID NO: 130283 - DNA, 20 bp, Artificial Sequence
  Description of Artificial Sequence: Synthetic oligonucleotide
  Target: ATXN1; (+) strand; PAM type: NRG; PAM sequence: GGG
atgcaagatctacataaaga

SEQ ID NO: 130284 - DNA, 20 bp, Artificial Sequence
  Description of Artificial Sequence: Synthetic oligonucleotide
  Target: ATXN1; (+) strand; PAM type: NRG; PAM sequence: TGG
aagatctacataaagagggc

SEQ ID NO: 130285 - DNA, 20 bp, Artificial Sequence
  Description of Artificial Sequence: Synthetic oligonucleotide
  Target: ATXN1; (+) strand; PAM type: NRG; PAM sequence: GGG
agatctacataaagagggct

SEQ ID NO: 130286 - DNA, 20 bp, Artificial Sequence
  Description of Artificial Sequence: Synthetic oligonucleotide
  Target: ATXN1; (+) strand; PAM type: NRG; PAM sequence: CAG
tacataaagagggctgggtg

SEQ ID NO: 130287 - DNA, 20 bp, Artificial Sequence
  Description of Artificial Sequence: Synthetic oligonucleotide
  Target: ATXN1; (+) strand; PAM type: NRG; PAM sequence: TGG
ataaagagggctgggtgcag

SEQ ID NO: 130288 - DNA, 20 bp, Artificial Sequence
  Description of Artificial Sequence: Synthetic oligonucleotide
  Target: ATXN1; (+) strand; PAM type: NRG; PAM sequence: CAG
gagggctgggtgcagtggct

SEQ ID NO: 130289 - DNA, 20 bp, Artificial Sequence
  Description of Artificial Sequence: Synthetic oligonucleotide
  Target: ATXN1; (+) strand; PAM type: NRG; PAM sequence: AGG
agggctgggtgcagtggctc

SEQ ID NO: 130290 - DNA, 20 bp, Artificial Sequence
  Description of Artificial Sequence: Synthetic oligonucleotide
  Target: ATXN1; (+) strand; PAM type: NRG; PAM sequence: CAG
gtggctcaggcctattattc

SEQ ID NO: 130291 - DNA, 20 bp, Artificial Sequence
  Description of Artificial Sequence: Synthetic oligonucleotide
  Target: ATXN1; (+) strand; PAM type: NRG; PAM sequence: TGG
ggcctattattccagcactt

SEQ ID NO: 130292 - DNA, 20 bp, Artificial Sequence
  Description of Artificial Sequence: Synthetic oligonucleotide
  Target: ATXN1; (+) strand; PAM type: NRG; PAM sequence: GGG
gcctattattccagcacttt

SEQ ID NO: 130293 - DNA, 20 bp, Artificial Sequence
  Description of Artificial Sequence: Synthetic oligonucleotide
  Target: ATXN1; (+) strand; PAM type: NRG; PAM sequence: GAG
ctattattccagcactttgg

SEQ ID NO: 130294 - DNA, 20 bp, Artificial Sequence
  Description of Artificial Sequence: Synthetic oligonucleotide
  Target: ATXN1; (+) strand; PAM type: NRG; PAM sequence: AGG
tattattccagcactttggg

SEQ ID NO: 130295 - DNA, 20 bp, Artificial Sequence
  Description of Artificial Sequence: Synthetic oligonucleotide
  Target: ATXN1; (+) strand; PAM type: NRG; PAM sequence: GGG
attattccagcactttggga

SEQ ID NO: 130296 - DNA, 20 bp, Artificial Sequence
  Description of Artificial Sequence: Synthetic oligonucleotide
  Target: ATXN1; (+) strand; PAM type: NRG; PAM sequence: GAG
ttccagcactttgggagggc

SEQ ID NO: 130297 - DNA, 20 bp, Artificial Sequence
  Description of Artificial Sequence: Synthetic oligonucleotide
  Target: ATXN1; (+) strand; PAM type: NRG; PAM sequence: AGG
tccagcactttgggagggcg

SEQ ID NO: 130298 - DNA, 20 bp, Artificial Sequence
  Description of Artificial Sequence: Synthetic oligonucleotide
  Target: ATXN1; (+) strand; PAM type: NRG; PAM sequence: TGG
agcactttgggagggcgagg

SEQ ID NO: 130299 - DNA, 20 bp, Artificial Sequence
  Description of Artificial Sequence: Synthetic oligonucleotide
  Target: ATXN1; (+) strand; PAM type: NRG; PAM sequence: GGG
gcactttgggagggcgaggt

SEQ ID NO: 130300 - DNA, 20 bp, Artificial Sequence
  Description of Artificial Sequence: Synthetic oligonucleotide
  Target: ATXN1; (+) strand; PAM type: NRG; PAM sequence: CAG
ctttgggagggcgaggtggg

SEQ ID NO: 130301 - DNA, 20 bp, Artificial Sequence
  Description of Artificial Sequence: Synthetic oligonucleotide
  Target: ATXN1; (+) strand; PAM type: NRG; PAM sequence: GAG
gcgaggtgggcagatcactt

SEQ ID NO: 130302 - DNA, 20 bp, Artificial Sequence
  Description of Artificial Sequence: Synthetic oligonucleotide
  Target: ATXN1; (+) strand; PAM type: NRG; PAM sequence: AGG
cgaggtgggcagatcacttg

SEQ ID NO: 130303 - DNA, 20 bp, Artificial Sequence
  Description of Artificial Sequence: Synthetic oligonucleotide
  Target: ATXN1; (+) strand; PAM type: NRG; PAM sequence: CAG
gtgggcagatcacttgaggt

SEQ ID NO: 130304 - DNA, 20 bp, Artificial Sequence
  Description of Artificial Sequence: Synthetic oligonucleotide
  Target: ATXN1; (+) strand; PAM type: NRG; PAM sequence: AGG
tgggcagatcacttgaggtc

SEQ ID NO: 130305 - DNA, 20 bp, Artificial Sequence
  Description of Artificial Sequence: Synthetic oligonucleotide
  Target: ATXN1; (+) strand; PAM type: NRG; PAM sequence: GAG
ggcagatcacttgaggtcag

SEQ ID NO: 130306 - DNA, 20 bp, Artificial Sequence
  Description of Artificial Sequence: Synthetic oligonucleotide
  Target: ATXN1; (+) strand; PAM type: NRG; PAM sequence: GAG
tcacttgaggtcaggagttc

SEQ ID NO: 130307 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagttcgagac

SEQ ID NO: 130308 - DNA, 20 bp, Artificial Sequence
  Description of Artificial Sequence: Synthetic oligonucleotide
  Target: ATXN1; (+) strand; PAM type: NRG; PAM sequence: TGG
gagaccagcctaaccaaaca

SEQ ID NO: 130309 - DNA, 20 bp, Artificial Sequence
  Description of Artificial Sequence: Synthetic oligonucleotide
  Target: ATXN1; (+) strand; PAM type: NRG; PAM sequence: TAG
tactaaaaatacaaaaaaat

SEQ ID NO: 130310 - DNA, 20 bp, Artificial Sequence
  Description of Artificial Sequence: Synthetic oligonucleotide
  Target: ATXN1; (+) strand; PAM type: NRG; PAM sequence: CAG
aaaaatacaaaaaaattagc

SEQ ID NO: 130311 - DNA, 20 bp, Artificial Sequence
  Description of Artificial Sequence: Synthetic oligonucleotide
  Target: ATXN1; (+) strand; PAM type: NRG; PAM sequence: AGG
aaaatacaaaaaaattagcc

SEQ ID NO: 130312 - DNA, 20 bp, Artificial Sequence
  Description of Artificial Sequence: Synthetic oligonucleotide
  Target: ATXN1; (+) strand; PAM type: NRG; PAM sequence: TGG
acaaaaaaattagccaggtg

SEQ ID NO: 130313 - DNA, 20 bp, Artificial Sequence
  Description of Artificial Sequence: Synthetic oligonucleotide
  Target: ATXN1; (+) strand; PAM type: NRG; PAM sequence: TGG
aaaaaattagccaggtgtgg

SEQ ID NO: 130314 - DNA, 20 bp, Artificial Sequence
  Description of Artificial Sequence: Synthetic oligonucleotide
  Target: ATXN1; (+) strand; PAM type: NRG; PAM sequence: CAG
aaattagccaggtgtggtgg

SEQ ID NO: 130315 - DNA, 20 bp, Artificial Sequence
  Description of Artificial Sequence: Synthetic oligonucleotide
  Target: ATXN1; (+) strand; PAM type: NRG; PAM sequence: TAG
ggtgtggtggcagacacctg

SEQ ID NO: 130316 - DNA, 20 bp, Artificial Sequence
  Description of Artificial Sequence: Synthetic oligonucleotide
  Target: ATXN1; (+) strand; PAM type: NRG; PAM sequence: CAG
gtggcagacacctgtagtcc

SEQ ID NO: 130317 - DNA, 20 bp, Artificial Sequence
  Description of Artificial Sequence: Synthetic oligonucleotide
  Target: ATXN1; (+) strand; PAM type: NRG; PAM sequence: TGG
acacctgtagtcccagttac

SEQ ID NO: 130318 - DNA, 20 bp, Artificial Sequence
  Description of Artificial Sequence: Synthetic oligonucleotide
  Target: ATXN1; (+) strand; PAM type: NRG; PAM sequence: GGG
cacctgtagtcccagttact

SEQ ID NO: 130319 - DNA, 20 bp, Artificial Sequence
  Description of Artificial Sequence: Synthetic oligonucleotide
  Target: ATXN1; (+) strand; PAM type: NRG; PAM sequence: GGG
acctgtagtcccagttactg

SEQ ID NO: 130320 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagttactggg

SEQ ID NO: 130321 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagttactgggg

SEQ ID NO: 130322 - DNA, 20 bp, Artificial Sequence
  Description of Artificial Sequence: Synthetic oligonucleotide
  Target: ATXN1; (+) strand; PAM type: NRG; PAM sequence: AAG
tcccagttactggggaggct

SEQ ID NO: 130323 - DNA, 20 bp, Artificial Sequence
  Description of Artificial Sequence: Synthetic oligonucleotide
  Target: ATXN1; (+) strand; PAM type: NRG; PAM sequence: AGG
cccagttactggggaggcta

SEQ ID NO: 130324 - DNA, 20 bp, Artificial Sequence
  Description of Artificial Sequence: Synthetic oligonucleotide
  Target: ATXN1; (+) strand; PAM type: NRG; PAM sequence: AAG
tactggggaggctaaggcac

SEQ ID NO: 130325 - DNA, 20 bp, Artificial Sequence
  Description of Artificial Sequence: Synthetic oligonucleotide
  Target: ATXN1; (+) strand; PAM type: NRG; PAM sequence: TGG
gcacaagaatcgcttgaacc

SEQ ID NO: 130326 - DNA, 20 bp, Artificial Sequence
  Description of Artificial Sequence: Synthetic oligonucleotide
  Target: ATXN1; (+) strand; PAM type: NRG; PAM sequence: GGG
cacaagaatcgcttgaacct

SEQ ID NO: 130327 - DNA, 20 bp, Artificial Sequence
  Description of Artificial Sequence: Synthetic oligonucleotide
  Target: ATXN1; (+) strand; PAM type: NRG; PAM sequence: GAG
caagaatcgcttgaacctgg

SEQ ID NO: 130328 - DNA, 20 bp, Artificial Sequence
  Description of Artificial Sequence: Synthetic oligonucleotide
  Target: ATXN1; (+) strand; PAM type: NRG; PAM sequence: CAG
aatcgcttgaacctgggagc

SEQ ID NO: 130329 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaacctgggagcca

SEQ ID NO: 130330 - DNA, 20 bp, Artificial Sequence
  Description of Artificial Sequence: Synthetic oligonucleotide
  Target: ATXN1; (+) strand; PAM type: NRG; PAM sequence: AGG
cgcttgaacctgggagccag

SEQ ID NO: 130331 - DNA, 20 bp, Artificial Sequence
  Description of Artificial Sequence: Synthetic oligonucleotide
  Target: ATXN1; (+) strand; PAM type: NRG; PAM sequence: CAG
aacctgggagccagaggttt

SEQ ID NO: 130332 - DNA, 20 bp, Artificial Sequence
  Description of Artificial Sequence: Synthetic oligonucleotide
  Target: ATXN1; (+) strand; PAM type: NRG; PAM sequence: GAG
tgggagccagaggtttcagt

SEQ ID NO: 130333 - DNA, 20 bp, Artificial Sequence
  Description of Artificial Sequence: Synthetic oligonucleotide
  Target: ATXN1; (+) strand; PAM type: NRG; PAM sequence: AAG
gccagaggtttcagtgagcc

SEQ ID NO: 130334 - DNA, 20 bp, Artificial Sequence
  Description of Artificial Sequence: Synthetic oligonucleotide
  Target: ATXN1; (+) strand; PAM type: NRG; PAM sequence: TAG
aagattgtgccactgcactt

SEQ ID NO: 130335 - DNA, 20 bp, Artificial Sequence
  Description of Artificial Sequence: Synthetic oligonucleotide
  Target: ATXN1; (+) strand; PAM type: NRG; PAM sequence: TGG
tgtgccactgcactttagcc

SEQ ID NO: 130336 - DNA, 20 bp, Artificial Sequence
  Description of Artificial Sequence: Synthetic oligonucleotide
  Target: ATXN1; (+) strand; PAM type: NRG; PAM sequence: GGG
gtgccactgcactttagcct

SEQ ID NO: 130337 - DNA, 20 bp, Artificial Sequence
  Description of Artificial Sequence: Synthetic oligonucleotide
  Target: ATXN1; (+) strand; PAM type: NRG; PAM sequence: CAG
ctgcactttagcctgggaaa

SEQ ID NO: 130338 - DNA, 20 bp, Artificial Sequence
  Description of Artificial Sequence: Synthetic oligonucleotide
  Target: ATXN1; (+) strand; PAM type: NRG; PAM sequence: GAG
gcactttagcctgggaaaca

SEQ ID NO: 130339 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaacaaatctacata

SEQ ID NO: 130340 - DNA, 20 bp, Artificial Sequence
  Description of Artificial Sequence: Synthetic oligonucleotide
  Target: ATXN1; (+) strand; PAM type: NRG; PAM sequence: AAG
aaaaacaaatctacataaag

SEQ ID NO: 130341 - DNA, 20 bp, Artificial Sequence
  Description of Artificial Sequence: Synthetic oligonucleotide
  Target: ATXN1; (+) strand; PAM type: NRG; PAM sequence: GAG
gaagaatgttaaatactact

SEQ ID NO: 130342 - DNA, 20 bp, Artificial Sequence
  Description of Artificial Sequence: Synthetic oligonucleotide
  Target: ATXN1; (+) strand; PAM type: NRG; PAM sequence: AGG
aagaatgttaaatactactg

SEQ ID NO: 130343 - DNA, 20 bp, Artificial Sequence
  Description of Artificial Sequence: Synthetic oligonucleotide
  Target: ATXN1; (+) strand; PAM type: NRG; PAM sequence: GGG
agaatgttaaatactactga

SEQ ID NO: 130344 - DNA, 20 bp, Artificial Sequence
  Description of Artificial Sequence: Synthetic oligonucleotide
  Target: ATXN1; (+) strand; PAM type: NRG; PAM sequence: CAG
tgttaaatactactgaggga

SEQ ID NO: 130345 - DNA, 20 bp, Artificial Sequence
  Description of Artificial Sequence: Synthetic oligonucleotide
  Target: ATXN1; (+) strand; PAM type: NRG; PAM sequence: GAG
ttaaatactactgagggaca

SEQ ID NO: 130346 - DNA, 20 bp, Artificial Sequence
  Description of Artificial Sequence: Synthetic oligonucleotide
  Target: ATXN1; (+) strand; PAM type: NRG; PAM sequence: AGG
taaatactactgagggacag

SEQ ID NO: 130347 - DNA, 20 bp, Artificial Sequence
  Description of Artificial Sequence: Synthetic oligonucleotide
  Target: ATXN1; (+) strand; PAM type: NRG; PAM sequence: GAG
aatactactgagggacagag

SEQ ID NO: 130348 - DNA, 20 bp, Artificial Sequence
  Description of Artificial Sequence: Synthetic oligonucleotide
  Target: ATXN1; (+) strand; PAM type: NRG; PAM sequence: AGG
atactactgagggacagagg

SEQ ID NO: 130349 - DNA, 20 bp, Artificial Sequence
  Description of Artificial Sequence: Synthetic oligonucleotide
  Target: ATXN1; (+) strand; PAM type: NRG; PAM sequence: GAG
actactgagggacagaggag

SEQ ID NO: 130350 - DNA, 20 bp, Artificial Sequence
  Description of Artificial Sequence: Synthetic oligonucleotide
  Target: ATXN1; (+) strand; PAM type: NRG; PAM sequence: TAG
ctgagggacagaggaggaga

SEQ ID NO: 130351 - DNA, 20 bp, Artificial Sequence
  Description of Artificial Sequence: Synthetic oligonucleotide
  Target: ATXN1; (+) strand; PAM type: NRG; PAM sequence: AGG
tgagggacagaggaggagat

SEQ ID NO: 130352 - DNA, 20 bp, Artificial Sequence
  Description of Artificial Sequence: Synthetic oligonucleotide
  Target: ATXN1; (+) strand; PAM type: NRG; PAM sequence: AAG
aggagataggaacaactgca

SEQ ID NO: 130353 - DNA, 20 bp, Artificial Sequence
  Description of Artificial Sequence: Synthetic oligonucleotide
  Target: ATXN1; (+) strand; PAM type: NRG; PAM sequence: AGG
ggagataggaacaactgcaa

SEQ ID NO: 130354 - DNA, 20 bp, Artificial Sequence
  Description of Artificial Sequence: Synthetic oligonucleotide
  Target: ATXN1; (+) strand; PAM type: NRG; PAM sequence: TAG
aggtctatcttcttcttgaa

SEQ ID NO: 130355 - DNA, 20 bp, Artificial Sequence
  Description of Artificial Sequence: Synthetic oligonucleotide
  Target: ATXN1; (+) strand; PAM type: NRG; PAM sequence: AAG
ctatcttcttcttgaataga

SEQ ID NO: 130356 - DNA, 20 bp, Artificial Sequence
  Description of Artificial Sequence: Synthetic oligonucleotide
  Target: ATXN1; (+) strand; PAM type: NRG; PAM sequence: AAG
ttgaatagaaagtcaatatc

SEQ ID NO: 130357 - DNA, 20 bp, Artificial Sequence
  Description of Artificial Sequence: Synthetic oligonucleotide
  Target: ATXN1; (+) strand; PAM type: NRG; PAM sequence: GAG
gaatagaaagtcaatatcaa

SEQ ID NO: 130358 - DNA, 20 bp, Artificial Sequence
  Description of Artificial Sequence: Synthetic oligonucleotide
  Target: ATXN1; (+) strand; PAM type: NRG; PAM sequence: TAG
atgatgtcaaaaatacaaat

SEQ ID NO: 130359 - DNA, 20 bp, Artificial Sequence
  Description of Artificial Sequence: Synthetic oligonucleotide
  Target: ATXN1; (+) strand; PAM type: NRG; PAM sequence: AAG
tgtcaaaaatacaaattaga

SEQ ID NO: 130360 - DNA, 20 bp, Artificial Sequence
  Description of Artificial Sequence: Synthetic oligonucleotide
  Target: ATXN1; (+) strand; PAM type: NRG; PAM sequence: AAG
aaattagaaagctaattctg

SEQ ID NO: 130361 - DNA, 20 bp, Artificial Sequence
  Description of Artificial Sequence: Synthetic oligonucleotide
  Target: ATXN1; (+) strand; PAM type: NRG; PAM sequence: TGG
agctaattctgaagttccta

SEQ ID NO: 130362 - DNA, 20 bp, Artificial Sequence
  Description of Artificial Sequence: Synthetic oligonucleotide
  Target: ATXN1; (+) strand; PAM type: NRG; PAM sequence: CAG
agttcctatggaaaaataaa

SEQ ID NO: 130363 - DNA, 20 bp, Artificial Sequence
  Description of Artificial Sequence: Synthetic oligonucleotide
  Target: ATXN1; (+) strand; PAM type: NRG; PAM sequence: AGG
gttcctatggaaaaataaac

SEQ ID NO: 130364 - DNA, 20 bp, Artificial Sequence
  Description of Artificial Sequence: Synthetic oligonucleotide
  Target: ATXN1; (+) strand; PAM type: NRG; PAM sequence: AAG
ctatggaaaaataaacagga

SEQ ID NO: 130365 - DNA, 20 bp, Artificial Sequence
  Description of Artificial Sequence: Synthetic oligonucleotide
  Target: ATXN1; (+) strand; PAM type: NRG; PAM sequence: TGG
gaaaaataaacaggaaagaa

SEQ ID NO: 130366 - DNA, 20 bp, Artificial Sequence
  Description of Artificial Sequence: Synthetic oligonucleotide
  Target: ATXN1; (+) strand; PAM type: NRG; PAM sequence: AAG
ggccataacaatgatataaa

SEQ ID NO: 130367 - DNA, 20 bp, Artificial Sequence
  Description of Artificial Sequence: Synthetic oligonucleotide
  Target: ATXN1; (+) strand; PAM type: NRG; PAM sequence: AAG
acaatgatataaaaagaaat

SEQ ID NO: 130368 - DNA, 20 bp, Artificial Sequence
  Description of Artificial Sequence: Synthetic oligonucleotide
  Target: ATXN1; (+) strand; PAM type: NRG; PAM sequence: AAG
gatataaaaagaaataagaa

SEQ ID NO: 130369 - DNA, 20 bp, Artificial Sequence
  Description of Artificial Sequence: Synthetic oligonucleotide
  Target: ATXN1; (+) strand; PAM type: NRG; PAM sequence: AAG
ccgatattaaaaatattata

SEQ ID NO: 130370 - DNA, 20 bp, Artificial Sequence
  Description of Artificial Sequence: Synthetic oligonucleotide
  Target: ATXN1; (+) strand; PAM type: NRG; PAM sequence: TAG
ttaaaaatattataaagcct

SEQ ID NO: 130371 - DNA, 20 bp, Artificial Sequence
  Description of Artificial Sequence: Synthetic oligonucleotide
  Target: ATXN1; (+) strand; PAM type: NRG; PAM sequence: AAG
aaatattataaagccttaga

SEQ ID NO: 130372 - DNA, 20 bp, Artificial Sequence
  Description of Artificial Sequence: Synthetic oligonucleotide
  Target: ATXN1; (+) strand; PAM type: NRG; PAM sequence: CAG
taaagccttagaaagtaaaa

SEQ ID NO: 130373 - DNA, 20 bp, Artificial Sequence
  Description of Artificial Sequence: Synthetic oligonucleotide
  Target: ATXN1; (+) strand; PAM type: NRG; PAM sequence: TGG
agaaagtaaaacagtgtgca

SEQ ID NO: 130374 - DNA, 20 bp, Artificial Sequence
  Description of Artificial Sequence: Synthetic oligonucleotide
  Target: ATXN1; (+) strand; PAM type: NRG; PAM sequence: GGG
gaaagtaaaacagtgtgcat

SEQ ID NO: 130375 - DNA, 20 bp, Artificial Sequence
  Description of Artificial Sequence: Synthetic oligonucleotide
  Target: ATXN1; (+) strand; PAM type: NRG; PAM sequence: CAG
taaaacagtgtgcatgggca

SEQ ID NO: 130376 - DNA, 20 bp, Artificial Sequence
  Description of Artificial Sequence: Synthetic oligonucleotide
  Target: ATXN1; (+) strand; PAM type: NRG; PAM sequence: AGG
aaaacagtgtgcatgggcac

SEQ ID NO: 130377 - DNA, 20 bp, Artificial Sequence
  Description of Artificial Sequence: Synthetic oligonucleotide
  Target: ATXN1; (+) strand; PAM type: NRG; PAM sequence: TAG
tgcatgggcacaggaatact

SEQ ID NO: 130378 - DNA, 20 bp, Artificial Sequence
  Description of Artificial Sequence: Synthetic oligonucleotide
  Target: ATXN1; (+) strand; PAM type: NRG; PAM sequence: AAG
tgggcacaggaatacttagc

SEQ ID NO: 130379 - DNA, 20 bp, Artificial Sequence
  Description of Artificial Sequence: Synthetic oligonucleotide
  Target: ATXN1; (+) strand; PAM type: NRG; PAM sequence: AGG
gggcacaggaatacttagca

SEQ ID NO: 130380 - DNA, 20 bp, Artificial Sequence
  Description of Artificial Sequence: Synthetic oligonucleotide
  Target: ATXN1; (+) strand; PAM type: NRG; PAM sequence: CAG
ggaatacttagcaaggtcaa

SEQ ID NO: 130381 - DNA, 20 bp, Artificial Sequence
  Description of Artificial Sequence: Synthetic oligonucleotide
  Target: ATXN1; (+) strand; PAM type: NRG; PAM sequence: AAG
acttagcaaggtcaacagaa

SEQ ID NO: 130382 - DNA, 20 bp, Artificial Sequence
  Description of Artificial Sequence: Synthetic oligonucleotide
  Target: ATXN1; (+) strand; PAM type: NRG; PAM sequence: GAG
ttagcaaggtcaacagaaaa

SEQ ID NO: 130383 - DNA, 20 bp, Artificial Sequence
  Description of Artificial Sequence: Synthetic oligonucleotide
  Target: ATXN1; (+) strand; PAM type: NRG; PAM sequence: AGG
tagcaaggtcaacagaaaag

SEQ ID NO: 130384 - DNA, 20 bp, Artificial Sequence
  Description of Artificial Sequence: Synthetic oligonucleotide
  Target: ATXN1; (+) strand; PAM type: NRG; PAM sequence: TGG
aggtcgatccaaatgaatac

SEQ ID NO: 130385 - DNA, 20 bp, Artificial Sequence
  Description of Artificial Sequence: Synthetic oligonucleotide
  Target: ATXN1; (+) strand; PAM type: NRG; PAM sequence: CAG
tccaaatgaatactggactt

SEQ ID NO: 130386 - DNA, 20 bp, Artificial Sequence
  Description of Artificial Sequence: Synthetic oligonucleotide
  Target: ATXN1; (+) strand; PAM type: NRG; PAM sequence: TGG
ctggacttcagtgaatgata

SEQ ID NO: 130387 - DNA, 20 bp, Artificial Sequence
  Description of Artificial Sequence: Synthetic oligonucleotide
  Target: ATXN1; (+) strand; PAM type: NRG; PAM sequence: GGG
tggacttcagtgaatgatat

SEQ ID NO: 130388 - DNA, 20 bp, Artificial Sequence
  Description of Artificial Sequence: Synthetic oligonucleotide
  Target: ATXN1; (+) strand; PAM type: NRG; PAM sequence: TAG
atatgggtgtcactgcactt

SEQ ID NO: 130389 - DNA, 20 bp, Artificial Sequence
  Description of Artificial Sequence: Synthetic oligonucleotide
  Target: ATXN1; (+) strand; PAM type: NRG; PAM sequence: TGG
tgggtgtcactgcactttag

SEQ ID NO: 130390 - DNA, 20 bp, Artificial Sequence
  Description of Artificial Sequence: Synthetic oligonucleotide
  Target: ATXN1; (+) strand; PAM type: NRG; PAM sequence: GGG
gggtgtcactgcactttagt

SEQ ID NO: 130391 - DNA, 20 bp, Artificial Sequence
  Description of Artificial Sequence: Synthetic oligonucleotide
  Target: ATXN1; (+) strand; PAM type: NRG; PAM sequence: GAG
gtgtcactgcactttagtgg

SEQ ID NO: 130392 - DNA, 20 bp, Artificial Sequence
  Description of Artificial Sequence: Synthetic oligonucleotide
  Target: ATXN1; (+) strand; PAM type: NRG; PAM sequence: AGG
tgtcactgcactttagtggg

SEQ ID NO: 130393 - DNA, 20 bp, Artificial Sequence
  Description of Artificial Sequence: Synthetic oligonucleotide
  Target: ATXN1; (+) strand; PAM type: NRG; PAM sequence: AAG
cactgcactttagtgggagg

SEQ ID NO: 130394 - DNA, 20 bp, Artificial Sequence
  Description of Artificial Sequence: Synthetic oligonucleotide
  Target: ATXN1; (+) strand; PAM type: NRG; PAM sequence: AGG
actgcactttagtgggagga

SEQ ID NO: 130395 - DNA, 20 bp, Artificial Sequence
  Description of Artificial Sequence: Synthetic oligonucleotide
  Target: ATXN1; (+) strand; PAM type: NRG; PAM sequence: TGG
gaggaaggacttccaataat

SEQ ID NO: 130396 - DNA, 20 bp, Artificial Sequence
  Description of Artificial Sequence: Synthetic oligonucleotide
  Target: ATXN1; (+) strand; PAM type: NRG; PAM sequence: CGG
aaggacttccaataattgga

SEQ ID NO: 130397 - DNA, 20 bp, Artificial Sequence
  Description of Artificial Sequence: Synthetic oligonucleotide
  Target: ATXN1; (+) strand; PAM type: NRG; PAM sequence: TAG
gacggccacctaaaaaaata

SEQ ID NO: 130398 - DNA, 20 bp, Artificial Sequence
  Description of Artificial Sequence: Synthetic oligonucleotide
  Target: ATXN1; (+) strand; PAM type: NRG; PAM sequence: AAG
cctgcactaaaataaatccc

SEQ ID NO: 130399 - DNA, 20 bp, Artificial Sequence
  Description of Artificial Sequence: Synthetic oligonucleotide
  Target: ATXN1; (+) strand; PAM type: NRG; PAM sequence: AGG
ctgcactaaaataaatccca

SEQ ID NO: 130400 - DNA, 20 bp, Artificial Sequence
  Description of Artificial Sequence: Synthetic oligonucleotide
  Target: ATXN1; (+) strand; PAM type: NRG; PAM sequence: AAG
aataaatcccaaggtgacca

SEQ ID NO: 130401 - DNA, 20 bp, Artificial Sequence
  Description of Artificial Sequence: Synthetic oligonucleotide
  Target: ATXN1; (+) strand; PAM type: NRG; PAM sequence: AAG
gatttgaacgtaaaaaatga

SEQ ID NO: 130402 - DNA, 20 bp, Artificial Sequence
  Description of Artificial Sequence: Synthetic oligonucleotide
  Target: ATXN1; (+) strand; PAM type: NRG; PAM sequence: GAG
aaatgaaagcataaaaatat

SEQ ID NO: 130403 - DNA, 20 bp, Artificial Sequence
  Description of Artificial Sequence: Synthetic oligonucleotide
  Target: ATXN1; (+) strand; PAM type: NRG; PAM sequence: AAG
gaaagcataaaaatatgaga

SEQ ID NO: 130404 - DNA, 20 bp, Artificial Sequence
  Description of Artificial Sequence: Synthetic oligonucleotide
  Target: ATXN1; (+) strand; PAM type: NRG; PAM sequence: AAG
aaccttgaaaacattacgct

SEQ ID NO: 130405 - DNA, 20 bp, Artificial Sequence
  Description of Artificial Sequence: Synthetic oligonucleotide
  Target: ATXN1; (+) strand; PAM type: NRG; PAM sequence: TGG
cttgaaaacattacgctaag

SEQ ID NO: 130406 - DNA, 20 bp, Artificial Sequence
  Description of Artificial Sequence: Synthetic oligonucleotide
  Target: ATXN1; (+) strand; PAM type: NRG; PAM sequence: AAG
aaacattacgctaagtggaa

SEQ ID NO: 130407 - DNA, 20 bp, Artificial Sequence
  Description of Artificial Sequence: Synthetic oligonucleotide
  Target: ATXN1; (+) strand; PAM type: NRG; PAM sequence: CAG
attacgctaagtggaaaagt

SEQ ID NO: 130408 - DNA, 20 bp, Artificial Sequence
  Description of Artificial Sequence: Synthetic oligonucleotide
  Target: ATXN1; (+) strand; PAM type: NRG; PAM sequence: AAG
agtggaaaagtcagttgtgt

SEQ ID NO: 130409 - DNA, 20 bp, Artificial Sequence
  Description of Artificial Sequence: Synthetic oligonucleotide
  Target: ATXN1; (+) strand; PAM type: NRG; PAM sequence: AGG
gtggaaaagtcagttgtgta

SEQ ID NO: 130410 - DNA, 20 bp, Artificial Sequence
  Description of Artificial Sequence: Synthetic oligonucleotide
  Target: ATXN1; (+) strand; PAM type: NRG; PAM sequence: TGG
gtgtaaggccacacattata

SEQ ID NO: 130411 - DNA, 20 bp, Artificial Sequence
  Description of Artificial Sequence: Synthetic oligonucleotide
  Target: ATXN1; (+) strand; PAM type: NRG; PAM sequence: GAG
ttatatggttccatttatat

SEQ ID NO: 130412 - DNA, 20 bp, Artificial Sequence
  Description of Artificial Sequence: Synthetic oligonucleotide
  Target: ATXN1; (+) strand; PAM type: NRG; PAM sequence: TAG
ttccatttatatgagatgtc

SEQ ID NO: 130413 - DNA, 20 bp, Artificial Sequence
  Description of Artificial Sequence: Synthetic oligonucleotide
  Target: ATXN1; (+) strand; PAM type: NRG; PAM sequence: AGG
tccatttatatgagatgtct

SEQ ID NO: 130414 - DNA, 20 bp, Artificial Sequence
  Description of Artificial Sequence: Synthetic oligonucleotide
  Target: ATXN1; (+) strand; PAM type: NRG; PAM sequence: CAG
tttatatgagatgtctagga

SEQ ID NO: 130415 - DNA, 20 bp, Artificial Sequence
  Description of Artificial Sequence: Synthetic oligonucleotide
  Target: ATXN1; (+) strand; PAM type: NRG; PAM sequence: AGG
ttatatgagatgtctaggac

SEQ ID NO: 130416 - DNA, 20 bp, Artificial Sequence
  Description of Artificial Sequence: Synthetic oligonucleotide
  Target: ATXN1; (+) strand; PAM type: NRG; PAM sequence: TAG
gtctaggacaggcaaatcca

SEQ ID NO: 130417 - DNA, 20 bp, Artificial Sequence
  Description of Artificial Sequence: Synthetic oligonucleotide
  Target: ATXN1; (+) strand; PAM type: NRG; PAM sequence: GAG
ctaggacaggcaaatccata

SEQ ID NO: 130418 - DNA, 20 bp, Artificial Sequence
  Description of Artificial Sequence: Synthetic oligonucleotide
  Target: ATXN1; (+) strand; PAM type: NRG; PAM sequence: TAG
aaatccatagagataaaaca

SEQ ID NO: 130419 - DNA, 20 bp, Artificial Sequence
  Description of Artificial Sequence: Synthetic oligonucleotide
  Target: ATXN1; (+) strand; PAM type: NRG; PAM sequence: AAG
atagagataaaacatagatt

SEQ ID NO: 130420 - DNA, 20 bp, Artificial Sequence
  Description of Artificial Sequence: Synthetic oligonucleotide
  Target: ATXN1; (+) strand; PAM type: NRG; PAM sequence: TGG
gagataaaacatagattaag

SEQ ID NO: 130421 - DNA, 20 bp, Artificial Sequence
  Description of Artificial Sequence: Synthetic oligonucleotide
  Target: ATXN1; (+) strand; PAM type: NRG; PAM sequence: CAG
aacatagattaagtggatac

SEQ ID NO: 130422 - DNA, 20 bp, Artificial Sequence
  Description of Artificial Sequence: Synthetic oligonucleotide
  Target: ATXN1; (+) strand; PAM type: NRG; PAM sequence: AGG
acatagattaagtggatacc

SEQ ID NO: 130423 - DNA, 20 bp, Artificial Sequence
  Description of Artificial Sequence: Synthetic oligonucleotide
  Target: ATXN1; (+) strand; PAM type: NRG; PAM sequence: GGG
catagattaagtggatacca

SEQ ID NO: 130424 - DNA, 20 bp, Artificial Sequence
  Description of Artificial Sequence: Synthetic oligonucleotide
  Target: ATXN1; (+) strand; PAM type: NRG; PAM sequence: GGG
atagattaagtggataccag

SEQ ID NO: 130425 - DNA, 20 bp, Artificial Sequence
  Description of Artificial Sequence: Synthetic oligonucleotide
  Target: ATXN1; (+) strand; PAM type: NRG; PAM sequence: CAG
attaagtggataccaggggc

SEQ ID NO: 130426 - DNA, 20 bp, Artificial Sequence
  Description of Artificial Sequence: Synthetic oligonucleotide
  Target: ATXN1; (+) strand; PAM type: NRG; PAM sequence: AAG
aagtggataccaggggccag

SEQ ID NO: 130427 - DNA, 20 bp, Artificial Sequence
  Description of Artificial Sequence: Synthetic oligonucleotide
  Target: ATXN1; (+) strand; PAM type: NRG; PAM sequence: AGG
agtggataccaggggccaga

SEQ ID NO: 130428 - DNA, 20 bp, Artificial Sequence
  Description of Artificial Sequence: Synthetic oligonucleotide
  Target: ATXN1; (+) strand; PAM type: NRG; PAM sequence: TAG
ggataccaggggccagaagg

SEQ ID NO: 130429 - DNA, 20 bp, Artificial Sequence
  Description of Artificial Sequence: Synthetic oligonucleotide
  Target: ATXN1; (+) strand; PAM type: NRG; PAM sequence: GAG
ataccaggggccagaaggta

SEQ ID NO: 130430 - DNA, 20 bp, Artificial Sequence
  Description of Artificial Sequence: Synthetic oligonucleotide
  Target: ATXN1; (+) strand; PAM type: NRG; PAM sequence: AGG
taccaggggccagaaggtag

SEQ ID NO: 130431 - DNA, 20 bp, Artificial Sequence
  Description of Artificial Sequence: Synthetic oligonucleotide
  Target: ATXN1; (+) strand; PAM type: NRG; PAM sequence: TGG
gggccagaaggtagaggaaa

SEQ ID NO: 130432 - DNA, 20 bp, Artificial Sequence
  Description of Artificial Sequence: Synthetic oligonucleotide
  Target: ATXN1; (+) strand; PAM type: NRG; PAM sequence: GGG
ggccagaaggtagaggaaat

SEQ ID NO: 130433 - DNA, 20 bp, Artificial Sequence
  Description of Artificial Sequence: Synthetic oligonucleotide
  Target: ATXN1; (+) strand; PAM type: NRG; PAM sequence: GGG
gccagaaggtagaggaaatg

SEQ ID NO: 130434 - DNA, 20 bp, Artificial Sequence
  Description of Artificial Sequence: Synthetic oligonucleotide
  Target: ATXN1; (+) strand; PAM type: NRG; PAM sequence: GGG
ccagaaggtagaggaaatgg

SEQ ID NO: 130435 - DNA, 20 bp, Artificial Sequence
  Description of Artificial Sequence: Synthetic oligonucleotide
  Target: ATXN1; (+) strand; PAM type: NRG; PAM sequence: GAG
agaaggtagaggaaatgggg

SEQ ID NO: 130436 - DNA, 20 bp, Artificial Sequence
  Description of Artificial Sequence: Synthetic oligonucleotide
  Target: ATXN1; (+) strand; PAM type: NRG; PAM sequence: TGG
aggtagaggaaatgggggag

SEQ ID NO: 130437 - DNA, 20 bp, Artificial Sequence
  Description of Artificial Sequence: Synthetic oligonucleotide
  Target: ATXN1; (+) strand; PAM type: NRG; PAM sequence: GGG
ggtagaggaaatgggggagt

SEQ ID NO: 130438 - DNA, 20 bp, Artificial Sequence
  Description of Artificial Sequence: Synthetic oligonucleotide
  Target: ATXN1; (+) strand; PAM type: NRG; PAM sequence: TGG
atgggggagtgggtgcttaa

SEQ ID NO: 130439 - DNA, 20 bp, Artificial Sequence
  Description of Artificial Sequence: Synthetic oligonucleotide
  Target: ATXN1; (+) strand; PAM type: NRG; PAM sequence: GGG
tgggggagtgggtgcttaat

SEQ ID NO: 130440 - DNA, 20 bp, Artificial Sequence
  Description of Artificial Sequence: Synthetic oligonucleotide
  Target: ATXN1; (+) strand; PAM type: NRG; PAM sequence: AAG
gagtgggtgcttaatgggta

SEQ ID NO: 130441 - DNA, 20 bp, Artificial Sequence
  Description of Artificial Sequence: Synthetic oligonucleotide
  Target: ATXN1; (+) strand; PAM type: NRG; PAM sequence: AGG
agtgggtgcttaatgggtaa

SEQ ID NO: 130442 - DNA, 20 bp, Artificial Sequence
  Description of Artificial Sequence: Synthetic oligonucleotide
  Target: ATXN1; (+) strand; PAM type: NRG; PAM sequence: TGG
atgggtaaaggttttctttt

SEQ ID NO: 130443 - DNA, 20 bp, Artificial Sequence
  Description of Artificial Sequence: Synthetic oligonucleotide
  Target: ATXN1; (+) strand; PAM type: NRG; PAM sequence: GAG
gggtaaaggttttctttttg

SEQ ID NO: 130444 - DNA, 20 bp, Artificial Sequence
  Description of Artificial Sequence: Synthetic oligonucleotide
  Target: ATXN1; (+) strand; PAM type: NRG; PAM sequence: TAG
gagtaatgaaaatgtaaaat

SEQ ID NO: 130445 - DNA, 20 bp, Artificial Sequence
  Description of Artificial Sequence: Synthetic oligonucleotide
  Target: ATXN1; (+) strand; PAM type: NRG; PAM sequence: AGG
agtaatgaaaatgtaaaatt

SEQ ID NO: 130446 - DNA, 20 bp, Artificial Sequence
  Description of Artificial Sequence: Synthetic oligonucleotide
  Target: ATXN1; (+) strand; PAM type: NRG; PAM sequence: TAG
tgattgtataattctatgaa

SEQ ID NO: 130447 - DNA, 20 bp, Artificial Sequence
  Description of Artificial Sequence: Synthetic oligonucleotide
  Target: ATXN1; (+) strand; PAM type: NRG; PAM sequence: AAG
attaaaaacccatttattaa

SEQ ID NO: 130448 - DNA, 20 bp, Artificial Sequence
  Description of Artificial Sequence: Synthetic oligonucleotide
  Target: ATXN1; (+) strand; PAM type: NRG; PAM sequence: TGG
tttattaaaagactgcattg

SEQ ID NO: 130449 - DNA, 20 bp, Artificial Sequence
  Description of Artificial Sequence: Synthetic oligonucleotide
  Target: ATXN1; (+) strand; PAM type: NRG; PAM sequence: TGG
ttaaaagactgcattgtggc

SEQ ID NO: 130450 - DNA, 20 bp, Artificial Sequence
  Description of Artificial Sequence: Synthetic oligonucleotide
  Target: ATXN1; (+) strand; PAM type: NRG; PAM sequence: GGG
taaaagactgcattgtggct

SEQ ID NO: 130451 - DNA, 20 bp, Artificial Sequence
  Description of Artificial Sequence: Synthetic oligonucleotide
  Target: ATXN1; (+) strand; PAM type: NRG; PAM sequence: CAG
gactgcattgtggctgggca

SEQ ID NO: 130452 - DNA, 20 bp, Artificial Sequence
  Description of Artificial Sequence: Synthetic oligonucleotide
  Target: ATXN1; (+) strand; PAM type: NRG; PAM sequence: TGG
tgcattgtggctgggcacag

SEQ ID NO: 130453 - DNA, 20 bp, Artificial Sequence
  Description of Artificial Sequence: Synthetic oligonucleotide
  Target: ATXN1; (+) strand; PAM type: NRG; PAM sequence: TAG
gtggctcacacctgtaatcc

SEQ ID NO: 130454 - DNA, 20 bp, Artificial Sequence
  Description of Artificial Sequence: Synthetic oligonucleotide
  Target: ATXN1; (+) strand; PAM type: NRG; PAM sequence: TAG
cacctgtaatcctagcactt

SEQ ID NO: 130455 - DNA, 20 bp, Artificial Sequence
  Description of Artificial Sequence: Synthetic oligonucleotide
  Target: ATXN1; (+) strand; PAM type: NRG; PAM sequence: AAG
ctgtaatcctagcactttag

SEQ ID NO: 130456 - DNA, 20 bp, Artificial Sequence
  Description of Artificial Sequence: Synthetic oligonucleotide
  Target: ATXN1; (+) strand; PAM type: NRG; PAM sequence: AGG
tgtaatcctagcactttaga

SEQ ID NO: 130457 - DNA, 20 bp, Artificial Sequence
  Description of Artificial Sequence: Synthetic oligonucleotide
  Target: ATXN1; (+) strand; PAM type: NRG; PAM sequence: AAG
tcctagcactttagaaggct

SEQ ID NO: 130458 - DNA, 20 bp, Artificial Sequence
  Description of Artificial Sequence: Synthetic oligonucleotide
  Target: ATXN1; (+) strand; PAM type: NRG; PAM sequence: AGG
cctagcactttagaaggcta

SEQ ID NO: 130459 - DNA, 20 bp, Artificial Sequence
  Description of Artificial Sequence: Synthetic oligonucleotide
  Target: ATXN1; (+) strand; PAM type: NRG; PAM sequence: CAG
agcactttagaaggctaagg

SEQ ID NO: 130460 - DNA, 20 bp, Artificial Sequence
  Description of Artificial Sequence: Synthetic oligonucleotide
  Target: ATXN1; (+) strand; PAM type: NRG; PAM sequence: AGG
gcactttagaaggctaaggc

SEQ ID NO: 130461 - DNA, 20 bp, Artificial Sequence
  Description of Artificial Sequence: Synthetic oligonucleotide
  Target: ATXN1; (+) strand; PAM type: NRG; PAM sequence: GAG
actttagaaggctaaggcag

SEQ ID NO: 130462 - DNA, 20 bp, Artificial Sequence
  Description of Artificial Sequence: Synthetic oligonucleotide
  Target: ATXN1; (+) strand; PAM type: NRG; PAM sequence: AGG
ctttagaaggctaaggcagg

SEQ ID NO: 130463 - DNA, 20 bp, Artificial Sequence
  Description of Artificial Sequence: Synthetic oligonucleotide
  Target: ATXN1; (+) strand; PAM type: NRG; PAM sequence: GAG
gctaaggcaggaggctgctt

SEQ ID NO: 130464 - DNA, 20 bp, Artificial Sequence
  Description of Artificial Sequence: Synthetic oligonucleotide
  Target: ATXN1; (+) strand; PAM type: NRG; PAM sequence: CAG
ggcaggaggctgcttgagcc

SEQ ID NO: 130465 - DNA, 20 bp, Artificial Sequence
  Description of Artificial Sequence: Synthetic oligonucleotide
  Target: ATXN1; (+) strand; PAM type: NRG; PAM sequence: AGG
gcaggaggctgcttgagccc

SEQ ID NO: 130466 - DNA, 20 bp, Artificial Sequence
  Description of Artificial Sequence: Synthetic oligonucleotide
  Target: ATXN1; (+) strand; PAM type: NRG; PAM sequence: GAG
aggaggctgcttgagcccag

SEQ ID NO: 130467 - DNA, 20 bp, Artificial Sequence
  Description of Artificial Sequence: Synthetic oligonucleotide
  Target: ATXN1; (+) strand; PAM type: NRG; PAM sequence: CAG
ctgcttgagcccaggagttc

SEQ ID NO: 130468 - DNA, 20 bp, Artificial Sequence
  Description of Artificial Sequence: Synthetic oligonucleotide
  Target: ATXN1; (+) strand; PAM type: NRG; PAM sequence: AGG
tgcttgagcccaggagttcc

SEQ ID NO: 130469 - DNA, 20 bp, Artificial Sequence
  Description of Artificial Sequence: Synthetic oligonucleotide
  Target: ATXN1; (+) strand; PAM type: NRG; PAM sequence: CAG
agcccaggagttccaggttg

SEQ ID NO: 130470 - DNA, 20 bp, Artificial Sequence
  Description of Artificial Sequence: Synthetic oligonucleotide
  Target: ATXN1; (+) strand; PAM type: NRG; PAM sequence: AAG
caggagttccaggttgcagt

SEQ ID NO: 130471 - DNA, 20 bp, Artificial Sequence
  Description of Artificial Sequence: Synthetic oligonucleotide
  Target: ATXN1; (+) strand; PAM type: NRG; PAM sequence: CAG
gtgactgcaccactgcactc

SEQ ID NO: 130472 - DNA, 20 bp, Artificial Sequence
  Description of Artificial Sequence: Synthetic oligonucleotide
  Target: ATXN1; (+) strand; PAM type: NRG; PAM sequence: TGG
tgcaccactgcactccagcc

SEQ ID NO: 130473 - DNA, 20 bp, Artificial Sequence
  Description of Artificial Sequence: Synthetic oligonucleotide
  Target: ATXN1; (+) strand; PAM type: NRG; PAM sequence: GGG
gcaccactgcactccagcct

SEQ ID NO: 130474 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggtga

SEQ ID NO: 130475 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggtgaca

SEQ ID NO: 130476 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggtgacagagc

SEQ ID NO: 130477 - DNA, 20 bp, Artificial Sequence
  Description of Artificial Sequence: Synthetic oligonucleotide
  Target: ATXN1; (+) strand; PAM type: NRG; PAM sequence: AAG
tgtcaaaaaaaaaaaaaaaa

SEQ ID NO: 130478 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaagaaaaaaaa

SEQ ID NO: 130479 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaaagaaaaaaaaa

SEQ ID NO: 130480 - DNA, 20 bp, Artificial Sequence
  Description of Artificial Sequence: Synthetic oligonucleotide
  Target: ATXN1; (+) strand; PAM type: NRG; PAM sequence: AAG
aaaaaagaaaaaaaaaaggt

SEQ ID NO: 130481 - DNA, 20 bp, Artificial Sequence
  Description of Artificial Sequence: Synthetic oligonucleotide
  Target: ATXN1; (+) strand; PAM type: NRG; PAM sequence: TAG
ttttaatttttattttcttt

SEQ ID NO: 130482 - DNA, 20 bp, Artificial Sequence
  Description of Artificial Sequence: Synthetic oligonucleotide
  Target: ATXN1; (+) strand; PAM type: NRG; PAM sequence: GAG
ttaatttttattttctttta

SEQ ID NO: 130483 - DNA, 20 bp, Artificial Sequence
  Description of Artificial Sequence: Synthetic oligonucleotide
  Target: ATXN1; (+) strand; PAM type: NRG; PAM sequence: CAG
tttttattttcttttagaga

SEQ ID NO: 130484 - DNA, 20 bp, Artificial Sequence
  Description of Artificial Sequence: Synthetic oligonucleotide
  Target: ATXN1; (+) strand; PAM type: NRG; PAM sequence: AGG
ttttattttcttttagagac

SEQ ID NO: 130485 - DNA, 20 bp, Artificial Sequence
  Description of Artificial Sequence: Synthetic oligonucleotide
  Target: ATXN1; (+) strand; PAM type: NRG; PAM sequence: GGG
tttattttcttttagagaca

SEQ ID NO: 130486 - DNA, 20 bp, Artificial Sequence
  Description of Artificial Sequence: Synthetic oligonucleotide
  Target: ATXN1; (+) strand; PAM type: NRG; PAM sequence: CAG
cagggtctcactctgtcacc

SEQ ID NO: 130487 - DNA, 20 bp, Artificial Sequence
  Description of Artificial Sequence: Synthetic oligonucleotide
  Target: ATXN1; (+) strand; PAM type: NRG; PAM sequence: AGG
agggtctcactctgtcaccc

SEQ ID NO: 130488 - DNA, 20 bp, Artificial Sequence
  Description of Artificial Sequence: Synthetic oligonucleotide
  Target: ATXN1; (+) strand; PAM type: NRG; PAM sequence: TGG
tctcactctgtcacccaggc

SEQ ID NO: 130489 - DNA, 20 bp, Artificial Sequence
  Description of Artificial Sequence: Synthetic oligonucleotide
  Target: ATXN1; (+) strand; PAM type: NRG; PAM sequence: GAG
tcactctgtcacccaggctg

SEQ ID NO: 130490 - DNA, 20 bp, Artificial Sequence
  Description of Artificial Sequence: Synthetic oligonucleotide
  Target: ATXN1; (+) strand; PAM type: NRG; PAM sequence: TAG
ctgtcacccaggctggagtg

SEQ ID NO: 130491 - DNA, 20 bp, Artificial Sequence
  Description of Artificial Sequence: Synthetic oligonucleotide
  Target: ATXN1; (+) strand; PAM type: NRG; PAM sequence: TAG
tcacccaggctggagtgtag

SEQ ID NO: 130492 - DNA, 20 bp, Artificial Sequence
  Description of Artificial Sequence: Synthetic oligonucleotide
  Target: ATXN1; (+) strand; PAM type: NRG; PAM sequence: CAG
agcacgaccataactcactg

SEQ ID NO: 130493 - DNA, 20 bp, Artificial Sequence
  Description of Artificial Sequence: Synthetic oligonucleotide
  Target: ATXN1; (+) strand; PAM type: NRG; PAM sequence: TGG
tcactgcagtctcaaactcc

SEQ ID NO: 130494 - DNA, 20 bp, Artificial Sequence
  Description of Artificial Sequence: Synthetic oligonucleotide
  Target: ATXN1; (+) strand; PAM type: NRG; PAM sequence: GGG
cactgcagtctcaaactcct

SEQ ID NO: 130495 - DNA, 20 bp, Artificial Sequence
  Description of Artificial Sequence: Synthetic oligonucleotide
  Target: ATXN1; (+) strand; PAM type: NRG; PAM sequence: CAG
ctcaaacaatccttccacct

SEQ ID NO: 130496 - DNA, 20 bp, Artificial Sequence
  Description of Artificial Sequence: Synthetic oligonucleotide
  Target: ATXN1; (+) strand; PAM type: NRG; PAM sequence: GAG
tccttccacctcagcctccc

SEQ ID NO: 130497 - DNA, 20 bp, Artificial Sequence
  Description of Artificial Sequence: Synthetic oligonucleotide
  Target: ATXN1; (+) strand; PAM type: NRG; PAM sequence: CAG
ctcagcctcccgagtacaaa

SEQ ID NO: 130498 - DNA, 20 bp, Artificial Sequence
  Description of Artificial Sequence: Synthetic oligonucleotide
  Target: ATXN1; (+) strand; PAM type: NRG; PAM sequence: AGG
tcagcctcccgagtacaaac

SEQ ID NO: 130499 - DNA, 20 bp, Artificial Sequence
  Description of Artificial Sequence: Synthetic oligonucleotide
  Target: ATXN1; (+) strand; PAM type: NRG; PAM sequence: TGG
caggcgtgcgccaccatgtt

SEQ ID NO: 130500 - DNA, 20 bp, Artificial Sequence
  Description of Artificial Sequence: Synthetic oligonucleotide
  Target: ATXN1; (+) strand; PAM type: NRG; PAM sequence: CAG
ttattattattatgtaaaaa

SEQ ID NO: 130501 - DNA, 20 bp, Artificial Sequence
  Description of Artificial Sequence: Synthetic oligonucleotide
  Target: ATXN1; (+) strand; PAM type: NRG; PAM sequence: AGG
tattattattatgtaaaaac

SEQ ID NO: 130502 - DNA, 20 bp, Artificial Sequence
  Description of Artificial Sequence: Synthetic oligonucleotide
  Target: ATXN1; (+) strand; PAM type: NRG; PAM sequence: GGG
attattattatgtaaaaaca

SEQ ID NO: 130503 - DNA, 20 bp, Artificial Sequence
  Description of Artificial Sequence: Synthetic oligonucleotide
  Target: ATXN1; (+) strand; PAM type: NRG; PAM sequence: CAG
cagggtctccctgtgttgtc

SEQ ID NO: 130504 - DNA, 20 bp, Artificial Sequence
  Description of Artificial Sequence: Synthetic oligonucleotide
  Target: ATXN1; (+) strand; PAM type: NRG; PAM sequence: TGG
tctccctgtgttgtccagac

SEQ ID NO: 130505 - DNA, 20 bp, Artificial Sequence
  Description of Artificial Sequence: Synthetic oligonucleotide
  Target: ATXN1; (+) strand; PAM type: NRG; PAM sequence: TGG
ccagactggtctctaactcc

SEQ ID NO: 130506 - DNA, 20 bp, Artificial Sequence
  Description of Artificial Sequence: Synthetic oligonucleotide
  Target: ATXN1; (+) strand; PAM type: NRG; PAM sequence: AAG
ggtctctaactcctggcctc

SEQ ID NO: 130507 - DNA, 20 bp, Artificial Sequence
  Description of Artificial Sequence: Synthetic oligonucleotide
  Target: ATXN1; (+) strand; PAM type: NRG; PAM sequence: TGG
ctcaagtgatgctctcgcct

SEQ ID NO: 130508 - DNA, 20 bp, Artificial Sequence
  Description of Artificial Sequence: Synthetic oligonucleotide
  Target: ATXN1; (+) strand; PAM type: NRG; PAM sequence: AAG
gctctcgccttggcctccca

SEQ ID NO: 130509 - DNA, 20 bp, Artificial Sequence
  Description of Artificial Sequence: Synthetic oligonucleotide
  Target: ATXN1; (+) strand; PAM type: NRG; PAM sequence: TGG
gccttggcctcccaaagtgc

SEQ ID NO: 130510 - DNA, 20 bp, Artificial Sequence
  Description of Artificial Sequence: Synthetic oligonucleotide
  Target: ATXN1; (+) strand; PAM type: NRG; PAM sequence: GGG
ccttggcctcccaaagtgct

SEQ ID NO: 130511 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 130512 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 130513 - DNA, 20 bp, Artificial Sequence
  Description of Artificial Sequence: Synthetic oligonucleotide
  Target: ATXN1; (+) strand; PAM type: NRG; PAM sequence: TGG
caggcatgaaccattgtgcc

SEQ ID NO: 130514 - DNA, 20 bp, Artificial Sequence
  Description of Artificial Sequence: Synthetic oligonucleotide
  Target: ATXN1; (+) strand; PAM type: NRG; PAM sequence: GAG
aaaatactaataaaaaatac

SEQ ID NO: 130515 - DNA, 20 bp, Artificial Sequence
  Description of Artificial Sequence: Synthetic oligonucleotide
  Target: ATXN1; (+) strand; PAM type: NRG; PAM sequence: TAG
taaaaattataattactgcg

SEQ ID NO: 130516 - DNA, 20 bp, Artificial Sequence
  Description of Artificial Sequence: Synthetic oligonucleotide
  Target: ATXN1; (+) strand; PAM type: NRG; PAM sequence: AAG
aaattataattactgcgtag

SEQ ID NO: 130517 - DNA, 20 bp, Artificial Sequence
  Description of Artificial Sequence: Synthetic oligonucleotide
  Target: ATXN1; (+) strand; PAM type: NRG; PAM sequence: GAG
attataattactgcgtagaa

SEQ ID NO: 130518 - DNA, 20 bp, Artificial Sequence
  Description of Artificial Sequence: Synthetic oligonucleotide
  Target: ATXN1; (+) strand; PAM type: NRG; PAM sequence: AAG
ttactgcgtagaagagacct

SEQ ID NO: 130519 - DNA, 20 bp, Artificial Sequence
  Description of Artificial Sequence: Synthetic oligonucleotide
  Target: ATXN1; (+) strand; PAM type: NRG; PAM sequence: AAG
taagtatgtaaaaaaattaa

SEQ ID NO: 130520 - DNA, 20 bp, Artificial Sequence
  Description of Artificial Sequence: Synthetic oligonucleotide
  Target: ATXN1; (+) strand; PAM type: NRG; PAM sequence: AAG
aaaataaaaatctgataaat

SEQ ID NO: 130521 - DNA, 20 bp, Artificial Sequence
  Description of Artificial Sequence: Synthetic oligonucleotide
  Target: ATXN1; (+) strand; PAM type: NRG; PAM sequence: AAG
attttttaaaaccctgcatg

SEQ ID NO: 130522 - DNA, 20 bp, Artificial Sequence
  Description of Artificial Sequence: Synthetic oligonucleotide
  Target: ATXN1; (+) strand; PAM type: NRG; PAM sequence: AAG
ccctgcatgaagaaaacata

SEQ ID NO: 130523 - DNA, 20 bp, Artificial Sequence
  Description of Artificial Sequence: Synthetic oligonucleotide
  Target: ATXN1; (+) strand; PAM type: NRG; PAM sequence: AAG
tgaagaaaacataaagtcaa

SEQ ID NO: 130524 - DNA, 20 bp, Artificial Sequence
  Description of Artificial Sequence: Synthetic oligonucleotide
  Target: ATXN1; (+) strand; PAM type: NRG; PAM sequence: CGG
acataaagtcaaaagacaaa

SEQ ID NO: 130525 - DNA, 20 bp, Artificial Sequence
  Description of Artificial Sequence: Synthetic oligonucleotide
  Target: ATXN1; (+) strand; PAM type: NRG; PAM sequence: TAG
cggaaaaatttaaactaaaa

SEQ ID NO: 130526 - DNA, 20 bp, Artificial Sequence
  Description of Artificial Sequence: Synthetic oligonucleotide
  Target: ATXN1; (+) strand; PAM type: NRG; PAM sequence: AAG
aatttaaactaaaatagcat

SEQ ID NO: 130527 - DNA, 20 bp, Artificial Sequence
  Description of Artificial Sequence: Synthetic oligonucleotide
  Target: ATXN1; (+) strand; PAM type: NRG; PAM sequence: AAG
actaaaatagcataagacaa

SEQ ID NO: 130528 - DNA, 20 bp, Artificial Sequence
  Description of Artificial Sequence: Synthetic oligonucleotide
  Target: ATXN1; (+) strand; PAM type: NRG; PAM sequence: AGG
ctaaaatagcataagacaaa

SEQ ID NO: 130529 - DNA, 20 bp, Artificial Sequence
  Description of Artificial Sequence: Synthetic oligonucleotide
  Target: ATXN1; (+) strand; PAM type: NRG; PAM sequence: TAG
gacaaaaggactaatctttt

SEQ ID NO: 130530 - DNA, 20 bp, Artificial Sequence
  Description of Artificial Sequence: Synthetic oligonucleotide
  Target: ATXN1; (+) strand; PAM type: NRG; PAM sequence: AAG
ttacatgctcctaaaaaaaa

SEQ ID NO: 130531 - DNA, 20 bp, Artificial Sequence
  Description of Artificial Sequence: Synthetic oligonucleotide
  Target: ATXN1; (+) strand; PAM type: NRG; PAM sequence: CAG
taaaaaaaaaagtcaattca

SEQ ID NO: 130532 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaaagtcaattcac

SEQ ID NO: 130533 - DNA, 20 bp, Artificial Sequence
  Description of Artificial Sequence: Synthetic oligonucleotide
  Target: ATXN1; (+) strand; PAM type: NRG; PAM sequence: TAG
cacaggataaaccaaaaacg

SEQ ID NO: 130534 - DNA, 20 bp, Artificial Sequence
  Description of Artificial Sequence: Synthetic oligonucleotide
  Target: ATXN1; (+) strand; PAM type: NRG; PAM sequence: TAG
aggataaaccaaaaacgtag

SEQ ID NO: 130535 - DNA, 20 bp, Artificial Sequence
  Description of Artificial Sequence: Synthetic oligonucleotide
  Target: ATXN1; (+) strand; PAM type: NRG; PAM sequence: TGG
ccaaaaacgtagtagaaaaa

SEQ ID NO: 130536 - DNA, 20 bp, Artificial Sequence
  Description of Artificial Sequence: Synthetic oligonucleotide
  Target: ATXN1; (+) strand; PAM type: NRG; PAM sequence: GGG
caaaaacgtagtagaaaaat

SEQ ID NO: 130537 - DNA, 20 bp, Artificial Sequence
  Description of Artificial Sequence: Synthetic oligonucleotide
  Target: ATXN1; (+) strand; PAM type: NRG; PAM sequence: GAG
gtagtagaaaaatgggcaac

SEQ ID NO: 130538 - DNA, 20 bp, Artificial Sequence
  Description of Artificial Sequence: Synthetic oligonucleotide
  Target: ATXN1; (+) strand; PAM type: NRG; PAM sequence: AGG
tagtagaaaaatgggcaacg

SEQ ID NO: 130539 - DNA, 20 bp, Artificial Sequence
  Description of Artificial Sequence: Synthetic oligonucleotide
  Target: ATXN1; (+) strand; PAM type: NRG; PAM sequence: CAG
gaggatgaatatacatttcc

SEQ ID NO: 130540 - DNA, 20 bp, Artificial Sequence
  Description of Artificial Sequence: Synthetic oligonucleotide
  Target: ATXN1; (+) strand; PAM type: NRG; PAM sequence: AAG
tgaatatacatttcccagaa

SEQ ID NO: 130541 - DNA, 20 bp, Artificial Sequence
  Description of Artificial Sequence: Synthetic oligonucleotide
  Target: ATXN1; (+) strand; PAM type: NRG; PAM sequence: TAG
acatttcccagaaaagaaaa

SEQ ID NO: 130542 - DNA, 20 bp, Artificial Sequence
  Description of Artificial Sequence: Synthetic oligonucleotide
  Target: ATXN1; (+) strand; PAM type: NRG; PAM sequence: AGG
catttcccagaaaagaaaat

SEQ ID NO: 130543 - DNA, 20 bp, Artificial Sequence
  Description of Artificial Sequence: Synthetic oligonucleotide
  Target: ATXN1; (+) strand; PAM type: NRG; PAM sequence: CGG
cccagaaaagaaaataggaa

SEQ ID NO: 130544 - DNA, 20 bp, Artificial Sequence
  Description of Artificial Sequence: Synthetic oligonucleotide
  Target: ATXN1; (+) strand; PAM type: NRG; PAM sequence: AAG
aacggcttttaaacatatga

SEQ ID NO: 130545 - DNA, 20 bp, Artificial Sequence
  Description of Artificial Sequence: Synthetic oligonucleotide
  Target: ATXN1; (+) strand; PAM type: NRG; PAM sequence: CAG
ttcaaccaccactataataa

SEQ ID NO: 130546 - DNA, 20 bp, Artificial Sequence
  Description of Artificial Sequence: Synthetic oligonucleotide
  Target: ATXN1; (+) strand; PAM type: NRG; PAM sequence: AAG
aataacagaaacccatatta

SEQ ID NO: 130547 - DNA, 20 bp, Artificial Sequence
  Description of Artificial Sequence: Synthetic oligonucleotide
  Target: ATXN1; (+) strand; PAM type: NRG; PAM sequence: TAG
gaaacccatattaaagctac

SEQ ID NO: 130548 - DNA, 20 bp, Artificial Sequence
  Description of Artificial Sequence: Synthetic oligonucleotide
  Target: ATXN1; (+) strand; PAM type: NRG; PAM sequence: TAG
atattaaagctactagaata

SEQ ID NO: 130549 - DNA, 20 bp, Artificial Sequence
  Description of Artificial Sequence: Synthetic oligonucleotide
  Target: ATXN1; (+) strand; PAM type: NRG; PAM sequence: TAG
ttaaagctactagaatatag

SEQ ID NO: 130550 - DNA, 20 bp, Artificial Sequence
  Description of Artificial Sequence: Synthetic oligonucleotide
  Target: ATXN1; (+) strand; PAM type: NRG; PAM sequence: CAG
atatagtagttttcacctct

SEQ ID NO: 130551 - DNA, 20 bp, Artificial Sequence
  Description of Artificial Sequence: Synthetic oligonucleotide
  Target: ATXN1; (+) strand; PAM type: NRG; PAM sequence: TGG
gtagttttcacctctcagat

SEQ ID NO: 130552 - DNA, 20 bp, Artificial Sequence
  Description of Artificial Sequence: Synthetic oligonucleotide
  Target: ATXN1; (+) strand; PAM type: NRG; PAM sequence: AAG
tttcacctctcagattggca

SEQ ID NO: 130553 - DNA, 20 bp, Artificial Sequence
  Description of Artificial Sequence: Synthetic oligonucleotide
  Target: ATXN1; (+) strand; PAM type: NRG; PAM sequence: AAG
tcagattggcaaagatcgtg

SEQ ID NO: 130554 - DNA, 20 bp, Artificial Sequence
  Description of Artificial Sequence: Synthetic oligonucleotide
  Target: ATXN1; (+) strand; PAM type: NRG; PAM sequence: TGG
aagtttaaaaacatcgtctg

SEQ ID NO: 130555 - DNA, 20 bp, Artificial Sequence
  Description of Artificial Sequence: Synthetic oligonucleotide
  Target: ATXN1; (+) strand; PAM type: NRG; PAM sequence: GAG
gtttaaaaacatcgtctgtg

SEQ ID NO: 130556 - DNA, 20 bp, Artificial Sequence
  Description of Artificial Sequence: Synthetic oligonucleotide
  Target: ATXN1; (+) strand; PAM type: NRG; PAM sequence: AAG
aaaacatcgtctgtggagaa

SEQ ID NO: 130557 - DNA, 20 bp, Artificial Sequence
  Description of Artificial Sequence: Synthetic oligonucleotide
  Target: ATXN1; (+) strand; PAM type: NRG; PAM sequence: CAG
tggagaaaagcacactcaaa

SEQ ID NO: 130558 - DNA, 20 bp, Artificial Sequence
  Description of Artificial Sequence: Synthetic oligonucleotide
  Target: ATXN1; (+) strand; PAM type: NRG; PAM sequence: TAG
aaagcacactcaaacagtgc

SEQ ID NO: 130559 - DNA, 20 bp, Artificial Sequence
  Description of Artificial Sequence: Synthetic oligonucleotide
  Target: ATXN1; (+) strand; PAM type: NRG; PAM sequence: CAG
gcacactcaaacagtgctag

SEQ ID NO: 130560 - DNA, 20 bp, Artificial Sequence
  Description of Artificial Sequence: Synthetic oligonucleotide
  Target: ATXN1; (+) strand; PAM type: NRG; PAM sequence: AGG
cacactcaaacagtgctagc

SEQ ID NO: 130561 - DNA, 20 bp, Artificial Sequence
  Description of Artificial Sequence: Synthetic oligonucleotide
  Target: ATXN1; (+) strand; PAM type: NRG; PAM sequence: TAG
gtgctagcaggaacatacaa

SEQ ID NO: 130562 - DNA, 20 bp, Artificial Sequence
  Description of Artificial Sequence: Synthetic oligonucleotide
  Target: ATXN1; (+) strand; PAM type: NRG; PAM sequence: AGG
tgctagcaggaacatacaat

SEQ ID NO: 130563 - DNA, 20 bp, Artificial Sequence
  Description of Artificial Sequence: Synthetic oligonucleotide
  Target: ATXN1; (+) strand; PAM type: NRG; PAM sequence: TGG
caataggacgaatgccaaat

SEQ ID NO: 130564 - DNA, 20 bp, Artificial Sequence
  Description of Artificial Sequence: Synthetic oligonucleotide
  Target: ATXN1; (+) strand; PAM type: NRG; PAM sequence: GAG
ataggacgaatgccaaattg

SEQ ID NO: 130565 - DNA, 20 bp, Artificial Sequence
  Description of Artificial Sequence: Synthetic oligonucleotide
  Target: ATXN1; (+) strand; PAM type: NRG; PAM sequence: AGG
taggacgaatgccaaattgg

SEQ ID NO: 130566 - DNA, 20 bp, Artificial Sequence
  Description of Artificial Sequence: Synthetic oligonucleotide
  Target: ATXN1; (+) strand; PAM type: NRG; PAM sequence: GGG
aggacgaatgccaaattgga

SEQ ID NO: 130567 - DNA, 20 bp, Artificial Sequence
  Description of Artificial Sequence: Synthetic oligonucleotide
  Target: ATXN1; (+) strand; PAM type: NRG; PAM sequence: TGG
tgccaaattggagggcaatt

SEQ ID NO: 130568 - DNA, 20 bp, Artificial Sequence
  Description of Artificial Sequence: Synthetic oligonucleotide
  Target: ATXN1; (+) strand; PAM type: NRG; PAM sequence: AAG
aaattggagggcaatttggc

SEQ ID NO: 130569 - DNA, 20 bp, Artificial Sequence
  Description of Artificial Sequence: Synthetic oligonucleotide
  Target: ATXN1; (+) strand; PAM type: NRG; PAM sequence: AGG
aattggagggcaatttggca

SEQ ID NO: 130570 - DNA, 20 bp, Artificial Sequence
  Description of Artificial Sequence: Synthetic oligonucleotide
  Target: ATXN1; (+) strand; PAM type: NRG; PAM sequence: TAG
ttgatccaacaattcccctt

SEQ ID NO: 130571 - DNA, 20 bp, Artificial Sequence
  Description of Artificial Sequence: Synthetic oligonucleotide
  Target: ATXN1; (+) strand; PAM type: NRG; PAM sequence: CAG
ccctttagtaatttctcctc

SEQ ID NO: 130572 - DNA, 20 bp, Artificial Sequence
  Description of Artificial Sequence: Synthetic oligonucleotide
  Target: ATXN1; (+) strand; PAM type: NRG; PAM sequence: GAG
ctttagtaatttctcctcca

SEQ ID NO: 130573 - DNA, 20 bp, Artificial Sequence
  Description of Artificial Sequence: Synthetic oligonucleotide
  Target: ATXN1; (+) strand; PAM type: NRG; PAM sequence: TAG
gacatacaacatgctattta

SEQ ID NO: 130574 - DNA, 20 bp, Artificial Sequence
  Description of Artificial Sequence: Synthetic oligonucleotide
  Target: ATXN1; (+) strand; PAM type: NRG; PAM sequence: GAG
catacaacatgctatttata

SEQ ID NO: 130575 - DNA, 20 bp, Artificial Sequence
  Description of Artificial Sequence: Synthetic oligonucleotide
  Target: ATXN1; (+) strand; PAM type: NRG; PAM sequence: GAG
tacaacatgctatttataga

SEQ ID NO: 130576 - DNA, 20 bp, Artificial Sequence
  Description of Artificial Sequence: Synthetic oligonucleotide
  Target: ATXN1; (+) strand; PAM type: NRG; PAM sequence: AAG
ttatagagagttgttcactg

SEQ ID NO: 130577 - DNA, 20 bp, Artificial Sequence
  Description of Artificial Sequence: Synthetic oligonucleotide
  Target: ATXN1; (+) strand; PAM type: NRG; PAM sequence: TAG
gttcactgaagcattgttca

SEQ ID NO: 130578 - DNA, 20 bp, Artificial Sequence
  Description of Artificial Sequence: Synthetic oligonucleotide
  Target: ATXN1; (+) strand; PAM type: NRG; PAM sequence: TAG
cactgaagcattgttcatag

SEQ ID NO: 130579 - DNA, 20 bp, Artificial Sequence
  Description of Artificial Sequence: Synthetic oligonucleotide
  Target: ATXN1; (+) strand; PAM type: NRG; PAM sequence: AAG
gaagcattgttcatagtagc

SEQ ID NO: 130580 - DNA, 20 bp, Artificial Sequence
  Description of Artificial Sequence: Synthetic oligonucleotide
  Target: ATXN1; (+) strand; PAM type: NRG; PAM sequence: TGG
tgttcatagtagcaagtgac

SEQ ID NO: 130581 - DNA, 20 bp, Artificial Sequence
  Description of Artificial Sequence: Synthetic oligonucleotide
  Target: ATXN1; (+) strand; PAM type: NRG; PAM sequence: AAG
aacaaccaaaaaaaaaaaaa

SEQ ID NO: 130582 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaaagtccatcaatg

SEQ ID NO: 130583 - DNA, 20 bp, Artificial Sequence
  Description of Artificial Sequence: Synthetic oligonucleotide
  Target: ATXN1; (+) strand; PAM type: NRG; PAM sequence: GGG
aaaaaaaagtccatcaatgt

SEQ ID NO: 130584 - DNA, 20 bp, Artificial Sequence
  Description of Artificial Sequence: Synthetic oligonucleotide
  Target: ATXN1; (+) strand; PAM type: NRG; PAM sequence: TGG
atgtgggactgaatacttta

SEQ ID NO: 130585 - DNA, 20 bp, Artificial Sequence
  Description of Artificial Sequence: Synthetic oligonucleotide
  Target: ATXN1; (+) strand; PAM type: NRG; PAM sequence: TAG
tcatacaatcgaatactatt

SEQ ID NO: 130586 - DNA, 20 bp, Artificial Sequence
  Description of Artificial Sequence: Synthetic oligonucleotide
  Target: ATXN1; (+) strand; PAM type: NRG; PAM sequence: AAG
atactatttagatactaaaa

SEQ ID NO: 130587 - DNA, 20 bp, Artificial Sequence
  Description of Artificial Sequence: Synthetic oligonucleotide
  Target: ATXN1; (+) strand; PAM type: NRG; PAM sequence: AAG
tttagatactaaaaaagaat

SEQ ID NO: 130588 - DNA, 20 bp, Artificial Sequence
  Description of Artificial Sequence: Synthetic oligonucleotide
  Target: ATXN1; (+) strand; PAM type: NRG; PAM sequence: AGG
ttagatactaaaaaagaata

SEQ ID NO: 130589 - DNA, 20 bp, Artificial Sequence
  Description of Artificial Sequence: Synthetic oligonucleotide
  Target: ATXN1; (+) strand; PAM type: NRG; PAM sequence: AAG
aggctgttctatgttccgat

SEQ ID NO: 130590 - DNA, 20 bp, Artificial Sequence
  Description of Artificial Sequence: Synthetic oligonucleotide
  Target: ATXN1; (+) strand; PAM type: NRG; PAM sequence: AAG
tgttctatgttccgataaga

SEQ ID NO: 130591 - DNA, 20 bp, Artificial Sequence
  Description of Artificial Sequence: Synthetic oligonucleotide
  Target: ATXN1; (+) strand; PAM type: NRG; PAM sequence: AGG
gttctatgttccgataagaa

SEQ ID NO: 130592 - DNA, 20 bp, Artificial Sequence
  Description of Artificial Sequence: Synthetic oligonucleotide
  Target: ATXN1; (+) strand; PAM type: NRG; PAM sequence: CAG
ttccgataagaaaggttttc

SEQ ID NO: 130593 - DNA, 20 bp, Artificial Sequence
  Description of Artificial Sequence: Synthetic oligonucleotide
  Target: ATXN1; (+) strand; PAM type: NRG; PAM sequence: AGG
tccgataagaaaggttttcc

SEQ ID NO: 130594 - DNA, 20 bp, Artificial Sequence
  Description of Artificial Sequence: Synthetic oligonucleotide
  Target: ATXN1; (+) strand; PAM type: NRG; PAM sequence: TAG
ggttttccaggacacactgt

SEQ ID NO: 130595 - DNA, 20 bp, Artificial Sequence
  Description of Artificial Sequence: Synthetic oligonucleotide
  Target: ATXN1; (+) strand; PAM type: NRG; PAM sequence: AGG
gttttccaggacacactgtt

SEQ ID NO: 130596 - DNA, 20 bp, Artificial Sequence
  Description of Artificial Sequence: Synthetic oligonucleotide
  Target: ATXN1; (+) strand; PAM type: NRG; PAM sequence: AAG
aggacacactgttaggtgaa

SEQ ID NO: 130597 - DNA, 20 bp, Artificial Sequence
  Description of Artificial Sequence: Synthetic oligonucleotide
  Target: ATXN1; (+) strand; PAM type: NRG; PAM sequence: GAG
gacacactgttaggtgaaaa

SEQ ID NO: 130598 - DNA, 20 bp, Artificial Sequence
  Description of Artificial Sequence: Synthetic oligonucleotide
  Target: ATXN1; (+) strand; PAM type: NRG; PAM sequence: AGG
acacactgttaggtgaaaag

SEQ ID NO: 130599 - DNA, 20 bp, Artificial Sequence
  Description of Artificial Sequence: Synthetic oligonucleotide
  Target: ATXN1; (+) strand; PAM type: NRG; PAM sequence: AAG
ctgttaggtgaaaagaggta

SEQ ID NO: 130600 - DNA, 20 bp, Artificial Sequence
  Description of Artificial Sequence: Synthetic oligonucleotide
  Target: ATXN1; (+) strand; PAM type: NRG; PAM sequence: AGG
tgttaggtgaaaagaggtaa

SEQ ID NO: 130601 - DNA, 20 bp, Artificial Sequence
  Description of Artificial Sequence: Synthetic oligonucleotide
  Target: ATXN1; (+) strand; PAM type: NRG; PAM sequence: GGG
gttaggtgaaaagaggtaaa

SEQ ID NO: 130602 - DNA, 20 bp, Artificial Sequence
  Description of Artificial Sequence: Synthetic oligonucleotide
  Target: ATXN1; (+) strand; PAM type: NRG; PAM sequence: CAG
aggtgaaaagaggtaaaggg

SEQ ID NO: 130603 - DNA, 20 bp, Artificial Sequence
  Description of Artificial Sequence: Synthetic oligonucleotide
  Target: ATXN1; (+) strand; PAM type: NRG; PAM sequence: TAG
aaaagaggtaaagggcagaa

SEQ ID NO: 130604 - DNA, 20 bp, Artificial Sequence
  Description of Artificial Sequence: Synthetic oligonucleotide
  Target: ATXN1; (+) strand; PAM type: NRG; PAM sequence: TGG
gtaaagggcagaatagtgta

SEQ ID NO: 130605 - DNA, 20 bp, Artificial Sequence
  Description of Artificial Sequence: Synthetic oligonucleotide
  Target: ATXN1; (+) strand; PAM type: NRG; PAM sequence: GGG
taaagggcagaatagtgtat

SEQ ID NO: 130606 - DNA, 20 bp, Artificial Sequence
  Description of Artificial Sequence: Synthetic oligonucleotide
  Target: ATXN1; (+) strand; PAM type: NRG; PAM sequence: GGG
aaagggcagaatagtgtatg

SEQ ID NO: 130607 - DNA, 20 bp, Artificial Sequence
  Description of Artificial Sequence: Synthetic oligonucleotide
  Target: ATXN1; (+) strand; PAM type: NRG; PAM sequence: AAG
taatcataaaatatccttaa

SEQ ID NO: 130608 - DNA, 20 bp, Artificial Sequence
  Description of Artificial Sequence: Synthetic oligonucleotide
  Target: ATXN1; (+) strand; PAM type: NRG; PAM sequence: AGG
aatcataaaatatccttaaa

SEQ ID NO: 130609 - DNA, 20 bp, Artificial Sequence
  Description of Artificial Sequence: Synthetic oligonucleotide
  Target: ATXN1; (+) strand; PAM type: NRG; PAM sequence: AAG
atatccttaaaaggactcac

SEQ ID NO: 130610 - DNA, 20 bp, Artificial Sequence
  Description of Artificial Sequence: Synthetic oligonucleotide
  Target: ATXN1; (+) strand; PAM type: NRG; PAM sequence: TGG
gactcacaagaaaatgataa

SEQ ID NO: 130611 - DNA, 20 bp, Artificial Sequence
  Description of Artificial Sequence: Synthetic oligonucleotide
  Target: ATXN1; (+) strand; PAM type: NRG; PAM sequence: TAG
atgataatggtacttgcttc

SEQ ID NO: 130612 - DNA, 20 bp, Artificial Sequence
  Description of Artificial Sequence: Synthetic oligonucleotide
  Target: ATXN1; (+) strand; PAM type: NRG; PAM sequence: AGG
tgataatggtacttgcttct

SEQ ID NO: 130613 - DNA, 20 bp, Artificial Sequence
  Description of Artificial Sequence: Synthetic oligonucleotide
  Target: ATXN1; (+) strand; PAM type: NRG; PAM sequence: GAG
aatggtacttgcttctaggt

SEQ ID NO: 130614 - DNA, 20 bp, Artificial Sequence
  Description of Artificial Sequence: Synthetic oligonucleotide
  Target: ATXN1; (+) strand; PAM type: NRG; PAM sequence: AAG
ttgcttctaggtgagaattc

SEQ ID NO: 130615 - DNA, 20 bp, Artificial Sequence
  Description of Artificial Sequence: Synthetic oligonucleotide
  Target: ATXN1; (+) strand; PAM type: NRG; PAM sequence: TAG
aggtgagaattcaagtgact

SEQ ID NO: 130616 - DNA, 20 bp, Artificial Sequence
  Description of Artificial Sequence: Synthetic oligonucleotide
  Target: ATXN1; (+) strand; PAM type: NRG; PAM sequence: CAG
gaattcaagtgacttagaca

SEQ ID NO: 130617 - DNA, 20 bp, Artificial Sequence
  Description of Artificial Sequence: Synthetic oligonucleotide
  Target: ATXN1; (+) strand; PAM type: NRG; PAM sequence: AAG
agtgacttagacacagaaat

SEQ ID NO: 130618 - DNA, 20 bp, Artificial Sequence
  Description of Artificial Sequence: Synthetic oligonucleotide
  Target: ATXN1; (+) strand; PAM type: NRG; PAM sequence: GAG
tgacttagacacagaaataa

SEQ ID NO: 130619 - DNA, 20 bp, Artificial Sequence
  Description of Artificial Sequence: Synthetic oligonucleotide
  Target: ATXN1; (+) strand; PAM type: NRG; PAM sequence: GAG
acttagacacagaaataaga

SEQ ID NO: 130620 - DNA, 20 bp, Artificial Sequence
  Description of Artificial Sequence: Synthetic oligonucleotide
  Target: ATXN1; (+) strand; PAM type: NRG; PAM sequence: TAG
tatcgtaccttctgtatatc

SEQ ID NO: 130621 - DNA, 20 bp, Artificial Sequence
  Description of Artificial Sequence: Synthetic oligonucleotide
  Target: ATXN1; (+) strand; PAM type: NRG; PAM sequence: AAG
aacaatattaatgcttcaaa

SEQ ID NO: 130622 - DNA, 20 bp, Artificial Sequence
  Description of Artificial Sequence: Synthetic oligonucleotide
  Target: ATXN1; (+) strand; PAM type: NRG; PAM sequence: AAG
atattaatgcttcaaaaaga

SEQ ID NO: 130623 - DNA, 20 bp, Artificial Sequence
  Description of Artificial Sequence: Synthetic oligonucleotide
  Target: ATXN1; (+) strand; PAM type: NRG; PAM sequence: AAG
aatgcttcaaaaagaaagaa

SEQ ID NO: 130624 - DNA, 20 bp, Artificial Sequence
  Description of Artificial Sequence: Synthetic oligonucleotide
  Target: ATXN1; (+) strand; PAM type: NRG; PAM sequence: AAG
aaaaagaaagaaaagaaacc

SEQ ID NO: 130625 - DNA, 20 bp, Artificial Sequence
  Description of Artificial Sequence: Synthetic oligonucleotide
  Target: ATXN1; (+) strand; PAM type: NRG; PAM sequence: AAG
gaaaagaaaccaagcatacc

SEQ ID NO: 130626 - DNA, 20 bp, Artificial Sequence
  Description of Artificial Sequence: Synthetic oligonucleotide
  Target: ATXN1; (+) strand; PAM type: NRG; PAM sequence: AGG
aaaagaaaccaagcatacca

SEQ ID NO: 130627 - DNA, 20 bp, Artificial Sequence
  Description of Artificial Sequence: Synthetic oligonucleotide
  Target: ATXN1; (+) strand; PAM type: NRG; PAM sequence: AAG
ccaaggacactgaaatataa

SEQ ID NO: 130628 - DNA, 20 bp, Artificial Sequence
  Description of Artificial Sequence: Synthetic oligonucleotide
  Target: ATXN1; (+) strand; PAM type: NRG; PAM sequence: AGG
caaggacactgaaatataaa

SEQ ID NO: 130629 - DNA, 20 bp, Artificial Sequence
  Description of Artificial Sequence: Synthetic oligonucleotide
  Target: ATXN1; (+) strand; PAM type: NRG; PAM sequence: GAG
aggacactgaaatataaaag

SEQ ID NO: 130630 - DNA, 20 bp, Artificial Sequence
  Description of Artificial Sequence: Synthetic oligonucleotide
  Target: ATXN1; (+) strand; PAM type: NRG; PAM sequence: AAG
actgaaatataaaaggagca

SEQ ID NO: 130631 - DNA, 20 bp, Artificial Sequence
  Description of Artificial Sequence: Synthetic oligonucleotide
  Target: ATXN1; (+) strand; PAM type: NRG; PAM sequence: TGG
tataaaaggagcaaagtacg

SEQ ID NO: 130632 - DNA, 20 bp, Artificial Sequence
  Description of Artificial Sequence: Synthetic oligonucleotide
  Target: ATXN1; (+) strand; PAM type: NRG; PAM sequence: TGG
caaagtacgtggtctaattt

SEQ ID NO: 130633 - DNA, 20 bp, Artificial Sequence
  Description of Artificial Sequence: Synthetic oligonucleotide
  Target: ATXN1; (+) strand; PAM type: NRG; PAM sequence: TAG
gtacgtggtctaattttgga

SEQ ID NO: 130634 - DNA, 20 bp, Artificial Sequence
  Description of Artificial Sequence: Synthetic oligonucleotide
  Target: ATXN1; (+) strand; PAM type: NRG; PAM sequence: TAG
ttggatagctttgttatttt

SEQ ID NO: 130635 - DNA, 20 bp, Artificial Sequence
  Description of Artificial Sequence: Synthetic oligonucleotide
  Target: ATXN1; (+) strand; PAM type: NRG; PAM sequence: AAG
tgtttaataaaaaaaaaata

SEQ ID NO: 130636 - DNA, 20 bp, Artificial Sequence
  Description of Artificial Sequence: Synthetic oligonucleotide
  Target: ATXN1; (+) strand; PAM type: NRG; PAM sequence: CAG
aaccctcaaaattgactgcc

SEQ ID NO: 130637 - DNA, 20 bp, Artificial Sequence
  Description of Artificial Sequence: Synthetic oligonucleotide
  Target: ATXN1; (+) strand; PAM type: NRG; PAM sequence: AGG
accctcaaaattgactgccc

SEQ ID NO: 130638 - DNA, 20 bp, Artificial Sequence
  Description of Artificial Sequence: Synthetic oligonucleotide
  Target: ATXN1; (+) strand; PAM type: NRG; PAM sequence: TAG
tgatttcaacttttcccaaa

SEQ ID NO: 130639 - DNA, 20 bp, Artificial Sequence
  Description of Artificial Sequence: Synthetic oligonucleotide
  Target: ATXN1; (+) strand; PAM type: NRG; PAM sequence: GAG
atttcaacttttcccaaata

SEQ ID NO: 130640 - DNA, 20 bp, Artificial Sequence
  Description of Artificial Sequence: Synthetic oligonucleotide
  Target: ATXN1; (+) strand; PAM type: NRG; PAM sequence: AGG
tttcaacttttcccaaatag

SEQ ID NO: 130641 - DNA, 20 bp, Artificial Sequence
  Description of Artificial Sequence: Synthetic oligonucleotide
  Target: ATXN1; (+) strand; PAM type: NRG; PAM sequence: TGG
ttttcccaaatagaggcatt

SEQ ID NO: 130642 - DNA, 20 bp, Artificial Sequence
  Description of Artificial Sequence: Synthetic oligonucleotide
  Target: ATXN1; (+) strand; PAM type: NRG; PAM sequence: AAG
ccaaatagaggcatttggct

SEQ ID NO: 130643 - DNA, 20 bp, Artificial Sequence
  Description of Artificial Sequence: Synthetic oligonucleotide
  Target: ATXN1; (+) strand; PAM type: NRG; PAM sequence: CAG
gcctccccaccccaccatca

SEQ ID NO: 130644 - DNA, 20 bp, Artificial Sequence
  Description of Artificial Sequence: Synthetic oligonucleotide
  Target: ATXN1; (+) strand; PAM type: NRG; PAM sequence: AGG
cctccccaccccaccatcac

SEQ ID NO: 130645 - DNA, 20 bp, Artificial Sequence
  Description of Artificial Sequence: Synthetic oligonucleotide
  Target: ATXN1; (+) strand; PAM type: NRG; PAM sequence: GAG
tccccaccccaccatcacag

SEQ ID NO: 130646 - DNA, 20 bp, Artificial Sequence
  Description of Artificial Sequence: Synthetic oligonucleotide
  Target: ATXN1; (+) strand; PAM type: NRG; PAM sequence: CGG
caccccaccatcacaggaga

SEQ ID NO: 130647 - DNA, 20 bp, Artificial Sequence
  Description of Artificial Sequence: Synthetic oligonucleotide
  Target: ATXN1; (+) strand; PAM type: NRG; PAM sequence: GGG
accccaccatcacaggagac

SEQ ID NO: 130648 - DNA, 20 bp, Artificial Sequence
  Description of Artificial Sequence: Synthetic oligonucleotide
  Target: ATXN1; (+) strand; PAM type: NRG; PAM sequence: AAG
caggagacgggaccacctcc

SEQ ID NO: 130649 - DNA, 20 bp, Artificial Sequence
  Description of Artificial Sequence: Synthetic oligonucleotide
  Target: ATXN1; (+) strand; PAM type: NRG; PAM sequence: AAG
acgggaccacctccaagacc

SEQ ID NO: 130650 - DNA, 20 bp, Artificial Sequence
  Description of Artificial Sequence: Synthetic oligonucleotide
  Target: ATXN1; (+) strand; PAM type: NRG; PAM sequence: TGG
ggaccacctccaagaccaag

SEQ ID NO: 130651 - DNA, 20 bp, Artificial Sequence
  Description of Artificial Sequence: Synthetic oligonucleotide
  Target: ATXN1; (+) strand; PAM type: NRG; PAM sequence: TAG
ttcaaatttgccctctgttg

SEQ ID NO: 130652 - DNA, 20 bp, Artificial Sequence
  Description of Artificial Sequence: Synthetic oligonucleotide
  Target: ATXN1; (+) strand; PAM type: NRG; PAM sequence: TGG
aatttgccctctgttgtagc

SEQ ID NO: 130653 - DNA, 20 bp, Artificial Sequence
  Description of Artificial Sequence: Synthetic oligonucleotide
  Target: ATXN1; (+) strand; PAM type: NRG; PAM sequence: GAG
tttgccctctgttgtagctg

SEQ ID NO: 130654 - DNA, 20 bp, Artificial Sequence
  Description of Artificial Sequence: Synthetic oligonucleotide
  Target: ATXN1; (+) strand; PAM type: NRG; PAM sequence: GAG
gtagctggagatatgccaac

SEQ ID NO: 130655 - DNA, 20 bp, Artificial Sequence
  Description of Artificial Sequence: Synthetic oligonucleotide
  Target: ATXN1; (+) strand; PAM type: NRG; PAM sequence: GAG
agctggagatatgccaacga

SEQ ID NO: 130656 - DNA, 20 bp, Artificial Sequence
  Description of Artificial Sequence: Synthetic oligonucleotide
  Target: ATXN1; (+) strand; PAM type: NRG; PAM sequence: AGG
gctggagatatgccaacgag

SEQ ID NO: 130657 - DNA, 20 bp, Artificial Sequence
  Description of Artificial Sequence: Synthetic oligonucleotide
  Target: ATXN1; (+) strand; PAM type: NRG; PAM sequence: GGG
ctggagatatgccaacgaga

SEQ ID NO: 130658 - DNA, 20 bp, Artificial Sequence
  Description of Artificial Sequence: Synthetic oligonucleotide
  Target: ATXN1; (+) strand; PAM type: NRG; PAM sequence: GGG
tggagatatgccaacgagag

SEQ ID NO: 130659 - DNA, 20 bp, Artificial Sequence
  Description of Artificial Sequence: Synthetic oligonucleotide
  Target: ATXN1; (+) strand; PAM type: NRG; PAM sequence: TAG
gccaacgagaggggtttgtt

SEQ ID NO: 130660 - DNA, 20 bp, Artificial Sequence
  Description of Artificial Sequence: Synthetic oligonucleotide
  Target: ATXN1; (+) strand; PAM type: NRG; PAM sequence: CAG
ggtttgtttagatttatcct

SEQ ID NO: 130661 - DNA, 20 bp, Artificial Sequence
  Description of Artificial Sequence: Synthetic oligonucleotide
  Target: ATXN1; (+) strand; PAM type: NRG; PAM sequence: AGG
gtttgtttagatttatcctc

SEQ ID NO: 130662 - DNA, 20 bp, Artificial Sequence
  Description of Artificial Sequence: Synthetic oligonucleotide
  Target: ATXN1; (+) strand; PAM type: NRG; PAM sequence: AAG
agatttatcctcaggatgca

SEQ ID NO: 130663 - DNA, 20 bp, Artificial Sequence
  Description of Artificial Sequence: Synthetic oligonucleotide
  Target: ATXN1; (+) strand; PAM type: NRG; PAM sequence: AAG
atcctcaggatgcaaagaaa

SEQ ID NO: 130664 - DNA, 20 bp, Artificial Sequence
  Description of Artificial Sequence: Synthetic oligonucleotide
  Target: ATXN1; (+) strand; PAM type: NRG; PAM sequence: TAG
ccaattttacttattctgcg

SEQ ID NO: 130665 - DNA, 20 bp, Artificial Sequence
  Description of Artificial Sequence: Synthetic oligonucleotide
  Target: ATXN1; (+) strand; PAM type: NRG; PAM sequence: TAG
attctgcgtagctgaatttt

SEQ ID NO: 130666 - DNA, 20 bp, Artificial Sequence
  Description of Artificial Sequence: Synthetic oligonucleotide
  Target: ATXN1; (+) strand; PAM type: NRG; PAM sequence: AGG
ttctgcgtagctgaattttt

SEQ ID NO: 130667 - DNA, 20 bp, Artificial Sequence
  Description of Artificial Sequence: Synthetic oligonucleotide
  Target: ATXN1; (+) strand; PAM type: NRG; PAM sequence: TGG
tgaatttttaggtcttccaa

SEQ ID NO: 130668 - DNA, 20 bp, Artificial Sequence
  Description of Artificial Sequence: Synthetic oligonucleotide
  Target: ATXN1; (+) strand; PAM type: NRG; PAM sequence: CAG
ttaggtcttccaatggtcat

SEQ ID NO: 130669 - DNA, 20 bp, Artificial Sequence
  Description of Artificial Sequence: Synthetic oligonucleotide
  Target: ATXN1; (+) strand; PAM type: NRG; PAM sequence: TAG
gtcttccaatggtcatcagt

SEQ ID NO: 130670 - DNA, 20 bp, Artificial Sequence
  Description of Artificial Sequence: Synthetic oligonucleotide
  Target: ATXN1; (+) strand; PAM type: NRG; PAM sequence: AGG
tcttccaatggtcatcagtt

SEQ ID NO: 130671 - DNA, 20 bp, Artificial Sequence
  Description of Artificial Sequence: Synthetic oligonucleotide
  Target: ATXN1; (+) strand; PAM type: NRG; PAM sequence: GGG
cttccaatggtcatcagtta

SEQ ID NO: 130672 - DNA, 20 bp, Artificial Sequence
  Description of Artificial Sequence: Synthetic oligonucleotide
  Target: ATXN1; (+) strand; PAM type: NRG; PAM sequence: TAG
caatggtcatcagttagggt

SEQ ID NO: 130673 - DNA, 20 bp, Artificial Sequence
  Description of Artificial Sequence: Synthetic oligonucleotide
  Target: ATXN1; (+) strand; PAM type: NRG; PAM sequence: CAG
agttagggttagaacgaaaa

SEQ ID NO: 130674 - DNA, 20 bp, Artificial Sequence
  Description of Artificial Sequence: Synthetic oligonucleotide
  Target: ATXN1; (+) strand; PAM type: NRG; PAM sequence: CAG
cagctgtaaaaatgtcctga

SEQ ID NO: 130675 - DNA, 20 bp, Artificial Sequence
  Description of Artificial Sequence: Synthetic oligonucleotide
  Target: ATXN1; (+) strand; PAM type: NRG; PAM sequence: AGG
agctgtaaaaatgtcctgac

SEQ ID NO: 130676 - DNA, 20 bp, Artificial Sequence
  Description of Artificial Sequence: Synthetic oligonucleotide
  Target: ATXN1; (+) strand; PAM type: NRG; PAM sequence: GAG
ctgtaaaaatgtcctgacag

SEQ ID NO: 130677 - DNA, 20 bp, Artificial Sequence
  Description of Artificial Sequence: Synthetic oligonucleotide
  Target: ATXN1; (+) strand; PAM type: NRG; PAM sequence: TGG
aaaaatgtcctgacaggagc

SEQ ID NO: 130678 - DNA, 20 bp, Artificial Sequence
  Description of Artificial Sequence: Synthetic oligonucleotide
  Target: ATXN1; (+) strand; PAM type: NRG; PAM sequence: GAG
aaatgtcctgacaggagctg

SEQ ID NO: 130679 - DNA, 20 bp, Artificial Sequence
  Description of Artificial Sequence: Synthetic oligonucleotide
  Target: ATXN1; (+) strand; PAM type: NRG; PAM sequence: CAG
tcctgacaggagctggagac

SEQ ID NO: 130680 - DNA, 20 bp, Artificial Sequence
  Description of Artificial Sequence: Synthetic oligonucleotide
  Target: ATXN1; (+) strand; PAM type: NRG; PAM sequence: TGG
acaggagctggagaccagcc

SEQ ID NO: 130681 - DNA, 20 bp, Artificial Sequence
  Description of Artificial Sequence: Synthetic oligonucleotide
  Target: ATXN1; (+) strand; PAM type: NRG; PAM sequence: TGG
ggagaccagcctggccaaca

SEQ ID NO: 130682 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatacaaaaatttgc

SEQ ID NO: 130683 - DNA, 20 bp, Artificial Sequence
  Description of Artificial Sequence: Synthetic oligonucleotide
  Target: ATXN1; (+) strand; PAM type: NRG; PAM sequence: GGG
taaaaatacaaaaatttgct

SEQ ID NO: 130684 - DNA, 20 bp, Artificial Sequence
  Description of Artificial Sequence: Synthetic oligonucleotide
  Target: ATXN1; (+) strand; PAM type: NRG; PAM sequence: TGG
atacaaaaatttgctgggca

SEQ ID NO: 130685 - DNA, 20 bp, Artificial Sequence
  Description of Artificial Sequence: Synthetic oligonucleotide
  Target: ATXN1; (+) strand; PAM type: NRG; PAM sequence: TGG
caaaaatttgctgggcatgg

SEQ ID NO: 130686 - DNA, 20 bp, Artificial Sequence
  Description of Artificial Sequence: Synthetic oligonucleotide
  Target: ATXN1; (+) strand; PAM type: NRG; PAM sequence: CAG
aaatttgctgggcatggtgg

SEQ ID NO: 130687 - DNA, 20 bp, Artificial Sequence
  Description of Artificial Sequence: Synthetic oligonucleotide
  Target: ATXN1; (+) strand; PAM type: NRG; PAM sequence: AGG
aatttgctgggcatggtggc

SEQ ID NO: 130688 - DNA, 20 bp, Artificial Sequence
  Description of Artificial Sequence: Synthetic oligonucleotide
  Target: ATXN1; (+) strand; PAM type: NRG; PAM sequence: CAG
gtggcaggtgcttgtaatcc

SEQ ID NO: 130689 - DNA, 20 bp, Artificial Sequence
  Description of Artificial Sequence: Synthetic oligonucleotide
  Target: ATXN1; (+) strand; PAM type: NRG; PAM sequence: CGG
tgcttgtaatcccagctact

SEQ ID NO: 130690 - DNA, 20 bp, Artificial Sequence
  Description of Artificial Sequence: Synthetic oligonucleotide
  Target: ATXN1; (+) strand; PAM type: NRG; PAM sequence: GGG
gcttgtaatcccagctactc

SEQ ID NO: 130691 - DNA, 20 bp, Artificial Sequence
  Description of Artificial Sequence: Synthetic oligonucleotide
  Target: ATXN1; (+) strand; PAM type: NRG; PAM sequence: GAG
ttgtaatcccagctactcgg

SEQ ID NO: 130692 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctactcggg

SEQ ID NO: 130693 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcgggaggct

SEQ ID NO: 130694 - DNA, 20 bp, Artificial Sequence
  Description of Artificial Sequence: Synthetic oligonucleotide
  Target: ATXN1; (+) strand; PAM type: NRG; PAM sequence: AGG
cccagctactcgggaggctg

SEQ ID NO: 130695 - DNA, 20 bp, Artificial Sequence
  Description of Artificial Sequence: Synthetic oligonucleotide
  Target: ATXN1; (+) strand; PAM type: NRG; PAM sequence: CAG
agctactcgggaggctgagg

SEQ ID NO: 130696 - DNA, 20 bp, Artificial Sequence
  Description of Artificial Sequence: Synthetic oligonucleotide
  Target: ATXN1; (+) strand; PAM type: NRG; PAM sequence: AGG
gctactcgggaggctgaggc

SEQ ID NO: 130697 - DNA, 20 bp, Artificial Sequence
  Description of Artificial Sequence: Synthetic oligonucleotide
  Target: ATXN1; (+) strand; PAM type: NRG; PAM sequence: GAG
tactcgggaggctgaggcag

SEQ ID NO: 130698 - DNA, 20 bp, Artificial Sequence
  Description of Artificial Sequence: Synthetic oligonucleotide
  Target: ATXN1; (+) strand; PAM type: NRG; PAM sequence: CGG
aggcaggagaatcgtttaaa

SEQ ID NO: 130699 - DNA, 20 bp, Artificial Sequence
  Description of Artificial Sequence: Synthetic oligonucleotide
  Target: ATXN1; (+) strand; PAM type: NRG; PAM sequence: GGG
ggcaggagaatcgtttaaac

SEQ ID NO: 130700 - DNA, 20 bp, Artificial Sequence
  Description of Artificial Sequence: Synthetic oligonucleotide
  Target: ATXN1; (+) strand; PAM type: NRG; PAM sequence: GGG
gcaggagaatcgtttaaacg

SEQ ID NO: 130701 - DNA, 20 bp, Artificial Sequence
  Description of Artificial Sequence: Synthetic oligonucleotide
  Target: ATXN1; (+) strand; PAM type: NRG; PAM sequence: GAG
aggagaatcgtttaaacggg

SEQ ID NO: 130702 - DNA, 20 bp, Artificial Sequence
  Description of Artificial Sequence: Synthetic oligonucleotide
  Target: ATXN1; (+) strand; PAM type: NRG; PAM sequence: AGG
ggagaatcgtttaaacgggg

SEQ ID NO: 130703 - DNA, 20 bp, Artificial Sequence
  Description of Artificial Sequence: Synthetic oligonucleotide
  Target: ATXN1; (+) strand; PAM type: NRG; PAM sequence: CGG
gaatcgtttaaacggggagg

SEQ ID NO: 130704 - DNA, 20 bp, Artificial Sequence
  Description of Artificial Sequence: Synthetic oligonucleotide
  Target: ATXN1; (+) strand; PAM type: NRG; PAM sequence: GAG
atcgtttaaacggggaggcg

SEQ ID NO: 130705 - DNA, 20 bp, Artificial Sequence
  Description of Artificial Sequence: Synthetic oligonucleotide
  Target: ATXN1; (+) strand; PAM type: NRG; PAM sequence: AGG
tcgtttaaacggggaggcgg

SEQ ID NO: 130706 - DNA, 20 bp, Artificial Sequence
  Description of Artificial Sequence: Synthetic oligonucleotide
  Target: ATXN1; (+) strand; PAM type: NRG; PAM sequence: CAG
aaacggggaggcggaggttg

SEQ ID NO: 130707 - DNA, 20 bp, Artificial Sequence
  Description of Artificial Sequence: Synthetic oligonucleotide
  Target: ATXN1; (+) strand; PAM type: NRG; PAM sequence: GAG
ggcggaggttgcagtgcacc

SEQ ID NO: 130708 - DNA, 20 bp, Artificial Sequence
  Description of Artificial Sequence: Synthetic oligonucleotide
  Target: ATXN1; (+) strand; PAM type: NRG; PAM sequence: CAG
gagatcacaccattgcactc

SEQ ID NO: 130709 - DNA, 20 bp, Artificial Sequence
  Description of Artificial Sequence: Synthetic oligonucleotide
  Target: ATXN1; (+) strand; PAM type: NRG; PAM sequence: TGG
cacaccattgcactccagtt

SEQ ID NO: 130710 - DNA, 20 bp, Artificial Sequence
  Description of Artificial Sequence: Synthetic oligonucleotide
  Target: ATXN1; (+) strand; PAM type: NRG; PAM sequence: TAG
ccattgcactccagtttgga

SEQ ID NO: 130711 - DNA, 20 bp, Artificial Sequence
  Description of Artificial Sequence: Synthetic oligonucleotide
  Target: ATXN1; (+) strand; PAM type: NRG; PAM sequence: AAG
tgcactccagtttggatagc

SEQ ID NO: 130712 - DNA, 20 bp, Artificial Sequence
  Description of Artificial Sequence: Synthetic oligonucleotide
  Target: ATXN1; (+) strand; PAM type: NRG; PAM sequence: GAG
cactccagtttggatagcaa

SEQ ID NO: 130713 - DNA, 20 bp, Artificial Sequence
  Description of Artificial Sequence: Synthetic oligonucleotide
  Target: ATXN1; (+) strand; PAM type: NRG; PAM sequence: AAG
aaaaataaaatgtcctgaca

SEQ ID NO: 130714 - DNA, 20 bp, Artificial Sequence
  Description of Artificial Sequence: Synthetic oligonucleotide
  Target: ATXN1; (+) strand; PAM type: NRG; PAM sequence: TAG
aaatgtcctgacaaagacta

SEQ ID NO: 130715 - DNA, 20 bp, Artificial Sequence
  Description of Artificial Sequence: Synthetic oligonucleotide
  Target: ATXN1; (+) strand; PAM type: NRG; PAM sequence: GAG
gtcctgacaaagactatagt

SEQ ID NO: 130716 - DNA, 20 bp, Artificial Sequence
  Description of Artificial Sequence: Synthetic oligonucleotide
  Target: ATXN1; (+) strand; PAM type: NRG; PAM sequence: CAG
aaagactatagtgagctcat

SEQ ID NO: 130717 - DNA, 20 bp, Artificial Sequence
  Description of Artificial Sequence: Synthetic oligonucleotide
  Target: ATXN1; (+) strand; PAM type: NRG; PAM sequence: AAG
cctttaatatgcttgttcta

SEQ ID NO: 130718 - DNA, 20 bp, Artificial Sequence
  Description of Artificial Sequence: Synthetic oligonucleotide
  Target: ATXN1; (+) strand; PAM type: NRG; PAM sequence: AGG
ctttaatatgcttgttctaa

SEQ ID NO: 130719 - DNA, 20 bp, Artificial Sequence
  Description of Artificial Sequence: Synthetic oligonucleotide
  Target: ATXN1; (+) strand; PAM type: NRG; PAM sequence: GGG
tttaatatgcttgttctaaa

SEQ ID NO: 130720 - DNA, 20 bp, Artificial Sequence
  Description of Artificial Sequence: Synthetic oligonucleotide
  Target: ATXN1; (+) strand; PAM type: NRG; PAM sequence: GGG
ttaatatgcttgttctaaag

SEQ ID NO: 130721 - DNA, 20 bp, Artificial Sequence
  Description of Artificial Sequence: Synthetic oligonucleotide
  Target: ATXN1; (+) strand; PAM type: NRG; PAM sequence: GGG
taatatgcttgttctaaagg

SEQ ID NO: 130722 - DNA, 20 bp, Artificial Sequence
  Description of Artificial Sequence: Synthetic oligonucleotide
  Target: ATXN1; (+) strand; PAM type: NRG; PAM sequence: CAG
tatgcttgttctaaaggggg

SEQ ID NO: 130723 - DNA, 20 bp, Artificial Sequence
  Description of Artificial Sequence: Synthetic oligonucleotide
  Target: ATXN1; (+) strand; PAM type: NRG; PAM sequence: AGG
atgcttgttctaaagggggc

SEQ ID NO: 130724 - DNA, 20 bp, Artificial Sequence
  Description of Artificial Sequence: Synthetic oligonucleotide
  Target: ATXN1; (+) strand; PAM type: NRG; PAM sequence: GGG
tgcttgttctaaagggggca

SEQ ID NO: 130725 - DNA, 20 bp, Artificial Sequence
  Description of Artificial Sequence: Synthetic oligonucleotide
  Target: ATXN1; (+) strand; PAM type: NRG; PAM sequence: GGG
gcttgttctaaagggggcag

SEQ ID NO: 130726 - DNA, 20 bp, Artificial Sequence
  Description of Artificial Sequence: Synthetic oligonucleotide
  Target: ATXN1; (+) strand; PAM type: NRG; PAM sequence: TGG
tgttctaaagggggcagggg

SEQ ID NO: 130727 - DNA, 20 bp, Artificial Sequence
  Description of Artificial Sequence: Synthetic oligonucleotide
  Target: ATXN1; (+) strand; PAM type: NRG; PAM sequence: GAG
ttctaaagggggcaggggtg

SEQ ID NO: 130728 - DNA, 20 bp, Artificial Sequence
  Description of Artificial Sequence: Synthetic oligonucleotide
  Target: ATXN1; (+) strand; PAM type: NRG; PAM sequence: GAG
ctaaagggggcaggggtgga

SEQ ID NO: 130729 - DNA, 20 bp, Artificial Sequence
  Description of Artificial Sequence: Synthetic oligonucleotide
  Target: ATXN1; (+) strand; PAM type: NRG; PAM sequence: GAG
aaagggggcaggggtggaga

SEQ ID NO: 130730 - DNA, 20 bp, Artificial Sequence
  Description of Artificial Sequence: Synthetic oligonucleotide
  Target: ATXN1; (+) strand; PAM type: NRG; PAM sequence: AAG
gggggcaggggtggagagag

SEQ ID NO: 130731 - DNA, 20 bp, Artificial Sequence
  Description of Artificial Sequence: Synthetic oligonucleotide
  Target: ATXN1; (+) strand; PAM type: NRG; PAM sequence: TAG
caggggtggagagagaagac

SEQ ID NO: 130732 - DNA, 20 bp, Artificial Sequence
  Description of Artificial Sequence: Synthetic oligonucleotide
  Target: ATXN1; (+) strand; PAM type: NRG; PAM sequence: TGG
tggagagagaagactagaat

SEQ ID NO: 130733 - DNA, 20 bp, Artificial Sequence
  Description of Artificial Sequence: Synthetic oligonucleotide
  Target: ATXN1; (+) strand; PAM type: NRG; PAM sequence: CAG
agaagactagaattggtctg

SEQ ID NO: 130734 - DNA, 20 bp, Artificial Sequence
  Description of Artificial Sequence: Synthetic oligonucleotide
  Target: ATXN1; (+) strand; PAM type: NRG; PAM sequence: AGG
gaagactagaattggtctgc

SEQ ID NO: 130735 - DNA, 20 bp, Artificial Sequence
  Description of Artificial Sequence: Synthetic oligonucleotide
  Target: ATXN1; (+) strand; PAM type: NRG; PAM sequence: GGG
aagactagaattggtctgca

SEQ ID NO: 130736 - DNA, 20 bp, Artificial Sequence
  Description of Artificial Sequence: Synthetic oligonucleotide
  Target: ATXN1; (+) strand; PAM type: NRG; PAM sequence: CAG
tagaattggtctgcagggcc

SEQ ID NO: 130737 - DNA, 20 bp, Artificial Sequence
  Description of Artificial Sequence: Synthetic oligonucleotide
  Target: ATXN1; (+) strand; PAM type: NRG; PAM sequence: CAG
ctgcagggcccagctcctct

SEQ ID NO: 130738 - DNA, 20 bp, Artificial Sequence
  Description of Artificial Sequence: Synthetic oligonucleotide
  Target: ATXN1; (+) strand; PAM type: NRG; PAM sequence: TGG
ctcctctcagacacccgtct

SEQ ID NO: 130739 - DNA, 20 bp, Artificial Sequence
  Description of Artificial Sequence: Synthetic oligonucleotide
  Target: ATXN1; (+) strand; PAM type: NRG; PAM sequence: GAG
cctctcagacacccgtcttg

SEQ ID NO: 130740 - DNA, 20 bp, Artificial Sequence
  Description of Artificial Sequence: Synthetic oligonucleotide
  Target: ATXN1; (+) strand; PAM type: NRG; PAM sequence: AGG
ctctcagacacccgtcttgg

SEQ ID NO: 130741 - DNA, 20 bp, Artificial Sequence
  Description of Artificial Sequence: Synthetic oligonucleotide
  Target: ATXN1; (+) strand; PAM type: NRG; PAM sequence: GAG
ctcagacacccgtcttggag

SEQ ID NO: 130742 - DNA, 20 bp, Artificial Sequence
  Description of Artificial Sequence: Synthetic oligonucleotide
  Target: ATXN1; (+) strand; PAM type: NRG; PAM sequence: AGG
tcagacacccgtcttggagg

SEQ ID NO: 130743 - DNA, 20 bp, Artificial Sequence
  Description of Artificial Sequence: Synthetic oligonucleotide
  Target: ATXN1; (+) strand; PAM type: NRG; PAM sequence: TAG
acacccgtcttggaggaggt

SEQ ID NO: 130744 - DNA, 20 bp, Artificial Sequence
  Description of Artificial Sequence: Synthetic oligonucleotide
  Target: ATXN1; (+) strand; PAM type: NRG; PAM sequence: AAG
cccgtcttggaggaggttag

SEQ ID NO: 130745 - DNA, 20 bp, Artificial Sequence
  Description of Artificial Sequence: Synthetic oligonucleotide
  Target: ATXN1; (+) strand; PAM type: NRG; PAM sequence: GAG
cgtcttggaggaggttagaa

SEQ ID NO: 130746 - DNA, 20 bp, Artificial Sequence
  Description of Artificial Sequence: Synthetic oligonucleotide
  Target: ATXN1; (+) strand; PAM type: NRG; PAM sequence: CAG
gaggaggttagaagagtgtt

SEQ ID NO: 130747 - DNA, 20 bp, Artificial Sequence
  Description of Artificial Sequence: Synthetic oligonucleotide
  Target: ATXN1; (+) strand; PAM type: NRG; PAM sequence: AGG
aggaggttagaagagtgttc

SEQ ID NO: 130748 - DNA, 20 bp, Artificial Sequence
  Description of Artificial Sequence: Synthetic oligonucleotide
  Target: ATXN1; (+) strand; PAM type: NRG; PAM sequence: GGG
ggaggttagaagagtgttca

SEQ ID NO: 130749 - DNA, 20 bp, Artificial Sequence
  Description of Artificial Sequence: Synthetic oligonucleotide
  Target: ATXN1; (+) strand; PAM type: NRG; PAM sequence: TGG
tagaagagtgttcagggtaa

SEQ ID NO: 130750 - DNA, 20 bp, Artificial Sequence
  Description of Artificial Sequence: Synthetic oligonucleotide
  Target: ATXN1; (+) strand; PAM type: NRG; PAM sequence: GGG
agaagagtgttcagggtaat

SEQ ID NO: 130751 - DNA, 20 bp, Artificial Sequence
  Description of Artificial Sequence: Synthetic oligonucleotide
  Target: ATXN1; (+) strand; PAM type: NRG; PAM sequence: CAG
gagtgttcagggtaatgggc

SEQ ID NO: 130752 - DNA, 20 bp, Artificial Sequence
  Description of Artificial Sequence: Synthetic oligonucleotide
  Target: ATXN1; (+) strand; PAM type: NRG; PAM sequence: CAG
ccagcaacactaaaatgtcc

SEQ ID NO: 130753 - DNA, 20 bp, Artificial Sequence
  Description of Artificial Sequence: Synthetic oligonucleotide
  Target: ATXN1; (+) strand; PAM type: NRG; PAM sequence: AAG
aaatgtcccagactccaatg

SEQ ID NO: 130754 - DNA, 20 bp, Artificial Sequence
  Description of Artificial Sequence: Synthetic oligonucleotide
  Target: ATXN1; (+) strand; PAM type: NRG; PAM sequence: CAG
ttctcattctaccactcctg

SEQ ID NO: 130755 - DNA, 20 bp, Artificial Sequence
  Description of Artificial Sequence: Synthetic oligonucleotide
  Target: ATXN1; (+) strand; PAM type: NRG; PAM sequence: GAG
ctcattctaccactcctgca

SEQ ID NO: 130756 - DNA, 20 bp, Artificial Sequence
  Description of Artificial Sequence: Synthetic oligonucleotide
  Target: ATXN1; (+) strand; PAM type: NRG; PAM sequence: TAG
cactcctgcagagattcttg

SEQ ID NO: 130757 - DNA, 20 bp, Artificial Sequence
  Description of Artificial Sequence: Synthetic oligonucleotide
  Target: ATXN1; (+) strand; PAM type: NRG; PAM sequence: TGG
agattcttgtagcaaatccc

SEQ ID NO: 130758 - DNA, 20 bp, Artificial Sequence
  Description of Artificial Sequence: Synthetic oligonucleotide
  Target: ATXN1; (+) strand; PAM type: NRG; PAM sequence: GGG
gattcttgtagcaaatccct

SEQ ID NO: 130759 - DNA, 20 bp, Artificial Sequence
  Description of Artificial Sequence: Synthetic oligonucleotide
  Target: ATXN1; (+) strand; PAM type: NRG; PAM sequence: AAG
ggtttttcaccttgcctgtc

SEQ ID NO: 130760 - DNA, 20 bp, Artificial Sequence
  Description of Artificial Sequence: Synthetic oligonucleotide
  Target: ATXN1; (+) strand; PAM type: NRG; PAM sequence: AAG
caacttttttgattcccttg

SEQ ID NO: 130761 - DNA, 20 bp, Artificial Sequence
  Description of Artificial Sequence: Synthetic oligonucleotide
  Target: ATXN1; (+) strand; PAM type: NRG; PAM sequence: CAG
gattcccttgaagacacatt

SEQ ID NO: 130762 - DNA, 20 bp, Artificial Sequence
  Description of Artificial Sequence: Synthetic oligonucleotide
  Target: ATXN1; (+) strand; PAM type: NRG; PAM sequence: AAG
agacacattcagcatcacaa

SEQ ID NO: 130763 - DNA, 20 bp, Artificial Sequence
  Description of Artificial Sequence: Synthetic oligonucleotide
  Target: ATXN1; (+) strand; PAM type: NRG; PAM sequence: GAG
acacattcagcatcacaaaa

SEQ ID NO: 130764 - DNA, 20 bp, Artificial Sequence
  Description of Artificial Sequence: Synthetic oligonucleotide
  Target: ATXN1; (+) strand; PAM type: NRG; PAM sequence: AGG
cacattcagcatcacaaaag

SEQ ID NO: 130765 - DNA, 20 bp, Artificial Sequence
  Description of Artificial Sequence: Synthetic oligonucleotide
  Target: ATXN1; (+) strand; PAM type: NRG; PAM sequence: TGG
attcagcatcacaaaagagg

SEQ ID NO: 130766 - DNA, 20 bp, Artificial Sequence
  Description of Artificial Sequence: Synthetic oligonucleotide
  Target: ATXN1; (+) strand; PAM type: NRG; PAM sequence: AAG
gcatcacaaaagaggtggta

SEQ ID NO: 130767 - DNA, 20 bp, Artificial Sequence
  Description of Artificial Sequence: Synthetic oligonucleotide
  Target: ATXN1; (+) strand; PAM type: NRG; PAM sequence: TAG
cccccaattatgaccatttt

SEQ ID NO: 130768 - DNA, 20 bp, Artificial Sequence
  Description of Artificial Sequence: Synthetic oligonucleotide
  Target: ATXN1; (+) strand; PAM type: NRG; PAM sequence: CAG
tatgaccatttttagcatca

SEQ ID NO: 130769 - DNA, 20 bp, Artificial Sequence
  Description of Artificial Sequence: Synthetic oligonucleotide
  Target: ATXN1; (+) strand; PAM type: NRG; PAM sequence: TGG
attttccactgtccacctga

SEQ ID NO: 130770 - DNA, 20 bp, Artificial Sequence
  Description of Artificial Sequence: Synthetic oligonucleotide
  Target: ATXN1; (+) strand; PAM type: NRG; PAM sequence: CGG
ccactgtccacctgatggac

SEQ ID NO: 130771 - DNA, 20 bp, Artificial Sequence
  Description of Artificial Sequence: Synthetic oligonucleotide
  Target: ATXN1; (+) strand; PAM type: NRG; PAM sequence: GAG
actgtccacctgatggaccg

SEQ ID NO: 130772 - DNA, 20 bp, Artificial Sequence
  Description of Artificial Sequence: Synthetic oligonucleotide
  Target: ATXN1; (+) strand; PAM type: NRG; PAM sequence: AGG
ctgtccacctgatggaccgg

SEQ ID NO: 130773 - DNA, 20 bp, Artificial Sequence
  Description of Artificial Sequence: Synthetic oligonucleotide
  Target: ATXN1; (+) strand; PAM type: NRG; PAM sequence: GGG
tgtccacctgatggaccgga

SEQ ID NO: 130774 - DNA, 20 bp, Artificial Sequence
  Description of Artificial Sequence: Synthetic oligonucleotide
  Target: ATXN1; (+) strand; PAM type: NRG; PAM sequence: AAG
acctgatggaccggagggca

SEQ ID NO: 130775 - DNA, 20 bp, Artificial Sequence
  Description of Artificial Sequence: Synthetic oligonucleotide
  Target: ATXN1; (+) strand; PAM type: NRG; PAM sequence: TGG
gatggaccggagggcaaagc

SEQ ID NO: 130776 - DNA, 20 bp, Artificial Sequence
  Description of Artificial Sequence: Synthetic oligonucleotide
  Target: ATXN1; (+) strand; PAM type: NRG; PAM sequence: CAG
gcaaagctggctgaaattca

SEQ ID NO: 130777 - DNA, 20 bp, Artificial Sequence
  Description of Artificial Sequence: Synthetic oligonucleotide
  Target: ATXN1; (+) strand; PAM type: NRG; PAM sequence: AGG
caaagctggctgaaattcac

SEQ ID NO: 130778 - DNA, 20 bp, Artificial Sequence
  Description of Artificial Sequence: Synthetic oligonucleotide
  Target: ATXN1; (+) strand; PAM type: NRG; PAM sequence: TAG
aggtaatcccaactttattt

SEQ ID NO: 130779 - DNA, 20 bp, Artificial Sequence
  Description of Artificial Sequence: Synthetic oligonucleotide
  Target: ATXN1; (+) strand; PAM type: NRG; PAM sequence: TAG
gttcctttcttctttgttca

SEQ ID NO: 130780 - DNA, 20 bp, Artificial Sequence
  Description of Artificial Sequence: Synthetic oligonucleotide
  Target: ATXN1; (+) strand; PAM type: NRG; PAM sequence: AGG
ttcctttcttctttgttcat

SEQ ID NO: 130781 - DNA, 20 bp, Artificial Sequence
  Description of Artificial Sequence: Synthetic oligonucleotide
  Target: ATXN1; (+) strand; PAM type: NRG; PAM sequence: GAG
cctttcttctttgttcatag

SEQ ID NO: 130782 - DNA, 20 bp, Artificial Sequence
  Description of Artificial Sequence: Synthetic oligonucleotide
  Target: ATXN1; (+) strand; PAM type: NRG; PAM sequence: TGG
ttgttcataggagaacaaaa

SEQ ID NO: 130783 - DNA, 20 bp, Artificial Sequence
  Description of Artificial Sequence: Synthetic oligonucleotide
  Target: ATXN1; (+) strand; PAM type: NRG; PAM sequence: GGG
tgttcataggagaacaaaat

SEQ ID NO: 130784 - DNA, 20 bp, Artificial Sequence
  Description of Artificial Sequence: Synthetic oligonucleotide
  Target: ATXN1; (+) strand; PAM type: NRG; PAM sequence: GAG
ttcataggagaacaaaatgg

SEQ ID NO: 130785 - DNA, 20 bp, Artificial Sequence
  Description of Artificial Sequence: Synthetic oligonucleotide
  Target: ATXN1; (+) strand; PAM type: NRG; PAM sequence: TAG
caaaatgggagtgatgtaat

SEQ ID NO: 130786 - DNA, 20 bp, Artificial Sequence
  Description of Artificial Sequence: Synthetic oligonucleotide
  Target: ATXN1; (+) strand; PAM type: NRG; PAM sequence: TGG
aatgggagtgatgtaattag

SEQ ID NO: 130787 - DNA, 20 bp, Artificial Sequence
  Description of Artificial Sequence: Synthetic oligonucleotide
  Target: ATXN1; (+) strand; PAM type: NRG; PAM sequence: GAG
tgggagtgatgtaattagtg

SEQ ID NO: 130788 - DNA, 20 bp, Artificial Sequence
  Description of Artificial Sequence: Synthetic oligonucleotide
  Target: ATXN1; (+) strand; PAM type: NRG; PAM sequence: TGG
gatgtaattagtggagacaa

SEQ ID NO: 130789 - DNA, 20 bp, Artificial Sequence
  Description of Artificial Sequence: Synthetic oligonucleotide
  Target: ATXN1; (+) strand; PAM type: NRG; PAM sequence: GGG
atgtaattagtggagacaat

SEQ ID NO: 130790 - DNA, 20 bp, Artificial Sequence
  Description of Artificial Sequence: Synthetic oligonucleotide
  Target: ATXN1; (+) strand; PAM type: NRG; PAM sequence: GAG
gtaattagtggagacaatgg

SEQ ID NO: 130791 - DNA, 20 bp, Artificial Sequence
  Description of Artificial Sequence: Synthetic oligonucleotide
  Target: ATXN1; (+) strand; PAM type: NRG; PAM sequence: GAG
ttagtggagacaatgggagt

SEQ ID NO: 130792 - DNA, 20 bp, Artificial Sequence
  Description of Artificial Sequence: Synthetic oligonucleotide
  Target: ATXN1; (+) strand; PAM type: NRG; PAM sequence: TAG
agacaatgggagtgagtaat

SEQ ID NO: 130793 - DNA, 20 bp, Artificial Sequence
  Description of Artificial Sequence: Synthetic oligonucleotide
  Target: ATXN1; (+) strand; PAM type: NRG; PAM sequence: TAG
agtgtgctttgtatacaatg

SEQ ID NO: 130794 - DNA, 20 bp, Artificial Sequence
  Description of Artificial Sequence: Synthetic oligonucleotide
  Target: ATXN1; (+) strand; PAM type: NRG; PAM sequence: GAG
tgtgctttgtatacaatgta

SEQ ID NO: 130795 - DNA, 20 bp, Artificial Sequence
  Description of Artificial Sequence: Synthetic oligonucleotide
  Target: ATXN1; (+) strand; PAM type: NRG; PAM sequence: AAG
ctattgaaaaataaaataaa

SEQ ID NO: 130796 - DNA, 20 bp, Artificial Sequence
  Description of Artificial Sequence: Synthetic oligonucleotide
  Target: ATXN1; (+) strand; PAM type: NRG; PAM sequence: AAG
ttttatgaaatattctataa

SEQ ID NO: 130797 - DNA, 20 bp, Artificial Sequence
  Description of Artificial Sequence: Synthetic oligonucleotide
  Target: ATXN1; (+) strand; PAM type: NRG; PAM sequence: CAG
atgaaatattctataaaagt

SEQ ID NO: 130798 - DNA, 20 bp, Artificial Sequence
  Description of Artificial Sequence: Synthetic oligonucleotide
  Target: ATXN1; (+) strand; PAM type: NRG; PAM sequence: AGG
tgaaatattctataaaagtc

SEQ ID NO: 130799 - DNA, 20 bp, Artificial Sequence
  Description of Artificial Sequence: Synthetic oligonucleotide
  Target: ATXN1; (+) strand; PAM type: NRG; PAM sequence: CAG
taaaagtcaggcttcctacc

SEQ ID NO: 130800 - DNA, 20 bp, Artificial Sequence
  Description of Artificial Sequence: Synthetic oligonucleotide
  Target: ATXN1; (+) strand; PAM type: NRG; PAM sequence: CGG
cttcctacccagatgacctt

SEQ ID NO: 130801 - DNA, 20 bp, Artificial Sequence
  Description of Artificial Sequence: Synthetic oligonucleotide
  Target: ATXN1; (+) strand; PAM type: NRG; PAM sequence: TGG
tctctgaatccctgatgcct

SEQ ID NO: 130802 - DNA, 20 bp, Artificial Sequence
  Description of Artificial Sequence: Synthetic oligonucleotide
  Target: ATXN1; (+) strand; PAM type: NRG; PAM sequence: GGG
ctctgaatccctgatgcctt

SEQ ID NO: 130803 - DNA, 20 bp, Artificial Sequence
  Description of Artificial Sequence: Synthetic oligonucleotide
  Target: ATXN1; (+) strand; PAM type: NRG; PAM sequence: CAG
tccctgatgccttgggtatc

SEQ ID NO: 130804 - DNA, 20 bp, Artificial Sequence
  Description of Artificial Sequence: Synthetic oligonucleotide
  Target: ATXN1; (+) strand; PAM type: NRG; PAM sequence: CAG
tgccttgggtatccagtatg

SEQ ID NO: 130805 - DNA, 20 bp, Artificial Sequence
  Description of Artificial Sequence: Synthetic oligonucleotide
  Target: ATXN1; (+) strand; PAM type: NRG; PAM sequence: AAG
gtatgcagtatatctgatac

SEQ ID NO: 130806 - DNA, 20 bp, Artificial Sequence
  Description of Artificial Sequence: Synthetic oligonucleotide
  Target: ATXN1; (+) strand; PAM type: NRG; PAM sequence: GAG
atgcagtatatctgatacaa

SEQ ID NO: 130807 - DNA, 20 bp, Artificial Sequence
  Description of Artificial Sequence: Synthetic oligonucleotide
  Target: ATXN1; (+) strand; PAM type: NRG; PAM sequence: TGG
gtatatctgatacaagagat

SEQ ID NO: 130808 - DNA, 20 bp, Artificial Sequence
  Description of Artificial Sequence: Synthetic oligonucleotide
  Target: ATXN1; (+) strand; PAM type: NRG; PAM sequence: GAG
atatctgatacaagagattg

SEQ ID NO: 130809 - DNA, 20 bp, Artificial Sequence
  Description of Artificial Sequence: Synthetic oligonucleotide
  Target: ATXN1; (+) strand; PAM type: NRG; PAM sequence: AGG
tatctgatacaagagattgg

SEQ ID NO: 130810 - DNA, 20 bp, Artificial Sequence
  Description of Artificial Sequence: Synthetic oligonucleotide
  Target: ATXN1; (+) strand; PAM type: NRG; PAM sequence: GAG
caagagattggaggatccat

SEQ ID NO: 130811 - DNA, 20 bp, Artificial Sequence
  Description of Artificial Sequence: Synthetic oligonucleotide
  Target: ATXN1; (+) strand; PAM type: NRG; PAM sequence: TGG
gaggatccatgagttcattc

SEQ ID NO: 130812 - DNA, 20 bp, Artificial Sequence
  Description of Artificial Sequence: Synthetic oligonucleotide
  Target: ATXN1; (+) strand; PAM type: NRG; PAM sequence: GGG
aggatccatgagttcattct

SEQ ID NO: 130813 - DNA, 20 bp, Artificial Sequence
  Description of Artificial Sequence: Synthetic oligonucleotide
  Target: ATXN1; (+) strand; PAM type: NRG; PAM sequence: TAG
tgagttcattctgggctgta

SEQ ID NO: 130814 - DNA, 20 bp, Artificial Sequence
  Description of Artificial Sequence: Synthetic oligonucleotide
  Target: ATXN1; (+) strand; PAM type: NRG; PAM sequence: AAG
aacactcattgctattttcc

SEQ ID NO: 130815 - DNA, 20 bp, Artificial Sequence
  Description of Artificial Sequence: Synthetic oligonucleotide
  Target: ATXN1; (+) strand; PAM type: NRG; PAM sequence: GAG
cattgctattttccaagctt

SEQ ID NO: 130816 - DNA, 20 bp, Artificial Sequence
  Description of Artificial Sequence: Synthetic oligonucleotide
  Target: ATXN1; (+) strand; PAM type: NRG; PAM sequence: TGG
ctatctgattaactgcaaaa

SEQ ID NO: 130817 - DNA, 20 bp, Artificial Sequence
  Description of Artificial Sequence: Synthetic oligonucleotide
  Target: ATXN1; (+) strand; PAM type: NRG; PAM sequence: GAG
taactgcaaaatggtgcact

SEQ ID NO: 130818 - DNA, 20 bp, Artificial Sequence
  Description of Artificial Sequence: Synthetic oligonucleotide
  Target: ATXN1; (+) strand; PAM type: NRG; PAM sequence: CAG
tgataatatttttgcaatta

SEQ ID NO: 130819 - DNA, 20 bp, Artificial Sequence
  Description of Artificial Sequence: Synthetic oligonucleotide
  Target: ATXN1; (+) strand; PAM type: NRG; PAM sequence: AGG
gataatatttttgcaattac

SEQ ID NO: 130820 - DNA, 20 bp, Artificial Sequence
  Description of Artificial Sequence: Synthetic oligonucleotide
  Target: ATXN1; (+) strand; PAM type: NRG; PAM sequence: GAG
taatatttttgcaattacag

SEQ ID NO: 130821 - DNA, 20 bp, Artificial Sequence
  Description of Artificial Sequence: Synthetic oligonucleotide
  Target: ATXN1; (+) strand; PAM type: NRG; PAM sequence: TGG
attacaggagttaattattt

SEQ ID NO: 130822 - DNA, 20 bp, Artificial Sequence
  Description of Artificial Sequence: Synthetic oligonucleotide
  Target: ATXN1; (+) strand; PAM type: NRG; PAM sequence: CAG
aggagttaattattttggtt

SEQ ID NO: 130823 - DNA, 20 bp, Artificial Sequence
  Description of Artificial Sequence: Synthetic oligonucleotide
  Target: ATXN1; (+) strand; PAM type: NRG; PAM sequence: CAG
ctctcccacccacctctcca

SEQ ID NO: 130824 - DNA, 20 bp, Artificial Sequence
  Description of Artificial Sequence: Synthetic oligonucleotide
  Target: ATXN1; (+) strand; PAM type: NRG; PAM sequence: AAG
ctccacagatacattttgct

SEQ ID NO: 130825 - DNA, 20 bp, Artificial Sequence
  Description of Artificial Sequence: Synthetic oligonucleotide
  Target: ATXN1; (+) strand; PAM type: NRG; PAM sequence: TGG
taagttttgcttttcttcat

SEQ ID NO: 130826 - DNA, 20 bp, Artificial Sequence
  Description of Artificial Sequence: Synthetic oligonucleotide
  Target: ATXN1; (+) strand; PAM type: NRG; PAM sequence: TGG
tcttcattggtaaataaaaa

SEQ ID NO: 130827 - DNA, 20 bp, Artificial Sequence
  Description of Artificial Sequence: Synthetic oligonucleotide
  Target: ATXN1; (+) strand; PAM type: NRG; PAM sequence: GGG
cttcattggtaaataaaaat

SEQ ID NO: 130828 - DNA, 20 bp, Artificial Sequence
  Description of Artificial Sequence: Synthetic oligonucleotide
  Target: ATXN1; (+) strand; PAM type: NRG; PAM sequence: AAG
aaaatgggacattcaccaac

SEQ ID NO: 130829 - DNA, 20 bp, Artificial Sequence
  Description of Artificial Sequence: Synthetic oligonucleotide
  Target: ATXN1; (+) strand; PAM type: NRG; PAM sequence: TAG
cattcaccaacaagttccca

SEQ ID NO: 130830 - DNA, 20 bp, Artificial Sequence
  Description of Artificial Sequence: Synthetic oligonucleotide
  Target: ATXN1; (+) strand; PAM type: NRG; PAM sequence: GAG
ttcaccaacaagttcccata

SEQ ID NO: 130831 - DNA, 20 bp, Artificial Sequence
  Description of Artificial Sequence: Synthetic oligonucleotide
  Target: ATXN1; (+) strand; PAM type: NRG; PAM sequence: TAG
tacttttcactcctttcatt

SEQ ID NO: 130832 - DNA, 20 bp, Artificial Sequence
  Description of Artificial Sequence: Synthetic oligonucleotide
  Target: ATXN1; (+) strand; PAM type: NRG; PAM sequence: AAG
acacaatatttactgtgttt

SEQ ID NO: 130833 - DNA, 20 bp, Artificial Sequence
  Description of Artificial Sequence: Synthetic oligonucleotide
  Target: ATXN1; (+) strand; PAM type: NRG; PAM sequence: AGG
cacaatatttactgtgttta

SEQ ID NO: 130834 - DNA, 20 bp, Artificial Sequence
  Description of Artificial Sequence: Synthetic oligonucleotide
  Target: ATXN1; (+) strand; PAM type: NRG; PAM sequence: CAG
atatttactgtgtttaagga

SEQ ID NO: 130835 - DNA, 20 bp, Artificial Sequence
  Description of Artificial Sequence: Synthetic oligonucleotide
  Target: ATXN1; (+) strand; PAM type: NRG; PAM sequence: AGG
tatttactgtgtttaaggac

SEQ ID NO: 130836 - DNA, 20 bp, Artificial Sequence
  Description of Artificial Sequence: Synthetic oligonucleotide
  Target: ATXN1; (+) strand; PAM type: NRG; PAM sequence: GGG
atttactgtgtttaaggaca

SEQ ID NO: 130837 - DNA, 20 bp, Artificial Sequence
  Description of Artificial Sequence: Synthetic oligonucleotide
  Target: ATXN1; (+) strand; PAM type: NRG; PAM sequence: GGG
tttactgtgtttaaggacag

SEQ ID NO: 130838 - DNA, 20 bp, Artificial Sequence
  Description of Artificial Sequence: Synthetic oligonucleotide
  Target: ATXN1; (+) strand; PAM type: NRG; PAM sequence: GAG
ttctcaatatactgtctcat

SEQ ID NO: 130839 - DNA, 20 bp, Artificial Sequence
  Description of Artificial Sequence: Synthetic oligonucleotide
  Target: ATXN1; (+) strand; PAM type: NRG; PAM sequence: TAG
tatactgtctcatgagtaca

SEQ ID NO: 130840 - DNA, 20 bp, Artificial Sequence
  Description of Artificial Sequence: Synthetic oligonucleotide
  Target: ATXN1; (+) strand; PAM type: NRG; PAM sequence: AAG
ctcatgagtacatagtttaa

SEQ ID NO: 130841 - DNA, 20 bp, Artificial Sequence
  Description of Artificial Sequence: Synthetic oligonucleotide
  Target: ATXN1; (+) strand; PAM type: NRG; PAM sequence: AAG
caacaaataatttgaaaacc

SEQ ID NO: 130842 - DNA, 20 bp, Artificial Sequence
  Description of Artificial Sequence: Synthetic oligonucleotide
  Target: ATXN1; (+) strand; PAM type: NRG; PAM sequence: AAG
ataatttgaaaaccaagtaa

SEQ ID NO: 130843 - DNA, 20 bp, Artificial Sequence
  Description of Artificial Sequence: Synthetic oligonucleotide
  Target: ATXN1; (+) strand; PAM type: NRG; PAM sequence: AAG
tttgaaaaccaagtaaaagt

SEQ ID NO: 130844 - DNA, 20 bp, Artificial Sequence
  Description of Artificial Sequence: Synthetic oligonucleotide
  Target: ATXN1; (+) strand; PAM type: NRG; PAM sequence: AAG
aaaaccaagtaaaagtaaga

SEQ ID NO: 130845 - DNA, 20 bp, Artificial Sequence
  Description of Artificial Sequence: Synthetic oligonucleotide
  Target: ATXN1; (+) strand; PAM type: NRG; PAM sequence: AGG
aaaccaagtaaaagtaagaa

SEQ ID NO: 130846 - DNA, 20 bp, Artificial Sequence
  Description of Artificial Sequence: Synthetic oligonucleotide
  Target: ATXN1; (+) strand; PAM type: NRG; PAM sequence: TGG
gaaaggtcccattaaaaatg

SEQ ID NO: 130847 - DNA, 20 bp, Artificial Sequence
  Description of Artificial Sequence: Synthetic oligonucleotide
  Target: ATXN1; (+) strand; PAM type: NRG; PAM sequence: AAG
taaaaatgtggaccaaaaaa

SEQ ID NO: 130848 - DNA, 20 bp, Artificial Sequence
  Description of Artificial Sequence: Synthetic oligonucleotide
  Target: ATXN1; (+) strand; PAM type: NRG; PAM sequence: TGG
ccaaaaaaaagataacttcc

SEQ ID NO: 130849 - DNA, 20 bp, Artificial Sequence
  Description of Artificial Sequence: Synthetic oligonucleotide
  Target: ATXN1; (+) strand; PAM type: NRG; PAM sequence: GGG
caaaaaaaagataacttcct

SEQ ID NO: 130850 - DNA, 20 bp, Artificial Sequence
  Description of Artificial Sequence: Synthetic oligonucleotide
  Target: ATXN1; (+) strand; PAM type: NRG; PAM sequence: GGG
aaaaaaaagataacttcctg

SEQ ID NO: 130851 - DNA, 20 bp, Artificial Sequence
  Description of Artificial Sequence: Synthetic oligonucleotide
  Target: ATXN1; (+) strand; PAM type: NRG; PAM sequence: GAG
ataacttcctggggtcattt

SEQ ID NO: 130852 - DNA, 20 bp, Artificial Sequence
  Description of Artificial Sequence: Synthetic oligonucleotide
  Target: ATXN1; (+) strand; PAM type: NRG; PAM sequence: AAG
gtcatttgagattatgtcat

SEQ ID NO: 130853 - DNA, 20 bp, Artificial Sequence
  Description of Artificial Sequence: Synthetic oligonucleotide
  Target: ATXN1; (+) strand; PAM type: NRG; PAM sequence: AGG
tcatttgagattatgtcata

SEQ ID NO: 130854 - DNA, 20 bp, Artificial Sequence
  Description of Artificial Sequence: Synthetic oligonucleotide
  Target: ATXN1; (+) strand; PAM type: NRG; PAM sequence: GAG
atttgagattatgtcataag

SEQ ID NO: 130855 - DNA, 20 bp, Artificial Sequence
  Description of Artificial Sequence: Synthetic oligonucleotide
  Target: ATXN1; (+) strand; PAM type: NRG; PAM sequence: CAG
attatgtcataaggagaaca

SEQ ID NO: 130856 - DNA, 20 bp, Artificial Sequence
  Description of Artificial Sequence: Synthetic oligonucleotide
  Target: ATXN1; (+) strand; PAM type: NRG; PAM sequence: TGG
ggagaacacagaatttgatg

SEQ ID NO: 130857 - DNA, 20 bp, Artificial Sequence
  Description of Artificial Sequence: Synthetic oligonucleotide
  Target: ATXN1; (+) strand; PAM type: NRG; PAM sequence: TGG
cacagaatttgatgtggtcc

SEQ ID NO: 130858 - DNA, 20 bp, Artificial Sequence
  Description of Artificial Sequence: Synthetic oligonucleotide
  Target: ATXN1; (+) strand; PAM type: NRG; PAM sequence: AAG
aatttgatgtggtcctggaa

SEQ ID NO: 130859 - DNA, 20 bp, Artificial Sequence
  Description of Artificial Sequence: Synthetic oligonucleotide
  Target: ATXN1; (+) strand; PAM type: NRG; PAM sequence: TAG
tggtcctggaaaagaatata

SEQ ID NO: 130860 - DNA, 20 bp, Artificial Sequence
  Description of Artificial Sequence: Synthetic oligonucleotide
  Target: ATXN1; (+) strand; PAM type: NRG; PAM sequence: CAG
gaaaagaatatatagaaatg

SEQ ID NO: 130861 - DNA, 20 bp, Artificial Sequence
  Description of Artificial Sequence: Synthetic oligonucleotide
  Target: ATXN1; (+) strand; PAM type: NRG; PAM sequence: GAG
aaagaatatatagaaatgca

SEQ ID NO: 130862 - DNA, 20 bp, Artificial Sequence
  Description of Artificial Sequence: Synthetic oligonucleotide
  Target: ATXN1; (+) strand; PAM type: NRG; PAM sequence: GAG
agaatatatagaaatgcaga

SEQ ID NO: 130863 - DNA, 20 bp, Artificial Sequence
  Description of Artificial Sequence: Synthetic oligonucleotide
  Target: ATXN1; (+) strand; PAM type: NRG; PAM sequence: AGG
gaatatatagaaatgcagag

SEQ ID NO: 130864 - DNA, 20 bp, Artificial Sequence
  Description of Artificial Sequence: Synthetic oligonucleotide
  Target: ATXN1; (+) strand; PAM type: NRG; PAM sequence: GGG
aatatatagaaatgcagaga

SEQ ID NO: 130865 - DNA, 20 bp, Artificial Sequence
  Description of Artificial Sequence: Synthetic oligonucleotide
  Target: ATXN1; (+) strand; PAM type: NRG; PAM sequence: GGG
atatatagaaatgcagagag

SEQ ID NO: 130866 - DNA, 20 bp, Artificial Sequence
  Description of Artificial Sequence: Synthetic oligonucleotide
  Target: ATXN1; (+) strand; PAM type: NRG; PAM sequence: GAG
atatagaaatgcagagaggg

SEQ ID NO: 130867 - DNA, 20 bp, Artificial Sequence
  Description of Artificial Sequence: Synthetic oligonucleotide
  Target: ATXN1; (+) strand; PAM type: NRG; PAM sequence: AGG
tatagaaatgcagagagggg

SEQ ID NO: 130868 - DNA, 20 bp, Artificial Sequence
  Description of Artificial Sequence: Synthetic oligonucleotide
  Target: ATXN1; (+) strand; PAM type: NRG; PAM sequence: CAG
agaaatgcagagaggggagg

SEQ ID NO: 130869 - DNA, 20 bp, Artificial Sequence
  Description of Artificial Sequence: Synthetic oligonucleotide
  Target: ATXN1; (+) strand; PAM type: NRG; PAM sequence: AGG
gaaatgcagagaggggaggc

SEQ ID NO: 130870 - DNA, 20 bp, Artificial Sequence
  Description of Artificial Sequence: Synthetic oligonucleotide
  Target: ATXN1; (+) strand; PAM type: NRG; PAM sequence: GAG
aatgcagagaggggaggcag

SEQ ID NO: 130871 - DNA, 20 bp, Artificial Sequence
  Description of Artificial Sequence: Synthetic oligonucleotide
  Target: ATXN1; (+) strand; PAM type: NRG; PAM sequence: AGG
atgcagagaggggaggcagg

SEQ ID NO: 130872 - DNA, 20 bp, Artificial Sequence
  Description of Artificial Sequence: Synthetic oligonucleotide
  Target: ATXN1; (+) strand; PAM type: NRG; PAM sequence: TAG
gggaggcaggaggatgatcc

SEQ ID NO: 130873 - DNA, 20 bp, Artificial Sequence
  Description of Artificial Sequence: Synthetic oligonucleotide
  Target: ATXN1; (+) strand; PAM type: NRG; PAM sequence: AGG
ggaggcaggaggatgatcct

SEQ ID NO: 130874 - DNA, 20 bp, Artificial Sequence
  Description of Artificial Sequence: Synthetic oligonucleotide
  Target: ATXN1; (+) strand; PAM type: NRG; PAM sequence: AAG
aggaggatgatcctaggtga

SEQ ID NO: 130875 - DNA, 20 bp, Artificial Sequence
  Description of Artificial Sequence: Synthetic oligonucleotide
  Target: ATXN1; (+) strand; PAM type: NRG; PAM sequence: CAG
tgatcctaggtgaaagaaac

SEQ ID NO: 130876 - DNA, 20 bp, Artificial Sequence
  Description of Artificial Sequence: Synthetic oligonucleotide
  Target: ATXN1; (+) strand; PAM type: NRG; PAM sequence: GAG
atcctaggtgaaagaaacca

SEQ ID NO: 130877 - DNA, 20 bp, Artificial Sequence
  Description of Artificial Sequence: Synthetic oligonucleotide
  Target: ATXN1; (+) strand; PAM type: NRG; PAM sequence: CAG
gaaagaaaccagagatgcaa

SEQ ID NO: 130878 - DNA, 20 bp, Artificial Sequence
  Description of Artificial Sequence: Synthetic oligonucleotide
  Target: ATXN1; (+) strand; PAM type: NRG; PAM sequence: AAG
agaaaccagagatgcaacag

SEQ ID NO: 130879 - DNA, 20 bp, Artificial Sequence
  Description of Artificial Sequence: Synthetic oligonucleotide
  Target: ATXN1; (+) strand; PAM type: NRG; PAM sequence: CAG
aaccagagatgcaacagaag

SEQ ID NO: 130880 - DNA, 20 bp, Artificial Sequence
  Description of Artificial Sequence: Synthetic oligonucleotide
  Target: ATXN1; (+) strand; PAM type: NRG; PAM sequence: AAG
tgcaacagaagcagaaaacc

SEQ ID NO: 130881 - DNA, 20 bp, Artificial Sequence
  Description of Artificial Sequence: Synthetic oligonucleotide
  Target: ATXN1; (+) strand; PAM type: NRG; PAM sequence: AGG
gcaacagaagcagaaaacca

SEQ ID NO: 130882 - DNA, 20 bp, Artificial Sequence
  Description of Artificial Sequence: Synthetic oligonucleotide
  Target: ATXN1; (+) strand; PAM type: NRG; PAM sequence: GGG
caacagaagcagaaaaccaa

SEQ ID NO: 130883 - DNA, 20 bp, Artificial Sequence
  Description of Artificial Sequence: Synthetic oligonucleotide
  Target: ATXN1; (+) strand; PAM type: NRG; PAM sequence: GAG
acagaagcagaaaaccaagg

SEQ ID NO: 130884 - DNA, 20 bp, Artificial Sequence
  Description of Artificial Sequence: Synthetic oligonucleotide
  Target: ATXN1; (+) strand; PAM type: NRG; PAM sequence: GAG
gcagaaaaccaagggagctt

SEQ ID NO: 130885 - DNA, 20 bp, Artificial Sequence
  Description of Artificial Sequence: Synthetic oligonucleotide
  Target: ATXN1; (+) strand; PAM type: NRG; PAM sequence: AGG
cagaaaaccaagggagcttg

SEQ ID NO: 130886 - DNA, 20 bp, Artificial Sequence
  Description of Artificial Sequence: Synthetic oligonucleotide
  Target: ATXN1; (+) strand; PAM type: NRG; PAM sequence: GAG
accaagggagcttgaggtgt

SEQ ID NO: 130887 - DNA, 20 bp, Artificial Sequence
  Description of Artificial Sequence: Synthetic oligonucleotide
  Target: ATXN1; (+) strand; PAM type: NRG; PAM sequence: GAG
caagggagcttgaggtgtga

SEQ ID NO: 130888 - DNA, 20 bp, Artificial Sequence
  Description of Artificial Sequence: Synthetic oligonucleotide
  Target: ATXN1; (+) strand; PAM type: NRG; PAM sequence: AGG
aagggagcttgaggtgtgag

SEQ ID NO: 130889 - DNA, 20 bp, Artificial Sequence
  Description of Artificial Sequence: Synthetic oligonucleotide
  Target: ATXN1; (+) strand; PAM type: NRG; PAM sequence: TGG
gaggaacatgtatataatta

SEQ ID NO: 130890 - DNA, 20 bp, Artificial Sequence
  Description of Artificial Sequence: Synthetic oligonucleotide
  Target: ATXN1; (+) strand; PAM type: NRG; PAM sequence: GGG
aggaacatgtatataattat

SEQ ID NO: 130891 - DNA, 20 bp, Artificial Sequence
  Description of Artificial Sequence: Synthetic oligonucleotide
  Target: ATXN1; (+) strand; PAM type: NRG; PAM sequence: GGG
ggaacatgtatataattatg

SEQ ID NO: 130892 - DNA, 20 bp, Artificial Sequence
  Description of Artificial Sequence: Synthetic oligonucleotide
  Target: ATXN1; (+) strand; PAM type: NRG; PAM sequence: AAG
acatgtatataattatgggg

SEQ ID NO: 130893 - DNA, 20 bp, Artificial Sequence
  Description of Artificial Sequence: Synthetic oligonucleotide
  Target: ATXN1; (+) strand; PAM type: NRG; PAM sequence: TGG
tatataattatggggaagcc

SEQ ID NO: 130894 - DNA, 20 bp, Artificial Sequence
  Description of Artificial Sequence: Synthetic oligonucleotide
  Target: ATXN1; (+) strand; PAM type: NRG; PAM sequence: GGG
atataattatggggaagcct

SEQ ID NO: 130895 - DNA, 20 bp, Artificial Sequence
  Description of Artificial Sequence: Synthetic oligonucleotide
  Target: ATXN1; (+) strand; PAM type: NRG; PAM sequence: GAG
ggggaagcctgggctgcaat

SEQ ID NO: 130896 - DNA, 20 bp, Artificial Sequence
  Description of Artificial Sequence: Synthetic oligonucleotide
  Target: ATXN1; (+) strand; PAM type: NRG; PAM sequence: AAG
aagcctgggctgcaatgagt

SEQ ID NO: 130897 - DNA, 20 bp, Artificial Sequence
  Description of Artificial Sequence: Synthetic oligonucleotide
  Target: ATXN1; (+) strand; PAM type: NRG; PAM sequence: AGG
agcctgggctgcaatgagta

SEQ ID NO: 130898 - DNA, 20 bp, Artificial Sequence
  Description of Artificial Sequence: Synthetic oligonucleotide
  Target: ATXN1; (+) strand; PAM type: NRG; PAM sequence: TAG
tgggctgcaatgagtaaggt

SEQ ID NO: 130899 - DNA, 20 bp, Artificial Sequence
  Description of Artificial Sequence: Synthetic oligonucleotide
  Target: ATXN1; (+) strand; PAM type: NRG; PAM sequence: AGG
gggctgcaatgagtaaggtt

SEQ ID NO: 130900 - DNA, 20 bp, Artificial Sequence
  Description of Artificial Sequence: Synthetic oligonucleotide
  Target: ATXN1; (+) strand; PAM type: NRG; PAM sequence: AAG
ctgcaatgagtaaggttagg

SEQ ID NO: 130901 - DNA, 20 bp, Artificial Sequence
  Description of Artificial Sequence: Synthetic oligonucleotide
  Target: ATXN1; (+) strand; PAM type: NRG; PAM sequence: AGG
tgcaatgagtaaggttagga

SEQ ID NO: 130902 - DNA, 20 bp, Artificial Sequence
  Description of Artificial Sequence: Synthetic oligonucleotide
  Target: ATXN1; (+) strand; PAM type: NRG; PAM sequence: TAG
aatgagtaaggttaggaagg

SEQ ID NO: 130903 - DNA, 20 bp, Artificial Sequence
  Description of Artificial Sequence: Synthetic oligonucleotide
  Target: ATXN1; (+) strand; PAM type: NRG; PAM sequence: AGG
atgagtaaggttaggaaggt

SEQ ID NO: 130904 - DNA, 20 bp, Artificial Sequence
  Description of Artificial Sequence: Synthetic oligonucleotide
  Target: ATXN1; (+) strand; PAM type: NRG; PAM sequence: AAG
taggaaggtaggctgtaacc

SEQ ID NO: 130905 - DNA, 20 bp, Artificial Sequence
  Description of Artificial Sequence: Synthetic oligonucleotide
  Target: ATXN1; (+) strand; PAM type: NRG; PAM sequence: CAG
accaagtcacaacactccct

SEQ ID NO: 130906 - DNA, 20 bp, Artificial Sequence
  Description of Artificial Sequence: Synthetic oligonucleotide
  Target: ATXN1; (+) strand; PAM type: NRG; PAM sequence: AGG
ccaagtcacaacactccctc

SEQ ID NO: 130907 - DNA, 20 bp, Artificial Sequence
  Description of Artificial Sequence: Synthetic oligonucleotide
  Target: ATXN1; (+) strand; PAM type: NRG; PAM sequence: TGG
cacaacactccctcaggacc

SEQ ID NO: 130908 - DNA, 20 bp, Artificial Sequence
  Description of Artificial Sequence: Synthetic oligonucleotide
  Target: ATXN1; (+) strand; PAM type: NRG; PAM sequence: AAG
aacactccctcaggacctgg

SEQ ID NO: 130909 - DNA, 20 bp, Artificial Sequence
  Description of Artificial Sequence: Synthetic oligonucleotide
  Target: ATXN1; (+) strand; PAM type: NRG; PAM sequence: AAG
aggacctggaagatgtaaac

SEQ ID NO: 130910 - DNA, 20 bp, Artificial Sequence
  Description of Artificial Sequence: Synthetic oligonucleotide
  Target: ATXN1; (+) strand; PAM type: NRG; PAM sequence: AGG
ggacctggaagatgtaaaca

SEQ ID NO: 130911 - DNA, 20 bp, Artificial Sequence
  Description of Artificial Sequence: Synthetic oligonucleotide
  Target: ATXN1; (+) strand; PAM type: NRG; PAM sequence: AAG
cctggaagatgtaaacaagg

SEQ ID NO: 130912 - DNA, 20 bp, Artificial Sequence
  Description of Artificial Sequence: Synthetic oligonucleotide
  Target: ATXN1; (+) strand; PAM type: NRG; PAM sequence: AAG
aagatgtaaacaaggaagaa

SEQ ID NO: 130913 - DNA, 20 bp, Artificial Sequence
  Description of Artificial Sequence: Synthetic oligonucleotide
  Target: ATXN1; (+) strand; PAM type: NRG; PAM sequence: TGG
atgtaaacaaggaagaaaag

SEQ ID NO: 130914 - DNA, 20 bp, Artificial Sequence
  Description of Artificial Sequence: Synthetic oligonucleotide
  Target: ATXN1; (+) strand; PAM type: NRG; PAM sequence: TAG
gaaaagtggttatacacact

SEQ ID NO: 130915 - DNA, 20 bp, Artificial Sequence
  Description of Artificial Sequence: Synthetic oligonucleotide
  Target: ATXN1; (+) strand; PAM type: NRG; PAM sequence: AGG
aaaagtggttatacacactt

SEQ ID NO: 130916 - DNA, 20 bp, Artificial Sequence
  Description of Artificial Sequence: Synthetic oligonucleotide
  Target: ATXN1; (+) strand; PAM type: NRG; PAM sequence: CAG
agtggttatacacacttagg

SEQ ID NO: 130917 - DNA, 20 bp, Artificial Sequence
  Description of Artificial Sequence: Synthetic oligonucleotide
  Target: ATXN1; (+) strand; PAM type: NRG; PAM sequence: AAG
cttaggcagaatctactttt

SEQ ID NO: 130918 - DNA, 20 bp, Artificial Sequence
  Description of Artificial Sequence: Synthetic oligonucleotide
  Target: ATXN1; (+) strand; PAM type: NRG; PAM sequence: AAG
cagaatctacttttaagaat

SEQ ID NO: 130919 - DNA, 20 bp, Artificial Sequence
  Description of Artificial Sequence: Synthetic oligonucleotide
  Target: ATXN1; (+) strand; PAM type: NRG; PAM sequence: AAG
cttttaagaataagtacgaa

SEQ ID NO: 130920 - DNA, 20 bp, Artificial Sequence
  Description of Artificial Sequence: Synthetic oligonucleotide
  Target: ATXN1; (+) strand; PAM type: NRG; PAM sequence: AGG
ttttaagaataagtacgaaa

SEQ ID NO: 130921 - DNA, 20 bp, Artificial Sequence
  Description of Artificial Sequence: Synthetic oligonucleotide
  Target: ATXN1; (+) strand; PAM type: NRG; PAM sequence: GGG
tttaagaataagtacgaaaa

SEQ ID NO: 130922 - DNA, 20 bp, Artificial Sequence
  Description of Artificial Sequence: Synthetic oligonucleotide
  Target: ATXN1; (+) strand; PAM type: NRG; PAM sequence: AAG
ataagtacgaaaagggacaa

SEQ ID NO: 130923 - DNA, 20 bp, Artificial Sequence
  Description of Artificial Sequence: Synthetic oligonucleotide
  Target: ATXN1; (+) strand; PAM type: NRG; PAM sequence: AAG
agtacgaaaagggacaaaag

SEQ ID NO: 130924 - DNA, 20 bp, Artificial Sequence
  Description of Artificial Sequence: Synthetic oligonucleotide
  Target: ATXN1; (+) strand; PAM type: NRG; PAM sequence: AGG
gtacgaaaagggacaaaaga

SEQ ID NO: 130925 - DNA, 20 bp, Artificial Sequence
  Description of Artificial Sequence: Synthetic oligonucleotide
  Target: ATXN1; (+) strand; PAM type: NRG; PAM sequence: AAG
cgaaaagggacaaaagaagg

SEQ ID NO: 130926 - DNA, 20 bp, Artificial Sequence
  Description of Artificial Sequence: Synthetic oligonucleotide
  Target: ATXN1; (+) strand; PAM type: NRG; PAM sequence: AAG
gacaaaagaaggaagacata

SEQ ID NO: 130927 - DNA, 20 bp, Artificial Sequence
  Description of Artificial Sequence: Synthetic oligonucleotide
  Target: ATXN1; (+) strand; PAM type: NRG; PAM sequence: AAG
aaaagaaggaagacataaag

SEQ ID NO: 130928 - DNA, 20 bp, Artificial Sequence
  Description of Artificial Sequence: Synthetic oligonucleotide
  Target: ATXN1; (+) strand; PAM type: NRG; PAM sequence: CAG
agacataaagaagaaatgat

SEQ ID NO: 130929 - DNA, 20 bp, Artificial Sequence
  Description of Artificial Sequence: Synthetic oligonucleotide
  Target: ATXN1; (+) strand; PAM type: NRG; PAM sequence: GAG
acataaagaagaaatgatca

SEQ ID NO: 130930 - DNA, 20 bp, Artificial Sequence
  Description of Artificial Sequence: Synthetic oligonucleotide
  Target: ATXN1; (+) strand; PAM type: NRG; PAM sequence: CAG
taaagaagaaatgatcagag

SEQ ID NO: 130931 - DNA, 20 bp, Artificial Sequence
  Description of Artificial Sequence: Synthetic oligonucleotide
  Target: ATXN1; (+) strand; PAM type: NRG; PAM sequence: TAG
agaagaaatgatcagagcag

SEQ ID NO: 130932 - DNA, 20 bp, Artificial Sequence
  Description of Artificial Sequence: Synthetic oligonucleotide
  Target: ATXN1; (+) strand; PAM type: NRG; PAM sequence: GAG
aagaaatgatcagagcagta

SEQ ID NO: 130933 - DNA, 20 bp, Artificial Sequence
  Description of Artificial Sequence: Synthetic oligonucleotide
  Target: ATXN1; (+) strand; PAM type: NRG; PAM sequence: AGG
agaaatgatcagagcagtag

SEQ ID NO: 130934 - DNA, 20 bp, Artificial Sequence
  Description of Artificial Sequence: Synthetic oligonucleotide
  Target: ATXN1; (+) strand; PAM type: NRG; PAM sequence: GGG
gaaatgatcagagcagtaga

SEQ ID NO: 130935 - DNA, 20 bp, Artificial Sequence
  Description of Artificial Sequence: Synthetic oligonucleotide
  Target: ATXN1; (+) strand; PAM type: NRG; PAM sequence: AAG
tgatcagagcagtagagggt

SEQ ID NO: 130936 - DNA, 20 bp, Artificial Sequence
  Description of Artificial Sequence: Synthetic oligonucleotide
  Target: ATXN1; (+) strand; PAM type: NRG; PAM sequence: GAG
atcagagcagtagagggtaa

SEQ ID NO: 130937 - DNA, 20 bp, Artificial Sequence
  Description of Artificial Sequence: Synthetic oligonucleotide
  Target: ATXN1; (+) strand; PAM type: NRG; PAM sequence: AAG
gtagagggtaagagaaaata

SEQ ID NO: 130938 - DNA, 20 bp, Artificial Sequence
  Description of Artificial Sequence: Synthetic oligonucleotide
  Target: ATXN1; (+) strand; PAM type: NRG; PAM sequence: AGG
tagagggtaagagaaaataa

SEQ ID NO: 130939 - DNA, 20 bp, Artificial Sequence
  Description of Artificial Sequence: Synthetic oligonucleotide
  Target: ATXN1; (+) strand; PAM type: NRG; PAM sequence: CAG
agggtaagagaaaataaagg

SEQ ID NO: 130940 - DNA, 20 bp, Artificial Sequence
  Description of Artificial Sequence: Synthetic oligonucleotide
  Target: ATXN1; (+) strand; PAM type: NRG; PAM sequence: AAG
agagaaaataaaggcagata

SEQ ID NO: 130941 - DNA, 20 bp, Artificial Sequence
  Description of Artificial Sequence: Synthetic oligonucleotide
  Target: ATXN1; (+) strand; PAM type: NRG; PAM sequence: GAG
agaaaataaaggcagataaa

SEQ ID NO: 130942 - DNA, 20 bp, Artificial Sequence
  Description of Artificial Sequence: Synthetic oligonucleotide
  Target: ATXN1; (+) strand; PAM type: NRG; PAM sequence: CAG
aggcagataaagagtgtttt

SEQ ID NO: 130943 - DNA, 20 bp, Artificial Sequence
  Description of Artificial Sequence: Synthetic oligonucleotide
  Target: ATXN1; (+) strand; PAM type: NRG; PAM sequence: TAG
agagtgttttcagaaacaaa

SEQ ID NO: 130944 - DNA, 20 bp, Artificial Sequence
  Description of Artificial Sequence: Synthetic oligonucleotide
  Target: ATXN1; (+) strand; PAM type: NRG; PAM sequence: AGG
gagtgttttcagaaacaaat

SEQ ID NO: 130945 - DNA, 20 bp, Artificial Sequence
  Description of Artificial Sequence: Synthetic oligonucleotide
  Target: ATXN1; (+) strand; PAM type: NRG; PAM sequence: CAG
cagaaacaaataggctgatg

SEQ ID NO: 130946 - DNA, 20 bp, Artificial Sequence
  Description of Artificial Sequence: Synthetic oligonucleotide
  Target: ATXN1; (+) strand; PAM type: NRG; PAM sequence: TGG
aaacaaataggctgatgcag

SEQ ID NO: 130947 - DNA, 20 bp, Artificial Sequence
  Description of Artificial Sequence: Synthetic oligonucleotide
  Target: ATXN1; (+) strand; PAM type: NRG; PAM sequence: CAG
gtggctcacacctgtaatcc

SEQ ID NO: 130948 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatcccagcactt

SEQ ID NO: 130949 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccagcacttt

SEQ ID NO: 130950 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 130951 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 130952 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggcc

SEQ ID NO: 130953 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggccg

SEQ ID NO: 130954 - DNA, 20 bp, Artificial Sequence
  Description of Artificial Sequence: Synthetic oligonucleotide
  Target: ATXN1; (+) strand; PAM type: NRG; PAM sequence: CAG
agcactttgggaggccgagg

SEQ ID NO: 130955 - DNA, 20 bp, Artificial Sequence
  Description of Artificial Sequence: Synthetic oligonucleotide
  Target: ATXN1; (+) strand; PAM type: NRG; PAM sequence: AGG
gcactttgggaggccgaggc

SEQ ID NO: 130956 - DNA, 20 bp, Artificial Sequence
  Description of Artificial Sequence: Synthetic oligonucleotide
  Target: ATXN1; (+) strand; PAM type: NRG; PAM sequence: CGG
ctttgggaggccgaggcagg

SEQ ID NO: 130957 - DNA, 20 bp, Artificial Sequence
  Description of Artificial Sequence: Synthetic oligonucleotide
  Target: ATXN1; (+) strand; PAM type: NRG; PAM sequence: GAG
ccgaggcaggcggattgctt

SEQ ID NO: 130958 - DNA, 20 bp, Artificial Sequence
  Description of Artificial Sequence: Synthetic oligonucleotide
  Target: ATXN1; (+) strand; PAM type: NRG; PAM sequence: CAG
gcaggcggattgcttgagct

SEQ ID NO: 130959 - DNA, 20 bp, Artificial Sequence
  Description of Artificial Sequence: Synthetic oligonucleotide
  Target: ATXN1; (+) strand; PAM type: NRG; PAM sequence: GAG
aggcggattgcttgagctca

SEQ ID NO: 130960 - DNA, 20 bp, Artificial Sequence
  Description of Artificial Sequence: Synthetic oligonucleotide
  Target: ATXN1; (+) strand; PAM type: NRG; PAM sequence: TGG
ggattgcttgagctcagagt

SEQ ID NO: 130961 - DNA, 20 bp, Artificial Sequence
  Description of Artificial Sequence: Synthetic oligonucleotide
  Target: ATXN1; (+) strand; PAM type: NRG; PAM sequence: GAG
attgcttgagctcagagttg

SEQ ID NO: 130962 - DNA, 20 bp, Artificial Sequence
  Description of Artificial Sequence: Synthetic oligonucleotide
  Target: ATXN1; (+) strand; PAM type: NRG; PAM sequence: CAG
ttgagctcagagttggagac

SEQ ID NO: 130963 - DNA, 20 bp, Artificial Sequence
  Description of Artificial Sequence: Synthetic oligonucleotide
  Target: ATXN1; (+) strand; PAM type: NRG; PAM sequence: TGG
ctcagagttggagaccagcc

SEQ ID NO: 130964 - DNA, 20 bp, Artificial Sequence
  Description of Artificial Sequence: Synthetic oligonucleotide
  Target: ATXN1; (+) strand; PAM type: NRG; PAM sequence: GGG
tcagagttggagaccagcct

SEQ ID NO: 130965 - DNA, 20 bp, Artificial Sequence
  Description of Artificial Sequence: Synthetic oligonucleotide
  Target: ATXN1; (+) strand; PAM type: NRG; PAM sequence: CAG
ggagaccagcctgggcaaca

SEQ ID NO: 130966 - DNA, 20 bp, Artificial Sequence
  Description of Artificial Sequence: Synthetic oligonucleotide
  Target: ATXN1; (+) strand; PAM type: NRG; PAM sequence: TAG
tctacaaaaaatacaaaaat

SEQ ID NO: 130967 - DNA, 20 bp, Artificial Sequence
  Description of Artificial Sequence: Synthetic oligonucleotide
  Target: ATXN1; (+) strand; PAM type: NRG; PAM sequence: CAG
caaaaaatacaaaaattagc

SEQ ID NO: 130968 - DNA, 20 bp, Artificial Sequence
  Description of Artificial Sequence: Synthetic oligonucleotide
  Target: ATXN1; (+) strand; PAM type: NRG; PAM sequence: AGG
aaaaaatacaaaaattagcc

SEQ ID NO: 130969 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagccaggtg

SEQ ID NO: 130970 - DNA, 20 bp, Artificial Sequence
  Description of Artificial Sequence: Synthetic oligonucleotide
  Target: ATXN1; (+) strand; PAM type: NRG; PAM sequence: TGG
caaaaattagccaggtgtgg

SEQ ID NO: 130971 - DNA, 20 bp, Artificial Sequence
  Description of Artificial Sequence: Synthetic oligonucleotide
  Target: ATXN1; (+) strand; PAM type: NRG; PAM sequence: TAG
ggtgtggtggcctgcacctg

SEQ ID NO: 130972 - DNA, 20 bp, Artificial Sequence
  Description of Artificial Sequence: Synthetic oligonucleotide
  Target: ATXN1; (+) strand; PAM type: NRG; PAM sequence: CAG
gtggcctgcacctgtagtcc

SEQ ID NO: 130973 - DNA, 20 bp, Artificial Sequence
  Description of Artificial Sequence: Synthetic oligonucleotide
  Target: ATXN1; (+) strand; PAM type: NRG; PAM sequence: TGG
cacctgtagtcccagctatt

SEQ ID NO: 130974 - DNA, 20 bp, Artificial Sequence
  Description of Artificial Sequence: Synthetic oligonucleotide
  Target: ATXN1; (+) strand; PAM type: NRG; PAM sequence: GGG
acctgtagtcccagctattt

SEQ ID NO: 130975 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagctatttgg

SEQ ID NO: 130976 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagctatttggg

SEQ ID NO: 130977 - DNA, 20 bp, Artificial Sequence
  Description of Artificial Sequence: Synthetic oligonucleotide
  Target: ATXN1; (+) strand; PAM type: NRG; PAM sequence: GAG
tcccagctatttgggaggct

SEQ ID NO: 130978 - DNA, 20 bp, Artificial Sequence
  Description of Artificial Sequence: Synthetic oligonucleotide
  Target: ATXN1; (+) strand; PAM type: NRG; PAM sequence: TGG
agctatttgggaggctgaga

SEQ ID NO: 130979 - DNA, 20 bp, Artificial Sequence
  Description of Artificial Sequence: Synthetic oligonucleotide
  Target: ATXN1; (+) strand; PAM type: NRG; PAM sequence: GGG
gctatttgggaggctgagat

SEQ ID NO: 130980 - DNA, 20 bp, Artificial Sequence
  Description of Artificial Sequence: Synthetic oligonucleotide
  Target: ATXN1; (+) strand; PAM type: NRG; PAM sequence: AAG
atttgggaggctgagatggg

SEQ ID NO: 130981 - DNA, 20 bp, Artificial Sequence
  Description of Artificial Sequence: Synthetic oligonucleotide
  Target: ATXN1; (+) strand; PAM type: NRG; PAM sequence: GAG
ctgagatgggaagatcactt

SEQ ID NO: 130982 - DNA, 20 bp, Artificial Sequence
  Description of Artificial Sequence: Synthetic oligonucleotide
  Target: ATXN1; (+) strand; PAM type: NRG; PAM sequence: CGG
atgggaagatcacttgagcc

SEQ ID NO: 130983 - DNA, 20 bp, Artificial Sequence
  Description of Artificial Sequence: Synthetic oligonucleotide
  Target: ATXN1; (+) strand; PAM type: NRG; PAM sequence: GGG
tgggaagatcacttgagccc

SEQ ID NO: 130984 - DNA, 20 bp, Artificial Sequence
  Description of Artificial Sequence: Synthetic oligonucleotide
  Target: ATXN1; (+) strand; PAM type: NRG; PAM sequence: GAG
ggaagatcacttgagcccgg

SEQ ID NO: 130985 - DNA, 20 bp, Artificial Sequence
  Description of Artificial Sequence: Synthetic oligonucleotide
  Target: ATXN1; (+) strand; PAM type: NRG; PAM sequence: AGG
gaagatcacttgagcccggg

SEQ ID NO: 130986 - DNA, 20 bp, Artificial Sequence
  Description of Artificial Sequence: Synthetic oligonucleotide
  Target: ATXN1; (+) strand; PAM type: NRG; PAM sequence: CAG
gatcacttgagcccgggagg

SEQ ID NO: 130987 - DNA, 20 bp, Artificial Sequence
  Description of Artificial Sequence: Synthetic oligonucleotide
  Target: ATXN1; (+) strand; PAM type: NRG; PAM sequence: GAG
tcacttgagcccgggaggca

SEQ ID NO: 130988 - DNA, 20 bp, Artificial Sequence
  Description of Artificial Sequence: Synthetic oligonucleotide
  Target: ATXN1; (+) strand; PAM type: NRG; PAM sequence: AGG
cacttgagcccgggaggcag

SEQ ID NO: 130989 - DNA, 20 bp, Artificial Sequence
  Description of Artificial Sequence: Synthetic oligonucleotide
  Target: ATXN1; (+) strand; PAM type: NRG; PAM sequence: CAG
agcccgggaggcagaggttg

SEQ ID NO: 130990 - DNA, 20 bp, Artificial Sequence
  Description of Artificial Sequence: Synthetic oligonucleotide
  Target: ATXN1; (+) strand; PAM type: NRG; PAM sequence: GAG
cgggaggcagaggttgcagt

SEQ ID NO: 130991 - DNA, 20 bp, Artificial Sequence
  Description of Artificial Sequence: Synthetic oligonucleotide
  Target: ATXN1; (+) strand; PAM type: NRG; PAM sequence: AAG
ggcagaggttgcagtgagcc

SEQ ID NO: 130992 - DNA, 20 bp, Artificial Sequence
  Description of Artificial Sequence: Synthetic oligonucleotide
  Target: ATXN1; (+) strand; PAM type: NRG; PAM sequence: CAG
aagatcaccccactgtactc

SEQ ID NO: 130993 - DNA, 20 bp, Artificial Sequence
  Description of Artificial Sequence: Synthetic oligonucleotide
  Target: ATXN1; (+) strand; PAM type: NRG; PAM sequence: TGG
caccccactgtactccagcc

SEQ ID NO: 130994 - DNA, 20 bp, Artificial Sequence
  Description of Artificial Sequence: Synthetic oligonucleotide
  Target: ATXN1; (+) strand; PAM type: NRG; PAM sequence: GGG
accccactgtactccagcct

SEQ ID NO: 130995 - DNA, 20 bp, Artificial Sequence
  Description of Artificial Sequence: Synthetic oligonucleotide
  Target: ATXN1; (+) strand; PAM type: NRG; PAM sequence: CAG
ctgtactccagcctgggcaa

SEQ ID NO: 130996 - DNA, 20 bp, Artificial Sequence
  Description of Artificial Sequence: Synthetic oligonucleotide
  Target: ATXN1; (+) strand; PAM type: NRG; PAM sequence: GAG
gtactccagcctgggcaaca

SEQ ID NO: 130997 - DNA, 20 bp, Artificial Sequence
  Description of Artificial Sequence: Synthetic oligonucleotide
  Target: ATXN1; (+) strand; PAM type: NRG; PAM sequence: TAG
tccagcctgggcaacagagc

SEQ ID NO: 130998 - DNA, 20 bp, Artificial Sequence
  Description of Artificial Sequence: Synthetic oligonucleotide
  Target: ATXN1; (+) strand; PAM type: NRG; PAM sequence: AAG
ttgtctcaaaaaaaaaaaaa

SEQ ID NO: 130999 - DNA, 20 bp, Artificial Sequence
  Description of Artificial Sequence: Synthetic oligonucleotide
  Target: ATXN1; (+) strand; PAM type: NRG; PAM sequence: AAG
tctcaaaaaaaaaaaaaaag

SEQ ID NO: 131000 - DNA, 20 bp, Artificial Sequence
  Description of Artificial Sequence: Synthetic oligonucleotide
  Target: ATXN1; (+) strand; PAM type: NRG; PAM sequence: AAG
caaaaaaaaaaaaaaagaag

SEQ ID NO: 131001 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaaagaagaag

SEQ ID NO: 131002 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaagaagaagaaga

SEQ ID NO: 131003 - DNA, 20 bp, Artificial Sequence
  Description of Artificial Sequence: Synthetic oligonucleotide
  Target: ATXN1; (+) strand; PAM type: NRG; PAM sequence: AAG
aaaaaagaagaagaagaaag

SEQ ID NO: 131004 - DNA, 20 bp, Artificial Sequence
  Description of Artificial Sequence: Synthetic oligonucleotide
  Target: ATXN1; (+) strand; PAM type: NRG; PAM sequence: AAG
aagaagaagaagaaagaaga

SEQ ID NO: 131005 - DNA, 20 bp, Artificial Sequence
  Description of Artificial Sequence: Synthetic oligonucleotide
  Target: ATXN1; (+) strand; PAM type: NRG; PAM sequence: AAG
aagaagaagaaagaagaaag

SEQ ID NO: 131006 - DNA, 20 bp, Artificial Sequence
  Description of Artificial Sequence: Synthetic oligonucleotide
  Target: ATXN1; (+) strand; PAM type: NRG; PAM sequence: AGG
agaagaagaaagaagaaaga

SEQ ID NO: 131007 - DNA, 20 bp, Artificial Sequence
  Description of Artificial Sequence: Synthetic oligonucleotide
  Target: ATXN1; (+) strand; PAM type: NRG; PAM sequence: GGG
gaagaagaaagaagaaagaa

SEQ ID NO: 131008 - DNA, 20 bp, Artificial Sequence
  Description of Artificial Sequence: Synthetic oligonucleotide
  Target: ATXN1; (+) strand; PAM type: NRG; PAM sequence: GGG
aagaagaaagaagaaagaag

SEQ ID NO: 131009 - DNA, 20 bp, Artificial Sequence
  Description of Artificial Sequence: Synthetic oligonucleotide
  Target: ATXN1; (+) strand; PAM type: NRG; PAM sequence: TGG
gaaagaagaaagaaggggaa

SEQ ID NO: 131010 - DNA, 20 bp, Artificial Sequence
  Description of Artificial Sequence: Synthetic oligonucleotide
  Target: ATXN1; (+) strand; PAM type: NRG; PAM sequence: GGG
aaagaagaaagaaggggaat

SEQ ID NO: 131011 - DNA, 20 bp, Artificial Sequence
  Description of Artificial Sequence: Synthetic oligonucleotide
  Target: ATXN1; (+) strand; PAM type: NRG; PAM sequence: GGG
aagaagaaagaaggggaatg

SEQ ID NO: 131012 - DNA, 20 bp, Artificial Sequence
  Description of Artificial Sequence: Synthetic oligonucleotide
  Target: ATXN1; (+) strand; PAM type: NRG; PAM sequence: AAG
aagaaagaaggggaatgggg

SEQ ID NO: 131013 - DNA, 20 bp, Artificial Sequence
  Description of Artificial Sequence: Synthetic oligonucleotide
  Target: ATXN1; (+) strand; PAM type: NRG; PAM sequence: AGG
agaaagaaggggaatgggga

SEQ ID NO: 131014 - DNA, 20 bp, Artificial Sequence
  Description of Artificial Sequence: Synthetic oligonucleotide
  Target: ATXN1; (+) strand; PAM type: NRG; PAM sequence: GGG
gaaagaaggggaatggggaa

SEQ ID NO: 131015 - DNA, 20 bp, Artificial Sequence
  Description of Artificial Sequence: Synthetic oligonucleotide
  Target: ATXN1; (+) strand; PAM type: NRG; PAM sequence: GGG
aaagaaggggaatggggaag

SEQ ID NO: 131016 - DNA, 20 bp, Artificial Sequence
  Description of Artificial Sequence: Synthetic oligonucleotide
  Target: ATXN1; (+) strand; PAM type: NRG; PAM sequence: AAG
gaaggggaatggggaagggg

SEQ ID NO: 131017 - DNA, 20 bp, Artificial Sequence
  Description of Artificial Sequence: Synthetic oligonucleotide
  Target: ATXN1; (+) strand; PAM type: NRG; PAM sequence: AGG
aaggggaatggggaagggga

SEQ ID NO: 131018 - DNA, 20 bp, Artificial Sequence
  Description of Artificial Sequence: Synthetic oligonucleotide
  Target: ATXN1; (+) strand; PAM type: NRG; PAM sequence: GAG
ggggaatggggaaggggaag

SEQ ID NO: 131019 - DNA, 20 bp, Artificial Sequence
  Description of Artificial Sequence: Synthetic oligonucleotide
  Target: ATXN1; (+) strand; PAM type: NRG; PAM sequence: AAG
gaatggggaaggggaaggag

SEQ ID NO: 131020 - DNA, 20 bp, Artificial Sequence
  Description of Artificial Sequence: Synthetic oligonucleotide
  Target: ATXN1; (+) strand; PAM type: NRG; PAM sequence: AAG
gggaaggggaaggagaagaa

SEQ ID NO: 131021 - DNA, 20 bp, Artificial Sequence
  Description of Artificial Sequence: Synthetic oligonucleotide
  Target: ATXN1; (+) strand; PAM type: NRG; PAM sequence: AAG
ggggaaggagaagaaaagaa

SEQ ID NO: 131022 - DNA, 20 bp, Artificial Sequence
  Description of Artificial Sequence: Synthetic oligonucleotide
  Target: ATXN1; (+) strand; PAM type: NRG; PAM sequence: AAG
aaggagaagaaaagaaaaga

SEQ ID NO: 131023 - DNA, 20 bp, Artificial Sequence
  Description of Artificial Sequence: Synthetic oligonucleotide
  Target: ATXN1; (+) strand; PAM type: NRG; PAM sequence: AAG
gaagaaaagaaaagaaagaa

SEQ ID NO: 131024 - DNA, 20 bp, Artificial Sequence
  Description of Artificial Sequence: Synthetic oligonucleotide
  Target: ATXN1; (+) strand; PAM type: NRG; PAM sequence: AGG
aagaaaagaaaagaaagaaa

SEQ ID NO: 131025 - DNA, 20 bp, Artificial Sequence
  Description of Artificial Sequence: Synthetic oligonucleotide
  Target: ATXN1; (+) strand; PAM type: NRG; PAM sequence: GAG
gaaaagaaaagaaagaaaag

SEQ ID NO: 131026 - DNA, 20 bp, Artificial Sequence
  Description of Artificial Sequence: Synthetic oligonucleotide
  Target: ATXN1; (+) strand; PAM type: NRG; PAM sequence: GAG
aaagaaaagaaagaaaagga

SEQ ID NO: 131027 - DNA, 20 bp, Artificial Sequence
  Description of Artificial Sequence: Synthetic oligonucleotide
  Target: ATXN1; (+) strand; PAM type: NRG; PAM sequence: AGG
aagaaaagaaagaaaaggag

SEQ ID NO: 131028 - DNA, 20 bp, Artificial Sequence
  Description of Artificial Sequence: Synthetic oligonucleotide
  Target: ATXN1; (+) strand; PAM type: NRG; PAM sequence: GAG
gaaaagaaagaaaaggagag

SEQ ID NO: 131029 - DNA, 20 bp, Artificial Sequence
  Description of Artificial Sequence: Synthetic oligonucleotide
  Target: ATXN1; (+) strand; PAM type: NRG; PAM sequence: GAG
aaagaaagaaaaggagagga

SEQ ID NO: 131030 - DNA, 20 bp, Artificial Sequence
  Description of Artificial Sequence: Synthetic oligonucleotide
  Target: ATXN1; (+) strand; PAM type: NRG; PAM sequence: AGG
aagaaagaaaaggagaggag

SEQ ID NO: 131031 - DNA, 20 bp, Artificial Sequence
  Description of Artificial Sequence: Synthetic oligonucleotide
  Target: ATXN1; (+) strand; PAM type: NRG; PAM sequence: GAG
gaaagaaaaggagaggagag

SEQ ID NO: 131032 - DNA, 20 bp, Artificial Sequence
  Description of Artificial Sequence: Synthetic oligonucleotide
  Target: ATXN1; (+) strand; PAM type: NRG; PAM sequence: GAG
aagaaaaggagaggagagga

SEQ ID NO: 131033 - DNA, 20 bp, Artificial Sequence
  Description of Artificial Sequence: Synthetic oligonucleotide
  Target: ATXN1; (+) strand; PAM type: NRG; PAM sequence: AGG
agaaaaggagaggagaggag

SEQ ID NO: 131034 - DNA, 20 bp, Artificial Sequence
  Description of Artificial Sequence: Synthetic oligonucleotide
  Target: ATXN1; (+) strand; PAM type: NRG; PAM sequence: GAG
aaaaggagaggagaggagag

SEQ ID NO: 131035 - DNA, 20 bp, Artificial Sequence
  Description of Artificial Sequence: Synthetic oligonucleotide
  Target: ATXN1; (+) strand; PAM type: NRG; PAM sequence: GAG
aaggagaggagaggagagga

SEQ ID NO: 131036 - DNA, 20 bp, Artificial Sequence
  Description of Artificial Sequence: Synthetic oligonucleotide
  Target: ATXN1; (+) strand; PAM type: NRG; PAM sequence: AGG
aggagaggagaggagaggag

SEQ ID NO: 131037 - DNA, 20 bp, Artificial Sequence
  Description of Artificial Sequence: Synthetic oligonucleotide
  Target: ATXN1; (+) strand; PAM type: NRG; PAM sequence: GAG
gagaggagaggagaggagag

SEQ ID NO: 131038 - DNA, 20 bp, Artificial Sequence
  Description of Artificial Sequence: Synthetic oligonucleotide
  Target: ATXN1; (+) strand; PAM type: NRG; PAM sequence: GAG
gaggagaggagaggagagga

SEQ ID NO: 131039 - DNA, 20 bp, Artificial Sequence
  Description of Artificial Sequence: Synthetic oligonucleotide
  Target: ATXN1; (+) strand; PAM type: NRG; PAM sequence: AGG
aggagaggagaggagaggag

SEQ ID NO: 131040 - DNA, 20 bp, Artificial Sequence
  Description of Artificial Sequence: Synthetic oligonucleotide
  Target: ATXN1; (+) strand; PAM type: NRG; PAM sequence: GAG
gagaggagaggagaggagag

SEQ ID NO: 131041 - DNA, 20 bp, Artificial Sequence
  Description of Artificial Sequence: Synthetic oligonucleotide
  Target: ATXN1; (+) strand; PAM type: NRG; PAM sequence: GAG
gaggagaggagaggagagga

SEQ ID NO: 131042 - DNA, 20 bp, Artificial Sequence
  Description of Artificial Sequence: Synthetic oligonucleotide
  Target: ATXN1; (+) strand; PAM type: NRG; PAM sequence: AGG
aggagaggagaggagaggag

SEQ ID NO: 131043 - DNA, 20 bp, Artificial Sequence
  Description of Artificial Sequence: Synthetic oligonucleotide
  Target: ATXN1; (+) strand; PAM type: NRG; PAM sequence: AAG
gaggagaggagaggagagga

SEQ ID NO: 131044 - DNA, 20 bp, Artificial Sequence
  Description of Artificial Sequence: Synthetic oligonucleotide
  Target: ATXN1; (+) strand; PAM type: NRG; PAM sequence: AGG
aggagaggagaggagaggaa

SEQ ID NO: 131045 - DNA, 20 bp, Artificial Sequence
  Description of Artificial Sequence: Synthetic oligonucleotide
  Target: ATXN1; (+) strand; PAM type: NRG; PAM sequence: AAG
gaggagaggagaggaaagga

SEQ ID NO: 131046 - DNA, 20 bp, Artificial Sequence
  Description of Artificial Sequence: Synthetic oligonucleotide
  Target: ATXN1; (+) strand; PAM type: NRG; PAM sequence: AGG
aggagaggagaggaaaggaa

SEQ ID NO: 131047 - DNA, 20 bp, Artificial Sequence
  Description of Artificial Sequence: Synthetic oligonucleotide
  Target: ATXN1; (+) strand; PAM type: NRG; PAM sequence: AAG
gaggagaggaaaggaaagga

SEQ ID NO: 131048 - DNA, 20 bp, Artificial Sequence
  Description of Artificial Sequence: Synthetic oligonucleotide
  Target: ATXN1; (+) strand; PAM type: NRG; PAM sequence: AGG
aggagaggaaaggaaaggaa

SEQ ID NO: 131049 - DNA, 20 bp, Artificial Sequence
  Description of Artificial Sequence: Synthetic oligonucleotide
  Target: ATXN1; (+) strand; PAM type: NRG; PAM sequence: AAG
gaggaaaggaaaggaaagga

SEQ ID NO: 131050 - DNA, 20 bp, Artificial Sequence
  Description of Artificial Sequence: Synthetic oligonucleotide
  Target: ATXN1; (+) strand; PAM type: NRG; PAM sequence: AGG
aggaaaggaaaggaaaggaa

SEQ ID NO: 131051 - DNA, 20 bp, Artificial Sequence
  Description of Artificial Sequence: Synthetic oligonucleotide
  Target: ATXN1; (+) strand; PAM type: NRG; PAM sequence: AAG
ggaaaggaaaggaaaggaaa

SEQ ID NO: 131052 - DNA, 20 bp, Artificial Sequence
  Description of Artificial Sequence: Synthetic oligonucleotide
  Target: ATXN1; (+) strand; PAM type: NRG; PAM sequence: AAG
ggaaaggaaaggaaaaagaa

SEQ ID NO: 131053 - DNA, 20 bp, Artificial Sequence
  Description of Artificial Sequence: Synthetic oligonucleotide
  Target: ATXN1; (+) strand; PAM type: NRG; PAM sequence: AAG
ggaaaggaaaaagaaaagaa

SEQ ID NO: 131054 - DNA, 20 bp, Artificial Sequence
  Description of Artificial Sequence: Synthetic oligonucleotide
  Target: ATXN1; (+) strand; PAM type: NRG; PAM sequence: AAG
aaagaaaagaaaagaaacaa

SEQ ID NO: 131055 - DNA, 20 bp, Artificial Sequence
  Description of Artificial Sequence: Synthetic oligonucleotide
  Target: ATXN1; (+) strand; PAM type: NRG; PAM sequence: AAG
aagaaaagaaacaaaagaaa

SEQ ID NO: 131056 - DNA, 20 bp, Artificial Sequence
  Description of Artificial Sequence: Synthetic oligonucleotide
  Target: ATXN1; (+) strand; PAM type: NRG; PAM sequence: AAG
aagaaacaaaagaaaaagaa

SEQ ID NO: 131057 - DNA, 20 bp, Artificial Sequence
  Description of Artificial Sequence: Synthetic oligonucleotide
  Target: ATXN1; (+) strand; PAM type: NRG; PAM sequence: AAG
acaaaagaaaaagaaaagaa

SEQ ID NO: 131058 - DNA, 20 bp, Artificial Sequence
  Description of Artificial Sequence: Synthetic oligonucleotide
  Target: ATXN1; (+) strand; PAM type: NRG; PAM sequence: TGG
agaaaagaaaagaaatgaaa

SEQ ID NO: 131059 - DNA, 20 bp, Artificial Sequence
  Description of Artificial Sequence: Synthetic oligonucleotide
  Target: ATXN1; (+) strand; PAM type: NRG; PAM sequence: TGG
aagaaaagaaatgaaatggc

SEQ ID NO: 131060 - DNA, 20 bp, Artificial Sequence
  Description of Artificial Sequence: Synthetic oligonucleotide
  Target: ATXN1; (+) strand; PAM type: NRG; PAM sequence: CAG
aaaagaaatgaaatggctgg

SEQ ID NO: 131061 - DNA, 20 bp, Artificial Sequence
  Description of Artificial Sequence: Synthetic oligonucleotide
  Target: ATXN1; (+) strand; PAM type: NRG; PAM sequence: CAG
agaaatgaaatggctggcag

SEQ ID NO: 131062 - DNA, 20 bp, Artificial Sequence
  Description of Artificial Sequence: Synthetic oligonucleotide
  Target: ATXN1; (+) strand; PAM type: NRG; PAM sequence: TAG
atggctggcagcagccaccg

SEQ ID NO: 131063 - DNA, 20 bp, Artificial Sequence
  Description of Artificial Sequence: Synthetic oligonucleotide
  Target: ATXN1; (+) strand; PAM type: NRG; PAM sequence: AGG
tggctggcagcagccaccgt

SEQ ID NO: 131064 - DNA, 20 bp, Artificial Sequence
  Description of Artificial Sequence: Synthetic oligonucleotide
  Target: ATXN1; (+) strand; PAM type: NRG; PAM sequence: CAG
agcagccaccgtaggaaata

SEQ ID NO: 131065 - DNA, 20 bp, Artificial Sequence
  Description of Artificial Sequence: Synthetic oligonucleotide
  Target: ATXN1; (+) strand; PAM type: NRG; PAM sequence: CAG
ccaccgtaggaaatacagcc

SEQ ID NO: 131066 - DNA, 20 bp, Artificial Sequence
  Description of Artificial Sequence: Synthetic oligonucleotide
  Target: ATXN1; (+) strand; PAM type: NRG; PAM sequence: GAG
accgtaggaaatacagccca

SEQ ID NO: 131067 - DNA, 20 bp, Artificial Sequence
  Description of Artificial Sequence: Synthetic oligonucleotide
  Target: ATXN1; (+) strand; PAM type: NRG; PAM sequence: AGG
ccgtaggaaatacagcccag

SEQ ID NO: 131068 - DNA, 20 bp, Artificial Sequence
  Description of Artificial Sequence: Synthetic oligonucleotide
  Target: ATXN1; (+) strand; PAM type: NRG; PAM sequence: TAG
ggaaatacagcccagaggtc

SEQ ID NO: 131069 - DNA, 20 bp, Artificial Sequence
  Description of Artificial Sequence: Synthetic oligonucleotide
  Target: ATXN1; (+) strand; PAM type: NRG; PAM sequence: AGG
gaaatacagcccagaggtct

SEQ ID NO: 131070 - DNA, 20 bp, Artificial Sequence
  Description of Artificial Sequence: Synthetic oligonucleotide
  Target: ATXN1; (+) strand; PAM type: NRG; PAM sequence: GAG
aatacagcccagaggtctag

SEQ ID NO: 131071 - DNA, 20 bp, Artificial Sequence
  Description of Artificial Sequence: Synthetic oligonucleotide
  Target: ATXN1; (+) strand; PAM type: NRG; PAM sequence: AAG
taggagtaaccactgaataa

SEQ ID NO: 131072 - DNA, 20 bp, Artificial Sequence
  Description of Artificial Sequence: Synthetic oligonucleotide
  Target: ATXN1; (+) strand; PAM type: NRG; PAM sequence: TAG
accactgaataaaagcttac

SEQ ID NO: 131073 - DNA, 20 bp, Artificial Sequence
  Description of Artificial Sequence: Synthetic oligonucleotide
  Target: ATXN1; (+) strand; PAM type: NRG; PAM sequence: GAG
gaataaaagcttactagttt

SEQ ID NO: 131074 - DNA, 20 bp, Artificial Sequence
  Description of Artificial Sequence: Synthetic oligonucleotide
  Target: ATXN1; (+) strand; PAM type: NRG; PAM sequence: TAG
ttactagtttgagtccatct

SEQ ID NO: 131075 - DNA, 20 bp, Artificial Sequence
  Description of Artificial Sequence: Synthetic oligonucleotide
  Target: ATXN1; (+) strand; PAM type: NRG; PAM sequence: AGG
tactagtttgagtccatctt

SEQ ID NO: 131076 - DNA, 20 bp, Artificial Sequence
  Description of Artificial Sequence: Synthetic oligonucleotide
  Target: ATXN1; (+) strand; PAM type: NRG; PAM sequence: CAG
agtttgagtccatcttaggc

SEQ ID NO: 131077 - DNA, 20 bp, Artificial Sequence
  Description of Artificial Sequence: Synthetic oligonucleotide
  Target: ATXN1; (+) strand; PAM type: NRG; PAM sequence: AAG
gagtccatcttaggccagtg

SEQ ID NO: 131078 - DNA, 20 bp, Artificial Sequence
  Description of Artificial Sequence: Synthetic oligonucleotide
  Target: ATXN1; (+) strand; PAM type: NRG; PAM sequence: TGG
tcttaggccagtgaagacat

SEQ ID NO: 131079 - DNA, 20 bp, Artificial Sequence
  Description of Artificial Sequence: Synthetic oligonucleotide
  Target: ATXN1; (+) strand; PAM type: NRG; PAM sequence: GGG
cttaggccagtgaagacatt

SEQ ID NO: 131080 - DNA, 20 bp, Artificial Sequence
  Description of Artificial Sequence: Synthetic oligonucleotide
  Target: ATXN1; (+) strand; PAM type: NRG; PAM sequence: GAG
gccagtgaagacattgggcc

SEQ ID NO: 131081 - DNA, 20 bp, Artificial Sequence
  Description of Artificial Sequence: Synthetic oligonucleotide
  Target: ATXN1; (+) strand; PAM type: NRG; PAM sequence: AAG
agtgaagacattgggccgag

SEQ ID NO: 131082 - DNA, 20 bp, Artificial Sequence
  Description of Artificial Sequence: Synthetic oligonucleotide
  Target: ATXN1; (+) strand; PAM type: NRG; PAM sequence: CAG
acattgggccgagaagtttc

SEQ ID NO: 131083 - DNA, 20 bp, Artificial Sequence
  Description of Artificial Sequence: Synthetic oligonucleotide
  Target: ATXN1; (+) strand; PAM type: NRG; PAM sequence: TGG
gccgagaagtttccagtgct

SEQ ID NO: 131084 - DNA, 20 bp, Artificial Sequence
  Description of Artificial Sequence: Synthetic oligonucleotide
  Target: ATXN1; (+) strand; PAM type: NRG; PAM sequence: CAG
agtttccagtgcttggatga

SEQ ID NO: 131085 - DNA, 20 bp, Artificial Sequence
  Description of Artificial Sequence: Synthetic oligonucleotide
  Target: ATXN1; (+) strand; PAM type: NRG; PAM sequence: GAG
tttccagtgcttggatgaca

SEQ ID NO: 131086 - DNA, 20 bp, Artificial Sequence
  Description of Artificial Sequence: Synthetic oligonucleotide
  Target: ATXN1; (+) strand; PAM type: NRG; PAM sequence: AAG
ccagtgcttggatgacagag

SEQ ID NO: 131087 - DNA, 20 bp, Artificial Sequence
  Description of Artificial Sequence: Synthetic oligonucleotide
  Target: ATXN1; (+) strand; PAM type: NRG; PAM sequence: TGG
cttggatgacagagaagaac

SEQ ID NO: 131088 - DNA, 20 bp, Artificial Sequence
  Description of Artificial Sequence: Synthetic oligonucleotide
  Target: ATXN1; (+) strand; PAM type: NRG; PAM sequence: AAG
acagagaagaactggtgact

SEQ ID NO: 131089 - DNA, 20 bp, Artificial Sequence
  Description of Artificial Sequence: Synthetic oligonucleotide
  Target: ATXN1; (+) strand; PAM type: NRG; PAM sequence: CAG
agaactggtgactaagactt

SEQ ID NO: 131090 - DNA, 20 bp, Artificial Sequence
  Description of Artificial Sequence: Synthetic oligonucleotide
  Target: ATXN1; (+) strand; PAM type: NRG; PAM sequence: TGG
actggtgactaagacttcag

SEQ ID NO: 131091 - DNA, 20 bp, Artificial Sequence
  Description of Artificial Sequence: Synthetic oligonucleotide
  Target: ATXN1; (+) strand; PAM type: NRG; PAM sequence: GGG
ctggtgactaagacttcagt

SEQ ID NO: 131092 - DNA, 20 bp, Artificial Sequence
  Description of Artificial Sequence: Synthetic oligonucleotide
  Target: ATXN1; (+) strand; PAM type: NRG; PAM sequence: TGG
gtgactaagacttcagtggg

SEQ ID NO: 131093 - DNA, 20 bp, Artificial Sequence
  Description of Artificial Sequence: Synthetic oligonucleotide
  Target: ATXN1; (+) strand; PAM type: NRG; PAM sequence: TGG
ttcagtgggtggtaataatc

SEQ ID NO: 131094 - DNA, 20 bp, Artificial Sequence
  Description of Artificial Sequence: Synthetic oligonucleotide
  Target: ATXN1; (+) strand; PAM type: NRG; PAM sequence: TAG
gtggtaataatctggatgaa

SEQ ID NO: 131095 - DNA, 20 bp, Artificial Sequence
  Description of Artificial Sequence: Synthetic oligonucleotide
  Target: ATXN1; (+) strand; PAM type: NRG; PAM sequence: CAG
taatctggatgaatagaaca

SEQ ID NO: 131096 - DNA, 20 bp, Artificial Sequence
  Description of Artificial Sequence: Synthetic oligonucleotide
  Target: ATXN1; (+) strand; PAM type: NRG; PAM sequence: GAG
ctatgttttcaaaacatgtt

SEQ ID NO: 131097 - DNA, 20 bp, Artificial Sequence
  Description of Artificial Sequence: Synthetic oligonucleotide
  Target: ATXN1; (+) strand; PAM type: NRG; PAM sequence: AGG
tatgttttcaaaacatgttg

SEQ ID NO: 131098 - DNA, 20 bp, Artificial Sequence
  Description of Artificial Sequence: Synthetic oligonucleotide
  Target: ATXN1; (+) strand; PAM type: NRG; PAM sequence: AAG
ttcaaaacatgttgaggtta

SEQ ID NO: 131099 - DNA, 20 bp, Artificial Sequence
  Description of Artificial Sequence: Synthetic oligonucleotide
  Target: ATXN1; (+) strand; PAM type: NRG; PAM sequence: AAG
aaacatgttgaggttaaaga

SEQ ID NO: 131100 - DNA, 20 bp, Artificial Sequence
  Description of Artificial Sequence: Synthetic oligonucleotide
  Target: ATXN1; (+) strand; PAM type: NRG; PAM sequence: TAG
tgttgaggttaaagaaagaa

SEQ ID NO: 131101 - DNA, 20 bp, Artificial Sequence
  Description of Artificial Sequence: Synthetic oligonucleotide
  Target: ATXN1; (+) strand; PAM type: NRG; PAM sequence: GAG
ttgaggttaaagaaagaata

SEQ ID NO: 131102 - DNA, 20 bp, Artificial Sequence
  Description of Artificial Sequence: Synthetic oligonucleotide
  Target: ATXN1; (+) strand; PAM type: NRG; PAM sequence: TGG
ttaaagaaagaatagagaaa

SEQ ID NO: 131103 - DNA, 20 bp, Artificial Sequence
  Description of Artificial Sequence: Synthetic oligonucleotide
  Target: ATXN1; (+) strand; PAM type: NRG; PAM sequence: GAG
tagagaaatggaaattgcct

SEQ ID NO: 131104 - DNA, 20 bp, Artificial Sequence
  Description of Artificial Sequence: Synthetic oligonucleotide
  Target: ATXN1; (+) strand; PAM type: NRG; PAM sequence: AGG
agagaaatggaaattgcctg

SEQ ID NO: 131105 - DNA, 20 bp, Artificial Sequence
  Description of Artificial Sequence: Synthetic oligonucleotide
  Target: ATXN1; (+) strand; PAM type: NRG; PAM sequence: GAG
agaaatggaaattgcctgag

SEQ ID NO: 131106 - DNA, 20 bp, Artificial Sequence
  Description of Artificial Sequence: Synthetic oligonucleotide
  Target: ATXN1; (+) strand; PAM type: NRG; PAM sequence: AAG
ggaaattgcctgaggagaac

SEQ ID NO: 131107 - DNA, 20 bp, Artificial Sequence
  Description of Artificial Sequence: Synthetic oligonucleotide
  Target: ATXN1; (+) strand; PAM type: NRG; PAM sequence: AGG
gaaattgcctgaggagaaca

SEQ ID NO: 131108 - DNA, 20 bp, Artificial Sequence
  Description of Artificial Sequence: Synthetic oligonucleotide
  Target: ATXN1; (+) strand; PAM type: NRG; PAM sequence: AAG
gaggagaacaaggtcaaaat

SEQ ID NO: 131109 - DNA, 20 bp, Artificial Sequence
  Description of Artificial Sequence: Synthetic oligonucleotide
  Target: ATXN1; (+) strand; PAM type: NRG; PAM sequence: AGG
aggagaacaaggtcaaaata

SEQ ID NO: 131110 - DNA, 20 bp, Artificial Sequence
  Description of Artificial Sequence: Synthetic oligonucleotide
  Target: ATXN1; (+) strand; PAM type: NRG; PAM sequence: GGG
ggagaacaaggtcaaaataa

SEQ ID NO: 131111 - DNA, 20 bp, Artificial Sequence
  Description of Artificial Sequence: Synthetic oligonucleotide
  Target: ATXN1; (+) strand; PAM type: NRG; PAM sequence: TAG
ggtcaaaataagggctcctt

SEQ ID NO: 131112 - DNA, 20 bp, Artificial Sequence
  Description of Artificial Sequence: Synthetic oligonucleotide
  Target: ATXN1; (+) strand; PAM type: NRG; PAM sequence: AAG
agggctcctttagtttttaa

SEQ ID NO: 131113 - DNA, 20 bp, Artificial Sequence
  Description of Artificial Sequence: Synthetic oligonucleotide
  Target: ATXN1; (+) strand; PAM type: NRG; PAM sequence: CAG
ctcctttagtttttaaaaga

SEQ ID NO: 131114 - DNA, 20 bp, Artificial Sequence
  Description of Artificial Sequence: Synthetic oligonucleotide
  Target: ATXN1; (+) strand; PAM type: NRG; PAM sequence: AGG
tcctttagtttttaaaagac

SEQ ID NO: 131115 - DNA, 20 bp, Artificial Sequence
  Description of Artificial Sequence: Synthetic oligonucleotide
  Target: ATXN1; (+) strand; PAM type: NRG; PAM sequence: TAG
taaaagacaggccacaccac

SEQ ID NO: 131116 - DNA, 20 bp, Artificial Sequence
  Description of Artificial Sequence: Synthetic oligonucleotide
  Target: ATXN1; (+) strand; PAM type: NRG; PAM sequence: AGG
aaaagacaggccacaccact

SEQ ID NO: 131117 - DNA, 20 bp, Artificial Sequence
  Description of Artificial Sequence: Synthetic oligonucleotide
  Target: ATXN1; (+) strand; PAM type: NRG; PAM sequence: TAG
cacaccactaggcacattca

SEQ ID NO: 131118 - DNA, 20 bp, Artificial Sequence
  Description of Artificial Sequence: Synthetic oligonucleotide
  Target: ATXN1; (+) strand; PAM type: NRG; PAM sequence: AAG
ctaggcacattcatagactg

SEQ ID NO: 131119 - DNA, 20 bp, Artificial Sequence
  Description of Artificial Sequence: Synthetic oligonucleotide
  Target: ATXN1; (+) strand; PAM type: NRG; PAM sequence: GAG
aggcacattcatagactgaa

SEQ ID NO: 131120 - DNA, 20 bp, Artificial Sequence
  Description of Artificial Sequence: Synthetic oligonucleotide
  Target: ATXN1; (+) strand; PAM type: NRG; PAM sequence: AAG
cacattcatagactgaagag

SEQ ID NO: 131121 - DNA, 20 bp, Artificial Sequence
  Description of Artificial Sequence: Synthetic oligonucleotide
  Target: ATXN1; (+) strand; PAM type: NRG; PAM sequence: AGG
acattcatagactgaagaga

SEQ ID NO: 131122 - DNA, 20 bp, Artificial Sequence
  Description of Artificial Sequence: Synthetic oligonucleotide
  Target: ATXN1; (+) strand; PAM type: NRG; PAM sequence: TGG
atagactgaagagaaggttt

SEQ ID NO: 131123 - DNA, 20 bp, Artificial Sequence
  Description of Artificial Sequence: Synthetic oligonucleotide
  Target: ATXN1; (+) strand; PAM type: NRG; PAM sequence: AAG
ctgaagagaaggttttggtt

SEQ ID NO: 131124 - DNA, 20 bp, Artificial Sequence
  Description of Artificial Sequence: Synthetic oligonucleotide
  Target: ATXN1; (+) strand; PAM type: NRG; PAM sequence: AAG
agaaggttttggttaagatg

SEQ ID NO: 131125 - DNA, 20 bp, Artificial Sequence
  Description of Artificial Sequence: Synthetic oligonucleotide
  Target: ATXN1; (+) strand; PAM type: NRG; PAM sequence: AAG
ggttaagatgaagataatga

SEQ ID NO: 131126 - DNA, 20 bp, Artificial Sequence
  Description of Artificial Sequence: Synthetic oligonucleotide
  Target: ATXN1; (+) strand; PAM type: NRG; PAM sequence: AAG
gatgaagataatgaaagatc

SEQ ID NO: 131127 - DNA, 20 bp, Artificial Sequence
  Description of Artificial Sequence: Synthetic oligonucleotide
  Target: ATXN1; (+) strand; PAM type: NRG; PAM sequence: CAG
gaagataatgaaagatcaag

SEQ ID NO: 131128 - DNA, 20 bp, Artificial Sequence
  Description of Artificial Sequence: Synthetic oligonucleotide
  Target: ATXN1; (+) strand; PAM type: NRG; PAM sequence: AGG
aagataatgaaagatcaagc

SEQ ID NO: 131129 - DNA, 20 bp, Artificial Sequence
  Description of Artificial Sequence: Synthetic oligonucleotide
  Target: ATXN1; (+) strand; PAM type: NRG; PAM sequence: GAG
gataatgaaagatcaagcag

SEQ ID NO: 131130 - DNA, 20 bp, Artificial Sequence
  Description of Artificial Sequence: Synthetic oligonucleotide
  Target: ATXN1; (+) strand; PAM type: NRG; PAM sequence: GAG
taatgaaagatcaagcagga

SEQ ID NO: 131131 - DNA, 20 bp, Artificial Sequence
  Description of Artificial Sequence: Synthetic oligonucleotide
  Target: ATXN1; (+) strand; PAM type: NRG; PAM sequence: AGG
aatgaaagatcaagcaggag

SEQ ID NO: 131132 - DNA, 20 bp, Artificial Sequence
  Description of Artificial Sequence: Synthetic oligonucleotide
  Target: ATXN1; (+) strand; PAM type: NRG; PAM sequence: GGG
atgaaagatcaagcaggaga

SEQ ID NO: 131133 - DNA, 20 bp, Artificial Sequence
  Description of Artificial Sequence: Synthetic oligonucleotide
  Target: ATXN1; (+) strand; PAM type: NRG; PAM sequence: GAG
gaaagatcaagcaggagagg

SEQ ID NO: 131134 - DNA, 20 bp, Artificial Sequence
  Description of Artificial Sequence: Synthetic oligonucleotide
  Target: ATXN1; (+) strand; PAM type: NRG; PAM sequence: TAG
agcaggagagggagataacc

SEQ ID NO: 131135 - DNA, 20 bp, Artificial Sequence
  Description of Artificial Sequence: Synthetic oligonucleotide
  Target: ATXN1; (+) strand; PAM type: NRG; PAM sequence: AGG
gcaggagagggagataacct

SEQ ID NO: 131136 - DNA, 20 bp, Artificial Sequence
  Description of Artificial Sequence: Synthetic oligonucleotide
  Target: ATXN1; (+) strand; PAM type: NRG; PAM sequence: AAG
gggagataacctaggtgaca

SEQ ID NO: 131137 - DNA, 20 bp, Artificial Sequence
  Description of Artificial Sequence: Synthetic oligonucleotide
  Target: ATXN1; (+) strand; PAM type: NRG; PAM sequence: CAG
taacctaggtgacaaagcct

SEQ ID NO: 131138 - DNA, 20 bp, Artificial Sequence
  Description of Artificial Sequence: Synthetic oligonucleotide
  Target: ATXN1; (+) strand; PAM type: NRG; PAM sequence: GAG
acctaggtgacaaagcctca

SEQ ID NO: 131139 - DNA, 20 bp, Artificial Sequence
  Description of Artificial Sequence: Synthetic oligonucleotide
  Target: ATXN1; (+) strand; PAM type: NRG; PAM sequence: AAG
taggtgacaaagcctcagag

SEQ ID NO: 131140 - DNA, 20 bp, Artificial Sequence
  Description of Artificial Sequence: Synthetic oligonucleotide
  Target: ATXN1; (+) strand; PAM type: NRG; PAM sequence: CAG
tgacaaagcctcagagaagt

SEQ ID NO: 131141 - DNA, 20 bp, Artificial Sequence
  Description of Artificial Sequence: Synthetic oligonucleotide
  Target: ATXN1; (+) strand; PAM type: NRG; PAM sequence: AGG
gacaaagcctcagagaagtc

SEQ ID NO: 131142 - DNA, 20 bp, Artificial Sequence
  Description of Artificial Sequence: Synthetic oligonucleotide
  Target: ATXN1; (+) strand; PAM type: NRG; PAM sequence: GGG
acaaagcctcagagaagtca

SEQ ID NO: 131143 - DNA, 20 bp, Artificial Sequence
  Description of Artificial Sequence: Synthetic oligonucleotide
  Target: ATXN1; (+) strand; PAM type: NRG; PAM sequence: TAG
aagcctcagagaagtcaggg

SEQ ID NO: 131144 - DNA, 20 bp, Artificial Sequence
  Description of Artificial Sequence: Synthetic oligonucleotide
  Target: ATXN1; (+) strand; PAM type: NRG; PAM sequence: GAG
gcctcagagaagtcagggta

SEQ ID NO: 131145 - DNA, 20 bp, Artificial Sequence
  Description of Artificial Sequence: Synthetic oligonucleotide
  Target: ATXN1; (+) strand; PAM type: NRG; PAM sequence: GAG
ctcagagaagtcagggtaga

SEQ ID NO: 131146 - DNA, 20 bp, Artificial Sequence
  Description of Artificial Sequence: Synthetic oligonucleotide
  Target: ATXN1; (+) strand; PAM type: NRG; PAM sequence: AGG
tcagagaagtcagggtagag

SEQ ID NO: 131147 - DNA, 20 bp, Artificial Sequence
  Description of Artificial Sequence: Synthetic oligonucleotide
  Target: ATXN1; (+) strand; PAM type: NRG; PAM sequence: GGG
cagagaagtcagggtagaga

SEQ ID NO: 131148 - DNA, 20 bp, Artificial Sequence
  Description of Artificial Sequence: Synthetic oligonucleotide
  Target: ATXN1; (+) strand; PAM type: NRG; PAM sequence: CAG
agtcagggtagagagggatc

SEQ ID NO: 131149 - DNA, 20 bp, Artificial Sequence
  Description of Artificial Sequence: Synthetic oligonucleotide
  Target: ATXN1; (+) strand; PAM type: NRG; PAM sequence: GAG
tagagagggatccagaaaac

SEQ ID NO: 131150 - DNA, 20 bp, Artificial Sequence
  Description of Artificial Sequence: Synthetic oligonucleotide
  Target: ATXN1; (+) strand; PAM type: NRG; PAM sequence: AGG
agagagggatccagaaaacg

SEQ ID NO: 131151 - DNA, 20 bp, Artificial Sequence
  Description of Artificial Sequence: Synthetic oligonucleotide
  Target: ATXN1; (+) strand; PAM type: NRG; PAM sequence: GGG
gagagggatccagaaaacga

SEQ ID NO: 131152 - DNA, 20 bp, Artificial Sequence
  Description of Artificial Sequence: Synthetic oligonucleotide
  Target: ATXN1; (+) strand; PAM type: NRG; PAM sequence: GGG
agagggatccagaaaacgag

SEQ ID NO: 131153 - DNA, 20 bp, Artificial Sequence
  Description of Artificial Sequence: Synthetic oligonucleotide
  Target: ATXN1; (+) strand; PAM type: NRG; PAM sequence: TGG
atccagaaaacgaggggtct

SEQ ID NO: 131154 - DNA, 20 bp, Artificial Sequence
  Description of Artificial Sequence: Synthetic oligonucleotide
  Target: ATXN1; (+) strand; PAM type: NRG; PAM sequence: GAG
ccagaaaacgaggggtcttg

SEQ ID NO: 131155 - DNA, 20 bp, Artificial Sequence
  Description of Artificial Sequence: Synthetic oligonucleotide
  Target: ATXN1; (+) strand; PAM type: NRG; PAM sequence: CGG
cgaggggtcttggagccttg

SEQ ID NO: 131156 - DNA, 20 bp, Artificial Sequence
  Description of Artificial Sequence: Synthetic oligonucleotide
  Target: ATXN1; (+) strand; PAM type: NRG; PAM sequence: GAG
aggggtcttggagccttgcg

SEQ ID NO: 131157 - DNA, 20 bp, Artificial Sequence
  Description of Artificial Sequence: Synthetic oligonucleotide
  Target: ATXN1; (+) strand; PAM type: NRG; PAM sequence: TGG
ggtcttggagccttgcggag

SEQ ID NO: 131158 - DNA, 20 bp, Artificial Sequence
  Description of Artificial Sequence: Synthetic oligonucleotide
  Target: ATXN1; (+) strand; PAM type: NRG; PAM sequence: GGG
gtcttggagccttgcggagt

SEQ ID NO: 131159 - DNA, 20 bp, Artificial Sequence
  Description of Artificial Sequence: Synthetic oligonucleotide
  Target: ATXN1; (+) strand; PAM type: NRG; PAM sequence: GAG
cttggagccttgcggagtgg

SEQ ID NO: 131160 - DNA, 20 bp, Artificial Sequence
  Description of Artificial Sequence: Synthetic oligonucleotide
  Target: ATXN1; (+) strand; PAM type: NRG; PAM sequence: AGG
ttggagccttgcggagtggg

SEQ ID NO: 131161 - DNA, 20 bp, Artificial Sequence
  Description of Artificial Sequence: Synthetic oligonucleotide
  Target: ATXN1; (+) strand; PAM type: NRG; PAM sequence: TGG
gggaggtcttcttgctcctc

SEQ ID NO: 131162 - DNA, 20 bp, Artificial Sequence
  Description of Artificial Sequence: Synthetic oligonucleotide
  Target: ATXN1; (+) strand; PAM type: NRG; PAM sequence: GGG
ggaggtcttcttgctcctct

SEQ ID NO: 131163 - DNA, 20 bp, Artificial Sequence
  Description of Artificial Sequence: Synthetic oligonucleotide
  Target: ATXN1; (+) strand; PAM type: NRG; PAM sequence: GAG
cttgctcctctgggatgcgt

SEQ ID NO: 131164 - DNA, 20 bp, Artificial Sequence
  Description of Artificial Sequence: Synthetic oligonucleotide
  Target: ATXN1; (+) strand; PAM type: NRG; PAM sequence: CAG
tcctctgggatgcgtgagca

SEQ ID NO: 131165 - DNA, 20 bp, Artificial Sequence
  Description of Artificial Sequence: Synthetic oligonucleotide
  Target: ATXN1; (+) strand; PAM type: NRG; PAM sequence: GAG
caacacttgtctgcaactgt

SEQ ID NO: 131166 - DNA, 20 bp, Artificial Sequence
  Description of Artificial Sequence: Synthetic oligonucleotide
  Target: ATXN1; (+) strand; PAM type: NRG; PAM sequence: CAG
acttgtctgcaactgtgaga

SEQ ID NO: 131167 - DNA, 20 bp, Artificial Sequence
  Description of Artificial Sequence: Synthetic oligonucleotide
  Target: ATXN1; (+) strand; PAM type: NRG; PAM sequence: AGG
cttgtctgcaactgtgagac

SEQ ID NO: 131168 - DNA, 20 bp, Artificial Sequence
  Description of Artificial Sequence: Synthetic oligonucleotide
  Target: ATXN1; (+) strand; PAM type: NRG; PAM sequence: GAG
tgtctgcaactgtgagacag

SEQ ID NO: 131169 - DNA, 20 bp, Artificial Sequence
  Description of Artificial Sequence: Synthetic oligonucleotide
  Target: ATXN1; (+) strand; PAM type: NRG; PAM sequence: CGG
caactgtgagacaggagcaa

SEQ ID NO: 131170 - DNA, 20 bp, Artificial Sequence
  Description of Artificial Sequence: Synthetic oligonucleotide
  Target: ATXN1; (+) strand; PAM type: NRG; PAM sequence: CAG
tgtgagacaggagcaacgga

SEQ ID NO: 131171 - DNA, 20 bp, Artificial Sequence
  Description of Artificial Sequence: Synthetic oligonucleotide
  Target: ATXN1; (+) strand; PAM type: NRG; PAM sequence: AAG
aggagcaacggacagaatta

SEQ ID NO: 131172 - DNA, 20 bp, Artificial Sequence
  Description of Artificial Sequence: Synthetic oligonucleotide
  Target: ATXN1; (+) strand; PAM type: NRG; PAM sequence: AGG
ggagcaacggacagaattaa

SEQ ID NO: 131173 - DNA, 20 bp, Artificial Sequence
  Description of Artificial Sequence: Synthetic oligonucleotide
  Target: ATXN1; (+) strand; PAM type: NRG; PAM sequence: GGG
gagcaacggacagaattaaa

SEQ ID NO: 131174 - DNA, 20 bp, Artificial Sequence
  Description of Artificial Sequence: Synthetic oligonucleotide
  Target: ATXN1; (+) strand; PAM type: NRG; PAM sequence: AAG
cggacagaattaaagggaaa

SEQ ID NO: 131175 - DNA, 20 bp, Artificial Sequence
  Description of Artificial Sequence: Synthetic oligonucleotide
  Target: ATXN1; (+) strand; PAM type: NRG; PAM sequence: GAG
gacagaattaaagggaaaaa

SEQ ID NO: 131176 - DNA, 20 bp, Artificial Sequence
  Description of Artificial Sequence: Synthetic oligonucleotide
  Target: ATXN1; (+) strand; PAM type: NRG; PAM sequence: GAG
cagaattaaagggaaaaaga

SEQ ID NO: 131177 - DNA, 20 bp, Artificial Sequence
  Description of Artificial Sequence: Synthetic oligonucleotide
  Target: ATXN1; (+) strand; PAM type: NRG; PAM sequence: TAG
aattaaagggaaaaagagag

SEQ ID NO: 131178 - DNA, 20 bp, Artificial Sequence
  Description of Artificial Sequence: Synthetic oligonucleotide
  Target: ATXN1; (+) strand; PAM type: NRG; PAM sequence: AAG
taaagggaaaaagagagtag

SEQ ID NO: 131179 - DNA, 20 bp, Artificial Sequence
  Description of Artificial Sequence: Synthetic oligonucleotide
  Target: ATXN1; (+) strand; PAM type: NRG; PAM sequence: AGG
aaagggaaaaagagagtaga

SEQ ID NO: 131180 - DNA, 20 bp, Artificial Sequence
  Description of Artificial Sequence: Synthetic oligonucleotide
  Target: ATXN1; (+) strand; PAM type: NRG; PAM sequence: TGG
agagtagaaggattcatgcc

SEQ ID NO: 131181 - DNA, 20 bp, Artificial Sequence
  Description of Artificial Sequence: Synthetic oligonucleotide
  Target: ATXN1; (+) strand; PAM type: NRG; PAM sequence: AAG
gattcatgcctggattcttc

SEQ ID NO: 131182 - DNA, 20 bp, Artificial Sequence
  Description of Artificial Sequence: Synthetic oligonucleotide
  Target: ATXN1; (+) strand; PAM type: NRG; PAM sequence: AAG
gattcttcaagattttaaaa

SEQ ID NO: 131183 - DNA, 20 bp, Artificial Sequence
  Description of Artificial Sequence: Synthetic oligonucleotide
  Target: ATXN1; (+) strand; PAM type: NRG; PAM sequence: AAG
cttcaagattttaaaaaagc

SEQ ID NO: 131184 - DNA, 20 bp, Artificial Sequence
  Description of Artificial Sequence: Synthetic oligonucleotide
  Target: ATXN1; (+) strand; PAM type: NRG; PAM sequence: TGG
aaaaaagcaagatgaataaa

SEQ ID NO: 131185 - DNA, 20 bp, Artificial Sequence
  Description of Artificial Sequence: Synthetic oligonucleotide
  Target: ATXN1; (+) strand; PAM type: NRG; PAM sequence: AAG
gaataaatggtcctctacca

SEQ ID NO: 131186 - DNA, 20 bp, Artificial Sequence
  Description of Artificial Sequence: Synthetic oligonucleotide
  Target: ATXN1; (+) strand; PAM type: NRG; PAM sequence: GAG
aaatggtcctctaccaaagt

SEQ ID NO: 131187 - DNA, 20 bp, Artificial Sequence
  Description of Artificial Sequence: Synthetic oligonucleotide
  Target: ATXN1; (+) strand; PAM type: NRG; PAM sequence: AGG
aatggtcctctaccaaagtg

SEQ ID NO: 131188 - DNA, 20 bp, Artificial Sequence
  Description of Artificial Sequence: Synthetic oligonucleotide
  Target: ATXN1; (+) strand; PAM type: NRG; PAM sequence: GGG
atggtcctctaccaaagtga

SEQ ID NO: 131189 - DNA, 20 bp, Artificial Sequence
  Description of Artificial Sequence: Synthetic oligonucleotide
  Target: ATXN1; (+) strand; PAM type: NRG; PAM sequence: GAG
tcctctaccaaagtgagggt

SEQ ID NO: 131190 - DNA, 20 bp, Artificial Sequence
  Description of Artificial Sequence: Synthetic oligonucleotide
  Target: ATXN1; (+) strand; PAM type: NRG; PAM sequence: AGG
cctctaccaaagtgagggtg

SEQ ID NO: 131191 - DNA, 20 bp, Artificial Sequence
  Description of Artificial Sequence: Synthetic oligonucleotide
  Target: ATXN1; (+) strand; PAM type: NRG; PAM sequence: GGG
ctctaccaaagtgagggtga

SEQ ID NO: 131192 - DNA, 20 bp, Artificial Sequence
  Description of Artificial Sequence: Synthetic oligonucleotide
  Target: ATXN1; (+) strand; PAM type: NRG; PAM sequence: AAG
accaaagtgagggtgagggt

SEQ ID NO: 131193 - DNA, 20 bp, Artificial Sequence
  Description of Artificial Sequence: Synthetic oligonucleotide
  Target: ATXN1; (+) strand; PAM type: NRG; PAM sequence: AAG
gagggtgagggtaagttttg

SEQ ID NO: 131194 - DNA, 20 bp, Artificial Sequence
  Description of Artificial Sequence: Synthetic oligonucleotide
  Target: ATXN1; (+) strand; PAM type: NRG; PAM sequence: GAG
gggtgagggtaagttttgaa

SEQ ID NO: 131195 - DNA, 20 bp, Artificial Sequence
  Description of Artificial Sequence: Synthetic oligonucleotide
  Target: ATXN1; (+) strand; PAM type: NRG; PAM sequence: TGG
agggtaagttttgaagagac

SEQ ID NO: 131196 - DNA, 20 bp, Artificial Sequence
  Description of Artificial Sequence: Synthetic oligonucleotide
  Target: ATXN1; (+) strand; PAM type: NRG; PAM sequence: AAG
aagttttgaagagactggaa

SEQ ID NO: 131197 - DNA, 20 bp, Artificial Sequence
  Description of Artificial Sequence: Synthetic oligonucleotide
  Target: ATXN1; (+) strand; PAM type: NRG; PAM sequence: TGG
ttgaagagactggaaaagtt

SEQ ID NO: 131198 - DNA, 20 bp, Artificial Sequence
  Description of Artificial Sequence: Synthetic oligonucleotide
  Target: ATXN1; (+) strand; PAM type: NRG; PAM sequence: TAG
gagactggaaaagtttggaa

SEQ ID NO: 131199 - DNA, 20 bp, Artificial Sequence
  Description of Artificial Sequence: Synthetic oligonucleotide
  Target: ATXN1; (+) strand; PAM type: NRG; PAM sequence: AAG
aagtttggaatagatcccat

SEQ ID NO: 131200 - DNA, 20 bp, Artificial Sequence
  Description of Artificial Sequence: Synthetic oligonucleotide
  Target: ATXN1; (+) strand; PAM type: NRG; PAM sequence: GAG
cccataagaaatgtgactat

SEQ ID NO: 131201 - DNA, 20 bp, Artificial Sequence
  Description of Artificial Sequence: Synthetic oligonucleotide
  Target: ATXN1; (+) strand; PAM type: NRG; PAM sequence: TAG
aaatgtgactatgagcccac

SEQ ID NO: 131202 - DNA, 20 bp, Artificial Sequence
  Description of Artificial Sequence: Synthetic oligonucleotide
  Target: ATXN1; (+) strand; PAM type: NRG; PAM sequence: AAG
tgactatgagcccactagaa

SEQ ID NO: 131203 - DNA, 20 bp, Artificial Sequence
  Description of Artificial Sequence: Synthetic oligonucleotide
  Target: ATXN1; (+) strand; PAM type: NRG; PAM sequence: CAG
aaagcaatgatgactctcct

SEQ ID NO: 131204 - DNA, 20 bp, Artificial Sequence
  Description of Artificial Sequence: Synthetic oligonucleotide
  Target: ATXN1; (+) strand; PAM type: NRG; PAM sequence: CAG
gatgactctcctcagattaa

SEQ ID NO: 131205 - DNA, 20 bp, Artificial Sequence
  Description of Artificial Sequence: Synthetic oligonucleotide
  Target: ATXN1; (+) strand; PAM type: NRG; PAM sequence: AAG
actctcctcagattaacagt

SEQ ID NO: 131206 - DNA, 20 bp, Artificial Sequence
  Description of Artificial Sequence: Synthetic oligonucleotide
  Target: ATXN1; (+) strand; PAM type: NRG; PAM sequence: CAG
ttaacagtaagaatttacat

SEQ ID NO: 131207 - DNA, 20 bp, Artificial Sequence
  Description of Artificial Sequence: Synthetic oligonucleotide
  Target: ATXN1; (+) strand; PAM type: NRG; PAM sequence: AGG
taacagtaagaatttacatc

SEQ ID NO: 131208 - DNA, 20 bp, Artificial Sequence
  Description of Artificial Sequence: Synthetic oligonucleotide
  Target: ATXN1; (+) strand; PAM type: NRG; PAM sequence: CAG
gaatttacatcaggacccat

SEQ ID NO: 131209 - DNA, 20 bp, Artificial Sequence
  Description of Artificial Sequence: Synthetic oligonucleotide
  Target: ATXN1; (+) strand; PAM type: NRG; PAM sequence: TGG
ttacatcaggacccatcagt

SEQ ID NO: 131210 - DNA, 20 bp, Artificial Sequence
  Description of Artificial Sequence: Synthetic oligonucleotide
  Target: ATXN1; (+) strand; PAM type: NRG; PAM sequence: GGG
tacatcaggacccatcagtt

SEQ ID NO: 131211 - DNA, 20 bp, Artificial Sequence
  Description of Artificial Sequence: Synthetic oligonucleotide
  Target: ATXN1; (+) strand; PAM type: NRG; PAM sequence: TGG
caggacccatcagttgggtt

SEQ ID NO: 131212 - DNA, 20 bp, Artificial Sequence
  Description of Artificial Sequence: Synthetic oligonucleotide
  Target: ATXN1; (+) strand; PAM type: NRG; PAM sequence: GGG
aggacccatcagttgggttt

SEQ ID NO: 131213 - DNA, 20 bp, Artificial Sequence
  Description of Artificial Sequence: Synthetic oligonucleotide
  Target: ATXN1; (+) strand; PAM type: NRG; PAM sequence: GGG
ggacccatcagttgggtttg

SEQ ID NO: 131214 - DNA, 20 bp, Artificial Sequence
  Description of Artificial Sequence: Synthetic oligonucleotide
  Target: ATXN1; (+) strand; PAM type: NRG; PAM sequence: GGG
gacccatcagttgggtttgg

SEQ ID NO: 131215 - DNA, 20 bp, Artificial Sequence
  Description of Artificial Sequence: Synthetic oligonucleotide
  Target: ATXN1; (+) strand; PAM type: NRG; PAM sequence: AAG
agttgggtttgggggcctct

SEQ ID NO: 131216 - DNA, 20 bp, Artificial Sequence
  Description of Artificial Sequence: Synthetic oligonucleotide
  Target: ATXN1; (+) strand; PAM type: NRG; PAM sequence: CAG
tgggtttgggggcctctaag

SEQ ID NO: 131217 - DNA, 20 bp, Artificial Sequence
  Description of Artificial Sequence: Synthetic oligonucleotide
  Target: ATXN1; (+) strand; PAM type: NRG; PAM sequence: CAG
ggggcctctaagcagctgtg

SEQ ID NO: 131218 - DNA, 20 bp, Artificial Sequence
  Description of Artificial Sequence: Synthetic oligonucleotide
  Target: ATXN1; (+) strand; PAM type: NRG; PAM sequence: AGG
gggcctctaagcagctgtgc

SEQ ID NO: 131219 - DNA, 20 bp, Artificial Sequence
  Description of Artificial Sequence: Synthetic oligonucleotide
  Target: ATXN1; (+) strand; PAM type: NRG; PAM sequence: TGG
ctaagcagctgtgcaggtga

SEQ ID NO: 131220 - DNA, 20 bp, Artificial Sequence
  Description of Artificial Sequence: Synthetic oligonucleotide
  Target: ATXN1; (+) strand; PAM type: NRG; PAM sequence: GGG
taagcagctgtgcaggtgat

SEQ ID NO: 131221 - DNA, 20 bp, Artificial Sequence
  Description of Artificial Sequence: Synthetic oligonucleotide
  Target: ATXN1; (+) strand; PAM type: NRG; PAM sequence: GGG
aagcagctgtgcaggtgatg

SEQ ID NO: 131222 - DNA, 20 bp, Artificial Sequence
  Description of Artificial Sequence: Synthetic oligonucleotide
  Target: ATXN1; (+) strand; PAM type: NRG; PAM sequence: CAG
tgcaggtgatggggatcatg

SEQ ID NO: 131223 - DNA, 20 bp, Artificial Sequence
  Description of Artificial Sequence: Synthetic oligonucleotide
  Target: ATXN1; (+) strand; PAM type: NRG; PAM sequence: AGG
gcaggtgatggggatcatgc

SEQ ID NO: 131224 - DNA, 20 bp, Artificial Sequence
  Description of Artificial Sequence: Synthetic oligonucleotide
  Target: ATXN1; (+) strand; PAM type: NRG; PAM sequence: TGG
tgatggggatcatgcaggat

SEQ ID NO: 131225 - DNA, 20 bp, Artificial Sequence
  Description of Artificial Sequence: Synthetic oligonucleotide
  Target: ATXN1; (+) strand; PAM type: NRG; PAM sequence: TGG
gatcatgcaggattggtgcc

SEQ ID NO: 131226 - DNA, 20 bp, Artificial Sequence
  Description of Artificial Sequence: Synthetic oligonucleotide
  Target: ATXN1; (+) strand; PAM type: NRG; PAM sequence: AAG
atgcaggattggtgcctgga

SEQ ID NO: 131227 - DNA, 20 bp, Artificial Sequence
  Description of Artificial Sequence: Synthetic oligonucleotide
  Target: ATXN1; (+) strand; PAM type: NRG; PAM sequence: AGG
tgcaggattggtgcctggaa

SEQ ID NO: 131228 - DNA, 20 bp, Artificial Sequence
  Description of Artificial Sequence: Synthetic oligonucleotide
  Target: ATXN1; (+) strand; PAM type: NRG; PAM sequence: TGG
ggtgcctggaaaggaatgca

SEQ ID NO: 131229 - DNA, 20 bp, Artificial Sequence
  Description of Artificial Sequence: Synthetic oligonucleotide
  Target: ATXN1; (+) strand; PAM type: NRG; PAM sequence: AAG
ggaaaggaatgcatggcact

SEQ ID NO: 131230 - DNA, 20 bp, Artificial Sequence
  Description of Artificial Sequence: Synthetic oligonucleotide
  Target: ATXN1; (+) strand; PAM type: NRG; PAM sequence: TGG
aatgcatggcactaagctat

SEQ ID NO: 131231 - DNA, 20 bp, Artificial Sequence
  Description of Artificial Sequence: Synthetic oligonucleotide
  Target: ATXN1; (+) strand; PAM type: NRG; PAM sequence: GGG
atgcatggcactaagctatt

SEQ ID NO: 131232 - DNA, 20 bp, Artificial Sequence
  Description of Artificial Sequence: Synthetic oligonucleotide
  Target: ATXN1; (+) strand; PAM type: NRG; PAM sequence: CAG
actaagctattgggcatgca

SEQ ID NO: 131233 - DNA, 20 bp, Artificial Sequence
  Description of Artificial Sequence: Synthetic oligonucleotide
  Target: ATXN1; (+) strand; PAM type: NRG; PAM sequence: AAG
gcatgcacagttaaactttc

SEQ ID NO: 131234 - DNA, 20 bp, Artificial Sequence
  Description of Artificial Sequence: Synthetic oligonucleotide
  Target: ATXN1; (+) strand; PAM type: NRG; PAM sequence: GAG
cagttaaactttcaagccat

SEQ ID NO: 131235 - DNA, 20 bp, Artificial Sequence
  Description of Artificial Sequence: Synthetic oligonucleotide
  Target: ATXN1; (+) strand; PAM type: NRG; PAM sequence: AGG
agttaaactttcaagccatg

SEQ ID NO: 131236 - DNA, 20 bp, Artificial Sequence
  Description of Artificial Sequence: Synthetic oligonucleotide
  Target: ATXN1; (+) strand; PAM type: NRG; PAM sequence: TAG
aactttcaagccatgaggtc

SEQ ID NO: 131237 - DNA, 20 bp, Artificial Sequence
  Description of Artificial Sequence: Synthetic oligonucleotide
  Target: ATXN1; (+) strand; PAM type: NRG; PAM sequence: AGG
actttcaagccatgaggtct

SEQ ID NO: 131238 - DNA, 20 bp, Artificial Sequence
  Description of Artificial Sequence: Synthetic oligonucleotide
  Target: ATXN1; (+) strand; PAM type: NRG; PAM sequence: TGG
tcaagccatgaggtctaggc

SEQ ID NO: 131239 - DNA, 20 bp, Artificial Sequence
  Description of Artificial Sequence: Synthetic oligonucleotide
  Target: ATXN1; (+) strand; PAM type: NRG; PAM sequence: TAG
gccatgaggtctaggctggt

SEQ ID NO: 131240 - DNA, 20 bp, Artificial Sequence
  Description of Artificial Sequence: Synthetic oligonucleotide
  Target: ATXN1; (+) strand; PAM type: NRG; PAM sequence: AGG
ccatgaggtctaggctggtt

SEQ ID NO: 131241 - DNA, 20 bp, Artificial Sequence
  Description of Artificial Sequence: Synthetic oligonucleotide
  Target: ATXN1; (+) strand; PAM type: NRG; PAM sequence: GGG
catgaggtctaggctggtta

SEQ ID NO: 131242 - DNA, 20 bp, Artificial Sequence
  Description of Artificial Sequence: Synthetic oligonucleotide
  Target: ATXN1; (+) strand; PAM type: NRG; PAM sequence: GGG
atgaggtctaggctggttag

SEQ ID NO: 131243 - DNA, 20 bp, Artificial Sequence
  Description of Artificial Sequence: Synthetic oligonucleotide
  Target: ATXN1; (+) strand; PAM type: NRG; PAM sequence: GGG
tgaggtctaggctggttagg

SEQ ID NO: 131244 - DNA, 20 bp, Artificial Sequence
  Description of Artificial Sequence: Synthetic oligonucleotide
  Target: ATXN1; (+) strand; PAM type: NRG; PAM sequence: CAG
ggtctaggctggttaggggg

SEQ ID NO: 131245 - DNA, 20 bp, Artificial Sequence
  Description of Artificial Sequence: Synthetic oligonucleotide
  Target: ATXN1; (+) strand; PAM type: NRG; PAM sequence: AGG
gtctaggctggttagggggc

SEQ ID NO: 131246 - DNA, 20 bp, Artificial Sequence
  Description of Artificial Sequence: Synthetic oligonucleotide
  Target: ATXN1; (+) strand; PAM type: NRG; PAM sequence: CGG
ctggttagggggcaggaata

SEQ ID NO: 131247 - DNA, 20 bp, Artificial Sequence
  Description of Artificial Sequence: Synthetic oligonucleotide
  Target: ATXN1; (+) strand; PAM type: NRG; PAM sequence: GAG
ggttagggggcaggaatacg

SEQ ID NO: 131248 - DNA, 20 bp, Artificial Sequence
  Description of Artificial Sequence: Synthetic oligonucleotide
  Target: ATXN1; (+) strand; PAM type: NRG; PAM sequence: AAG
gggcaggaatacggagcctg

SEQ ID NO: 131249 - DNA, 20 bp, Artificial Sequence
  Description of Artificial Sequence: Synthetic oligonucleotide
  Target: ATXN1; (+) strand; PAM type: NRG; PAM sequence: AAG
aggaatacggagcctgaaga

SEQ ID NO: 131250 - DNA, 20 bp, Artificial Sequence
  Description of Artificial Sequence: Synthetic oligonucleotide
  Target: ATXN1; (+) strand; PAM type: NRG; PAM sequence: TGG
aatacggagcctgaagaaag

SEQ ID NO: 131251 - DNA, 20 bp, Artificial Sequence
  Description of Artificial Sequence: Synthetic oligonucleotide
  Target: ATXN1; (+) strand; PAM type: NRG; PAM sequence: TAG
gagcctgaagaaagtggcta

SEQ ID NO: 131252 - DNA, 20 bp, Artificial Sequence
  Description of Artificial Sequence: Synthetic oligonucleotide
  Target: ATXN1; (+) strand; PAM type: NRG; PAM sequence: AAG
agaaagtggctatagtgacc

SEQ ID NO: 131253 - DNA, 20 bp, Artificial Sequence
  Description of Artificial Sequence: Synthetic oligonucleotide
  Target: ATXN1; (+) strand; PAM type: NRG; PAM sequence: GAG
aaagtggctatagtgaccaa

SEQ ID NO: 131254 - DNA, 20 bp, Artificial Sequence
  Description of Artificial Sequence: Synthetic oligonucleotide
  Target: ATXN1; (+) strand; PAM type: NRG; PAM sequence: TGG
gtggctatagtgaccaagag

SEQ ID NO: 131255 - DNA, 20 bp, Artificial Sequence
  Description of Artificial Sequence: Synthetic oligonucleotide
  Target: ATXN1; (+) strand; PAM type: NRG; PAM sequence: GGG
tggctatagtgaccaagagt

SEQ ID NO: 131256 - DNA, 20 bp, Artificial Sequence
  Description of Artificial Sequence: Synthetic oligonucleotide
  Target: ATXN1; (+) strand; PAM type: NRG; PAM sequence: GGG
ggctatagtgaccaagagtg

SEQ ID NO: 131257 - DNA, 20 bp, Artificial Sequence
  Description of Artificial Sequence: Synthetic oligonucleotide
  Target: ATXN1; (+) strand; PAM type: NRG; PAM sequence: GGG
gctatagtgaccaagagtgg

SEQ ID NO: 131258 - DNA, 20 bp, Artificial Sequence
  Description of Artificial Sequence: Synthetic oligonucleotide
  Target: ATXN1; (+) strand; PAM type: NRG; PAM sequence: GAG
agtgaccaagagtgggggat

SEQ ID NO: 131259 - DNA, 20 bp, Artificial Sequence
  Description of Artificial Sequence: Synthetic oligonucleotide
  Target: ATXN1; (+) strand; PAM type: NRG; PAM sequence: CAG
accaagagtgggggatgagt

SEQ ID NO: 131260 - DNA, 20 bp, Artificial Sequence
  Description of Artificial Sequence: Synthetic oligonucleotide
  Target: ATXN1; (+) strand; PAM type: NRG; PAM sequence: AGG
ccaagagtgggggatgagtc

SEQ ID NO: 131261 - DNA, 20 bp, Artificial Sequence
  Description of Artificial Sequence: Synthetic oligonucleotide
  Target: ATXN1; (+) strand; PAM type: NRG; PAM sequence: GGG
caagagtgggggatgagtca

SEQ ID NO: 131262 - DNA, 20 bp, Artificial Sequence
  Description of Artificial Sequence: Synthetic oligonucleotide
  Target: ATXN1; (+) strand; PAM type: NRG; PAM sequence: AAG
gatgagtcagggctcacaat

SEQ ID NO: 131263 - DNA, 20 bp, Artificial Sequence
  Description of Artificial Sequence: Synthetic oligonucleotide
  Target: ATXN1; (+) strand; PAM type: NRG; PAM sequence: AGG
atgagtcagggctcacaata

SEQ ID NO: 131264 - DNA, 20 bp, Artificial Sequence
  Description of Artificial Sequence: Synthetic oligonucleotide
  Target: ATXN1; (+) strand; PAM type: NRG; PAM sequence: GAG
gagtcagggctcacaataag

SEQ ID NO: 131265 - DNA, 20 bp, Artificial Sequence
  Description of Artificial Sequence: Synthetic oligonucleotide
  Target: ATXN1; (+) strand; PAM type: NRG; PAM sequence: GAG
ctcacaataaggagacaact

SEQ ID NO: 131266 - DNA, 20 bp, Artificial Sequence
  Description of Artificial Sequence: Synthetic oligonucleotide
  Target: ATXN1; (+) strand; PAM type: NRG; PAM sequence: GAG
taaggagacaactgagttct

SEQ ID NO: 131267 - DNA, 20 bp, Artificial Sequence
  Description of Artificial Sequence: Synthetic oligonucleotide
  Target: ATXN1; (+) strand; PAM type: NRG; PAM sequence: AGG
aaggagacaactgagttctg

SEQ ID NO: 131268 - DNA, 20 bp, Artificial Sequence
  Description of Artificial Sequence: Synthetic oligonucleotide
  Target: ATXN1; (+) strand; PAM type: NRG; PAM sequence: AAG
gagacaactgagttctgagg

SEQ ID NO: 131269 - DNA, 20 bp, Artificial Sequence
  Description of Artificial Sequence: Synthetic oligonucleotide
  Target: ATXN1; (+) strand; PAM type: NRG; PAM sequence: GAG
gacaactgagttctgaggaa

SEQ ID NO: 131270 - DNA, 20 bp, Artificial Sequence
  Description of Artificial Sequence: Synthetic oligonucleotide
  Target: ATXN1; (+) strand; PAM type: NRG; PAM sequence: GAG
caactgagttctgaggaaga

SEQ ID NO: 131271 - DNA, 20 bp, Artificial Sequence
  Description of Artificial Sequence: Synthetic oligonucleotide
  Target: ATXN1; (+) strand; PAM type: NRG; PAM sequence: AGG
aactgagttctgaggaagag

SEQ ID NO: 131272 - DNA, 20 bp, Artificial Sequence
  Description of Artificial Sequence: Synthetic oligonucleotide
  Target: ATXN1; (+) strand; PAM type: NRG; PAM sequence: GGG
actgagttctgaggaagaga

SEQ ID NO: 131273 - DNA, 20 bp, Artificial Sequence
  Description of Artificial Sequence: Synthetic oligonucleotide
  Target: ATXN1; (+) strand; PAM type: NRG; PAM sequence: AAG
agttctgaggaagagaggga

SEQ ID NO: 131274 - DNA, 20 bp, Artificial Sequence
  Description of Artificial Sequence: Synthetic oligonucleotide
  Target: ATXN1; (+) strand; PAM type: NRG; PAM sequence: AAG
ctgaggaagagagggaaagc

SEQ ID NO: 131275 - DNA, 20 bp, Artificial Sequence
  Description of Artificial Sequence: Synthetic oligonucleotide
  Target: ATXN1; (+) strand; PAM type: NRG; PAM sequence: AGG
tgaggaagagagggaaagca

SEQ ID NO: 131276 - DNA, 20 bp, Artificial Sequence
  Description of Artificial Sequence: Synthetic oligonucleotide
  Target: ATXN1; (+) strand; PAM type: NRG; PAM sequence: GGG
gaggaagagagggaaagcaa

SEQ ID NO: 131277 - DNA, 20 bp, Artificial Sequence
  Description of Artificial Sequence: Synthetic oligonucleotide
  Target: ATXN1; (+) strand; PAM type: NRG; PAM sequence: GGG
aggaagagagggaaagcaag

SEQ ID NO: 131278 - DNA, 20 bp, Artificial Sequence
  Description of Artificial Sequence: Synthetic oligonucleotide
  Target: ATXN1; (+) strand; PAM type: NRG; PAM sequence: GGG
ggaagagagggaaagcaagg

SEQ ID NO: 131279 - DNA, 20 bp, Artificial Sequence
  Description of Artificial Sequence: Synthetic oligonucleotide
  Target: ATXN1; (+) strand; PAM type: NRG; PAM sequence: CAG
gagagggaaagcaagggggt

SEQ ID NO: 131280 - DNA, 20 bp, Artificial Sequence
  Description of Artificial Sequence: Synthetic oligonucleotide
  Target: ATXN1; (+) strand; PAM type: NRG; PAM sequence: AGG
agagggaaagcaagggggtc

SEQ ID NO: 131281 - DNA, 20 bp, Artificial Sequence
  Description of Artificial Sequence: Synthetic oligonucleotide
  Target: ATXN1; (+) strand; PAM type: NRG; PAM sequence: GAG
agggaaagcaagggggtcag

SEQ ID NO: 131282 - DNA, 20 bp, Artificial Sequence
  Description of Artificial Sequence: Synthetic oligonucleotide
  Target: ATXN1; (+) strand; PAM type: NRG; PAM sequence: AGG
gggaaagcaagggggtcagg

SEQ ID NO: 131283 - DNA, 20 bp, Artificial Sequence
  Description of Artificial Sequence: Synthetic oligonucleotide
  Target: ATXN1; (+) strand; PAM type: NRG; PAM sequence: CAG
gggggtcaggaggctatgcc

SEQ ID NO: 131284 - DNA, 20 bp, Artificial Sequence
  Description of Artificial Sequence: Synthetic oligonucleotide
  Target: ATXN1; (+) strand; PAM type: NRG; PAM sequence: GAG
gggtcaggaggctatgccca

SEQ ID NO: 131285 - DNA, 20 bp, Artificial Sequence
  Description of Artificial Sequence: Synthetic oligonucleotide
  Target: ATXN1; (+) strand; PAM type: NRG; PAM sequence: GAG
gtcaggaggctatgcccaga

SEQ ID NO: 131286 - DNA, 20 bp, Artificial Sequence
  Description of Artificial Sequence: Synthetic oligonucleotide
  Target: ATXN1; (+) strand; PAM type: NRG; PAM sequence: CAG
gctatgcccagagagaacta

SEQ ID NO: 131287 - DNA, 20 bp, Artificial Sequence
  Description of Artificial Sequence: Synthetic oligonucleotide
  Target: ATXN1; (+) strand; PAM type: NRG; PAM sequence: GAG
tatgcccagagagaactaca

SEQ ID NO: 131288 - DNA, 20 bp, Artificial Sequence
  Description of Artificial Sequence: Synthetic oligonucleotide
  Target: ATXN1; (+) strand; PAM type: NRG; PAM sequence: GAG
cagagagaactacagagtct

SEQ ID NO: 131289 - DNA, 20 bp, Artificial Sequence
  Description of Artificial Sequence: Synthetic oligonucleotide
  Target: ATXN1; (+) strand; PAM type: NRG; PAM sequence: AAG
actacagagtctgagatttt

SEQ ID NO: 131290 - DNA, 20 bp, Artificial Sequence
  Description of Artificial Sequence: Synthetic oligonucleotide
  Target: ATXN1; (+) strand; PAM type: NRG; PAM sequence: TAG
gagtctgagattttaagatt

SEQ ID NO: 131291 - DNA, 20 bp, Artificial Sequence
  Description of Artificial Sequence: Synthetic oligonucleotide
  Target: ATXN1; (+) strand; PAM type: NRG; PAM sequence: AAG
ctgagattttaagatttaga

SEQ ID NO: 131292 - DNA, 20 bp, Artificial Sequence
  Description of Artificial Sequence: Synthetic oligonucleotide
  Target: ATXN1; (+) strand; PAM type: NRG; PAM sequence: AGG
tgagattttaagatttagaa

SEQ ID NO: 131293 - DNA, 20 bp, Artificial Sequence
  Description of Artificial Sequence: Synthetic oligonucleotide
  Target: ATXN1; (+) strand; PAM type: NRG; PAM sequence: AAG
tttaagatttagaaaggtcc

SEQ ID NO: 131294 - DNA, 20 bp, Artificial Sequence
  Description of Artificial Sequence: Synthetic oligonucleotide
  Target: ATXN1; (+) strand; PAM type: NRG; PAM sequence: TGG
agatttagaaaggtccaagt

SEQ ID NO: 131295 - DNA, 20 bp, Artificial Sequence
  Description of Artificial Sequence: Synthetic oligonucleotide
  Target: ATXN1; (+) strand; PAM type: NRG; PAM sequence: GGG
gatttagaaaggtccaagtt

SEQ ID NO: 131296 - DNA, 20 bp, Artificial Sequence
  Description of Artificial Sequence: Synthetic oligonucleotide
  Target: ATXN1; (+) strand; PAM type: NRG; PAM sequence: GGG
atttagaaaggtccaagttg

SEQ ID NO: 131297 - DNA, 20 bp, Artificial Sequence
  Description of Artificial Sequence: Synthetic oligonucleotide
  Target: ATXN1; (+) strand; PAM type: NRG; PAM sequence: GGG
tttagaaaggtccaagttgg

SEQ ID NO: 131298 - DNA, 20 bp, Artificial Sequence
  Description of Artificial Sequence: Synthetic oligonucleotide
  Target: ATXN1; (+) strand; PAM type: NRG; PAM sequence: GGG
ttagaaaggtccaagttggg

SEQ ID NO: 131299 - DNA, 20 bp, Artificial Sequence
  Description of Artificial Sequence: Synthetic oligonucleotide
  Target: ATXN1; (+) strand; PAM type: NRG; PAM sequence: GAG
aggtccaagttggggggtgt

SEQ ID NO: 131300 - DNA, 20 bp, Artificial Sequence
  Description of Artificial Sequence: Synthetic oligonucleotide
  Target: ATXN1; (+) strand; PAM type: NRG; PAM sequence: AGG
ggtccaagttggggggtgtg

SEQ ID NO: 131301 - DNA, 20 bp, Artificial Sequence
  Description of Artificial Sequence: Synthetic oligonucleotide
  Target: ATXN1; (+) strand; PAM type: NRG; PAM sequence: GGG
gtccaagttggggggtgtga

SEQ ID NO: 131302 - DNA, 20 bp, Artificial Sequence
  Description of Artificial Sequence: Synthetic oligonucleotide
  Target: ATXN1; (+) strand; PAM type: NRG; PAM sequence: AAG
gttggggggtgtgagggttc

SEQ ID NO: 131303 - DNA, 20 bp, Artificial Sequence
  Description of Artificial Sequence: Synthetic oligonucleotide
  Target: ATXN1; (+) strand; PAM type: NRG; PAM sequence: CAG
tgagggttcaagttgataca

SEQ ID NO: 131304 - DNA, 20 bp, Artificial Sequence
  Description of Artificial Sequence: Synthetic oligonucleotide
  Target: ATXN1; (+) strand; PAM type: NRG; PAM sequence: AGG
gagggttcaagttgatacac

SEQ ID NO: 131305 - DNA, 20 bp, Artificial Sequence
  Description of Artificial Sequence: Synthetic oligonucleotide
  Target: ATXN1; (+) strand; PAM type: NRG; PAM sequence: CGG
ttcaagttgatacacaggtc

SEQ ID NO: 131306 - DNA, 20 bp, Artificial Sequence
  Description of Artificial Sequence: Synthetic oligonucleotide
  Target: ATXN1; (+) strand; PAM type: NRG; PAM sequence: GGG
tcaagttgatacacaggtcc

SEQ ID NO: 131307 - DNA, 20 bp, Artificial Sequence
  Description of Artificial Sequence: Synthetic oligonucleotide
  Target: ATXN1; (+) strand; PAM type: NRG; PAM sequence: GGG
caagttgatacacaggtccg

SEQ ID NO: 131308 - DNA, 20 bp, Artificial Sequence
  Description of Artificial Sequence: Synthetic oligonucleotide
  Target: ATXN1; (+) strand; PAM type: NRG; PAM sequence: TGG
tgatacacaggtccggggtg

SEQ ID NO: 131309 - DNA, 20 bp, Artificial Sequence
  Description of Artificial Sequence: Synthetic oligonucleotide
  Target: ATXN1; (+) strand; PAM type: NRG; PAM sequence: CAG
tacacaggtccggggtgtgg

SEQ ID NO: 131310 - DNA, 20 bp, Artificial Sequence
  Description of Artificial Sequence: Synthetic oligonucleotide
  Target: ATXN1; (+) strand; PAM type: NRG; PAM sequence: TGG
ccggggtgtggcagtatctc

SEQ ID NO: 131311 - DNA, 20 bp, Artificial Sequence
  Description of Artificial Sequence: Synthetic oligonucleotide
  Target: ATXN1; (+) strand; PAM type: NRG; PAM sequence: GGG
cggggtgtggcagtatctct

SEQ ID NO: 131312 - DNA, 20 bp, Artificial Sequence
  Description of Artificial Sequence: Synthetic oligonucleotide
  Target: ATXN1; (+) strand; PAM type: NRG; PAM sequence: AAG
ggtgtggcagtatctctggg

SEQ ID NO: 131313 - DNA, 20 bp, Artificial Sequence
  Description of Artificial Sequence: Synthetic oligonucleotide
  Target: ATXN1; (+) strand; PAM type: NRG; PAM sequence: AAG
atctctgggaagctgaaatg

SEQ ID NO: 131314 - DNA, 20 bp, Artificial Sequence
  Description of Artificial Sequence: Synthetic oligonucleotide
  Target: ATXN1; (+) strand; PAM type: NRG; PAM sequence: AGG
tctctgggaagctgaaatga

SEQ ID NO: 131315 - DNA, 20 bp, Artificial Sequence
  Description of Artificial Sequence: Synthetic oligonucleotide
  Target: ATXN1; (+) strand; PAM type: NRG; PAM sequence: AAG
tgggaagctgaaatgaagga

SEQ ID NO: 131316 - DNA, 20 bp, Artificial Sequence
  Description of Artificial Sequence: Synthetic oligonucleotide
  Target: ATXN1; (+) strand; PAM type: NRG; PAM sequence: AGG
gggaagctgaaatgaaggaa

SEQ ID NO: 131317 - DNA, 20 bp, Artificial Sequence
  Description of Artificial Sequence: Synthetic oligonucleotide
  Target: ATXN1; (+) strand; PAM type: NRG; PAM sequence: AAG
gctgaaatgaaggaaaggtg

SEQ ID NO: 131318 - DNA, 20 bp, Artificial Sequence
  Description of Artificial Sequence: Synthetic oligonucleotide
  Target: ATXN1; (+) strand; PAM type: NRG; PAM sequence: AAG
tgaaggaaaggtgaagtctt

SEQ ID NO: 131319 - DNA, 20 bp, Artificial Sequence
  Description of Artificial Sequence: Synthetic oligonucleotide
  Target: ATXN1; (+) strand; PAM type: NRG; PAM sequence: AGG
gaaggaaaggtgaagtctta

SEQ ID NO: 131320 - DNA, 20 bp, Artificial Sequence
  Description of Artificial Sequence: Synthetic oligonucleotide
  Target: ATXN1; (+) strand; PAM type: NRG; PAM sequence: GAG
gaaaggtgaagtcttaaggt

SEQ ID NO: 131321 - DNA, 20 bp, Artificial Sequence
  Description of Artificial Sequence: Synthetic oligonucleotide
  Target: ATXN1; (+) strand; PAM type: NRG; PAM sequence: AGG
aaaggtgaagtcttaaggtg

SEQ ID NO: 131322 - DNA, 20 bp, Artificial Sequence
  Description of Artificial Sequence: Synthetic oligonucleotide
  Target: ATXN1; (+) strand; PAM type: NRG; PAM sequence: GAG
aggtgaagtcttaaggtgag

SEQ ID NO: 131323 - DNA, 20 bp, Artificial Sequence
  Description of Artificial Sequence: Synthetic oligonucleotide
  Target: ATXN1; (+) strand; PAM type: NRG; PAM sequence: AAG
agtcttaaggtgaggagatg

SEQ ID NO: 131324 - DNA, 20 bp, Artificial Sequence
  Description of Artificial Sequence: Synthetic oligonucleotide
  Target: ATXN1; (+) strand; PAM type: NRG; PAM sequence: CAG
gtgaggagatgaagcaactg

SEQ ID NO: 131325 - DNA, 20 bp, Artificial Sequence
  Description of Artificial Sequence: Synthetic oligonucleotide
  Target: ATXN1; (+) strand; PAM type: NRG; PAM sequence: AGG
tgaggagatgaagcaactgc

SEQ ID NO: 131326 - DNA, 20 bp, Artificial Sequence
  Description of Artificial Sequence: Synthetic oligonucleotide
  Target: ATXN1; (+) strand; PAM type: NRG; PAM sequence: GGG
gaggagatgaagcaactgca

SEQ ID NO: 131327 - DNA, 20 bp, Artificial Sequence
  Description of Artificial Sequence: Synthetic oligonucleotide
  Target: ATXN1; (+) strand; PAM type: NRG; PAM sequence: CAG
gagatgaagcaactgcaggg

SEQ ID NO: 131328 - DNA, 20 bp, Artificial Sequence
  Description of Artificial Sequence: Synthetic oligonucleotide
  Target: ATXN1; (+) strand; PAM type: NRG; PAM sequence: GAG
gatgaagcaactgcagggca

SEQ ID NO: 131329 - DNA, 20 bp, Artificial Sequence
  Description of Artificial Sequence: Synthetic oligonucleotide
  Target: ATXN1; (+) strand; PAM type: NRG; PAM sequence: GAG
tgaagcaactgcagggcaga

SEQ ID NO: 131330 - DNA, 20 bp, Artificial Sequence
  Description of Artificial Sequence: Synthetic oligonucleotide
  Target: ATXN1; (+) strand; PAM type: NRG; PAM sequence: AAG
agcaactgcagggcagagag

SEQ ID NO: 131331 - DNA, 20 bp, Artificial Sequence
  Description of Artificial Sequence: Synthetic oligonucleotide
  Target: ATXN1; (+) strand; PAM type: NRG; PAM sequence: AGG
gcaactgcagggcagagaga

SEQ ID NO: 131332 - DNA, 20 bp, Artificial Sequence
  Description of Artificial Sequence: Synthetic oligonucleotide
  Target: ATXN1; (+) strand; PAM type: NRG; PAM sequence: GGG
caactgcagggcagagagaa

SEQ ID NO: 131333 - DNA, 20 bp, Artificial Sequence
  Description of Artificial Sequence: Synthetic oligonucleotide
  Target: ATXN1; (+) strand; PAM type: NRG; PAM sequence: CAG
tgcagggcagagagaagggt

SEQ ID NO: 131334 - DNA, 20 bp, Artificial Sequence
  Description of Artificial Sequence: Synthetic oligonucleotide
  Target: ATXN1; (+) strand; PAM type: NRG; PAM sequence: AGG
gcagggcagagagaagggtc

SEQ ID NO: 131335 - DNA, 20 bp, Artificial Sequence
  Description of Artificial Sequence: Synthetic oligonucleotide
  Target: ATXN1; (+) strand; PAM type: NRG; PAM sequence: CGG
ggtcaggttaaacttaacac

SEQ ID NO: 131336 - DNA, 20 bp, Artificial Sequence
  Description of Artificial Sequence: Synthetic oligonucleotide
  Target: ATXN1; (+) strand; PAM type: NRG; PAM sequence: CAG
gtccatgacgccgctgcact

SEQ ID NO: 131337 - DNA, 20 bp, Artificial Sequence
  Description of Artificial Sequence: Synthetic oligonucleotide
  Target: ATXN1; (+) strand; PAM type: NRG; PAM sequence: CAG
gacgccgctgcactcagaca

SEQ ID NO: 131338 - DNA, 20 bp, Artificial Sequence
  Description of Artificial Sequence: Synthetic oligonucleotide
  Target: ATXN1; (+) strand; PAM type: NRG; PAM sequence: GAG
cgccgctgcactcagacaca

SEQ ID NO: 131339 - DNA, 20 bp, Artificial Sequence
  Description of Artificial Sequence: Synthetic oligonucleotide
  Target: ATXN1; (+) strand; PAM type: NRG; PAM sequence: AGG
gccgctgcactcagacacag

SEQ ID NO: 131340 - DNA, 20 bp, Artificial Sequence
  Description of Artificial Sequence: Synthetic oligonucleotide
  Target: ATXN1; (+) strand; PAM type: NRG; PAM sequence: AAG
gctgcactcagacacagagg

SEQ ID NO: 131341 - DNA, 20 bp, Artificial Sequence
  Description of Artificial Sequence: Synthetic oligonucleotide
  Target: ATXN1; (+) strand; PAM type: NRG; PAM sequence: CGG
tttcatcatctttttgtcaa

SEQ ID NO: 131342 - DNA, 20 bp, Artificial Sequence
  Description of Artificial Sequence: Synthetic oligonucleotide
  Target: ATXN1; (+) strand; PAM type: NRG; PAM sequence: GGG
ttcatcatctttttgtcaac

SEQ ID NO: 131343 - DNA, 20 bp, Artificial Sequence
  Description of Artificial Sequence: Synthetic oligonucleotide
  Target: ATXN1; (+) strand; PAM type: NRG; PAM sequence: GGG
tcatcatctttttgtcaacg

SEQ ID NO: 131344 - DNA, 20 bp, Artificial Sequence
  Description of Artificial Sequence: Synthetic oligonucleotide
  Target: ATXN1; (+) strand; PAM type: NRG; PAM sequence: CAG
gggaacacaaatgcccgctc

SEQ ID NO: 131345 - DNA, 20 bp, Artificial Sequence
  Description of Artificial Sequence: Synthetic oligonucleotide
  Target: ATXN1; (+) strand; PAM type: NRG; PAM sequence: AGG
ggaacacaaatgcccgctcc

SEQ ID NO: 131346 - DNA, 20 bp, Artificial Sequence
  Description of Artificial Sequence: Synthetic oligonucleotide
  Target: ATXN1; (+) strand; PAM type: NRG; PAM sequence: AAG
caaatgcccgctccaggtcc

SEQ ID NO: 131347 - DNA, 20 bp, Artificial Sequence
  Description of Artificial Sequence: Synthetic oligonucleotide
  Target: ATXN1; (+) strand; PAM type: NRG; PAM sequence: AGG
aaatgcccgctccaggtcca

SEQ ID NO: 131348 - DNA, 20 bp, Artificial Sequence
  Description of Artificial Sequence: Synthetic oligonucleotide
  Target: ATXN1; (+) strand; PAM type: NRG; PAM sequence: GGG
aatgcccgctccaggtccaa

SEQ ID NO: 131349 - DNA, 20 bp, Artificial Sequence
  Description of Artificial Sequence: Synthetic oligonucleotide
  Target: ATXN1; (+) strand; PAM type: NRG; PAM sequence: TAG
ccgctccaggtccaagggct

SEQ ID NO: 131350 - DNA, 20 bp, Artificial Sequence
  Description of Artificial Sequence: Synthetic oligonucleotide
  Target: ATXN1; (+) strand; PAM type: NRG; PAM sequence: AGG
cgctccaggtccaagggctt

SEQ ID NO: 131351 - DNA, 20 bp, Artificial Sequence
  Description of Artificial Sequence: Synthetic oligonucleotide
  Target: ATXN1; (+) strand; PAM type: NRG; PAM sequence: CGG
ccaggtccaagggcttagga

SEQ ID NO: 131352 - DNA, 20 bp, Artificial Sequence
  Description of Artificial Sequence: Synthetic oligonucleotide
  Target: ATXN1; (+) strand; PAM type: NRG; PAM sequence: GAG
aggtccaagggcttaggacg

SEQ ID NO: 131353 - DNA, 20 bp, Artificial Sequence
  Description of Artificial Sequence: Synthetic oligonucleotide
  Target: ATXN1; (+) strand; PAM type: NRG; PAM sequence: TAG
gatttatattccttactttt

SEQ ID NO: 131354 - DNA, 20 bp, Artificial Sequence
  Description of Artificial Sequence: Synthetic oligonucleotide
  Target: ATXN1; (+) strand; PAM type: NRG; PAM sequence: AGG
atttatattccttacttttt

SEQ ID NO: 131355 - DNA, 20 bp, Artificial Sequence
  Description of Artificial Sequence: Synthetic oligonucleotide
  Target: ATXN1; (+) strand; PAM type: NRG; PAM sequence: TGG
cttactttttaggatacaat

SEQ ID NO: 131356 - DNA, 20 bp, Artificial Sequence
  Description of Artificial Sequence: Synthetic oligonucleotide
  Target: ATXN1; (+) strand; PAM type: NRG; PAM sequence: GGG
ttactttttaggatacaatt

SEQ ID NO: 131357 - DNA, 20 bp, Artificial Sequence
  Description of Artificial Sequence: Synthetic oligonucleotide
  Target: ATXN1; (+) strand; PAM type: NRG; PAM sequence: GAG
actttttaggatacaattgg

SEQ ID NO: 131358 - DNA, 20 bp, Artificial Sequence
  Description of Artificial Sequence: Synthetic oligonucleotide
  Target: ATXN1; (+) strand; PAM type: NRG; PAM sequence: AAG
ttttaggatacaattgggag

SEQ ID NO: 131359 - DNA, 20 bp, Artificial Sequence
  Description of Artificial Sequence: Synthetic oligonucleotide
  Target: ATXN1; (+) strand; PAM type: NRG; PAM sequence: TAG
aattgggagaagctcacgaa

SEQ ID NO: 131360 - DNA, 20 bp, Artificial Sequence
  Description of Artificial Sequence: Synthetic oligonucleotide
  Target: ATXN1; (+) strand; PAM type: NRG; PAM sequence: AAG
gggagaagctcacgaataga

SEQ ID NO: 131361 - DNA, 20 bp, Artificial Sequence
  Description of Artificial Sequence: Synthetic oligonucleotide
  Target: ATXN1; (+) strand; PAM type: NRG; PAM sequence: GAG
gagaagctcacgaatagaaa

SEQ ID NO: 131362 - DNA, 20 bp, Artificial Sequence
  Description of Artificial Sequence: Synthetic oligonucleotide
  Target: ATXN1; (+) strand; PAM type: NRG; PAM sequence: AAG
gaatagaaagagaattctct

SEQ ID NO: 131363 - DNA, 20 bp, Artificial Sequence
  Description of Artificial Sequence: Synthetic oligonucleotide
  Target: ATXN1; (+) strand; PAM type: NRG; PAM sequence: CAG
agaattctctaagatttcaa

SEQ ID NO: 131364 - DNA, 20 bp, Artificial Sequence
  Description of Artificial Sequence: Synthetic oligonucleotide
  Target: ATXN1; (+) strand; PAM type: NRG; PAM sequence: AGG
gaattctctaagatttcaac

SEQ ID NO: 131365 - DNA, 20 bp, Artificial Sequence
  Description of Artificial Sequence: Synthetic oligonucleotide
  Target: ATXN1; (+) strand; PAM type: NRG; PAM sequence: TGG
atttcaacaggtgtatgatc

SEQ ID NO: 131366 - DNA, 20 bp, Artificial Sequence
  Description of Artificial Sequence: Synthetic oligonucleotide
  Target: ATXN1; (+) strand; PAM type: NRG; PAM sequence: GGG
tttcaacaggtgtatgatct

SEQ ID NO: 131367 - DNA, 20 bp, Artificial Sequence
  Description of Artificial Sequence: Synthetic oligonucleotide
  Target: ATXN1; (+) strand; PAM type: NRG; PAM sequence: GAG
atgatctgggatcatatcat

SEQ ID NO: 131368 - DNA, 20 bp, Artificial Sequence
  Description of Artificial Sequence: Synthetic oligonucleotide
  Target: ATXN1; (+) strand; PAM type: NRG; PAM sequence: AGG
tgatctgggatcatatcatg

SEQ ID NO: 131369 - DNA, 20 bp, Artificial Sequence
  Description of Artificial Sequence: Synthetic oligonucleotide
  Target: ATXN1; (+) strand; PAM type: NRG; PAM sequence: GGG
gatctgggatcatatcatga

SEQ ID NO: 131370 - DNA, 20 bp, Artificial Sequence
  Description of Artificial Sequence: Synthetic oligonucleotide
  Target: ATXN1; (+) strand; PAM type: NRG; PAM sequence: GAG
tctgggatcatatcatgagg

SEQ ID NO: 131371 - DNA, 20 bp, Artificial Sequence
  Description of Artificial Sequence: Synthetic oligonucleotide
  Target: ATXN1; (+) strand; PAM type: NRG; PAM sequence: CAG
tcatatcatgagggagtcaa

SEQ ID NO: 131372 - DNA, 20 bp, Artificial Sequence
  Description of Artificial Sequence: Synthetic oligonucleotide
  Target: ATXN1; (+) strand; PAM type: NRG; PAM sequence: CAG
atcatgagggagtcaacaga

SEQ ID NO: 131373 - DNA, 20 bp, Artificial Sequence
  Description of Artificial Sequence: Synthetic oligonucleotide
  Target: ATXN1; (+) strand; PAM type: NRG; PAM sequence: TGG
gagggagtcaacagacagca

SEQ ID NO: 131374 - DNA, 20 bp, Artificial Sequence
  Description of Artificial Sequence: Synthetic oligonucleotide
  Target: ATXN1; (+) strand; PAM type: NRG; PAM sequence: GAG
cagacagcatggaccttgct

SEQ ID NO: 131375 - DNA, 20 bp, Artificial Sequence
  Description of Artificial Sequence: Synthetic oligonucleotide
  Target: ATXN1; (+) strand; PAM type: NRG; PAM sequence: CAG
catggaccttgctgagtaaa

SEQ ID NO: 131376 - DNA, 20 bp, Artificial Sequence
  Description of Artificial Sequence: Synthetic oligonucleotide
  Target: ATXN1; (+) strand; PAM type: NRG; PAM sequence: AGG
atggaccttgctgagtaaac

SEQ ID NO: 131377 - DNA, 20 bp, Artificial Sequence
  Description of Artificial Sequence: Synthetic oligonucleotide
  Target: ATXN1; (+) strand; PAM type: NRG; PAM sequence: TGG
cttgctgagtaaacaggatg

SEQ ID NO: 131378 - DNA, 20 bp, Artificial Sequence
  Description of Artificial Sequence: Synthetic oligonucleotide
  Target: ATXN1; (+) strand; PAM type: NRG; PAM sequence: GGG
ttgctgagtaaacaggatgt

SEQ ID NO: 131379 - DNA, 20 bp, Artificial Sequence
  Description of Artificial Sequence: Synthetic oligonucleotide
  Target: ATXN1; (+) strand; PAM type: NRG; PAM sequence: CAG
caggatgtgggtccaaatcc

SEQ ID NO: 131380 - DNA, 20 bp, Artificial Sequence
  Description of Artificial Sequence: Synthetic oligonucleotide
  Target: ATXN1; (+) strand; PAM type: NRG; PAM sequence: CAG
tcccagctcttctacctttt

SEQ ID NO: 131381 - DNA, 20 bp, Artificial Sequence
  Description of Artificial Sequence: Synthetic oligonucleotide
  Target: ATXN1; (+) strand; PAM type: NRG; PAM sequence: CAG
cttttcagctgaatgacctc

SEQ ID NO: 131382 - DNA, 20 bp, Artificial Sequence
  Description of Artificial Sequence: Synthetic oligonucleotide
  Target: ATXN1; (+) strand; PAM type: NRG; PAM sequence: AGG
ttttcagctgaatgacctcc

SEQ ID NO: 131383 - DNA, 20 bp, Artificial Sequence
  Description of Artificial Sequence: Synthetic oligonucleotide
  Target: ATXN1; (+) strand; PAM type: NRG; PAM sequence: TAG
agctgaatgacctccaggct

SEQ ID NO: 131384 - DNA, 20 bp, Artificial Sequence
  Description of Artificial Sequence: Synthetic oligonucleotide
  Target: ATXN1; (+) strand; PAM type: NRG; PAM sequence: CAG
tgaatgacctccaggcttag

SEQ ID NO: 131385 - DNA, 20 bp, Artificial Sequence
  Description of Artificial Sequence: Synthetic oligonucleotide
  Target: ATXN1; (+) strand; PAM type: NRG; PAM sequence: CAG
ttagcagcctctctaaacct

SEQ ID NO: 131386 - DNA, 20 bp, Artificial Sequence
  Description of Artificial Sequence: Synthetic oligonucleotide
  Target: ATXN1; (+) strand; PAM type: NRG; PAM sequence: AAG
aacctcagcccccgtctata

SEQ ID NO: 131387 - DNA, 20 bp, Artificial Sequence
  Description of Artificial Sequence: Synthetic oligonucleotide
  Target: ATXN1; (+) strand; PAM type: NRG; PAM sequence: GAG
tcagcccccgtctataaagt

SEQ ID NO: 131388 - DNA, 20 bp, Artificial Sequence
  Description of Artificial Sequence: Synthetic oligonucleotide
  Target: ATXN1; (+) strand; PAM type: NRG; PAM sequence: TAG
tgtaacacatacatgatgct

SEQ ID NO: 131389 - DNA, 20 bp, Artificial Sequence
  Description of Artificial Sequence: Synthetic oligonucleotide
  Target: ATXN1; (+) strand; PAM type: NRG; PAM sequence: CAG
aacacatacatgatgcttag

SEQ ID NO: 131390 - DNA, 20 bp, Artificial Sequence
  Description of Artificial Sequence: Synthetic oligonucleotide
  Target: ATXN1; (+) strand; PAM type: NRG; PAM sequence: GAG
cacatacatgatgcttagca

SEQ ID NO: 131391 - DNA, 20 bp, Artificial Sequence
  Description of Artificial Sequence: Synthetic oligonucleotide
  Target: ATXN1; (+) strand; PAM type: NRG; PAM sequence: TGG
atgatgcttagcagagcgcc

SEQ ID NO: 131392 - DNA, 20 bp, Artificial Sequence
  Description of Artificial Sequence: Synthetic oligonucleotide
  Target: ATXN1; (+) strand; PAM type: NRG; PAM sequence: GGG
tgatgcttagcagagcgcct

SEQ ID NO: 131393 - DNA, 20 bp, Artificial Sequence
  Description of Artificial Sequence: Synthetic oligonucleotide
  Target: ATXN1; (+) strand; PAM type: NRG; PAM sequence: TAG
agcgcctgggcattcatact

SEQ ID NO: 131394 - DNA, 20 bp, Artificial Sequence
  Description of Artificial Sequence: Synthetic oligonucleotide
  Target: ATXN1; (+) strand; PAM type: NRG; PAM sequence: AAG
tgggcattcatacttagcaa

SEQ ID NO: 131395 - DNA, 20 bp, Artificial Sequence
  Description of Artificial Sequence: Synthetic oligonucleotide
  Target: ATXN1; (+) strand; PAM type: NRG; PAM sequence: TGG
cattcatacttagcaaaagt

SEQ ID NO: 131396 - DNA, 20 bp, Artificial Sequence
  Description of Artificial Sequence: Synthetic oligonucleotide
  Target: ATXN1; (+) strand; PAM type: NRG; PAM sequence: AAG
ccttctacaactatgttctc

SEQ ID NO: 131397 - DNA, 20 bp, Artificial Sequence
  Description of Artificial Sequence: Synthetic oligonucleotide
  Target: ATXN1; (+) strand; PAM type: NRG; PAM sequence: TGG
ttctcaagaaaaatcatttt

SEQ ID NO: 131398 - DNA, 20 bp, Artificial Sequence
  Description of Artificial Sequence: Synthetic oligonucleotide
  Target: ATXN1; (+) strand; PAM type: NRG; PAM sequence: GGG
tctcaagaaaaatcattttt

SEQ ID NO: 131399 - DNA, 20 bp, Artificial Sequence
  Description of Artificial Sequence: Synthetic oligonucleotide
  Target: ATXN1; (+) strand; PAM type: NRG; PAM sequence: GAG
tcaagaaaaatcatttttgg

SEQ ID NO: 131400 - DNA, 20 bp, Artificial Sequence
  Description of Artificial Sequence: Synthetic oligonucleotide
  Target: ATXN1; (+) strand; PAM type: NRG; PAM sequence: GAG
aagaaaaatcatttttggga

SEQ ID NO: 131401 - DNA, 20 bp, Artificial Sequence
  Description of Artificial Sequence: Synthetic oligonucleotide
  Target: ATXN1; (+) strand; PAM type: NRG; PAM sequence: GAG
aaaatcatttttgggagagt

SEQ ID NO: 131402 - DNA, 20 bp, Artificial Sequence
  Description of Artificial Sequence: Synthetic oligonucleotide
  Target: ATXN1; (+) strand; PAM type: NRG; PAM sequence: TAG
tcatttttgggagagtgaga

SEQ ID NO: 131403 - DNA, 20 bp, Artificial Sequence
  Description of Artificial Sequence: Synthetic oligonucleotide
  Target: ATXN1; (+) strand; PAM type: NRG; PAM sequence: AGG
catttttgggagagtgagat

SEQ ID NO: 131404 - DNA, 20 bp, Artificial Sequence
  Description of Artificial Sequence: Synthetic oligonucleotide
  Target: ATXN1; (+) strand; PAM type: NRG; PAM sequence: AAG
tttgggagagtgagataggt

SEQ ID NO: 131405 - DNA, 20 bp, Artificial Sequence
  Description of Artificial Sequence: Synthetic oligonucleotide
  Target: ATXN1; (+) strand; PAM type: NRG; PAM sequence: AAG
gggagagtgagataggtaag

SEQ ID NO: 131406 - DNA, 20 bp, Artificial Sequence
  Description of Artificial Sequence: Synthetic oligonucleotide
  Target: ATXN1; (+) strand; PAM type: NRG; PAM sequence: GAG
gagagtgagataggtaagaa

SEQ ID NO: 131407 - DNA, 20 bp, Artificial Sequence
  Description of Artificial Sequence: Synthetic oligonucleotide
  Target: ATXN1; (+) strand; PAM type: NRG; PAM sequence: GAG
gagtgagataggtaagaaga

SEQ ID NO: 131408 - DNA, 20 bp, Artificial Sequence
  Description of Artificial Sequence: Synthetic oligonucleotide
  Target: ATXN1; (+) strand; PAM type: NRG; PAM sequence: GAG
gtgagataggtaagaagaga

SEQ ID NO: 131409 - DNA, 20 bp, Artificial Sequence
  Description of Artificial Sequence: Synthetic oligonucleotide
  Target: ATXN1; (+) strand; PAM type: NRG; PAM sequence: AGG
tgagataggtaagaagagag

SEQ ID NO: 131410 - DNA, 20 bp, Artificial Sequence
  Description of Artificial Sequence: Synthetic oligonucleotide
  Target: ATXN1; (+) strand; PAM type: NRG; PAM sequence: GAG
agataggtaagaagagagag

SEQ ID NO: 131411 - DNA, 20 bp, Artificial Sequence
  Description of Artificial Sequence: Synthetic oligonucleotide
  Target: ATXN1; (+) strand; PAM type: NRG; PAM sequence: AGG
gataggtaagaagagagagg

SEQ ID NO: 131412 - DNA, 20 bp, Artificial Sequence
  Description of Artificial Sequence: Synthetic oligonucleotide
  Target: ATXN1; (+) strand; PAM type: NRG; PAM sequence: AAG
agagagaggaggccatcgtg

SEQ ID NO: 131413 - DNA, 20 bp, Artificial Sequence
  Description of Artificial Sequence: Synthetic oligonucleotide
  Target: ATXN1; (+) strand; PAM type: NRG; PAM sequence: AAG
cttaatttgtaactacctaa

SEQ ID NO: 131414 - DNA, 20 bp, Artificial Sequence
  Description of Artificial Sequence: Synthetic oligonucleotide
  Target: ATXN1; (+) strand; PAM type: NRG; PAM sequence: TAG
aatttgtaactacctaaaag

SEQ ID NO: 131415 - DNA, 20 bp, Artificial Sequence
  Description of Artificial Sequence: Synthetic oligonucleotide
  Target: ATXN1; (+) strand; PAM type: NRG; PAM sequence: AGG
atttgtaactacctaaaagt

SEQ ID NO: 131416 - DNA, 20 bp, Artificial Sequence
  Description of Artificial Sequence: Synthetic oligonucleotide
  Target: ATXN1; (+) strand; PAM type: NRG; PAM sequence: CAG
ctacctaaaagtaggctgca

SEQ ID NO: 131417 - DNA, 20 bp, Artificial Sequence
  Description of Artificial Sequence: Synthetic oligonucleotide
  Target: ATXN1; (+) strand; PAM type: NRG; PAM sequence: GAG
acctaaaagtaggctgcaca

SEQ ID NO: 131418 - DNA, 20 bp, Artificial Sequence
  Description of Artificial Sequence: Synthetic oligonucleotide
  Target: ATXN1; (+) strand; PAM type: NRG; PAM sequence: TGG
actatgtctacacaaaaact

SEQ ID NO: 131419 - DNA, 20 bp, Artificial Sequence
  Description of Artificial Sequence: Synthetic oligonucleotide
  Target: ATXN1; (+) strand; PAM type: NRG; PAM sequence: AAG
tgtctacacaaaaacttgga

SEQ ID NO: 131420 - DNA, 20 bp, Artificial Sequence
  Description of Artificial Sequence: Synthetic oligonucleotide
  Target: ATXN1; (+) strand; PAM type: NRG; PAM sequence: AGG
gtctacacaaaaacttggaa

SEQ ID NO: 131421 - DNA, 20 bp, Artificial Sequence
  Description of Artificial Sequence: Synthetic oligonucleotide
  Target: ATXN1; (+) strand; PAM type: NRG; PAM sequence: TAG
aacttggaaaggaatgttca

SEQ ID NO: 131422 - DNA, 20 bp, Artificial Sequence
  Description of Artificial Sequence: Synthetic oligonucleotide
  Target: ATXN1; (+) strand; PAM type: NRG; PAM sequence: CAG
ttggaaaggaatgttcatag

SEQ ID NO: 131423 - DNA, 20 bp, Artificial Sequence
  Description of Artificial Sequence: Synthetic oligonucleotide
  Target: ATXN1; (+) strand; PAM type: NRG; PAM sequence: TAG
catagcagcactgttcataa

SEQ ID NO: 131424 - DNA, 20 bp, Artificial Sequence
  Description of Artificial Sequence: Synthetic oligonucleotide
  Target: ATXN1; (+) strand; PAM type: NRG; PAM sequence: AAG
agcactgttcataatagtga

SEQ ID NO: 131425 - DNA, 20 bp, Artificial Sequence
  Description of Artificial Sequence: Synthetic oligonucleotide
  Target: ATXN1; (+) strand; PAM type: NRG; PAM sequence: GAG
cactgttcataatagtgaaa

SEQ ID NO: 131426 - DNA, 20 bp, Artificial Sequence
  Description of Artificial Sequence: Synthetic oligonucleotide
  Target: ATXN1; (+) strand; PAM type: NRG; PAM sequence: TGG
tgttcataatagtgaaagag

SEQ ID NO: 131427 - DNA, 20 bp, Artificial Sequence
  Description of Artificial Sequence: Synthetic oligonucleotide
  Target: ATXN1; (+) strand; PAM type: NRG; PAM sequence: GAG
ttcataatagtgaaagagtg

SEQ ID NO: 131428 - DNA, 20 bp, Artificial Sequence
  Description of Artificial Sequence: Synthetic oligonucleotide
  Target: ATXN1; (+) strand; PAM type: NRG; PAM sequence: AAG
gataaatgaataaacaaaat

SEQ ID NO: 131429 - DNA, 20 bp, Artificial Sequence
  Description of Artificial Sequence: Synthetic oligonucleotide
  Target: ATXN1; (+) strand; PAM type: NRG; PAM sequence: AGG
ataaatgaataaacaaaata

SEQ ID NO: 131430 - DNA, 20 bp, Artificial Sequence
  Description of Artificial Sequence: Synthetic oligonucleotide
  Target: ATXN1; (+) strand; PAM type: NRG; PAM sequence: TAG
tgaataaacaaaataaggta

SEQ ID NO: 131431 - DNA, 20 bp, Artificial Sequence
  Description of Artificial Sequence: Synthetic oligonucleotide
  Target: ATXN1; (+) strand; PAM type: NRG; PAM sequence: AAG
ttacattattccatcataac

SEQ ID NO: 131432 - DNA, 20 bp, Artificial Sequence
  Description of Artificial Sequence: Synthetic oligonucleotide
  Target: ATXN1; (+) strand; PAM type: NRG; PAM sequence: TGG
gactgatgtatgctgaaatg

SEQ ID NO: 131433 - DNA, 20 bp, Artificial Sequence
  Description of Artificial Sequence: Synthetic oligonucleotide
  Target: ATXN1; (+) strand; PAM type: NRG; PAM sequence: AAG
gaaatgtggatgatccttga

SEQ ID NO: 131434 - DNA, 20 bp, Artificial Sequence
  Description of Artificial Sequence: Synthetic oligonucleotide
  Target: ATXN1; (+) strand; PAM type: NRG; PAM sequence: AAG
atccttgaaagcattatgct

SEQ ID NO: 131435 - DNA, 20 bp, Artificial Sequence
  Description of Artificial Sequence: Synthetic oligonucleotide
  Target: ATXN1; (+) strand; PAM type: NRG; PAM sequence: AAG
gaaagcattatgctaagtga

SEQ ID NO: 131436 - DNA, 20 bp, Artificial Sequence
  Description of Artificial Sequence: Synthetic oligonucleotide
  Target: ATXN1; (+) strand; PAM type: NRG; PAM sequence: AAG
agcattatgctaagtgaaag

SEQ ID NO: 131437 - DNA, 20 bp, Artificial Sequence
  Description of Artificial Sequence: Synthetic oligonucleotide
  Target: ATXN1; (+) strand; PAM type: NRG; PAM sequence: CAG
ttatgctaagtgaaagaagt

SEQ ID NO: 131438 - DNA, 20 bp, Artificial Sequence
  Description of Artificial Sequence: Synthetic oligonucleotide
  Target: ATXN1; (+) strand; PAM type: NRG; PAM sequence: CAG
taagtgaaagaagtcagtca

SEQ ID NO: 131439 - DNA, 20 bp, Artificial Sequence
  Description of Artificial Sequence: Synthetic oligonucleotide
  Target: ATXN1; (+) strand; PAM type: NRG; PAM sequence: AAG
gtgaaagaagtcagtcacag

SEQ ID NO: 131440 - DNA, 20 bp, Artificial Sequence
  Description of Artificial Sequence: Synthetic oligonucleotide
  Target: ATXN1; (+) strand; PAM type: NRG; PAM sequence: TGG
attgcatgattctatttata

SEQ ID NO: 131441 - DNA, 20 bp, Artificial Sequence
  Description of Artificial Sequence: Synthetic oligonucleotide
  Target: ATXN1; (+) strand; PAM type: NRG; PAM sequence: TAG
ttctatttatatggaatgtc

SEQ ID NO: 131442 - DNA, 20 bp, Artificial Sequence
  Description of Artificial Sequence: Synthetic oligonucleotide
  Target: ATXN1; (+) strand; PAM type: NRG; PAM sequence: AAG
ttatatggaatgtctagaac

SEQ ID NO: 131443 - DNA, 20 bp, Artificial Sequence
  Description of Artificial Sequence: Synthetic oligonucleotide
  Target: ATXN1; (+) strand; PAM type: NRG; PAM sequence: TAG
agaacaagcaaatctatata

SEQ ID NO: 131444 - DNA, 20 bp, Artificial Sequence
  Description of Artificial Sequence: Synthetic oligonucleotide
  Target: ATXN1; (+) strand; PAM type: NRG; PAM sequence: GAG
aacaagcaaatctatatata

SEQ ID NO: 131445 - DNA, 20 bp, Artificial Sequence
  Description of Artificial Sequence: Synthetic oligonucleotide
  Target: ATXN1; (+) strand; PAM type: NRG; PAM sequence: CAG
caaatctatatatagagaaa

SEQ ID NO: 131446 - DNA, 20 bp, Artificial Sequence
  Description of Artificial Sequence: Synthetic oligonucleotide
  Target: ATXN1; (+) strand; PAM type: NRG; PAM sequence: TGG
tatatagagaaacagcttcg

SEQ ID NO: 131447 - DNA, 20 bp, Artificial Sequence
  Description of Artificial Sequence: Synthetic oligonucleotide
  Target: ATXN1; (+) strand; PAM type: NRG; PAM sequence: CAG
agaaacagcttcgtggttgc

SEQ ID NO: 131448 - DNA, 20 bp, Artificial Sequence
  Description of Artificial Sequence: Synthetic oligonucleotide
  Target: ATXN1; (+) strand; PAM type: NRG; PAM sequence: AGG
gaaacagcttcgtggttgcc

SEQ ID NO: 131449 - DNA, 20 bp, Artificial Sequence
  Description of Artificial Sequence: Synthetic oligonucleotide
  Target: ATXN1; (+) strand; PAM type: NRG; PAM sequence: GAG
aacagcttcgtggttgccag

SEQ ID NO: 131450 - DNA, 20 bp, Artificial Sequence
  Description of Artificial Sequence: Synthetic oligonucleotide
  Target: ATXN1; (+) strand; PAM type: NRG; PAM sequence: GAG
cttcgtggttgccaggagct

SEQ ID NO: 131451 - DNA, 20 bp, Artificial Sequence
  Description of Artificial Sequence: Synthetic oligonucleotide
  Target: ATXN1; (+) strand; PAM type: NRG; PAM sequence: AGG
ttcgtggttgccaggagctg

SEQ ID NO: 131452 - DNA, 20 bp, Artificial Sequence
  Description of Artificial Sequence: Synthetic oligonucleotide
  Target: ATXN1; (+) strand; PAM type: NRG; PAM sequence: GGG
tcgtggttgccaggagctga

SEQ ID NO: 131453 - DNA, 20 bp, Artificial Sequence
  Description of Artificial Sequence: Synthetic oligonucleotide
  Target: ATXN1; (+) strand; PAM type: NRG; PAM sequence: TAG
tggttgccaggagctgaggg

SEQ ID NO: 131454 - DNA, 20 bp, Artificial Sequence
  Description of Artificial Sequence: Synthetic oligonucleotide
  Target: ATXN1; (+) strand; PAM type: NRG; PAM sequence: GAG
gttgccaggagctgagggta

SEQ ID NO: 131455 - DNA, 20 bp, Artificial Sequence
  Description of Artificial Sequence: Synthetic oligonucleotide
  Target: ATXN1; (+) strand; PAM type: NRG; PAM sequence: AGG
ttgccaggagctgagggtag

SEQ ID NO: 131456 - DNA, 20 bp, Artificial Sequence
  Description of Artificial Sequence: Synthetic oligonucleotide
  Target: ATXN1; (+) strand; PAM type: NRG; PAM sequence: TGG
aggagctgagggtagaggat

SEQ ID NO: 131457 - DNA, 20 bp, Artificial Sequence
  Description of Artificial Sequence: Synthetic oligonucleotide
  Target: ATXN1; (+) strand; PAM type: NRG; PAM sequence: GGG
ggagctgagggtagaggatt

SEQ ID NO: 131458 - DNA, 20 bp, Artificial Sequence
  Description of Artificial Sequence: Synthetic oligonucleotide
  Target: ATXN1; (+) strand; PAM type: NRG; PAM sequence: GGG
gagctgagggtagaggattg

SEQ ID NO: 131459 - DNA, 20 bp, Artificial Sequence
  Description of Artificial Sequence: Synthetic oligonucleotide
  Target: ATXN1; (+) strand; PAM type: NRG; PAM sequence: GGG
agctgagggtagaggattgg

SEQ ID NO: 131460 - DNA, 20 bp, Artificial Sequence
  Description of Artificial Sequence: Synthetic oligonucleotide
  Target: ATXN1; (+) strand; PAM type: NRG; PAM sequence: TGG
ggtagaggattgggggaaaa

SEQ ID NO: 131461 - DNA, 20 bp, Artificial Sequence
  Description of Artificial Sequence: Synthetic oligonucleotide
  Target: ATXN1; (+) strand; PAM type: NRG; PAM sequence: GGG
gtagaggattgggggaaaat

SEQ ID NO: 131462 - DNA, 20 bp, Artificial Sequence
  Description of Artificial Sequence: Synthetic oligonucleotide
  Target: ATXN1; (+) strand; PAM type: NRG; PAM sequence: AAG
gaggattgggggaaaatggg

SEQ ID NO: 131463 - DNA, 20 bp, Artificial Sequence
  Description of Artificial Sequence: Synthetic oligonucleotide
  Target: ATXN1; (+) strand; PAM type: NRG; PAM sequence: TGG
aaatgggaagtgattgctga

SEQ ID NO: 131464 - DNA, 20 bp, Artificial Sequence
  Description of Artificial Sequence: Synthetic oligonucleotide
  Target: ATXN1; (+) strand; PAM type: NRG; PAM sequence: GGG
aatgggaagtgattgctgat

SEQ ID NO: 131465 - DNA, 20 bp, Artificial Sequence
  Description of Artificial Sequence: Synthetic oligonucleotide
  Target: ATXN1; (+) strand; PAM type: NRG; PAM sequence: TGG
gaagtgattgctgatgggta

SEQ ID NO: 131466 - DNA, 20 bp, Artificial Sequence
  Description of Artificial Sequence: Synthetic oligonucleotide
  Target: ATXN1; (+) strand; PAM type: NRG; PAM sequence: GGG
aagtgattgctgatgggtat

SEQ ID NO: 131467 - DNA, 20 bp, Artificial Sequence
  Description of Artificial Sequence: Synthetic oligonucleotide
  Target: ATXN1; (+) strand; PAM type: NRG; PAM sequence: TAG
gatgggtatgggatttcctt

SEQ ID NO: 131468 - DNA, 20 bp, Artificial Sequence
  Description of Artificial Sequence: Synthetic oligonucleotide
  Target: ATXN1; (+) strand; PAM type: NRG; PAM sequence: AGG
atgggtatgggatttccttt

SEQ ID NO: 131469 - DNA, 20 bp, Artificial Sequence
  Description of Artificial Sequence: Synthetic oligonucleotide
  Target: ATXN1; (+) strand; PAM type: NRG; PAM sequence: GGG
tgggtatgggatttccttta

SEQ ID NO: 131470 - DNA, 20 bp, Artificial Sequence
  Description of Artificial Sequence: Synthetic oligonucleotide
  Target: ATXN1; (+) strand; PAM type: NRG; PAM sequence: GGG
gggtatgggatttcctttag

SEQ ID NO: 131471 - DNA, 20 bp, Artificial Sequence
  Description of Artificial Sequence: Synthetic oligonucleotide
  Target: ATXN1; (+) strand; PAM type: NRG; PAM sequence: TGG
aaatgttctaaaatttattg

SEQ ID NO: 131472 - DNA, 20 bp, Artificial Sequence
  Description of Artificial Sequence: Synthetic oligonucleotide
  Target: ATXN1; (+) strand; PAM type: NRG; PAM sequence: TAG
tctaaaatttattgtggtga

SEQ ID NO: 131473 - DNA, 20 bp, Artificial Sequence
  Description of Artificial Sequence: Synthetic oligonucleotide
  Target: ATXN1; (+) strand; PAM type: NRG; PAM sequence: CAG
ttattgtggtgatagctgca

SEQ ID NO: 131474 - DNA, 20 bp, Artificial Sequence
  Description of Artificial Sequence: Synthetic oligonucleotide
  Target: ATXN1; (+) strand; PAM type: NRG; PAM sequence: AAG
agctctgtaaatacactaaa

SEQ ID NO: 131475 - DNA, 20 bp, Artificial Sequence
  Description of Artificial Sequence: Synthetic oligonucleotide
  Target: ATXN1; (+) strand; PAM type: NRG; PAM sequence: AAG
cttttttttttaatttaaat

SEQ ID NO: 131476 - DNA, 20 bp, Artificial Sequence
  Description of Artificial Sequence: Synthetic oligonucleotide
  Target: ATXN1; (+) strand; PAM type: NRG; PAM sequence: CAG
tttaatttaaataagctatg

SEQ ID NO: 131477 - DNA, 20 bp, Artificial Sequence
  Description of Artificial Sequence: Synthetic oligonucleotide
  Target: ATXN1; (+) strand; PAM type: NRG; PAM sequence: AAG
tccccatctcctgaataaac

SEQ ID NO: 131478 - DNA, 20 bp, Artificial Sequence
  Description of Artificial Sequence: Synthetic oligonucleotide
  Target: ATXN1; (+) strand; PAM type: NRG; PAM sequence: TGG
ataaacaagactttcttccc

SEQ ID NO: 131479 - DNA, 20 bp, Artificial Sequence
  Description of Artificial Sequence: Synthetic oligonucleotide
  Target: ATXN1; (+) strand; PAM type: NRG; PAM sequence: GGG
taaacaagactttcttccct

SEQ ID NO: 131480 - DNA, 20 bp, Artificial Sequence
  Description of Artificial Sequence: Synthetic oligonucleotide
  Target: ATXN1; (+) strand; PAM type: NRG; PAM sequence: GAG
caagactttcttccctgggt

SEQ ID NO: 131481 - DNA, 20 bp, Artificial Sequence
  Description of Artificial Sequence: Synthetic oligonucleotide
  Target: ATXN1; (+) strand; PAM type: NRG; PAM sequence: AGG
aagactttcttccctgggtg

SEQ ID NO: 131482 - DNA, 20 bp, Artificial Sequence
  Description of Artificial Sequence: Synthetic oligonucleotide
  Target: ATXN1; (+) strand; PAM type: NRG; PAM sequence: GGG
agactttcttccctgggtga

SEQ ID NO: 131483 - DNA, 20 bp, Artificial Sequence
  Description of Artificial Sequence: Synthetic oligonucleotide
  Target: ATXN1; (+) strand; PAM type: NRG; PAM sequence: TAG
tccctgggtgagggtcttga

SEQ ID NO: 131484 - DNA, 20 bp, Artificial Sequence
  Description of Artificial Sequence: Synthetic oligonucleotide
  Target: ATXN1; (+) strand; PAM type: NRG; PAM sequence: AGG
ccctgggtgagggtcttgat

SEQ ID NO: 131485 - DNA, 20 bp, Artificial Sequence
  Description of Artificial Sequence: Synthetic oligonucleotide
  Target: ATXN1; (+) strand; PAM type: NRG; PAM sequence: TAG
tgggtgagggtcttgatagg

SEQ ID NO: 131486 - DNA, 20 bp, Artificial Sequence
  Description of Artificial Sequence: Synthetic oligonucleotide
  Target: ATXN1; (+) strand; PAM type: NRG; PAM sequence: CGG
gataggtagaatactgtaca

SEQ ID NO: 131487 - DNA, 20 bp, Artificial Sequence
  Description of Artificial Sequence: Synthetic oligonucleotide
  Target: ATXN1; (+) strand; PAM type: NRG; PAM sequence: CAG
agaatactgtacacggaata

SEQ ID NO: 131488 - DNA, 20 bp, Artificial Sequence
  Description of Artificial Sequence: Synthetic oligonucleotide
  Target: ATXN1; (+) strand; PAM type: NRG; PAM sequence: AAG
gtacacggaatacagaattc

SEQ ID NO: 131489 - DNA, 20 bp, Artificial Sequence
  Description of Artificial Sequence: Synthetic oligonucleotide
  Target: ATXN1; (+) strand; PAM type: NRG; PAM sequence: CAG
cacggaatacagaattcaag

SEQ ID NO: 131490 - DNA, 20 bp, Artificial Sequence
  Description of Artificial Sequence: Synthetic oligonucleotide
  Target: ATXN1; (+) strand; PAM type: NRG; PAM sequence: CAG
gttccttgacttatgaatat

SEQ ID NO: 131491 - DNA, 20 bp, Artificial Sequence
  Description of Artificial Sequence: Synthetic oligonucleotide
  Target: ATXN1; (+) strand; PAM type: NRG; PAM sequence: AAG
ccttgacttatgaatatcag

SEQ ID NO: 131492 - DNA, 20 bp, Artificial Sequence
  Description of Artificial Sequence: Synthetic oligonucleotide
  Target: ATXN1; (+) strand; PAM type: NRG; PAM sequence: CAG
aagatgtccatcctctttct

SEQ ID NO: 131493 - DNA, 20 bp, Artificial Sequence
  Description of Artificial Sequence: Synthetic oligonucleotide
  Target: ATXN1; (+) strand; PAM type: NRG; PAM sequence: AGG
agatgtccatcctctttctc

SEQ ID NO: 131494 - DNA, 20 bp, Artificial Sequence
  Description of Artificial Sequence: Synthetic oligonucleotide
  Target: ATXN1; (+) strand; PAM type: NRG; PAM sequence: GAG
atgtccatcctctttctcag

SEQ ID NO: 131495 - DNA, 20 bp, Artificial Sequence
  Description of Artificial Sequence: Synthetic oligonucleotide
  Target: ATXN1; (+) strand; PAM type: NRG; PAM sequence: CAG
tctttctcaggagacatttc

SEQ ID NO: 131496 - DNA, 20 bp, Artificial Sequence
  Description of Artificial Sequence: Synthetic oligonucleotide
  Target: ATXN1; (+) strand; PAM type: NRG; PAM sequence: AGG
ctttctcaggagacatttcc

SEQ ID NO: 131497 - DNA, 20 bp, Artificial Sequence
  Description of Artificial Sequence: Synthetic oligonucleotide
  Target: ATXN1; (+) strand; PAM type: NRG; PAM sequence: TGG
tctcaggagacatttccagg

SEQ ID NO: 131498 - DNA, 20 bp, Artificial Sequence
  Description of Artificial Sequence: Synthetic oligonucleotide
  Target: ATXN1; (+) strand; PAM type: NRG; PAM sequence: CAG
agacatttccaggtggatgc

SEQ ID NO: 131499 - DNA, 20 bp, Artificial Sequence
  Description of Artificial Sequence: Synthetic oligonucleotide
  Target: ATXN1; (+) strand; PAM type: NRG; PAM sequence: GAG
acatttccaggtggatgcca

SEQ ID NO: 131500 - DNA, 20 bp, Artificial Sequence
  Description of Artificial Sequence: Synthetic oligonucleotide
  Target: ATXN1; (+) strand; PAM type: NRG; PAM sequence: AGG
catttccaggtggatgccag

SEQ ID NO: 131501 - DNA, 20 bp, Artificial Sequence
  Description of Artificial Sequence: Synthetic oligonucleotide
  Target: ATXN1; (+) strand; PAM type: NRG; PAM sequence: GAG
tttccaggtggatgccagag

SEQ ID NO: 131502 - DNA, 20 bp, Artificial Sequence
  Description of Artificial Sequence: Synthetic oligonucleotide
  Target: ATXN1; (+) strand; PAM type: NRG; PAM sequence: AGG
ttccaggtggatgccagagg

SEQ ID NO: 131503 - DNA, 20 bp, Artificial Sequence
  Description of Artificial Sequence: Synthetic oligonucleotide
  Target: ATXN1; (+) strand; PAM type: NRG; PAM sequence: TAG
ccatctgcttctttaaatct

SEQ ID NO: 131504 - DNA, 20 bp, Artificial Sequence
  Description of Artificial Sequence: Synthetic oligonucleotide
  Target: ATXN1; (+) strand; PAM type: NRG; PAM sequence: GAG
tgcattctgtttccccatat

SEQ ID NO: 131505 - DNA, 20 bp, Artificial Sequence
  Description of Artificial Sequence: Synthetic oligonucleotide
  Target: ATXN1; (+) strand; PAM type: NRG; PAM sequence: TAG
tctgtttccccatatgagca

SEQ ID NO: 131506 - DNA, 20 bp, Artificial Sequence
  Description of Artificial Sequence: Synthetic oligonucleotide
  Target: ATXN1; (+) strand; PAM type: NRG; PAM sequence: TGG
gtttccccatatgagcatag

SEQ ID NO: 131507 - DNA, 20 bp, Artificial Sequence
  Description of Artificial Sequence: Synthetic oligonucleotide
  Target: ATXN1; (+) strand; PAM type: NRG; PAM sequence: CAG
caatctctgctttatcttca

SEQ ID NO: 131508 - DNA, 20 bp, Artificial Sequence
  Description of Artificial Sequence: Synthetic oligonucleotide
  Target: ATXN1; (+) strand; PAM type: NRG; PAM sequence: AGG
aatctctgctttatcttcac

SEQ ID NO: 131509 - DNA, 20 bp, Artificial Sequence
  Description of Artificial Sequence: Synthetic oligonucleotide
  Target: ATXN1; (+) strand; PAM type: NRG; PAM sequence: AAG
tgctttatcttcacaggcga

SEQ ID NO: 131510 - DNA, 20 bp, Artificial Sequence
  Description of Artificial Sequence: Synthetic oligonucleotide
  Target: ATXN1; (+) strand; PAM type: NRG; PAM sequence: AAG
cttcacaggcgaaagcttta

SEQ ID NO: 131511 - DNA, 20 bp, Artificial Sequence
  Description of Artificial Sequence: Synthetic oligonucleotide
  Target: ATXN1; (+) strand; PAM type: NRG; PAM sequence: TGG
cacaggcgaaagctttaaag

SEQ ID NO: 131512 - DNA, 20 bp, Artificial Sequence
  Description of Artificial Sequence: Synthetic oligonucleotide
  Target: ATXN1; (+) strand; PAM type: NRG; PAM sequence: CAG
ggcgaaagctttaaagtgga

SEQ ID NO: 131513 - DNA, 20 bp, Artificial Sequence
  Description of Artificial Sequence: Synthetic oligonucleotide
  Target: ATXN1; (+) strand; PAM type: NRG; PAM sequence: AGG
gcgaaagctttaaagtggac

SEQ ID NO: 131514 - DNA, 20 bp, Artificial Sequence
  Description of Artificial Sequence: Synthetic oligonucleotide
  Target: ATXN1; (+) strand; PAM type: NRG; PAM sequence: TAG
gtggacaggtctttcatacc

SEQ ID NO: 131515 - DNA, 20 bp, Artificial Sequence
  Description of Artificial Sequence: Synthetic oligonucleotide
  Target: ATXN1; (+) strand; PAM type: NRG; PAM sequence: AAG
ggtctttcatacctagtttg

SEQ ID NO: 131516 - DNA, 20 bp, Artificial Sequence
  Description of Artificial Sequence: Synthetic oligonucleotide
  Target: ATXN1; (+) strand; PAM type: NRG; PAM sequence: AAG
ctagtttgaagtttatgaaa

SEQ ID NO: 131517 - DNA, 20 bp, Artificial Sequence
  Description of Artificial Sequence: Synthetic oligonucleotide
  Target: ATXN1; (+) strand; PAM type: NRG; PAM sequence: AAG
tgaagtttatgaaaaagaat

SEQ ID NO: 131518 - DNA, 20 bp, Artificial Sequence
  Description of Artificial Sequence: Synthetic oligonucleotide
  Target: ATXN1; (+) strand; PAM type: NRG; PAM sequence: AGG
gaagtttatgaaaaagaata

SEQ ID NO: 131519 - DNA, 20 bp, Artificial Sequence
  Description of Artificial Sequence: Synthetic oligonucleotide
  Target: ATXN1; (+) strand; PAM type: NRG; PAM sequence: GGG
aagtttatgaaaaagaataa

SEQ ID NO: 131520 - DNA, 20 bp, Artificial Sequence
  Description of Artificial Sequence: Synthetic oligonucleotide
  Target: ATXN1; (+) strand; PAM type: NRG; PAM sequence: GGG
agtttatgaaaaagaataag

SEQ ID NO: 131521 - DNA, 20 bp, Artificial Sequence
  Description of Artificial Sequence: Synthetic oligonucleotide
  Target: ATXN1; (+) strand; PAM type: NRG; PAM sequence: GGG
gtttatgaaaaagaataagg

SEQ ID NO: 131522 - DNA, 20 bp, Artificial Sequence
  Description of Artificial Sequence: Synthetic oligonucleotide
  Target: ATXN1; (+) strand; PAM type: NRG; PAM sequence: TGG
aaagaataagggggctactc

SEQ ID NO: 131523 - DNA, 20 bp, Artificial Sequence
  Description of Artificial Sequence: Synthetic oligonucleotide
  Target: ATXN1; (+) strand; PAM type: NRG; PAM sequence: GAG
agaataagggggctactctg

SEQ ID NO: 131524 - DNA, 20 bp, Artificial Sequence
  Description of Artificial Sequence: Synthetic oligonucleotide
  Target: ATXN1; (+) strand; PAM type: NRG; PAM sequence: GAG
gggctactctggagtactgt

SEQ ID NO: 131525 - DNA, 20 bp, Artificial Sequence
  Description of Artificial Sequence: Synthetic oligonucleotide
  Target: ATXN1; (+) strand; PAM type: NRG; PAM sequence: AAG
tttctgcttctccacaccat

SEQ ID NO: 131526 - DNA, 20 bp, Artificial Sequence
  Description of Artificial Sequence: Synthetic oligonucleotide
  Target: ATXN1; (+) strand; PAM type: NRG; PAM sequence: AGG
ttctgcttctccacaccata

SEQ ID NO: 131527 - DNA, 20 bp, Artificial Sequence
  Description of Artificial Sequence: Synthetic oligonucleotide
  Target: ATXN1; (+) strand; PAM type: NRG; PAM sequence: CAG
gcttctccacaccataagga

SEQ ID NO: 131528 - DNA, 20 bp, Artificial Sequence
  Description of Artificial Sequence: Synthetic oligonucleotide
  Target: ATXN1; (+) strand; PAM type: NRG; PAM sequence: AGG
cttctccacaccataaggac

SEQ ID NO: 131529 - DNA, 20 bp, Artificial Sequence
  Description of Artificial Sequence: Synthetic oligonucleotide
  Target: ATXN1; (+) strand; PAM type: NRG; PAM sequence: GGG
ttctccacaccataaggaca

SEQ ID NO: 131530 - DNA, 20 bp, Artificial Sequence
  Description of Artificial Sequence: Synthetic oligonucleotide
  Target: ATXN1; (+) strand; PAM type: NRG; PAM sequence: AAG
cataaggacagggtccctgt

SEQ ID NO: 131531 - DNA, 20 bp, Artificial Sequence
  Description of Artificial Sequence: Synthetic oligonucleotide
  Target: ATXN1; (+) strand; PAM type: NRG; PAM sequence: TAG
ctccaaaccaatccacctaa

SEQ ID NO: 131532 - DNA, 20 bp, Artificial Sequence
  Description of Artificial Sequence: Synthetic oligonucleotide
  Target: ATXN1; (+) strand; PAM type: NRG; PAM sequence: AGG
tccaaaccaatccacctaat

SEQ ID NO: 131533 - DNA, 20 bp, Artificial Sequence
  Description of Artificial Sequence: Synthetic oligonucleotide
  Target: ATXN1; (+) strand; PAM type: NRG; PAM sequence: TAG
ataggccacatcattttgtt

SEQ ID NO: 131534 - DNA, 20 bp, Artificial Sequence
  Description of Artificial Sequence: Synthetic oligonucleotide
  Target: ATXN1; (+) strand; PAM type: NRG; PAM sequence: AGG
taggccacatcattttgttt

SEQ ID NO: 131535 - DNA, 20 bp, Artificial Sequence
  Description of Artificial Sequence: Synthetic oligonucleotide
  Target: ATXN1; (+) strand; PAM type: NRG; PAM sequence: GGG
aggccacatcattttgttta

SEQ ID NO: 131536 - DNA, 20 bp, Artificial Sequence
  Description of Artificial Sequence: Synthetic oligonucleotide
  Target: ATXN1; (+) strand; PAM type: NRG; PAM sequence: AAG
ccacatcattttgtttaggg

SEQ ID NO: 131537 - DNA, 20 bp, Artificial Sequence
  Description of Artificial Sequence: Synthetic oligonucleotide
  Target: ATXN1; (+) strand; PAM type: NRG; PAM sequence: AAG
tttagggaagaaactgcaaa

SEQ ID NO: 131538 - DNA, 20 bp, Artificial Sequence
  Description of Artificial Sequence: Synthetic oligonucleotide
  Target: ATXN1; (+) strand; PAM type: NRG; PAM sequence: GAG
tagggaagaaactgcaaaaa

SEQ ID NO: 131539 - DNA, 20 bp, Artificial Sequence
  Description of Artificial Sequence: Synthetic oligonucleotide
  Target: ATXN1; (+) strand; PAM type: NRG; PAM sequence: AAG
atgccaaaatattgcctaaa

SEQ ID NO: 131540 - DNA, 20 bp, Artificial Sequence
  Description of Artificial Sequence: Synthetic oligonucleotide
  Target: ATXN1; (+) strand; PAM type: NRG; PAM sequence: CAG
taacatcatattattacttc

SEQ ID NO: 131541 - DNA, 20 bp, Artificial Sequence
  Description of Artificial Sequence: Synthetic oligonucleotide
  Target: ATXN1; (+) strand; PAM type: NRG; PAM sequence: AGG
aacatcatattattacttcc

SEQ ID NO: 131542 - DNA, 20 bp, Artificial Sequence
  Description of Artificial Sequence: Synthetic oligonucleotide
  Target: ATXN1; (+) strand; PAM type: NRG; PAM sequence: CAG
accttctccataaaaatcaa

SEQ ID NO: 131543 - DNA, 20 bp, Artificial Sequence
  Description of Artificial Sequence: Synthetic oligonucleotide
  Target: ATXN1; (+) strand; PAM type: NRG; PAM sequence: AAG
aaaaatcaacagtgttttta

SEQ ID NO: 131544 - DNA, 20 bp, Artificial Sequence
  Description of Artificial Sequence: Synthetic oligonucleotide
  Target: ATXN1; (+) strand; PAM type: NRG; PAM sequence: AGG
aaaatcaacagtgtttttaa

SEQ ID NO: 131545 - DNA, 20 bp, Artificial Sequence
  Description of Artificial Sequence: Synthetic oligonucleotide
  Target: ATXN1; (+) strand; PAM type: NRG; PAM sequence: GAG
agtgtttttaaaggaacgtt

SEQ ID NO: 131546 - DNA, 20 bp, Artificial Sequence
  Description of Artificial Sequence: Synthetic oligonucleotide
  Target: ATXN1; (+) strand; PAM type: NRG; PAM sequence: AGG
gtgtttttaaaggaacgttg

SEQ ID NO: 131547 - DNA, 20 bp, Artificial Sequence
  Description of Artificial Sequence: Synthetic oligonucleotide
  Target: ATXN1; (+) strand; PAM type: NRG; PAM sequence: CAG
aacgttgaggttaaaaaaat

SEQ ID NO: 131548 - DNA, 20 bp, Artificial Sequence
  Description of Artificial Sequence: Synthetic oligonucleotide
  Target: ATXN1; (+) strand; PAM type: NRG; PAM sequence: TAG
tgcaaaaataacaataatca

SEQ ID NO: 131549 - DNA, 20 bp, Artificial Sequence
  Description of Artificial Sequence: Synthetic oligonucleotide
  Target: ATXN1; (+) strand; PAM type: NRG; PAM sequence: CAG
ataataatttccacatgaac

SEQ ID NO: 131550 - DNA, 20 bp, Artificial Sequence
  Description of Artificial Sequence: Synthetic oligonucleotide
  Target: ATXN1; (+) strand; PAM type: NRG; PAM sequence: AAG
ataatttccacatgaaccag

SEQ ID NO: 131551 - DNA, 20 bp, Artificial Sequence
  Description of Artificial Sequence: Synthetic oligonucleotide
  Target: ATXN1; (+) strand; PAM type: NRG; PAM sequence: AGG
taatttccacatgaaccaga

SEQ ID NO: 131552 - DNA, 20 bp, Artificial Sequence
  Description of Artificial Sequence: Synthetic oligonucleotide
  Target: ATXN1; (+) strand; PAM type: NRG; PAM sequence: TGG
cacatgaaccagaaggtctc

SEQ ID NO: 131553 - DNA, 20 bp, Artificial Sequence
  Description of Artificial Sequence: Synthetic oligonucleotide
  Target: ATXN1; (+) strand; PAM type: NRG; PAM sequence: GGG
acatgaaccagaaggtctct

SEQ ID NO: 131554 - DNA, 20 bp, Artificial Sequence
  Description of Artificial Sequence: Synthetic oligonucleotide
  Target: ATXN1; (+) strand; PAM type: NRG; PAM sequence: TGG
agaaggtctctgggtaatgc

SEQ ID NO: 131555 - DNA, 20 bp, Artificial Sequence
  Description of Artificial Sequence: Synthetic oligonucleotide
  Target: ATXN1; (+) strand; PAM type: NRG; PAM sequence: CAG
aacacacacatgcacaccaa

SEQ ID NO: 131556 - DNA, 20 bp, Artificial Sequence
  Description of Artificial Sequence: Synthetic oligonucleotide
  Target: ATXN1; (+) strand; PAM type: NRG; PAM sequence: CAG
cctttgctatttgaacattc

SEQ ID NO: 131557 - DNA, 20 bp, Artificial Sequence
  Description of Artificial Sequence: Synthetic oligonucleotide
  Target: ATXN1; (+) strand; PAM type: NRG; PAM sequence: AGG
ctttgctatttgaacattcc

SEQ ID NO: 131558 - DNA, 20 bp, Artificial Sequence
  Description of Artificial Sequence: Synthetic oligonucleotide
  Target: ATXN1; (+) strand; PAM type: NRG; PAM sequence: CAG
aacattgctcaaaaaatttc

SEQ ID NO: 131559 - DNA, 20 bp, Artificial Sequence
  Description of Artificial Sequence: Synthetic oligonucleotide
  Target: ATXN1; (+) strand; PAM type: NRG; PAM sequence: AGG
acattgctcaaaaaatttcc

SEQ ID NO: 131560 - DNA, 20 bp, Artificial Sequence
  Description of Artificial Sequence: Synthetic oligonucleotide
  Target: ATXN1; (+) strand; PAM type: NRG; PAM sequence: TAG
aggtaaaccatgttaatatc

SEQ ID NO: 131561 - DNA, 20 bp, Artificial Sequence
  Description of Artificial Sequence: Synthetic oligonucleotide
  Target: ATXN1; (+) strand; PAM type: NRG; PAM sequence: AGG
ggtaaaccatgttaatatct

SEQ ID NO: 131562 - DNA, 20 bp, Artificial Sequence
  Description of Artificial Sequence: Synthetic oligonucleotide
  Target: ATXN1; (+) strand; PAM type: NRG; PAM sequence: GGG
gtaaaccatgttaatatcta

SEQ ID NO: 131563 - DNA, 20 bp, Artificial Sequence
  Description of Artificial Sequence: Synthetic oligonucleotide
  Target: ATXN1; (+) strand; PAM type: NRG; PAM sequence: AAG
gttaatatctagggttaata

SEQ ID NO: 131564 - DNA, 20 bp, Artificial Sequence
  Description of Artificial Sequence: Synthetic oligonucleotide
  Target: ATXN1; (+) strand; PAM type: NRG; PAM sequence: AAG
agtctctttaaatgttaata

SEQ ID NO: 131565 - DNA, 20 bp, Artificial Sequence
  Description of Artificial Sequence: Synthetic oligonucleotide
  Target: ATXN1; (+) strand; PAM type: NRG; PAM sequence: CAG
aagtctctccataaaatgtt

SEQ ID NO: 131566 - DNA, 20 bp, Artificial Sequence
  Description of Artificial Sequence: Synthetic oligonucleotide
  Target: ATXN1; (+) strand; PAM type: NRG; PAM sequence: AAG
ccataaaatgttcagccctg

SEQ ID NO: 131567 - DNA, 20 bp, Artificial Sequence
  Description of Artificial Sequence: Synthetic oligonucleotide
  Target: ATXN1; (+) strand; PAM type: NRG; PAM sequence: CAG
aatgttcagccctgaagaca

SEQ ID NO: 131568 - DNA, 20 bp, Artificial Sequence
  Description of Artificial Sequence: Synthetic oligonucleotide
  Target: ATXN1; (+) strand; PAM type: NRG; PAM sequence: CAG
taaaacatcatgttttataa

SEQ ID NO: 131569 - DNA, 20 bp, Artificial Sequence
  Description of Artificial Sequence: Synthetic oligonucleotide
  Target: ATXN1; (+) strand; PAM type: NRG; PAM sequence: AGG
aaaacatcatgttttataac

SEQ ID NO: 131570 - DNA, 20 bp, Artificial Sequence
  Description of Artificial Sequence: Synthetic oligonucleotide
  Target: ATXN1; (+) strand; PAM type: NRG; PAM sequence: TGG
tgttttataacaggttacta

SEQ ID NO: 131571 - DNA, 20 bp, Artificial Sequence
  Description of Artificial Sequence: Synthetic oligonucleotide
  Target: ATXN1; (+) strand; PAM type: NRG; PAM sequence: TGG
taacaggttactatggtcaa

SEQ ID NO: 131572 - DNA, 20 bp, Artificial Sequence
  Description of Artificial Sequence: Synthetic oligonucleotide
  Target: ATXN1; (+) strand; PAM type: NRG; PAM sequence: GAG
acaggttactatggtcaatg

SEQ ID NO: 131573 - DNA, 20 bp, Artificial Sequence
  Description of Artificial Sequence: Synthetic oligonucleotide
  Target: ATXN1; (+) strand; PAM type: NRG; PAM sequence: CAG
tactatggtcaatggagtat

SEQ ID NO: 131574 - DNA, 20 bp, Artificial Sequence
  Description of Artificial Sequence: Synthetic oligonucleotide
  Target: ATXN1; (+) strand; PAM type: NRG; PAM sequence: GAG
ataaaatataaacttctact

SEQ ID NO: 131575 - DNA, 20 bp, Artificial Sequence
  Description of Artificial Sequence: Synthetic oligonucleotide
  Target: ATXN1; (+) strand; PAM type: NRG; PAM sequence: AGG
taaaatataaacttctactg

SEQ ID NO: 131576 - DNA, 20 bp, Artificial Sequence
  Description of Artificial Sequence: Synthetic oligonucleotide
  Target: ATXN1; (+) strand; PAM type: NRG; PAM sequence: AAG
atataaacttctactgagga

SEQ ID NO: 131577 - DNA, 20 bp, Artificial Sequence
  Description of Artificial Sequence: Synthetic oligonucleotide
  Target: ATXN1; (+) strand; PAM type: NRG; PAM sequence: CGG
tctactgaggaaagcacatc

SEQ ID NO: 131578 - DNA, 20 bp, Artificial Sequence
  Description of Artificial Sequence: Synthetic oligonucleotide
  Target: ATXN1; (+) strand; PAM type: NRG; PAM sequence: AAG
ctgaggaaagcacatccggc

SEQ ID NO: 131579 - DNA, 20 bp, Artificial Sequence
  Description of Artificial Sequence: Synthetic oligonucleotide
  Target: ATXN1; (+) strand; PAM type: NRG; PAM sequence: TAG
cacatccggcaagtgtaaaa

SEQ ID NO: 131580 - DNA, 20 bp, Artificial Sequence
  Description of Artificial Sequence: Synthetic oligonucleotide
  Target: ATXN1; (+) strand; PAM type: NRG; PAM sequence: TGG
gcaagtgtaaaatagcccac

SEQ ID NO: 131581 - DNA, 20 bp, Artificial Sequence
  Description of Artificial Sequence: Synthetic oligonucleotide
  Target: ATXN1; (+) strand; PAM type: NRG; PAM sequence: GGG
caagtgtaaaatagcccact

SEQ ID NO: 131582 - DNA, 20 bp, Artificial Sequence
  Description of Artificial Sequence: Synthetic oligonucleotide
  Target: ATXN1; (+) strand; PAM type: NRG; PAM sequence: AAG
cactgggtccaatttccatg

SEQ ID NO: 131583 - DNA, 20 bp, Artificial Sequence
  Description of Artificial Sequence: Synthetic oligonucleotide
  Target: ATXN1; (+) strand; PAM type: NRG; PAM sequence: GAG
ctgggtccaatttccatgaa

SEQ ID NO: 131584 - DNA, 20 bp, Artificial Sequence
  Description of Artificial Sequence: Synthetic oligonucleotide
  Target: ATXN1; (+) strand; PAM type: NRG; PAM sequence: AGG
tgggtccaatttccatgaag

SEQ ID NO: 131585 - DNA, 20 bp, Artificial Sequence
  Description of Artificial Sequence: Synthetic oligonucleotide
  Target: ATXN1; (+) strand; PAM type: NRG; PAM sequence: CAG
caatttccatgaagaggtgc

SEQ ID NO: 131586 - DNA, 20 bp, Artificial Sequence
  Description of Artificial Sequence: Synthetic oligonucleotide
  Target: ATXN1; (+) strand; PAM type: NRG; PAM sequence: TGG
gaagaggtgccagctccatt

SEQ ID NO: 131587 - DNA, 20 bp, Artificial Sequence
  Description of Artificial Sequence: Synthetic oligonucleotide
  Target: ATXN1; (+) strand; PAM type: NRG; PAM sequence: AAG
tacaatctacaaatgaatcc

SEQ ID NO: 131588 - DNA, 20 bp, Artificial Sequence
  Description of Artificial Sequence: Synthetic oligonucleotide
  Target: ATXN1; (+) strand; PAM type: NRG; PAM sequence: CAG
caaatgaatccaagcactat

SEQ ID NO: 131589 - DNA, 20 bp, Artificial Sequence
  Description of Artificial Sequence: Synthetic oligonucleotide
  Target: ATXN1; (+) strand; PAM type: NRG; PAM sequence: TGG
aactgttaactgcatgactc

SEQ ID NO: 131590 - DNA, 20 bp, Artificial Sequence
  Description of Artificial Sequence: Synthetic oligonucleotide
  Target: ATXN1; (+) strand; PAM type: NRG; PAM sequence: TGG
gttaactgcatgactctgga

SEQ ID NO: 131591 - DNA, 20 bp, Artificial Sequence
  Description of Artificial Sequence: Synthetic oligonucleotide
  Target: ATXN1; (+) strand; PAM type: NRG; PAM sequence: TAG
aactgcatgactctggatgg

SEQ ID NO: 131592 - DNA, 20 bp, Artificial Sequence
  Description of Artificial Sequence: Synthetic oligonucleotide
  Target: ATXN1; (+) strand; PAM type: NRG; PAM sequence: AGG
actgcatgactctggatggt

SEQ ID NO: 131593 - DNA, 20 bp, Artificial Sequence
  Description of Artificial Sequence: Synthetic oligonucleotide
  Target: ATXN1; (+) strand; PAM type: NRG; PAM sequence: GGG
ctgcatgactctggatggta

SEQ ID NO: 131594 - DNA, 20 bp, Artificial Sequence
  Description of Artificial Sequence: Synthetic oligonucleotide
  Target: ATXN1; (+) strand; PAM type: NRG; PAM sequence: GGG
tgcatgactctggatggtag

SEQ ID NO: 131595 - DNA, 20 bp, Artificial Sequence
  Description of Artificial Sequence: Synthetic oligonucleotide
  Target: ATXN1; (+) strand; PAM type: NRG; PAM sequence: GGG
gcatgactctggatggtagg

SEQ ID NO: 131596 - DNA, 20 bp, Artificial Sequence
  Description of Artificial Sequence: Synthetic oligonucleotide
  Target: ATXN1; (+) strand; PAM type: NRG; PAM sequence: GAG
atgactctggatggtagggg

SEQ ID NO: 131597 - DNA, 20 bp, Artificial Sequence
  Description of Artificial Sequence: Synthetic oligonucleotide
  Target: ATXN1; (+) strand; PAM type: NRG; PAM sequence: AGG
tgactctggatggtaggggg

SEQ ID NO: 131598 - DNA, 20 bp, Artificial Sequence
  Description of Artificial Sequence: Synthetic oligonucleotide
  Target: ATXN1; (+) strand; PAM type: NRG; PAM sequence: GGG
gactctggatggtaggggga

SEQ ID NO: 131599 - DNA, 20 bp, Artificial Sequence
  Description of Artificial Sequence: Synthetic oligonucleotide
  Target: ATXN1; (+) strand; PAM type: NRG; PAM sequence: AAG
tctggatggtagggggaggg

SEQ ID NO: 131600 - DNA, 20 bp, Artificial Sequence
  Description of Artificial Sequence: Synthetic oligonucleotide
  Target: ATXN1; (+) strand; PAM type: NRG; PAM sequence: AGG
ctggatggtagggggaggga

SEQ ID NO: 131601 - DNA, 20 bp, Artificial Sequence
  Description of Artificial Sequence: Synthetic oligonucleotide
  Target: ATXN1; (+) strand; PAM type: NRG; PAM sequence: GGG
tggatggtagggggagggaa

SEQ ID NO: 131602 - DNA, 20 bp, Artificial Sequence
  Description of Artificial Sequence: Synthetic oligonucleotide
  Target: ATXN1; (+) strand; PAM type: NRG; PAM sequence: AAG
gggagggaagggtctcaaaa

SEQ ID NO: 131603 - DNA, 20 bp, Artificial Sequence
  Description of Artificial Sequence: Synthetic oligonucleotide
  Target: ATXN1; (+) strand; PAM type: NRG; PAM sequence: GAG
gagggaagggtctcaaaaaa

SEQ ID NO: 131604 - DNA, 20 bp, Artificial Sequence
  Description of Artificial Sequence: Synthetic oligonucleotide
  Target: ATXN1; (+) strand; PAM type: NRG; PAM sequence: GAG
gggaagggtctcaaaaaaga

SEQ ID NO: 131605 - DNA, 20 bp, Artificial Sequence
  Description of Artificial Sequence: Synthetic oligonucleotide
  Target: ATXN1; (+) strand; PAM type: NRG; PAM sequence: AAG
ggtctcaaaaaagagagaaa

SEQ ID NO: 131606 - DNA, 20 bp, Artificial Sequence
  Description of Artificial Sequence: Synthetic oligonucleotide
  Target: ATXN1; (+) strand; PAM type: NRG; PAM sequence: AGG
gtctcaaaaaagagagaaaa

SEQ ID NO: 131607 - DNA, 20 bp, Artificial Sequence
  Description of Artificial Sequence: Synthetic oligonucleotide
  Target: ATXN1; (+) strand; PAM type: NRG; PAM sequence: CAG
aagagagaaaaaggattttt

SEQ ID NO: 131608 - DNA, 20 bp, Artificial Sequence
  Description of Artificial Sequence: Synthetic oligonucleotide
  Target: ATXN1; (+) strand; PAM type: NRG; PAM sequence: AGG
agagagaaaaaggatttttc

SEQ ID NO: 131609 - DNA, 20 bp, Artificial Sequence
  Description of Artificial Sequence: Synthetic oligonucleotide
  Target: ATXN1; (+) strand; PAM type: NRG; PAM sequence: TGG
aaaaggatttttcaggatac

SEQ ID NO: 131610 - DNA, 20 bp, Artificial Sequence
  Description of Artificial Sequence: Synthetic oligonucleotide
  Target: ATXN1; (+) strand; PAM type: NRG; PAM sequence: GAG
ttttcaggatactggaaatt

SEQ ID NO: 131611 - DNA, 20 bp, Artificial Sequence
  Description of Artificial Sequence: Synthetic oligonucleotide
  Target: ATXN1; (+) strand; PAM type: NRG; PAM sequence: GAG
ttcaggatactggaaattga

SEQ ID NO: 131612 - DNA, 20 bp, Artificial Sequence
  Description of Artificial Sequence: Synthetic oligonucleotide
  Target: ATXN1; (+) strand; PAM type: NRG; PAM sequence: CAG
aggatactggaaattgagag

SEQ ID NO: 131613 - DNA, 20 bp, Artificial Sequence
  Description of Artificial Sequence: Synthetic oligonucleotide
  Target: ATXN1; (+) strand; PAM type: NRG; PAM sequence: AAG
aaattgagagcagattataa

SEQ ID NO: 131614 - DNA, 20 bp, Artificial Sequence
  Description of Artificial Sequence: Synthetic oligonucleotide
  Target: ATXN1; (+) strand; PAM type: NRG; PAM sequence: AAG
aaagatttacgttgaataac

SEQ ID NO: 131615 - DNA, 20 bp, Artificial Sequence
  Description of Artificial Sequence: Synthetic oligonucleotide
  Target: ATXN1; (+) strand; PAM type: NRG; PAM sequence: AAG
tacgttgaataacaagaata

SEQ ID NO: 131616 - DNA, 20 bp, Artificial Sequence
  Description of Artificial Sequence: Synthetic oligonucleotide
  Target: ATXN1; (+) strand; PAM type: NRG; PAM sequence: TAG
gtatctctatgtgaaaaaaa

SEQ ID NO: 131617 - DNA, 20 bp, Artificial Sequence
  Description of Artificial Sequence: Synthetic oligonucleotide
  Target: ATXN1; (+) strand; PAM type: NRG; PAM sequence: TAG
tctatgtgaaaaaaatagcc

SEQ ID NO: 131618 - DNA, 20 bp, Artificial Sequence
  Description of Artificial Sequence: Synthetic oligonucleotide
  Target: ATXN1; (+) strand; PAM type: NRG; PAM sequence: CAG
acatttcatgtttttgcatc

SEQ ID NO: 131619 - DNA, 20 bp, Artificial Sequence
  Description of Artificial Sequence: Synthetic oligonucleotide
  Target: ATXN1; (+) strand; PAM type: NRG; PAM sequence: AAG
atgtttttgcatccagatat

SEQ ID NO: 131620 - DNA, 20 bp, Artificial Sequence
  Description of Artificial Sequence: Synthetic oligonucleotide
  Target: ATXN1; (+) strand; PAM type: NRG; PAM sequence: TGG
tgccctattctgtttttgct

SEQ ID NO: 131621 - DNA, 20 bp, Artificial Sequence
  Description of Artificial Sequence: Synthetic oligonucleotide
  Target: ATXN1; (+) strand; PAM type: NRG; PAM sequence: GGG
gccctattctgtttttgctt

SEQ ID NO: 131622 - DNA, 20 bp, Artificial Sequence
  Description of Artificial Sequence: Synthetic oligonucleotide
  Target: ATXN1; (+) strand; PAM type: NRG; PAM sequence: GAG
tattctgtttttgcttgggt

SEQ ID NO: 131623 - DNA, 20 bp, Artificial Sequence
  Description of Artificial Sequence: Synthetic oligonucleotide
  Target: ATXN1; (+) strand; PAM type: NRG; PAM sequence: AGG
attctgtttttgcttgggtg

SEQ ID NO: 131624 - DNA, 20 bp, Artificial Sequence
  Description of Artificial Sequence: Synthetic oligonucleotide
  Target: ATXN1; (+) strand; PAM type: NRG; PAM sequence: CAG
ttgggtgaggctaaaaaact

SEQ ID NO: 131625 - DNA, 20 bp, Artificial Sequence
  Description of Artificial Sequence: Synthetic oligonucleotide
  Target: ATXN1; (+) strand; PAM type: NRG; PAM sequence: TAG
cagtaccaccatgttttttg

SEQ ID NO: 131626 - DNA, 20 bp, Artificial Sequence
  Description of Artificial Sequence: Synthetic oligonucleotide
  Target: ATXN1; (+) strand; PAM type: NRG; PAM sequence: AGG
agtaccaccatgttttttgt

SEQ ID NO: 131627 - DNA, 20 bp, Artificial Sequence
  Description of Artificial Sequence: Synthetic oligonucleotide
  Target: ATXN1; (+) strand; PAM type: NRG; PAM sequence: GGG
gtaccaccatgttttttgta

SEQ ID NO: 131628 - DNA, 20 bp, Artificial Sequence
  Description of Artificial Sequence: Synthetic oligonucleotide
  Target: ATXN1; (+) strand; PAM type: NRG; PAM sequence: AAG
ccatgttttttgtagggtca

SEQ ID NO: 131629 - DNA, 20 bp, Artificial Sequence
  Description of Artificial Sequence: Synthetic oligonucleotide
  Target: ATXN1; (+) strand; PAM type: NRG; PAM sequence: GAG
atgttttttgtagggtcaaa

SEQ ID NO: 131630 - DNA, 20 bp, Artificial Sequence
  Description of Artificial Sequence: Synthetic oligonucleotide
  Target: ATXN1; (+) strand; PAM type: NRG; PAM sequence: CGG
tttttgtagggtcaaagaga

SEQ ID NO: 131631 - DNA, 20 bp, Artificial Sequence
  Description of Artificial Sequence: Synthetic oligonucleotide
  Target: ATXN1; (+) strand; PAM type: NRG; PAM sequence: AAG
gtagggtcaaagagacggct

SEQ ID NO: 131632 - DNA, 20 bp, Artificial Sequence
  Description of Artificial Sequence: Synthetic oligonucleotide
  Target: ATXN1; (+) strand; PAM type: NRG; PAM sequence: GAG
agggtcaaagagacggctaa

SEQ ID NO: 131633 - DNA, 20 bp, Artificial Sequence
  Description of Artificial Sequence: Synthetic oligonucleotide
  Target: ATXN1; (+) strand; PAM type: NRG; PAM sequence: TGG
ccttaattaataatttttgt

SEQ ID NO: 131634 - DNA, 20 bp, Artificial Sequence
  Description of Artificial Sequence: Synthetic oligonucleotide
  Target: ATXN1; (+) strand; PAM type: NRG; PAM sequence: TGG
ttgttggcattttacaactc

SEQ ID NO: 131635 - DNA, 20 bp, Artificial Sequence
  Description of Artificial Sequence: Synthetic oligonucleotide
  Target: ATXN1; (+) strand; PAM type: NRG; PAM sequence: CAG
tggattcccccaaactcctg

SEQ ID NO: 131636 - DNA, 20 bp, Artificial Sequence
  Description of Artificial Sequence: Synthetic oligonucleotide
  Target: ATXN1; (+) strand; PAM type: NRG; PAM sequence: TGG
cccccaaactcctgcagcat

SEQ ID NO: 131637 - DNA, 20 bp, Artificial Sequence
  Description of Artificial Sequence: Synthetic oligonucleotide
  Target: ATXN1; (+) strand; PAM type: NRG; PAM sequence: TAG
tgcagcattggtgtaacttc

SEQ ID NO: 131638 - DNA, 20 bp, Artificial Sequence
  Description of Artificial Sequence: Synthetic oligonucleotide
  Target: ATXN1; (+) strand; PAM type: NRG; PAM sequence: TGG
ttgctgtaatctcaaactcc

SEQ ID NO: 131639 - DNA, 20 bp, Artificial Sequence
  Description of Artificial Sequence: Synthetic oligonucleotide
  Target: ATXN1; (+) strand; PAM type: NRG; PAM sequence: GGG
tgctgtaatctcaaactcct

SEQ ID NO: 131640 - DNA, 20 bp, Artificial Sequence
  Description of Artificial Sequence: Synthetic oligonucleotide
  Target: ATXN1; (+) strand; PAM type: NRG; PAM sequence: AAG
aatctcaaactcctgggctc

SEQ ID NO: 131641 - DNA, 20 bp, Artificial Sequence
  Description of Artificial Sequence: Synthetic oligonucleotide
  Target: ATXN1; (+) strand; PAM type: NRG; PAM sequence: CAG
ctcaagcgatcctcccgcct

SEQ ID NO: 131642 - DNA, 20 bp, Artificial Sequence
  Description of Artificial Sequence: Synthetic oligonucleotide
  Target: ATXN1; (+) strand; PAM type: NRG; PAM sequence: CAG
gatcctcccgcctcagcctc

SEQ ID NO: 131643 - DNA, 20 bp, Artificial Sequence
  Description of Artificial Sequence: Synthetic oligonucleotide
  Target: ATXN1; (+) strand; PAM type: NRG; PAM sequence: GAG
tcctcccgcctcagcctcca

SEQ ID NO: 131644 - DNA, 20 bp, Artificial Sequence
  Description of Artificial Sequence: Synthetic oligonucleotide
  Target: ATXN1; (+) strand; PAM type: NRG; PAM sequence: TAG
tcccgcctcagcctccagag

SEQ ID NO: 131645 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctccagagtagc

SEQ ID NO: 131646 - DNA, 20 bp, Artificial Sequence
  Description of Artificial Sequence: Synthetic oligonucleotide
  Target: ATXN1; (+) strand; PAM type: NRG; PAM sequence: AAG
ctccagagtagctggactat

SEQ ID NO: 131647 - DNA, 20 bp, Artificial Sequence
  Description of Artificial Sequence: Synthetic oligonucleotide
  Target: ATXN1; (+) strand; PAM type: NRG; PAM sequence: TGG
taagcacatctcaccatgcc

SEQ ID NO: 131648 - DNA, 20 bp, Artificial Sequence
  Description of Artificial Sequence: Synthetic oligonucleotide
  Target: ATXN1; (+) strand; PAM type: NRG; PAM sequence: CAG
caaacaaacaaacaaacaaa

SEQ ID NO: 131649 - DNA, 20 bp, Artificial Sequence
  Description of Artificial Sequence: Synthetic oligonucleotide
  Target: ATXN1; (+) strand; PAM type: NRG; PAM sequence: AGG
aaacaaacaaacaaacaaac

SEQ ID NO: 131650 - DNA, 20 bp, Artificial Sequence
  Description of Artificial Sequence: Synthetic oligonucleotide
  Target: ATXN1; (+) strand; PAM type: NRG; PAM sequence: TGG
aaacaaacaaacaaacaggc

SEQ ID NO: 131651 - DNA, 20 bp, Artificial Sequence
  Description of Artificial Sequence: Synthetic oligonucleotide
  Target: ATXN1; (+) strand; PAM type: NRG; PAM sequence: GGG
aacaaacaaacaaacaggct

SEQ ID NO: 131652 - DNA, 20 bp, Artificial Sequence
  Description of Artificial Sequence: Synthetic oligonucleotide
  Target: ATXN1; (+) strand; PAM type: NRG; PAM sequence: CGG
acaaacaaacaggctgggcg

SEQ ID NO: 131653 - DNA, 20 bp, Artificial Sequence
  Description of Artificial Sequence: Synthetic oligonucleotide
  Target: ATXN1; (+) strand; PAM type: NRG; PAM sequence: TGG
aacaaacaggctgggcgcgg

SEQ ID NO: 131654 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgactgtaatcc

SEQ ID NO: 131655 - DNA, 20 bp, Artificial Sequence
  Description of Artificial Sequence: Synthetic oligonucleotide
  Target: ATXN1; (+) strand; PAM type: NRG; PAM sequence: TGG
cgactgtaatcccagcactt

SEQ ID NO: 131656 - DNA, 20 bp, Artificial Sequence
  Description of Artificial Sequence: Synthetic oligonucleotide
  Target: ATXN1; (+) strand; PAM type: NRG; PAM sequence: GGG
gactgtaatcccagcacttt

SEQ ID NO: 131657 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 131658 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 131659 - DNA, 20 bp, Artificial Sequence
  Description of Artificial Sequence: Synthetic oligonucleotide
  Target: ATXN1; (+) strand; PAM type: NRG; PAM sequence: CGG
cccagcactttgggaggcca

SEQ ID NO: 131660 - DNA, 20 bp, Artificial Sequence
  Description of Artificial Sequence: Synthetic oligonucleotide
  Target: ATXN1; (+) strand; PAM type: NRG; PAM sequence: CGG
agcactttgggaggccacgg

SEQ ID NO: 131661 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccacggc

SEQ ID NO: 131662 - DNA, 20 bp, Artificial Sequence
  Description of Artificial Sequence: Synthetic oligonucleotide
  Target: ATXN1; (+) strand; PAM type: NRG; PAM sequence: CGG
ctttgggaggccacggcggg

SEQ ID NO: 131663 - DNA, 20 bp, Artificial Sequence
  Description of Artificial Sequence: Synthetic oligonucleotide
  Target: ATXN1; (+) strand; PAM type: NRG; PAM sequence: GAG
ggccacggcgggcggatcac

SEQ ID NO: 131664 - DNA, 20 bp, Artificial Sequence
  Description of Artificial Sequence: Synthetic oligonucleotide
  Target: ATXN1; (+) strand; PAM type: NRG; PAM sequence: AGG
gccacggcgggcggatcacg

SEQ ID NO: 131665 - DNA, 20 bp, Artificial Sequence
  Description of Artificial Sequence: Synthetic oligonucleotide
  Target: ATXN1; (+) strand; PAM type: NRG; PAM sequence: CAG
cggcgggcggatcacgaggt

SEQ ID NO: 131666 - DNA, 20 bp, Artificial Sequence
  Description of Artificial Sequence: Synthetic oligonucleotide
  Target: ATXN1; (+) strand; PAM type: NRG; PAM sequence: AGG
ggcgggcggatcacgaggtc

SEQ ID NO: 131667 - DNA, 20 bp, Artificial Sequence
  Description of Artificial Sequence: Synthetic oligonucleotide
  Target: ATXN1; (+) strand; PAM type: NRG; PAM sequence: GAG
cgggcggatcacgaggtcag

SEQ ID NO: 131668 - DNA, 20 bp, Artificial Sequence
  Description of Artificial Sequence: Synthetic oligonucleotide
  Target: ATXN1; (+) strand; PAM type: NRG; PAM sequence: AAG
gatcacgaggtcaggagatc

SEQ ID NO: 131669 - DNA, 20 bp, Artificial Sequence
  Description of Artificial Sequence: Synthetic oligonucleotide
  Target: ATXN1; (+) strand; PAM type: NRG; PAM sequence: TGG
tcaggagatcaagaccatcc

SEQ ID NO: 131670 - DNA, 20 bp, Artificial Sequence
  Description of Artificial Sequence: Synthetic oligonucleotide
  Target: ATXN1; (+) strand; PAM type: NRG; PAM sequence: TAG
ctaaaaatacaaaaaaaaat

SEQ ID NO: 131671 - DNA, 20 bp, Artificial Sequence
  Description of Artificial Sequence: Synthetic oligonucleotide
  Target: ATXN1; (+) strand; PAM type: NRG; PAM sequence: CGG
aaatacaaaaaaaaattagc

SEQ ID NO: 131672 - DNA, 20 bp, Artificial Sequence
  Description of Artificial Sequence: Synthetic oligonucleotide
  Target: ATXN1; (+) strand; PAM type: NRG; PAM sequence: GGG
aatacaaaaaaaaattagcc

SEQ ID NO: 131673 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaaattagccgggca

SEQ ID NO: 131674 - DNA, 20 bp, Artificial Sequence
  Description of Artificial Sequence: Synthetic oligonucleotide
  Target: ATXN1; (+) strand; PAM type: NRG; PAM sequence: TGG
aaaaaattagccgggcatgg

SEQ ID NO: 131675 - DNA, 20 bp, Artificial Sequence
  Description of Artificial Sequence: Synthetic oligonucleotide
  Target: ATXN1; (+) strand; PAM type: NRG; PAM sequence: TGG
aaattagccgggcatggtgg

SEQ ID NO: 131676 - DNA, 20 bp, Artificial Sequence
  Description of Artificial Sequence: Synthetic oligonucleotide
  Target: ATXN1; (+) strand; PAM type: NRG; PAM sequence: GGG
aattagccgggcatggtggt

SEQ ID NO: 131677 - DNA, 20 bp, Artificial Sequence
  Description of Artificial Sequence: Synthetic oligonucleotide
  Target: ATXN1; (+) strand; PAM type: NRG; PAM sequence: CAG
gtggtgggttcctgtaatct

SEQ ID NO: 131678 - DNA, 20 bp, Artificial Sequence
  Description of Artificial Sequence: Synthetic oligonucleotide
  Target: ATXN1; (+) strand; PAM type: NRG; PAM sequence: CGG
ttcctgtaatctcagctact

SEQ ID NO: 131679 - DNA, 20 bp, Artificial Sequence
  Description of Artificial Sequence: Synthetic oligonucleotide
  Target: ATXN1; (+) strand; PAM type: NRG; PAM sequence: GGG
tcctgtaatctcagctactc

SEQ ID NO: 131680 - DNA, 20 bp, Artificial Sequence
  Description of Artificial Sequence: Synthetic oligonucleotide
  Target: ATXN1; (+) strand; PAM type: NRG; PAM sequence: GAG
ctgtaatctcagctactcgg

SEQ ID NO: 131681 - DNA, 20 bp, Artificial Sequence
  Description of Artificial Sequence: Synthetic oligonucleotide
  Target: ATXN1; (+) strand; PAM type: NRG; PAM sequence: AGG
tgtaatctcagctactcggg

SEQ ID NO: 131682 - DNA, 20 bp, Artificial Sequence
  Description of Artificial Sequence: Synthetic oligonucleotide
  Target: ATXN1; (+) strand; PAM type: NRG; PAM sequence: GAG
tctcagctactcgggaggct

SEQ ID NO: 131683 - DNA, 20 bp, Artificial Sequence
  Description of Artificial Sequence: Synthetic oligonucleotide
  Target: ATXN1; (+) strand; PAM type: NRG; PAM sequence: AGG
ctcagctactcgggaggctg

SEQ ID NO: 131684 - DNA, 20 bp, Artificial Sequence
  Description of Artificial Sequence: Synthetic oligonucleotide
  Target: ATXN1; (+) strand; PAM type: NRG; PAM sequence: CAG
agctactcgggaggctgagg

SEQ ID NO: 131685 - DNA, 20 bp, Artificial Sequence
  Description of Artificial Sequence: Synthetic oligonucleotide
  Target: ATXN1; (+) strand; PAM type: NRG; PAM sequence: AGG
gctactcgggaggctgaggc

SEQ ID NO: 131686 - DNA, 20 bp, Artificial Sequence
  Description of Artificial Sequence: Synthetic oligonucleotide
  Target: ATXN1; (+) strand; PAM type: NRG; PAM sequence: GAG
tactcgggaggctgaggcag

SEQ ID NO: 131687 - DNA, 20 bp, Artificial Sequence
  Description of Artificial Sequence: Synthetic oligonucleotide
  Target: ATXN1; (+) strand; PAM type: NRG; PAM sequence: TGG
gcaggagaatcgcttgaatc

SEQ ID NO: 131688 - DNA, 20 bp, Artificial Sequence
  Description of Artificial Sequence: Synthetic oligonucleotide
  Target: ATXN1; (+) strand; PAM type: NRG; PAM sequence: GGG
caggagaatcgcttgaatct

SEQ ID NO: 131689 - DNA, 20 bp, Artificial Sequence
  Description of Artificial Sequence: Synthetic oligonucleotide
  Target: ATXN1; (+) strand; PAM type: NRG; PAM sequence: GAG
ggagaatcgcttgaatctgg

SEQ ID NO: 131690 - DNA, 20 bp, Artificial Sequence
  Description of Artificial Sequence: Synthetic oligonucleotide
  Target: ATXN1; (+) strand; PAM type: NRG; PAM sequence: AGG
gagaatcgcttgaatctggg

SEQ ID NO: 131691 - DNA, 20 bp, Artificial Sequence
  Description of Artificial Sequence: Synthetic oligonucleotide
  Target: ATXN1; (+) strand; PAM type: NRG; PAM sequence: AAG
tcgcttgaatctgggaggca

SEQ ID NO: 131692 - DNA, 20 bp, Artificial Sequence
  Description of Artificial Sequence: Synthetic oligonucleotide
  Target: ATXN1; (+) strand; PAM type: NRG; PAM sequence: AGG
cgcttgaatctgggaggcaa

SEQ ID NO: 131693 - DNA, 20 bp, Artificial Sequence
  Description of Artificial Sequence: Synthetic oligonucleotide
  Target: ATXN1; (+) strand; PAM type: NRG; PAM sequence: CAG
aatctgggaggcaaaggttg

SEQ ID NO: 131694 - DNA, 20 bp, Artificial Sequence
  Description of Artificial Sequence: Synthetic oligonucleotide
  Target: ATXN1; (+) strand; PAM type: NRG; PAM sequence: GAG
tgggaggcaaaggttgcagt

SEQ ID NO: 131695 - DNA, 20 bp, Artificial Sequence
  Description of Artificial Sequence: Synthetic oligonucleotide
  Target: ATXN1; (+) strand; PAM type: NRG; PAM sequence: GAG
ggcaaaggttgcagtgagcc

SEQ ID NO: 131696 - DNA, 20 bp, Artificial Sequence
  Description of Artificial Sequence: Synthetic oligonucleotide
  Target: ATXN1; (+) strand; PAM type: NRG; PAM sequence: CAG
gagatcacaccactgcactc

SEQ ID NO: 131697 - DNA, 20 bp, Artificial Sequence
  Description of Artificial Sequence: Synthetic oligonucleotide
  Target: ATXN1; (+) strand; PAM type: NRG; PAM sequence: TGG
cacaccactgcactccagcc

SEQ ID NO: 131698 - DNA, 20 bp, Artificial Sequence
  Description of Artificial Sequence: Synthetic oligonucleotide
  Target: ATXN1; (+) strand; PAM type: NRG; PAM sequence: GGG
acaccactgcactccagcct

SEQ ID NO: 131699 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggcaa

SEQ ID NO: 131700 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggcaaca

SEQ ID NO: 131701 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggcaacagagt

SEQ ID NO: 131702 - DNA, 20 bp, Artificial Sequence
  Description of Artificial Sequence: Synthetic oligonucleotide
  Target: ATXN1; (+) strand; PAM type: NRG; PAM sequence: TAG
acaacaacaaaaacattttg

SEQ ID NO: 131703 - DNA, 20 bp, Artificial Sequence
  Description of Artificial Sequence: Synthetic oligonucleotide
  Target: ATXN1; (+) strand; PAM type: NRG; PAM sequence: GAG
aacaacaaaaacattttgta

SEQ ID NO: 131704 - DNA, 20 bp, Artificial Sequence
  Description of Artificial Sequence: Synthetic oligonucleotide
  Target: ATXN1; (+) strand; PAM type: NRG; PAM sequence: AGG
acaacaaaaacattttgtag

SEQ ID NO: 131705 - DNA, 20 bp, Artificial Sequence
  Description of Artificial Sequence: Synthetic oligonucleotide
  Target: ATXN1; (+) strand; PAM type: NRG; PAM sequence: TGG
acaaaaacattttgtagagg

SEQ ID NO: 131706 - DNA, 20 bp, Artificial Sequence
  Description of Artificial Sequence: Synthetic oligonucleotide
  Target: ATXN1; (+) strand; PAM type: NRG; PAM sequence: GGG
caaaaacattttgtagaggt

SEQ ID NO: 131707 - DNA, 20 bp, Artificial Sequence
  Description of Artificial Sequence: Synthetic oligonucleotide
  Target: ATXN1; (+) strand; PAM type: NRG; PAM sequence: TAG
tgggtcctcactgtgttgcc

SEQ ID NO: 131708 - DNA, 20 bp, Artificial Sequence
  Description of Artificial Sequence: Synthetic oligonucleotide
  Target: ATXN1; (+) strand; PAM type: NRG; PAM sequence: AGG
gggtcctcactgtgttgcct

SEQ ID NO: 131709 - DNA, 20 bp, Artificial Sequence
  Description of Artificial Sequence: Synthetic oligonucleotide
  Target: ATXN1; (+) strand; PAM type: NRG; PAM sequence: TAG
cctcactgtgttgcctaggc

SEQ ID NO: 131710 - DNA, 20 bp, Artificial Sequence
  Description of Artificial Sequence: Synthetic oligonucleotide
  Target: ATXN1; (+) strand; PAM type: NRG; PAM sequence: TGG
ctaggctagtctcaaactcc

SEQ ID NO: 131711 - DNA, 20 bp, Artificial Sequence
  Description of Artificial Sequence: Synthetic oligonucleotide
  Target: ATXN1; (+) strand; PAM type: NRG; PAM sequence: AAG
tctcaaactcctggcatcgt

SEQ ID NO: 131712 - DNA, 20 bp, Artificial Sequence
  Description of Artificial Sequence: Synthetic oligonucleotide
  Target: ATXN1; (+) strand; PAM type: NRG; PAM sequence: TGG
aagttgtctttcatatgctt

SEQ ID NO: 131713 - DNA, 20 bp, Artificial Sequence
  Description of Artificial Sequence: Synthetic oligonucleotide
  Target: ATXN1; (+) strand; PAM type: NRG; PAM sequence: CAG
atgctttggcattcaatgct

SEQ ID NO: 131714 - DNA, 20 bp, Artificial Sequence
  Description of Artificial Sequence: Synthetic oligonucleotide
  Target: ATXN1; (+) strand; PAM type: NRG; PAM sequence: GAG
tcaatgctcagtaacaacct

SEQ ID NO: 131715 - DNA, 20 bp, Artificial Sequence
  Description of Artificial Sequence: Synthetic oligonucleotide
  Target: ATXN1; (+) strand; PAM type: NRG; PAM sequence: TAG
tataatgcctcacctttaaa

SEQ ID NO: 131716 - DNA, 20 bp, Artificial Sequence
  Description of Artificial Sequence: Synthetic oligonucleotide
  Target: ATXN1; (+) strand; PAM type: NRG; PAM sequence: CAG
cacctttaaatagtactcta

SEQ ID NO: 131717 - DNA, 20 bp, Artificial Sequence
  Description of Artificial Sequence: Synthetic oligonucleotide
  Target: ATXN1; (+) strand; PAM type: NRG; PAM sequence: AAG
atagtactctacagttcata

SEQ ID NO: 131718 - DNA, 20 bp, Artificial Sequence
  Description of Artificial Sequence: Synthetic oligonucleotide
  Target: ATXN1; (+) strand; PAM type: NRG; PAM sequence: TAG
tgctttctttcacactgatg

SEQ ID NO: 131719 - DNA, 20 bp, Artificial Sequence
  Description of Artificial Sequence: Synthetic oligonucleotide
  Target: ATXN1; (+) strand; PAM type: NRG; PAM sequence: CAG
gccttccttgtattaaatca

SEQ ID NO: 131720 - DNA, 20 bp, Artificial Sequence
  Description of Artificial Sequence: Synthetic oligonucleotide
  Target: ATXN1; (+) strand; PAM type: NRG; PAM sequence: CAG
tgtattaaatcacagctttg

SEQ ID NO: 131721 - DNA, 20 bp, Artificial Sequence
  Description of Artificial Sequence: Synthetic oligonucleotide
  Target: ATXN1; (+) strand; PAM type: NRG; PAM sequence: AAG
atttttgcaaaaccctttca

SEQ ID NO: 131722 - DNA, 20 bp, Artificial Sequence
  Description of Artificial Sequence: Synthetic oligonucleotide
  Target: ATXN1; (+) strand; PAM type: NRG; PAM sequence: AGG
tttttgcaaaaccctttcaa

SEQ ID NO: 131723 - DNA, 20 bp, Artificial Sequence
  Description of Artificial Sequence: Synthetic oligonucleotide
  Target: ATXN1; (+) strand; PAM type: NRG; PAM sequence: AAG
aaggtacttgtcaattaatg

SEQ ID NO: 131724 - DNA, 20 bp, Artificial Sequence
  Description of Artificial Sequence: Synthetic oligonucleotide
  Target: ATXN1; (+) strand; PAM type: NRG; PAM sequence: AAG
attaatgaagattaaacata

SEQ ID NO: 131725 - DNA, 20 bp, Artificial Sequence
  Description of Artificial Sequence: Synthetic oligonucleotide
  Target: ATXN1; (+) strand; PAM type: NRG; PAM sequence: AGG
ttaatgaagattaaacataa

SEQ ID NO: 131726 - DNA, 20 bp, Artificial Sequence
  Description of Artificial Sequence: Synthetic oligonucleotide
  Target: ATXN1; (+) strand; PAM type: NRG; PAM sequence: TGG
gattaaacataaaggtgatc

SEQ ID NO: 131727 - DNA, 20 bp, Artificial Sequence
  Description of Artificial Sequence: Synthetic oligonucleotide
  Target: ATXN1; (+) strand; PAM type: NRG; PAM sequence: GAG
aaaggtgatctggaatctat

SEQ ID NO: 131728 - DNA, 20 bp, Artificial Sequence
  Description of Artificial Sequence: Synthetic oligonucleotide
  Target: ATXN1; (+) strand; PAM type: NRG; PAM sequence: AGG
aaggtgatctggaatctatg

SEQ ID NO: 131729 - DNA, 20 bp, Artificial Sequence
  Description of Artificial Sequence: Synthetic oligonucleotide
  Target: ATXN1; (+) strand; PAM type: NRG; PAM sequence: TGG
tggaatctatgaggacaatc

SEQ ID NO: 131730 - DNA, 20 bp, Artificial Sequence
  Description of Artificial Sequence: Synthetic oligonucleotide
  Target: ATXN1; (+) strand; PAM type: NRG; PAM sequence: GGG
ggaatctatgaggacaatct

SEQ ID NO: 131731 - DNA, 20 bp, Artificial Sequence
  Description of Artificial Sequence: Synthetic oligonucleotide
  Target: ATXN1; (+) strand; PAM type: NRG; PAM sequence: GGG
gaatctatgaggacaatctg

SEQ ID NO: 131732 - DNA, 20 bp, Artificial Sequence
  Description of Artificial Sequence: Synthetic oligonucleotide
  Target: ATXN1; (+) strand; PAM type: NRG; PAM sequence: GGG
aatctatgaggacaatctgg

SEQ ID NO: 131733 - DNA, 20 bp, Artificial Sequence
  Description of Artificial Sequence: Synthetic oligonucleotide
  Target: ATXN1; (+) strand; PAM type: NRG; PAM sequence: GGG
atctatgaggacaatctggg

SEQ ID NO: 131734 - DNA, 20 bp, Artificial Sequence
  Description of Artificial Sequence: Synthetic oligonucleotide
  Target: ATXN1; (+) strand; PAM type: NRG; PAM sequence: AAG
ggggatatgactgccaactg

SEQ ID NO: 131735 - DNA, 20 bp, Artificial Sequence
  Description of Artificial Sequence: Synthetic oligonucleotide
  Target: ATXN1; (+) strand; PAM type: NRG; PAM sequence: TGG
atatgactgccaactgaaga

SEQ ID NO: 131736 - DNA, 20 bp, Artificial Sequence
  Description of Artificial Sequence: Synthetic oligonucleotide
  Target: ATXN1; (+) strand; PAM type: NRG; PAM sequence: CAG
tgactgccaactgaagatgg

SEQ ID NO: 131737 - DNA, 20 bp, Artificial Sequence
  Description of Artificial Sequence: Synthetic oligonucleotide
  Target: ATXN1; (+) strand; PAM type: NRG; PAM sequence: CAG
tgccattgaaattattctca

SEQ ID NO: 131738 - DNA, 20 bp, Artificial Sequence
  Description of Artificial Sequence: Synthetic oligonucleotide
  Target: ATXN1; (+) strand; PAM type: NRG; PAM sequence: CAG
aattattctcacagttttga

SEQ ID NO: 131739 - DNA, 20 bp, Artificial Sequence
  Description of Artificial Sequence: Synthetic oligonucleotide
  Target: ATXN1; (+) strand; PAM type: NRG; PAM sequence: TAG
tattctcacagttttgacag

SEQ ID NO: 131740 - DNA, 20 bp, Artificial Sequence
  Description of Artificial Sequence: Synthetic oligonucleotide
  Target: ATXN1; (+) strand; PAM type: NRG; PAM sequence: GAG
ttctcacagttttgacagta

SEQ ID NO: 131741 - DNA, 20 bp, Artificial Sequence
  Description of Artificial Sequence: Synthetic oligonucleotide
  Target: ATXN1; (+) strand; PAM type: NRG; PAM sequence: AAG
cagtagagaaaaaccatcaa

SEQ ID NO: 131742 - DNA, 20 bp, Artificial Sequence
  Description of Artificial Sequence: Synthetic oligonucleotide
  Target: ATXN1; (+) strand; PAM type: NRG; PAM sequence: AAG
ccacaaaatgcataaaatta

SEQ ID NO: 131743 - DNA, 20 bp, Artificial Sequence
  Description of Artificial Sequence: Synthetic oligonucleotide
  Target: ATXN1; (+) strand; PAM type: NRG; PAM sequence: AGG
cacaaaatgcataaaattaa

SEQ ID NO: 131744 - DNA, 20 bp, Artificial Sequence
  Description of Artificial Sequence: Synthetic oligonucleotide
  Target: ATXN1; (+) strand; PAM type: NRG; PAM sequence: GGG
acaaaatgcataaaattaaa

SEQ ID NO: 131745 - DNA, 20 bp, Artificial Sequence
  Description of Artificial Sequence: Synthetic oligonucleotide
  Target: ATXN1; (+) strand; PAM type: NRG; PAM sequence: TGG
aaagggaaatgtttcttgca

SEQ ID NO: 131746 - DNA, 20 bp, Artificial Sequence
  Description of Artificial Sequence: Synthetic oligonucleotide
  Target: ATXN1; (+) strand; PAM type: NRG; PAM sequence: GGG
aagggaaatgtttcttgcat

SEQ ID NO: 131747 - DNA, 20 bp, Artificial Sequence
  Description of Artificial Sequence: Synthetic oligonucleotide
  Target: ATXN1; (+) strand; PAM type: NRG; PAM sequence: CAG
aatgtttcttgcatgggctg

SEQ ID NO: 131748 - DNA, 20 bp, Artificial Sequence
  Description of Artificial Sequence: Synthetic oligonucleotide
  Target: ATXN1; (+) strand; PAM type: NRG; PAM sequence: CAG
ggctgcagtactgttttaaa

SEQ ID NO: 131749 - DNA, 20 bp, Artificial Sequence
  Description of Artificial Sequence: Synthetic oligonucleotide
  Target: ATXN1; (+) strand; PAM type: NRG; PAM sequence: AAG
tgcagtactgttttaaacag

SEQ ID NO: 131750 - DNA, 20 bp, Artificial Sequence
  Description of Artificial Sequence: Synthetic oligonucleotide
  Target: ATXN1; (+) strand; PAM type: NRG; PAM sequence: AGG
gcagtactgttttaaacaga

SEQ ID NO: 131751 - DNA, 20 bp, Artificial Sequence
  Description of Artificial Sequence: Synthetic oligonucleotide
  Target: ATXN1; (+) strand; PAM type: NRG; PAM sequence: GGG
cagtactgttttaaacagaa

SEQ ID NO: 131752 - DNA, 20 bp, Artificial Sequence
  Description of Artificial Sequence: Synthetic oligonucleotide
  Target: ATXN1; (+) strand; PAM type: NRG; PAM sequence: AAG
actgttttaaacagaaggga

SEQ ID NO: 131753 - DNA, 20 bp, Artificial Sequence
  Description of Artificial Sequence: Synthetic oligonucleotide
  Target: ATXN1; (+) strand; PAM type: NRG; PAM sequence: TGG
gaaagaccattaaacatgac

SEQ ID NO: 131754 - DNA, 20 bp, Artificial Sequence
  Description of Artificial Sequence: Synthetic oligonucleotide
  Target: ATXN1; (+) strand; PAM type: NRG; PAM sequence: TGG
tcactaaattttaactacac

SEQ ID NO: 131755 - DNA, 20 bp, Artificial Sequence
  Description of Artificial Sequence: Synthetic oligonucleotide
  Target: ATXN1; (+) strand; PAM type: NRG; PAM sequence: AAG
ttttaactacactggcatca

SEQ ID NO: 131756 - DNA, 20 bp, Artificial Sequence
  Description of Artificial Sequence: Synthetic oligonucleotide
  Target: ATXN1; (+) strand; PAM type: NRG; PAM sequence: GAG
ctacactggcatcaaagtct

SEQ ID NO: 131757 - DNA, 20 bp, Artificial Sequence
  Description of Artificial Sequence: Synthetic oligonucleotide
  Target: ATXN1; (+) strand; PAM type: NRG; PAM sequence: GAG
gcatcaaagtctgagcctgt

SEQ ID NO: 131758 - DNA, 20 bp, Artificial Sequence
  Description of Artificial Sequence: Synthetic oligonucleotide
  Target: ATXN1; (+) strand; PAM type: NRG; PAM sequence: AAG
aagtctgagcctgtgagtgc

SEQ ID NO: 131759 - DNA, 20 bp, Artificial Sequence
  Description of Artificial Sequence: Synthetic oligonucleotide
  Target: ATXN1; (+) strand; PAM type: NRG; PAM sequence: CAG
ctgagcctgtgagtgcaagt

SEQ ID NO: 131760 - DNA, 20 bp, Artificial Sequence
  Description of Artificial Sequence: Synthetic oligonucleotide
  Target: ATXN1; (+) strand; PAM type: NRG; PAM sequence: AAG
taaatgtttctttccactgc

SEQ ID NO: 131761 - DNA, 20 bp, Artificial Sequence
  Description of Artificial Sequence: Synthetic oligonucleotide
  Target: ATXN1; (+) strand; PAM type: NRG; PAM sequence: AGG
aaatgtttctttccactgca

SEQ ID NO: 131762 - DNA, 20 bp, Artificial Sequence
  Description of Artificial Sequence: Synthetic oligonucleotide
  Target: ATXN1; (+) strand; PAM type: NRG; PAM sequence: GGG
aatgtttctttccactgcaa

SEQ ID NO: 131763 - DNA, 20 bp, Artificial Sequence
  Description of Artificial Sequence: Synthetic oligonucleotide
  Target: ATXN1; (+) strand; PAM type: NRG; PAM sequence: GAG
cactgcaagggtgcatgtgt

SEQ ID NO: 131764 - DNA, 20 bp, Artificial Sequence
  Description of Artificial Sequence: Synthetic oligonucleotide
  Target: ATXN1; (+) strand; PAM type: NRG; PAM sequence: AGG
actgcaagggtgcatgtgtg

SEQ ID NO: 131765 - DNA, 20 bp, Artificial Sequence
  Description of Artificial Sequence: Synthetic oligonucleotide
  Target: ATXN1; (+) strand; PAM type: NRG; PAM sequence: GGG
ctgcaagggtgcatgtgtga

SEQ ID NO: 131766 - DNA, 20 bp, Artificial Sequence
  Description of Artificial Sequence: Synthetic oligonucleotide
  Target: ATXN1; (+) strand; PAM type: NRG; PAM sequence: GGG
tgcaagggtgcatgtgtgag

SEQ ID NO: 131767 - DNA, 20 bp, Artificial Sequence
  Description of Artificial Sequence: Synthetic oligonucleotide
  Target: ATXN1; (+) strand; PAM type: NRG; PAM sequence: GGG
gcaagggtgcatgtgtgagg

SEQ ID NO: 131768 - DNA, 20 bp, Artificial Sequence
  Description of Artificial Sequence: Synthetic oligonucleotide
  Target: ATXN1; (+) strand; PAM type: NRG; PAM sequence: GGG
caagggtgcatgtgtgaggg

SEQ ID NO: 131769 - DNA, 20 bp, Artificial Sequence
  Description of Artificial Sequence: Synthetic oligonucleotide
  Target: ATXN1; (+) strand; PAM type: NRG; PAM sequence: AAG
gcatgtgtgaggggggaaca

SEQ ID NO: 131770 - DNA, 20 bp, Artificial Sequence
  Description of Artificial Sequence: Synthetic oligonucleotide
  Target: ATXN1; (+) strand; PAM type: NRG; PAM sequence: TGG
acaaagtattctttttaata

SEQ ID NO: 131771 - DNA, 20 bp, Artificial Sequence
  Description of Artificial Sequence: Synthetic oligonucleotide
  Target: ATXN1; (+) strand; PAM type: NRG; PAM sequence: AAG
aagtattctttttaatatgg

SEQ ID NO: 131772 - DNA, 20 bp, Artificial Sequence
  Description of Artificial Sequence: Synthetic oligonucleotide
  Target: ATXN1; (+) strand; PAM type: NRG; PAM sequence: AAG
cctgacaatctaactctgac

SEQ ID NO: 131773 - DNA, 20 bp, Artificial Sequence
  Description of Artificial Sequence: Synthetic oligonucleotide
  Target: ATXN1; (+) strand; PAM type: NRG; PAM sequence: TAG
ctaactctgacaagcttgca

SEQ ID NO: 131774 - DNA, 20 bp, Artificial Sequence
  Description of Artificial Sequence: Synthetic oligonucleotide
  Target: ATXN1; (+) strand; PAM type: NRG; PAM sequence: TAG
ctgacaagcttgcatagtcc

SEQ ID NO: 131775 - DNA, 20 bp, Artificial Sequence
  Description of Artificial Sequence: Synthetic oligonucleotide
  Target: ATXN1; (+) strand; PAM type: NRG; PAM sequence: AGG
tgacaagcttgcatagtcct

SEQ ID NO: 131776 - DNA, 20 bp, Artificial Sequence
  Description of Artificial Sequence: Synthetic oligonucleotide
  Target: ATXN1; (+) strand; PAM type: NRG; PAM sequence: CAG
attctatttctacctcctaa

SEQ ID NO: 131777 - DNA, 20 bp, Artificial Sequence
  Description of Artificial Sequence: Synthetic oligonucleotide
  Target: ATXN1; (+) strand; PAM type: NRG; PAM sequence: CAG
atttctacctcctaacagaa

SEQ ID NO: 131778 - DNA, 20 bp, Artificial Sequence
  Description of Artificial Sequence: Synthetic oligonucleotide
  Target: ATXN1; (+) strand; PAM type: NRG; PAM sequence: CAG
acctcctaacagaacagcat

SEQ ID NO: 131779 - DNA, 20 bp, Artificial Sequence
  Description of Artificial Sequence: Synthetic oligonucleotide
  Target: ATXN1; (+) strand; PAM type: NRG; PAM sequence: CAG
catttgtgatcatattctgt

SEQ ID NO: 131780 - DNA, 20 bp, Artificial Sequence
  Description of Artificial Sequence: Synthetic oligonucleotide
  Target: ATXN1; (+) strand; PAM type: NRG; PAM sequence: GAG
tcagctgctctgctaacaat

SEQ ID NO: 131781 - DNA, 20 bp, Artificial Sequence
  Description of Artificial Sequence: Synthetic oligonucleotide
  Target: ATXN1; (+) strand; PAM type: NRG; PAM sequence: TGG
gagaaatttttacttgtata

SEQ ID NO: 131782 - DNA, 20 bp, Artificial Sequence
  Description of Artificial Sequence: Synthetic oligonucleotide
  Target: ATXN1; (+) strand; PAM type: NRG; PAM sequence: TAG
aatttttacttgtatatgga

SEQ ID NO: 131783 - DNA, 20 bp, Artificial Sequence
  Description of Artificial Sequence: Synthetic oligonucleotide
  Target: ATXN1; (+) strand; PAM type: NRG; PAM sequence: AAG
tttacttgtatatggatagt

SEQ ID NO: 131784 - DNA, 20 bp, Artificial Sequence
  Description of Artificial Sequence: Synthetic oligonucleotide
  Target: ATXN1; (+) strand; PAM type: NRG; PAM sequence: GAG
atatggatagtaagttccct

SEQ ID NO: 131785 - DNA, 20 bp, Artificial Sequence
  Description of Artificial Sequence: Synthetic oligonucleotide
  Target: ATXN1; (+) strand; PAM type: NRG; PAM sequence: AAG
tggatagtaagttccctgag

SEQ ID NO: 131786 - DNA, 20 bp, Artificial Sequence
  Description of Artificial Sequence: Synthetic oligonucleotide
  Target: ATXN1; (+) strand; PAM type: NRG; PAM sequence: AGG
ggatagtaagttccctgaga

SEQ ID NO: 131787 - DNA, 20 bp, Artificial Sequence
  Description of Artificial Sequence: Synthetic oligonucleotide
  Target: ATXN1; (+) strand; PAM type: NRG; PAM sequence: CAG
tccctgagaaggcatatctc

SEQ ID NO: 131788 - DNA, 20 bp, Artificial Sequence
  Description of Artificial Sequence: Synthetic oligonucleotide
  Target: ATXN1; (+) strand; PAM type: NRG; PAM sequence: AGG
ccctgagaaggcatatctcc

SEQ ID NO: 131789 - DNA, 20 bp, Artificial Sequence
  Description of Artificial Sequence: Synthetic oligonucleotide
  Target: ATXN1; (+) strand; PAM type: NRG; PAM sequence: CAG
agaaggcatatctccaggac

SEQ ID NO: 131790 - DNA, 20 bp, Artificial Sequence
  Description of Artificial Sequence: Synthetic oligonucleotide
  Target: ATXN1; (+) strand; PAM type: NRG; PAM sequence: CAG
tttactttacaatctaatgt

SEQ ID NO: 131791 - DNA, 20 bp, Artificial Sequence
  Description of Artificial Sequence: Synthetic oligonucleotide
  Target: ATXN1; (+) strand; PAM type: NRG; PAM sequence: AAG
ctttacaatctaatgtcagc

SEQ ID NO: 131792 - DNA, 20 bp, Artificial Sequence
  Description of Artificial Sequence: Synthetic oligonucleotide
  Target: ATXN1; (+) strand; PAM type: NRG; PAM sequence: GAG
ttacaatctaatgtcagcaa

SEQ ID NO: 131793 - DNA, 20 bp, Artificial Sequence
  Description of Artificial Sequence: Synthetic oligonucleotide
  Target: ATXN1; (+) strand; PAM type: NRG; PAM sequence: CAG
gcacacattacccatgcaca

SEQ ID NO: 131794 - DNA, 20 bp, Artificial Sequence
  Description of Artificial Sequence: Synthetic oligonucleotide
  Target: ATXN1; (+) strand; PAM type: NRG; PAM sequence: TAG
cattacccatgcacacagct

SEQ ID NO: 131795 - DNA, 20 bp, Artificial Sequence
  Description of Artificial Sequence: Synthetic oligonucleotide
  Target: ATXN1; (+) strand; PAM type: NRG; PAM sequence: AAG
cacacagcttagaaataaac

SEQ ID NO: 131796 - DNA, 20 bp, Artificial Sequence
  Description of Artificial Sequence: Synthetic oligonucleotide
  Target: ATXN1; (+) strand; PAM type: NRG; PAM sequence: AGG
acacagcttagaaataaaca

SEQ ID NO: 131797 - DNA, 20 bp, Artificial Sequence
  Description of Artificial Sequence: Synthetic oligonucleotide
  Target: ATXN1; (+) strand; PAM type: NRG; PAM sequence: TGG
aaggtgtgtaaactgcaaat

SEQ ID NO: 131798 - DNA, 20 bp, Artificial Sequence
  Description of Artificial Sequence: Synthetic oligonucleotide
  Target: ATXN1; (+) strand; PAM type: NRG; PAM sequence: CAG
taaactgcaaattggttcca

SEQ ID NO: 131799 - DNA, 20 bp, Artificial Sequence
  Description of Artificial Sequence: Synthetic oligonucleotide
  Target: ATXN1; (+) strand; PAM type: NRG; PAM sequence: GAG
aactgcaaattggttccaca

SEQ ID NO: 131800 - DNA, 20 bp, Artificial Sequence
  Description of Artificial Sequence: Synthetic oligonucleotide
  Target: ATXN1; (+) strand; PAM type: NRG; PAM sequence: CAG
agagcaaataactgattcac

SEQ ID NO: 131801 - DNA, 20 bp, Artificial Sequence
  Description of Artificial Sequence: Synthetic oligonucleotide
  Target: ATXN1; (+) strand; PAM type: NRG; PAM sequence: AAG
gattcaccagatatctgtaa

SEQ ID NO: 131802 - DNA, 20 bp, Artificial Sequence
  Description of Artificial Sequence: Synthetic oligonucleotide
  Target: ATXN1; (+) strand; PAM type: NRG; PAM sequence: CAG
ttgaaaaaccataaaatgct

SEQ ID NO: 131803 - DNA, 20 bp, Artificial Sequence
  Description of Artificial Sequence: Synthetic oligonucleotide
  Target: ATXN1; (+) strand; PAM type: NRG; PAM sequence: AGG
tgaaaaaccataaaatgctc

SEQ ID NO: 131804 - DNA, 20 bp, Artificial Sequence
  Description of Artificial Sequence: Synthetic oligonucleotide
  Target: ATXN1; (+) strand; PAM type: NRG; PAM sequence: AAG
caggacctttatgttaacta

SEQ ID NO: 131805 - DNA, 20 bp, Artificial Sequence
  Description of Artificial Sequence: Synthetic oligonucleotide
  Target: ATXN1; (+) strand; PAM type: NRG; PAM sequence: TAG
agtattttccttccatgtgt

SEQ ID NO: 131806 - DNA, 20 bp, Artificial Sequence
  Description of Artificial Sequence: Synthetic oligonucleotide
  Target: ATXN1; (+) strand; PAM type: NRG; PAM sequence: TAG
agattttccccttatatgtg

SEQ ID NO: 131807 - DNA, 20 bp, Artificial Sequence
  Description of Artificial Sequence: Synthetic oligonucleotide
  Target: ATXN1; (+) strand; PAM type: NRG; PAM sequence: AAG
tgtgtagaacacacacacaa

SEQ ID NO: 131808 - DNA, 20 bp, Artificial Sequence
  Description of Artificial Sequence: Synthetic oligonucleotide
  Target: ATXN1; (+) strand; PAM type: NRG; PAM sequence: GAG
tgtagaacacacacacaaaa

SEQ ID NO: 131809 - DNA, 20 bp, Artificial Sequence
  Description of Artificial Sequence: Synthetic oligonucleotide
  Target: ATXN1; (+) strand; PAM type: NRG; PAM sequence: CAG
caaaagagaattataaacgt

SEQ ID NO: 131810 - DNA, 20 bp, Artificial Sequence
  Description of Artificial Sequence: Synthetic oligonucleotide
  Target: ATXN1; (+) strand; PAM type: NRG; PAM sequence: GAG
aaagagaattataaacgtca

SEQ ID NO: 131811 - DNA, 20 bp, Artificial Sequence
  Description of Artificial Sequence: Synthetic oligonucleotide
  Target: ATXN1; (+) strand; PAM type: NRG; PAM sequence: CAG
ttaacctttaaaaaccaaca

SEQ ID NO: 131812 - DNA, 20 bp, Artificial Sequence
  Description of Artificial Sequence: Synthetic oligonucleotide
  Target: ATXN1; (+) strand; PAM type: NRG; PAM sequence: AAG
aacacagtaattatattgca

SEQ ID NO: 131813 - DNA, 20 bp, Artificial Sequence
  Description of Artificial Sequence: Synthetic oligonucleotide
  Target: ATXN1; (+) strand; PAM type: NRG; PAM sequence: CAG
tgcaaagatatctgacaacc

SEQ ID NO: 131814 - DNA, 20 bp, Artificial Sequence
  Description of Artificial Sequence: Synthetic oligonucleotide
  Target: ATXN1; (+) strand; PAM type: NRG; PAM sequence: GAG
caaagatatctgacaaccca

SEQ ID NO: 131815 - DNA, 20 bp, Artificial Sequence
  Description of Artificial Sequence: Synthetic oligonucleotide
  Target: ATXN1; (+) strand; PAM type: NRG; PAM sequence: TAG
ctgacaacccagagtaatac

SEQ ID NO: 131816 - DNA, 20 bp, Artificial Sequence
  Description of Artificial Sequence: Synthetic oligonucleotide
  Target: ATXN1; (+) strand; PAM type: NRG; PAM sequence: AAG
aacccagagtaatactagaa

SEQ ID NO: 131817 - DNA, 20 bp, Artificial Sequence
  Description of Artificial Sequence: Synthetic oligonucleotide
  Target: ATXN1; (+) strand; PAM type: NRG; PAM sequence: AGG
acccagagtaatactagaaa

SEQ ID NO: 131818 - DNA, 20 bp, Artificial Sequence
  Description of Artificial Sequence: Synthetic oligonucleotide
  Target: ATXN1; (+) strand; PAM type: NRG; PAM sequence: TAG
ctgcgcccccttcttttaaa

SEQ ID NO: 131819 - DNA, 20 bp, Artificial Sequence
  Description of Artificial Sequence: Synthetic oligonucleotide
  Target: ATXN1; (+) strand; PAM type: NRG; PAM sequence: TAG
ctcaatttttctacaattta

SEQ ID NO: 131820 - DNA, 20 bp, Artificial Sequence
  Description of Artificial Sequence: Synthetic oligonucleotide
  Target: ATXN1; (+) strand; PAM type: NRG; PAM sequence: AGG
tcaatttttctacaatttat

SEQ ID NO: 131821 - DNA, 20 bp, Artificial Sequence
  Description of Artificial Sequence: Synthetic oligonucleotide
  Target: ATXN1; (+) strand; PAM type: NRG; PAM sequence: CGG
atttttctacaatttatagg

SEQ ID NO: 131822 - DNA, 20 bp, Artificial Sequence
  Description of Artificial Sequence: Synthetic oligonucleotide
  Target: ATXN1; (+) strand; PAM type: NRG; PAM sequence: AAG
tttataggcggactgtgcaa

SEQ ID NO: 131823 - DNA, 20 bp, Artificial Sequence
  Description of Artificial Sequence: Synthetic oligonucleotide
  Target: ATXN1; (+) strand; PAM type: NRG; PAM sequence: TAG
gactgtgcaaaagattttca

SEQ ID NO: 131824 - DNA, 20 bp, Artificial Sequence
  Description of Artificial Sequence: Synthetic oligonucleotide
  Target: ATXN1; (+) strand; PAM type: NRG; PAM sequence: AAG
catagccatgaatcctatta

SEQ ID NO: 131825 - DNA, 20 bp, Artificial Sequence
  Description of Artificial Sequence: Synthetic oligonucleotide
  Target: ATXN1; (+) strand; PAM type: NRG; PAM sequence: TGG
gaatcctattaaagatacat

SEQ ID NO: 131826 - DNA, 20 bp, Artificial Sequence
  Description of Artificial Sequence: Synthetic oligonucleotide
  Target: ATXN1; (+) strand; PAM type: NRG; PAM sequence: GGG
aatcctattaaagatacatt

SEQ ID NO: 131827 - DNA, 20 bp, Artificial Sequence
  Description of Artificial Sequence: Synthetic oligonucleotide
  Target: ATXN1; (+) strand; PAM type: NRG; PAM sequence: GAG
tcctattaaagatacattgg

SEQ ID NO: 131828 - DNA, 20 bp, Artificial Sequence
  Description of Artificial Sequence: Synthetic oligonucleotide
  Target: ATXN1; (+) strand; PAM type: NRG; PAM sequence: AAG
aaatcactattccaattcgc

SEQ ID NO: 131829 - DNA, 20 bp, Artificial Sequence
  Description of Artificial Sequence: Synthetic oligonucleotide
  Target: ATXN1; (+) strand; PAM type: NRG; PAM sequence: AAG
gaatatttgaaacgctgcca

SEQ ID NO: 131830 - DNA, 20 bp, Artificial Sequence
  Description of Artificial Sequence: Synthetic oligonucleotide
  Target: ATXN1; (+) strand; PAM type: NRG; PAM sequence: AGG
aatatttgaaacgctgccaa

SEQ ID NO: 131831 - DNA, 20 bp, Artificial Sequence
  Description of Artificial Sequence: Synthetic oligonucleotide
  Target: ATXN1; (+) strand; PAM type: NRG; PAM sequence: GGG
atatttgaaacgctgccaaa

SEQ ID NO: 131832 - DNA, 20 bp, Artificial Sequence
  Description of Artificial Sequence: Synthetic oligonucleotide
  Target: ATXN1; (+) strand; PAM type: NRG; PAM sequence: AAG
ggaatgtttctccaaacata

SEQ ID NO: 131833 - DNA, 20 bp, Artificial Sequence
  Description of Artificial Sequence: Synthetic oligonucleotide
  Target: ATXN1; (+) strand; PAM type: NRG; PAM sequence: GAG
aatgtttctccaaacataaa

SEQ ID NO: 131834 - DNA, 20 bp, Artificial Sequence
  Description of Artificial Sequence: Synthetic oligonucleotide
  Target: ATXN1; (+) strand; PAM type: NRG; PAM sequence: GAG
tgtttctccaaacataaaga

SEQ ID NO: 131835 - DNA, 20 bp, Artificial Sequence
  Description of Artificial Sequence: Synthetic oligonucleotide
  Target: ATXN1; (+) strand; PAM type: NRG; PAM sequence: AAG
taaagagagtattaaatttt

SEQ ID NO: 131836 - DNA, 20 bp, Artificial Sequence
  Description of Artificial Sequence: Synthetic oligonucleotide
  Target: ATXN1; (+) strand; PAM type: NRG; PAM sequence: GAG
aagagagtattaaattttaa

SEQ ID NO: 131837 - DNA, 20 bp, Artificial Sequence
  Description of Artificial Sequence: Synthetic oligonucleotide
  Target: ATXN1; (+) strand; PAM type: NRG; PAM sequence: GAG
gagagtattaaattttaaga

SEQ ID NO: 131838 - DNA, 20 bp, Artificial Sequence
  Description of Artificial Sequence: Synthetic oligonucleotide
  Target: ATXN1; (+) strand; PAM type: NRG; PAM sequence: GAG
gagtattaaattttaagaga

SEQ ID NO: 131839 - DNA, 20 bp, Artificial Sequence
  Description of Artificial Sequence: Synthetic oligonucleotide
  Target: ATXN1; (+) strand; PAM type: NRG; PAM sequence: AGG
agtattaaattttaagagag

SEQ ID NO: 131840 - DNA, 20 bp, Artificial Sequence
  Description of Artificial Sequence: Synthetic oligonucleotide
  Target: ATXN1; (+) strand; PAM type: NRG; PAM sequence: AAG
gagaggctatcatcaaaacg

SEQ ID NO: 131841 - DNA, 20 bp, Artificial Sequence
  Description of Artificial Sequence: Synthetic oligonucleotide
  Target: ATXN1; (+) strand; PAM type: NRG; PAM sequence: AGG
agaggctatcatcaaaacga

SEQ ID NO: 131842 - DNA, 20 bp, Artificial Sequence
  Description of Artificial Sequence: Synthetic oligonucleotide
  Target: ATXN1; (+) strand; PAM type: NRG; PAM sequence: CAG
ggctatcatcaaaacgaagg

SEQ ID NO: 131843 - DNA, 20 bp, Artificial Sequence
  Description of Artificial Sequence: Synthetic oligonucleotide
  Target: ATXN1; (+) strand; PAM type: NRG; PAM sequence: GAG
ctatcatcaaaacgaaggca

SEQ ID NO: 131844 - DNA, 20 bp, Artificial Sequence
  Description of Artificial Sequence: Synthetic oligonucleotide
  Target: ATXN1; (+) strand; PAM type: NRG; PAM sequence: GAG
atcatcaaaacgaaggcaga

SEQ ID NO: 131845 - DNA, 20 bp, Artificial Sequence
  Description of Artificial Sequence: Synthetic oligonucleotide
  Target: ATXN1; (+) strand; PAM type: NRG; PAM sequence: AAG
atcaaaacgaaggcagagag

SEQ ID NO: 131846 - DNA, 20 bp, Artificial Sequence
  Description of Artificial Sequence: Synthetic oligonucleotide
  Target: ATXN1; (+) strand; PAM type: NRG; PAM sequence: AAG
aggcagagagaagtacacat

SEQ ID NO: 131847 - DNA, 20 bp, Artificial Sequence
  Description of Artificial Sequence: Synthetic oligonucleotide
  Target: ATXN1; (+) strand; PAM type: NRG; PAM sequence: AAG
tacacataagtcaacctgac

SEQ ID NO: 131848 - DNA, 20 bp, Artificial Sequence
  Description of Artificial Sequence: Synthetic oligonucleotide
  Target: ATXN1; (+) strand; PAM type: NRG; PAM sequence: AAG
ctgacaagcccatattgata

SEQ ID NO: 131849 - DNA, 20 bp, Artificial Sequence
  Description of Artificial Sequence: Synthetic oligonucleotide
  Target: ATXN1; (+) strand; PAM type: NRG; PAM sequence: CAG
acaagcccatattgataaag

SEQ ID NO: 131850 - DNA, 20 bp, Artificial Sequence
  Description of Artificial Sequence: Synthetic oligonucleotide
  Target: ATXN1; (+) strand; PAM type: NRG; PAM sequence: GAG
aagcccatattgataaagca

SEQ ID NO: 131851 - DNA, 20 bp, Artificial Sequence
  Description of Artificial Sequence: Synthetic oligonucleotide
  Target: ATXN1; (+) strand; PAM type: NRG; PAM sequence: AAG
tattgataaagcagagataa

SEQ ID NO: 131852 - DNA, 20 bp, Artificial Sequence
  Description of Artificial Sequence: Synthetic oligonucleotide
  Target: ATXN1; (+) strand; PAM type: NRG; PAM sequence: CAG
gcagagataaaagttatctc

SEQ ID NO: 131853 - DNA, 20 bp, Artificial Sequence
  Description of Artificial Sequence: Synthetic oligonucleotide
  Target: ATXN1; (+) strand; PAM type: NRG; PAM sequence: AGG
cagagataaaagttatctcc

SEQ ID NO: 131854 - DNA, 20 bp, Artificial Sequence
  Description of Artificial Sequence: Synthetic oligonucleotide
  Target: ATXN1; (+) strand; PAM type: NRG; PAM sequence: CGG
ttatctccaggttacatgcc

SEQ ID NO: 131855 - DNA, 20 bp, Artificial Sequence
  Description of Artificial Sequence: Synthetic oligonucleotide
  Target: ATXN1; (+) strand; PAM type: NRG; PAM sequence: CAG
tccaggttacatgcccggta

SEQ ID NO: 131856 - DNA, 20 bp, Artificial Sequence
  Description of Artificial Sequence: Synthetic oligonucleotide
  Target: ATXN1; (+) strand; PAM type: NRG; PAM sequence: AGG
ccaggttacatgcccggtac

SEQ ID NO: 131857 - DNA, 20 bp, Artificial Sequence
  Description of Artificial Sequence: Synthetic oligonucleotide
  Target: ATXN1; (+) strand; PAM type: NRG; PAM sequence: CAG
ggttacatgcccggtacagg

SEQ ID NO: 131858 - DNA, 20 bp, Artificial Sequence
  Description of Artificial Sequence: Synthetic oligonucleotide
  Target: ATXN1; (+) strand; PAM type: NRG; PAM sequence: GAG
gcagttctcaatgtatgaat

SEQ ID NO: 131859 - DNA, 20 bp, Artificial Sequence
  Description of Artificial Sequence: Synthetic oligonucleotide
  Target: ATXN1; (+) strand; PAM type: NRG; PAM sequence: CAG
atgtatgaatgagttgtata

SEQ ID NO: 131860 - DNA, 20 bp, Artificial Sequence
  Description of Artificial Sequence: Synthetic oligonucleotide
  Target: ATXN1; (+) strand; PAM type: NRG; PAM sequence: AAG
atgaatgagttgtatacaga

SEQ ID NO: 131861 - DNA, 20 bp, Artificial Sequence
  Description of Artificial Sequence: Synthetic oligonucleotide
  Target: ATXN1; (+) strand; PAM type: NRG; PAM sequence: AAG
tatacagaaagttcatttgt

SEQ ID NO: 131862 - DNA, 20 bp, Artificial Sequence
  Description of Artificial Sequence: Synthetic oligonucleotide
  Target: ATXN1; (+) strand; PAM type: NRG; PAM sequence: CAG
aaactccaaacacattttct

SEQ ID NO: 131863 - DNA, 20 bp, Artificial Sequence
  Description of Artificial Sequence: Synthetic oligonucleotide
  Target: ATXN1; (+) strand; PAM type: NRG; PAM sequence: GAG
actccaaacacattttctca

SEQ ID NO: 131864 - DNA, 20 bp, Artificial Sequence
  Description of Artificial Sequence: Synthetic oligonucleotide
  Target: ATXN1; (+) strand; PAM type: NRG; PAM sequence: CAG
aacacattttctcagagaaa

SEQ ID NO: 131865 - DNA, 20 bp, Artificial Sequence
  Description of Artificial Sequence: Synthetic oligonucleotide
  Target: ATXN1; (+) strand; PAM type: NRG; PAM sequence: TAG
cagagaaacagtgttataaa

SEQ ID NO: 131866 - DNA, 20 bp, Artificial Sequence
  Description of Artificial Sequence: Synthetic oligonucleotide
  Target: ATXN1; (+) strand; PAM type: NRG; PAM sequence: TAG
acagtgttataaatagtgct

SEQ ID NO: 131867 - DNA, 20 bp, Artificial Sequence
  Description of Artificial Sequence: Synthetic oligonucleotide
  Target: ATXN1; (+) strand; PAM type: NRG; PAM sequence: CAG
ataaatagtgcttagttttg

SEQ ID NO: 131868 - DNA, 20 bp, Artificial Sequence
  Description of Artificial Sequence: Synthetic oligonucleotide
  Target: ATXN1; (+) strand; PAM type: NRG; PAM sequence: AGG
taaatagtgcttagttttgc

SEQ ID NO: 131869 - DNA, 20 bp, Artificial Sequence
  Description of Artificial Sequence: Synthetic oligonucleotide
  Target: ATXN1; (+) strand; PAM type: NRG; PAM sequence: AAG
atagtgcttagttttgcagg

SEQ ID NO: 131870 - DNA, 20 bp, Artificial Sequence
  Description of Artificial Sequence: Synthetic oligonucleotide
  Target: ATXN1; (+) strand; PAM type: NRG; PAM sequence: AGG
tagtgcttagttttgcagga

SEQ ID NO: 131871 - DNA, 20 bp, Artificial Sequence
  Description of Artificial Sequence: Synthetic oligonucleotide
  Target: ATXN1; (+) strand; PAM type: NRG; PAM sequence: AAG
tagttttgcaggaaggcaaa

SEQ ID NO: 131872 - DNA, 20 bp, Artificial Sequence
  Description of Artificial Sequence: Synthetic oligonucleotide
  Target: ATXN1; (+) strand; PAM type: NRG; PAM sequence: GAG
gttttgcaggaaggcaaaaa

SEQ ID NO: 131873 - DNA, 20 bp, Artificial Sequence
  Description of Artificial Sequence: Synthetic oligonucleotide
  Target: ATXN1; (+) strand; PAM type: NRG; PAM sequence: TAG
caggaaggcaaaaagagcta

SEQ ID NO: 131874 - DNA, 20 bp, Artificial Sequence
  Description of Artificial Sequence: Synthetic oligonucleotide
  Target: ATXN1; (+) strand; PAM type: NRG; PAM sequence: GAG
ggaaggcaaaaagagctata

SEQ ID NO: 131875 - DNA, 20 bp, Artificial Sequence
  Description of Artificial Sequence: Synthetic oligonucleotide
  Target: ATXN1; (+) strand; PAM type: NRG; PAM sequence: TAG
gagctatagagcttataata

SEQ ID NO: 131876 - DNA, 20 bp, Artificial Sequence
  Description of Artificial Sequence: Synthetic oligonucleotide
  Target: ATXN1; (+) strand; PAM type: NRG; PAM sequence: TAG
cttataatatagacaaactc

SEQ ID NO: 131877 - DNA, 20 bp, Artificial Sequence
  Description of Artificial Sequence: Synthetic oligonucleotide
  Target: ATXN1; (+) strand; PAM type: NRG; PAM sequence: GAG
tagacaaactctagtaccat

SEQ ID NO: 131878 - DNA, 20 bp, Artificial Sequence
  Description of Artificial Sequence: Synthetic oligonucleotide
  Target: ATXN1; (+) strand; PAM type: NRG; PAM sequence: CAG
acaaactctagtaccatgag

SEQ ID NO: 131879 - DNA, 20 bp, Artificial Sequence
  Description of Artificial Sequence: Synthetic oligonucleotide
  Target: ATXN1; (+) strand; PAM type: NRG; PAM sequence: AGG
caaactctagtaccatgagc

SEQ ID NO: 131880 - DNA, 20 bp, Artificial Sequence
  Description of Artificial Sequence: Synthetic oligonucleotide
  Target: ATXN1; (+) strand; PAM type: NRG; PAM sequence: GGG
aaactctagtaccatgagca

SEQ ID NO: 131881 - DNA, 20 bp, Artificial Sequence
  Description of Artificial Sequence: Synthetic oligonucleotide
  Target: ATXN1; (+) strand; PAM type: NRG; PAM sequence: GGG
aactctagtaccatgagcag

SEQ ID NO: 131882 - DNA, 20 bp, Artificial Sequence
  Description of Artificial Sequence: Synthetic oligonucleotide
  Target: ATXN1; (+) strand; PAM type: NRG; PAM sequence: CAG
ctagtaccatgagcagggga

SEQ ID NO: 131883 - DNA, 20 bp, Artificial Sequence
  Description of Artificial Sequence: Synthetic oligonucleotide
  Target: ATXN1; (+) strand; PAM type: NRG; PAM sequence: AGG
tagtaccatgagcaggggac

SEQ ID NO: 131884 - DNA, 20 bp, Artificial Sequence
  Description of Artificial Sequence: Synthetic oligonucleotide
  Target: ATXN1; (+) strand; PAM type: NRG; PAM sequence: GAG
gtaccatgagcaggggacag

SEQ ID NO: 131885 - DNA, 20 bp, Artificial Sequence
  Description of Artificial Sequence: Synthetic oligonucleotide
  Target: ATXN1; (+) strand; PAM type: NRG; PAM sequence: AGG
taccatgagcaggggacagg

SEQ ID NO: 131886 - DNA, 20 bp, Artificial Sequence
  Description of Artificial Sequence: Synthetic oligonucleotide
  Target: ATXN1; (+) strand; PAM type: NRG; PAM sequence: AAG
tgagcaggggacaggaggtg

SEQ ID NO: 131887 - DNA, 20 bp, Artificial Sequence
  Description of Artificial Sequence: Synthetic oligonucleotide
  Target: ATXN1; (+) strand; PAM type: NRG; PAM sequence: GAG
acaggaggtgaagaaatcat

SEQ ID NO: 131888 - DNA, 20 bp, Artificial Sequence
  Description of Artificial Sequence: Synthetic oligonucleotide
  Target: ATXN1; (+) strand; PAM type: NRG; PAM sequence: AGG
caggaggtgaagaaatcatg

SEQ ID NO: 131889 - DNA, 20 bp, Artificial Sequence
  Description of Artificial Sequence: Synthetic oligonucleotide
  Target: ATXN1; (+) strand; PAM type: NRG; PAM sequence: GAG
ggaggtgaagaaatcatgag

SEQ ID NO: 131890 - DNA, 20 bp, Artificial Sequence
  Description of Artificial Sequence: Synthetic oligonucleotide
  Target: ATXN1; (+) strand; PAM type: NRG; PAM sequence: AGG
gaggtgaagaaatcatgagg

SEQ ID NO: 131891 - DNA, 20 bp, Artificial Sequence
  Description of Artificial Sequence: Synthetic oligonucleotide
  Target: ATXN1; (+) strand; PAM type: NRG; PAM sequence: TGG
gtgaagaaatcatgaggagg

SEQ ID NO: 131892 - DNA, 20 bp, Artificial Sequence
  Description of Artificial Sequence: Synthetic oligonucleotide
  Target: ATXN1; (+) strand; PAM type: NRG; PAM sequence: GGG
tgaagaaatcatgaggaggt

SEQ ID NO: 131893 - DNA, 20 bp, Artificial Sequence
  Description of Artificial Sequence: Synthetic oligonucleotide
  Target: ATXN1; (+) strand; PAM type: NRG; PAM sequence: CGG
tacaaatgaactttcttttt

SEQ ID NO: 131894 - DNA, 20 bp, Artificial Sequence
  Description of Artificial Sequence: Synthetic oligonucleotide
  Target: ATXN1; (+) strand; PAM type: NRG; PAM sequence: TGG
gaactttctttttcggtacc

SEQ ID NO: 131895 - DNA, 20 bp, Artificial Sequence
  Description of Artificial Sequence: Synthetic oligonucleotide
  Target: ATXN1; (+) strand; PAM type: NRG; PAM sequence: AAG
tcggtacctggaaacaacca

SEQ ID NO: 131896 - DNA, 20 bp, Artificial Sequence
  Description of Artificial Sequence: Synthetic oligonucleotide
  Target: ATXN1; (+) strand; PAM type: NRG; PAM sequence: TGG
caaccaaagttttttttttc

SEQ ID NO: 131897 - DNA, 20 bp, Artificial Sequence
  Description of Artificial Sequence: Synthetic oligonucleotide
  Target: ATXN1; (+) strand; PAM type: NRG; PAM sequence: CAG
actgtctaaatgcttcatcc

SEQ ID NO: 131898 - DNA, 20 bp, Artificial Sequence
  Description of Artificial Sequence: Synthetic oligonucleotide
  Target: ATXN1; (+) strand; PAM type: NRG; PAM sequence: AAG
tgcttcatcccagcccatat

SEQ ID NO: 131899 - DNA, 20 bp, Artificial Sequence
  Description of Artificial Sequence: Synthetic oligonucleotide
  Target: ATXN1; (+) strand; PAM type: NRG; PAM sequence: GAG
cttcatcccagcccatataa

SEQ ID NO: 131900 - DNA, 20 bp, Artificial Sequence
  Description of Artificial Sequence: Synthetic oligonucleotide
  Target: ATXN1; (+) strand; PAM type: NRG; PAM sequence: GAG
tcatcccagcccatataaga

SEQ ID NO: 131901 - DNA, 20 bp, Artificial Sequence
  Description of Artificial Sequence: Synthetic oligonucleotide
  Target: ATXN1; (+) strand; PAM type: NRG; PAM sequence: TAG
agcaccaaaaaaatttaata

SEQ ID NO: 131902 - DNA, 20 bp, Artificial Sequence
  Description of Artificial Sequence: Synthetic oligonucleotide
  Target: ATXN1; (+) strand; PAM type: NRG; PAM sequence: AAG
tttcccaaactccccttccc

SEQ ID NO: 131903 - DNA, 20 bp, Artificial Sequence
  Description of Artificial Sequence: Synthetic oligonucleotide
  Target: ATXN1; (+) strand; PAM type: NRG; PAM sequence: CAG
caaactccccttcccaagtc

SEQ ID NO: 131904 - DNA, 20 bp, Artificial Sequence
  Description of Artificial Sequence: Synthetic oligonucleotide
  Target: ATXN1; (+) strand; PAM type: NRG; PAM sequence: TGG
ccttcccaagtccagttatc

SEQ ID NO: 131905 - DNA, 20 bp, Artificial Sequence
  Description of Artificial Sequence: Synthetic oligonucleotide
  Target: ATXN1; (+) strand; PAM type: NRG; PAM sequence: AAG
gtccagttatctggcaatca

SEQ ID NO: 131906 - DNA, 20 bp, Artificial Sequence
  Description of Artificial Sequence: Synthetic oligonucleotide
  Target: ATXN1; (+) strand; PAM type: NRG; PAM sequence: AGG
tccagttatctggcaatcaa

SEQ ID NO: 131907 - DNA, 20 bp, Artificial Sequence
  Description of Artificial Sequence: Synthetic oligonucleotide
  Target: ATXN1; (+) strand; PAM type: NRG; PAM sequence: AAG
ctggcaatcaaaggctaata

SEQ ID NO: 131908 - DNA, 20 bp, Artificial Sequence
  Description of Artificial Sequence: Synthetic oligonucleotide
  Target: ATXN1; (+) strand; PAM type: NRG; PAM sequence: GAG
ggcaatcaaaggctaataaa

SEQ ID NO: 131909 - DNA, 20 bp, Artificial Sequence
  Description of Artificial Sequence: Synthetic oligonucleotide
  Target: ATXN1; (+) strand; PAM type: NRG; PAM sequence: CAG
tcaaaggctaataaagagtt

SEQ ID NO: 131910 - DNA, 20 bp, Artificial Sequence
  Description of Artificial Sequence: Synthetic oligonucleotide
  Target: ATXN1; (+) strand; PAM type: NRG; PAM sequence: CAG
ggctaataaagagttcagtt

SEQ ID NO: 131911 - DNA, 20 bp, Artificial Sequence
  Description of Artificial Sequence: Synthetic oligonucleotide
  Target: ATXN1; (+) strand; PAM type: NRG; PAM sequence: AAG
ataaagagttcagttcagta

SEQ ID NO: 131912 - DNA, 20 bp, Artificial Sequence
  Description of Artificial Sequence: Synthetic oligonucleotide
  Target: ATXN1; (+) strand; PAM type: NRG; PAM sequence: TAG
gttcagtaaagacttgtttc

SEQ ID NO: 131913 - DNA, 20 bp, Artificial Sequence
  Description of Artificial Sequence: Synthetic oligonucleotide
  Target: ATXN1; (+) strand; PAM type: NRG; PAM sequence: AGG
ttcagtaaagacttgtttct

SEQ ID NO: 131914 - DNA, 20 bp, Artificial Sequence
  Description of Artificial Sequence: Synthetic oligonucleotide
  Target: ATXN1; (+) strand; PAM type: NRG; PAM sequence: CAG
gacttgtttctaggttttga

SEQ ID NO: 131915 - DNA, 20 bp, Artificial Sequence
  Description of Artificial Sequence: Synthetic oligonucleotide
  Target: ATXN1; (+) strand; PAM type: NRG; PAM sequence: CAG
ttgtttctaggttttgacag

SEQ ID NO: 131916 - DNA, 20 bp, Artificial Sequence
  Description of Artificial Sequence: Synthetic oligonucleotide
  Target: ATXN1; (+) strand; PAM type: NRG; PAM sequence: GAG
ttgacagcagatctaatctt

SEQ ID NO: 131917 - DNA, 20 bp, Artificial Sequence
  Description of Artificial Sequence: Synthetic oligonucleotide
  Target: ATXN1; (+) strand; PAM type: NRG; PAM sequence: GAG
gacagcagatctaatcttga

SEQ ID NO: 131918 - DNA, 20 bp, Artificial Sequence
  Description of Artificial Sequence: Synthetic oligonucleotide
  Target: ATXN1; (+) strand; PAM type: NRG; PAM sequence: GAG
cagcagatctaatcttgaga

SEQ ID NO: 131919 - DNA, 20 bp, Artificial Sequence
  Description of Artificial Sequence: Synthetic oligonucleotide
  Target: ATXN1; (+) strand; PAM type: NRG; PAM sequence: GAG
gcagatctaatcttgagaga

SEQ ID NO: 131920 - DNA, 20 bp, Artificial Sequence
  Description of Artificial Sequence: Synthetic oligonucleotide
  Target: ATXN1; (+) strand; PAM type: NRG; PAM sequence: AGG
cagatctaatcttgagagag

SEQ ID NO: 131921 - DNA, 20 bp, Artificial Sequence
  Description of Artificial Sequence: Synthetic oligonucleotide
  Target: ATXN1; (+) strand; PAM type: NRG; PAM sequence: TGG
ctaatcttgagagagaggaa

SEQ ID NO: 131922 - DNA, 20 bp, Artificial Sequence
  Description of Artificial Sequence: Synthetic oligonucleotide
  Target: ATXN1; (+) strand; PAM type: NRG; PAM sequence: GGG
taatcttgagagagaggaat

SEQ ID NO: 131923 - DNA, 20 bp, Artificial Sequence
  Description of Artificial Sequence: Synthetic oligonucleotide
  Target: ATXN1; (+) strand; PAM type: NRG; PAM sequence: GGG
aatcttgagagagaggaatg

SEQ ID NO: 131924 - DNA, 20 bp, Artificial Sequence
  Description of Artificial Sequence: Synthetic oligonucleotide
  Target: ATXN1; (+) strand; PAM type: NRG; PAM sequence: AAG
agaggaatggggacatgacc

SEQ ID NO: 131925 - DNA, 20 bp, Artificial Sequence
  Description of Artificial Sequence: Synthetic oligonucleotide
  Target: ATXN1; (+) strand; PAM type: NRG; PAM sequence: TGG
atggggacatgaccaagctc

SEQ ID NO: 131926 - DNA, 20 bp, Artificial Sequence
  Description of Artificial Sequence: Synthetic oligonucleotide
  Target: ATXN1; (+) strand; PAM type: NRG; PAM sequence: GGG
tggggacatgaccaagctct

SEQ ID NO: 131927 - DNA, 20 bp, Artificial Sequence
  Description of Artificial Sequence: Synthetic oligonucleotide
  Target: ATXN1; (+) strand; PAM type: NRG; PAM sequence: AAG
aagctctgggtatacacaca

SEQ ID NO: 131928 - DNA, 20 bp, Artificial Sequence
  Description of Artificial Sequence: Synthetic oligonucleotide
  Target: ATXN1; (+) strand; PAM type: NRG; PAM sequence: TGG
cacacaaagaatgaaccatc

SEQ ID NO: 131929 - DNA, 20 bp, Artificial Sequence
  Description of Artificial Sequence: Synthetic oligonucleotide
  Target: ATXN1; (+) strand; PAM type: NRG; PAM sequence: GGG
acacaaagaatgaaccatct

SEQ ID NO: 131930 - DNA, 20 bp, Artificial Sequence
  Description of Artificial Sequence: Synthetic oligonucleotide
  Target: ATXN1; (+) strand; PAM type: NRG; PAM sequence: GAG
acaaagaatgaaccatctgg

SEQ ID NO: 131931 - DNA, 20 bp, Artificial Sequence
  Description of Artificial Sequence: Synthetic oligonucleotide
  Target: ATXN1; (+) strand; PAM type: NRG; PAM sequence: AGG
caaagaatgaaccatctggg

SEQ ID NO: 131932 - DNA, 20 bp, Artificial Sequence
  Description of Artificial Sequence: Synthetic oligonucleotide
  Target: ATXN1; (+) strand; PAM type: NRG; PAM sequence: TGG
aatgaaccatctgggaggac

SEQ ID NO: 131933 - DNA, 20 bp, Artificial Sequence
  Description of Artificial Sequence: Synthetic oligonucleotide
  Target: ATXN1; (+) strand; PAM type: NRG; PAM sequence: CAG
ctgggaggactggataattt

SEQ ID NO: 131934 - DNA, 20 bp, Artificial Sequence
  Description of Artificial Sequence: Synthetic oligonucleotide
  Target: ATXN1; (+) strand; PAM type: NRG; PAM sequence: AGG
tgggaggactggataatttc

SEQ ID NO: 131935 - DNA, 20 bp, Artificial Sequence
  Description of Artificial Sequence: Synthetic oligonucleotide
  Target: ATXN1; (+) strand; PAM type: NRG; PAM sequence: TAG
tcaggaatttccccgtaatt

SEQ ID NO: 131936 - DNA, 20 bp, Artificial Sequence
  Description of Artificial Sequence: Synthetic oligonucleotide
  Target: ATXN1; (+) strand; PAM type: NRG; PAM sequence: TGG
atttccccgtaatttagtaa

SEQ ID NO: 131937 - DNA, 20 bp, Artificial Sequence
  Description of Artificial Sequence: Synthetic oligonucleotide
  Target: ATXN1; (+) strand; PAM type: NRG; PAM sequence: AAG
gtaatttagtaatggtaaac

SEQ ID NO: 131938 - DNA, 20 bp, Artificial Sequence
  Description of Artificial Sequence: Synthetic oligonucleotide
  Target: ATXN1; (+) strand; PAM type: NRG; PAM sequence: CAG
ttagtaatggtaaacaagaa

SEQ ID NO: 131939 - DNA, 20 bp, Artificial Sequence
  Description of Artificial Sequence: Synthetic oligonucleotide
  Target: ATXN1; (+) strand; PAM type: NRG; PAM sequence: AGG
tagtaatggtaaacaagaac

SEQ ID NO: 131940 - DNA, 20 bp, Artificial Sequence
  Description of Artificial Sequence: Synthetic oligonucleotide
  Target: ATXN1; (+) strand; PAM type: NRG; PAM sequence: CAG
tggtaaacaagaacaggacc

SEQ ID NO: 131941 - DNA, 20 bp, Artificial Sequence
  Description of Artificial Sequence: Synthetic oligonucleotide
  Target: ATXN1; (+) strand; PAM type: NRG; PAM sequence: AAG
aagaacaggacccagctcct

SEQ ID NO: 131942 - DNA, 20 bp, Artificial Sequence
  Description of Artificial Sequence: Synthetic oligonucleotide
  Target: ATXN1; (+) strand; PAM type: NRG; PAM sequence: AAG
aacaggacccagctcctaag

SEQ ID NO: 131943 - DNA, 20 bp, Artificial Sequence
  Description of Artificial Sequence: Synthetic oligonucleotide
  Target: ATXN1; (+) strand; PAM type: NRG; PAM sequence: CAG
gacccagctcctaagaagtg

SEQ ID NO: 131944 - DNA, 20 bp, Artificial Sequence
  Description of Artificial Sequence: Synthetic oligonucleotide
  Target: ATXN1; (+) strand; PAM type: NRG; PAM sequence: AAG
ctaagaagtgcagatgaatg

SEQ ID NO: 131945 - DNA, 20 bp, Artificial Sequence
  Description of Artificial Sequence: Synthetic oligonucleotide
  Target: ATXN1; (+) strand; PAM type: NRG; PAM sequence: AAG
aagtgcagatgaatgaagta

SEQ ID NO: 131946 - DNA, 20 bp, Artificial Sequence
  Description of Artificial Sequence: Synthetic oligonucleotide
  Target: ATXN1; (+) strand; PAM type: NRG; PAM sequence: TAG
tgcagatgaatgaagtaaag

SEQ ID NO: 131947 - DNA, 20 bp, Artificial Sequence
  Description of Artificial Sequence: Synthetic oligonucleotide
  Target: ATXN1; (+) strand; PAM type: NRG; PAM sequence: AAG
agatgaatgaagtaaagtag

SEQ ID NO: 131948 - DNA, 20 bp, Artificial Sequence
  Description of Artificial Sequence: Synthetic oligonucleotide
  Target: ATXN1; (+) strand; PAM type: NRG; PAM sequence: CAG
tgaatgaagtaaagtagaag

SEQ ID NO: 131949 - DNA, 20 bp, Artificial Sequence
  Description of Artificial Sequence: Synthetic oligonucleotide
  Target: ATXN1; (+) strand; PAM type: NRG; PAM sequence: AGG
gaatgaagtaaagtagaagc

SEQ ID NO: 131950 - DNA, 20 bp, Artificial Sequence
  Description of Artificial Sequence: Synthetic oligonucleotide
  Target: ATXN1; (+) strand; PAM type: NRG; PAM sequence: CAG
agaagcaggttcctgaccaa

SEQ ID NO: 131951 - DNA, 20 bp, Artificial Sequence
  Description of Artificial Sequence: Synthetic oligonucleotide
  Target: ATXN1; (+) strand; PAM type: NRG; PAM sequence: AGG
gaagcaggttcctgaccaac

SEQ ID NO: 131952 - DNA, 20 bp, Artificial Sequence
  Description of Artificial Sequence: Synthetic oligonucleotide
  Target: ATXN1; (+) strand; PAM type: NRG; PAM sequence: TAG
aggttcctgaccaacaggta

SEQ ID NO: 131953 - DNA, 20 bp, Artificial Sequence
  Description of Artificial Sequence: Synthetic oligonucleotide
  Target: ATXN1; (+) strand; PAM type: NRG; PAM sequence: AAG
tgaccaacaggtatagatca

SEQ ID NO: 131954 - DNA, 20 bp, Artificial Sequence
  Description of Artificial Sequence: Synthetic oligonucleotide
  Target: ATXN1; (+) strand; PAM type: NRG; PAM sequence: AGG
gaccaacaggtatagatcaa

SEQ ID NO: 131955 - DNA, 20 bp, Artificial Sequence
  Description of Artificial Sequence: Synthetic oligonucleotide
  Target: ATXN1; (+) strand; PAM type: NRG; PAM sequence: CAG
caacaggtatagatcaaagg

SEQ ID NO: 131956 - DNA, 20 bp, Artificial Sequence
  Description of Artificial Sequence: Synthetic oligonucleotide
  Target: ATXN1; (+) strand; PAM type: NRG; PAM sequence: AGG
aacaggtatagatcaaaggc

SEQ ID NO: 131957 - DNA, 20 bp, Artificial Sequence
  Description of Artificial Sequence: Synthetic oligonucleotide
  Target: ATXN1; (+) strand; PAM type: NRG; PAM sequence: GGG
acaggtatagatcaaaggca

SEQ ID NO: 131958 - DNA, 20 bp, Artificial Sequence
  Description of Artificial Sequence: Synthetic oligonucleotide
  Target: ATXN1; (+) strand; PAM type: NRG; PAM sequence: TGG
cagggcttctatcccacacc

SEQ ID NO: 131959 - DNA, 20 bp, Artificial Sequence
  Description of Artificial Sequence: Synthetic oligonucleotide
  Target: ATXN1; (+) strand; PAM type: NRG; PAM sequence: TAG
tctatcccacacctggtttc

SEQ ID NO: 131960 - DNA, 20 bp, Artificial Sequence
  Description of Artificial Sequence: Synthetic oligonucleotide
  Target: ATXN1; (+) strand; PAM type: NRG; PAM sequence: CGG
atcccacacctggtttctag

SEQ ID NO: 131961 - DNA, 20 bp, Artificial Sequence
  Description of Artificial Sequence: Synthetic oligonucleotide
  Target: ATXN1; (+) strand; PAM type: NRG; PAM sequence: CAG
ccacacctggtttctagcgg

SEQ ID NO: 131962 - DNA, 20 bp, Artificial Sequence
  Description of Artificial Sequence: Synthetic oligonucleotide
  Target: ATXN1; (+) strand; PAM type: NRG; PAM sequence: TAG
tggtttctagcggcagtatc

SEQ ID NO: 131963 - DNA, 20 bp, Artificial Sequence
  Description of Artificial Sequence: Synthetic oligonucleotide
  Target: ATXN1; (+) strand; PAM type: NRG; PAM sequence: AAG
tttctagcggcagtatctag

SEQ ID NO: 131964 - DNA, 20 bp, Artificial Sequence
  Description of Artificial Sequence: Synthetic oligonucleotide
  Target: ATXN1; (+) strand; PAM type: NRG; PAM sequence: AGG
ttctagcggcagtatctaga

SEQ ID NO: 131965 - DNA, 20 bp, Artificial Sequence
  Description of Artificial Sequence: Synthetic oligonucleotide
  Target: ATXN1; (+) strand; PAM type: NRG; PAM sequence: TGG
gaaggttccttgccttttca

SEQ ID NO: 131966 - DNA, 20 bp, Artificial Sequence
  Description of Artificial Sequence: Synthetic oligonucleotide
  Target: ATXN1; (+) strand; PAM type: NRG; PAM sequence: GGG
aaggttccttgccttttcat

SEQ ID NO: 131967 - DNA, 20 bp, Artificial Sequence
  Description of Artificial Sequence: Synthetic oligonucleotide
  Target: ATXN1; (+) strand; PAM type: NRG; PAM sequence: GGG
aggttccttgccttttcatg

SEQ ID NO: 131968 - DNA, 20 bp, Artificial Sequence
  Description of Artificial Sequence: Synthetic oligonucleotide
  Target: ATXN1; (+) strand; PAM type: NRG; PAM sequence: GAG
gttccttgccttttcatggg

SEQ ID NO: 131969 - DNA, 20 bp, Artificial Sequence
  Description of Artificial Sequence: Synthetic oligonucleotide
  Target: ATXN1; (+) strand; PAM type: NRG; PAM sequence: AAG
tgcctgctcttcttcccatg

SEQ ID NO: 131970 - DNA, 20 bp, Artificial Sequence
  Description of Artificial Sequence: Synthetic oligonucleotide
  Target: ATXN1; (+) strand; PAM type: NRG; PAM sequence: AAG
tcttcccatgaagataacat

SEQ ID NO: 131971 - DNA, 20 bp, Artificial Sequence
  Description of Artificial Sequence: Synthetic oligonucleotide
  Target: ATXN1; (+) strand; PAM type: NRG; PAM sequence: AGG
cttcccatgaagataacata

SEQ ID NO: 131972 - DNA, 20 bp, Artificial Sequence
  Description of Artificial Sequence: Synthetic oligonucleotide
  Target: ATXN1; (+) strand; PAM type: NRG; PAM sequence: GGG
ttcccatgaagataacataa

SEQ ID NO: 131973 - DNA, 20 bp, Artificial Sequence
  Description of Artificial Sequence: Synthetic oligonucleotide
  Target: ATXN1; (+) strand; PAM type: NRG; PAM sequence: CAG
aagataacataagggactgt

SEQ ID NO: 131974 - DNA, 20 bp, Artificial Sequence
  Description of Artificial Sequence: Synthetic oligonucleotide
  Target: ATXN1; (+) strand; PAM type: NRG; PAM sequence: CAG
aacataagggactgtcagtt

SEQ ID NO: 131975 - DNA, 20 bp, Artificial Sequence
  Description of Artificial Sequence: Synthetic oligonucleotide
  Target: ATXN1; (+) strand; PAM type: NRG; PAM sequence: CGG
agggactgtcagttcagacc

SEQ ID NO: 131976 - DNA, 20 bp, Artificial Sequence
  Description of Artificial Sequence: Synthetic oligonucleotide
  Target: ATXN1; (+) strand; PAM type: NRG; PAM sequence: GGG
gggactgtcagttcagaccc

SEQ ID NO: 131977 - DNA, 20 bp, Artificial Sequence
  Description of Artificial Sequence: Synthetic oligonucleotide
  Target: ATXN1; (+) strand; PAM type: NRG; PAM sequence: TGG
actgtcagttcagacccggg

SEQ ID NO: 131978 - DNA, 20 bp, Artificial Sequence
  Description of Artificial Sequence: Synthetic oligonucleotide
  Target: ATXN1; (+) strand; PAM type: NRG; PAM sequence: AAG
ttcagacccgggtggtttaa

SEQ ID NO: 131979 - DNA, 20 bp, Artificial Sequence
  Description of Artificial Sequence: Synthetic oligonucleotide
  Target: ATXN1; (+) strand; PAM type: NRG; PAM sequence: AAG
cccgggtggtttaaaagatg

SEQ ID NO: 131980 - DNA, 20 bp, Artificial Sequence
  Description of Artificial Sequence: Synthetic oligonucleotide
  Target: ATXN1; (+) strand; PAM type: NRG; PAM sequence: GAG
cgggtggtttaaaagatgaa

SEQ ID NO: 131981 - DNA, 20 bp, Artificial Sequence
  Description of Artificial Sequence: Synthetic oligonucleotide
  Target: ATXN1; (+) strand; PAM type: NRG; PAM sequence: TGG
gtttaaaagatgaagagtcc

SEQ ID NO: 131982 - DNA, 20 bp, Artificial Sequence
  Description of Artificial Sequence: Synthetic oligonucleotide
  Target: ATXN1; (+) strand; PAM type: NRG; PAM sequence: TGG
aaagatgaagagtcctggcc

SEQ ID NO: 131983 - DNA, 20 bp, Artificial Sequence
  Description of Artificial Sequence: Synthetic oligonucleotide
  Target: ATXN1; (+) strand; PAM type: NRG; PAM sequence: TGG
tgaagagtcctggcctggcg

SEQ ID NO: 131984 - DNA, 20 bp, Artificial Sequence
  Description of Artificial Sequence: Synthetic oligonucleotide
  Target: ATXN1; (+) strand; PAM type: NRG; PAM sequence: TGG
agagtcctggcctggcgtgg

SEQ ID NO: 131985 - DNA, 20 bp, Artificial Sequence
  Description of Artificial Sequence: Synthetic oligonucleotide
  Target: ATXN1; (+) strand; PAM type: NRG; PAM sequence: TGG
gtcctggcctggcgtggtgg

SEQ ID NO: 131986 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctgtaatcc

SEQ ID NO: 131987 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagcactt

SEQ ID NO: 131988 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 131989 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 131990 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 131991 - DNA, 20 bp, Artificial Sequence
  Description of Artificial Sequence: Synthetic oligonucleotide
  Target: ATXN1; (+) strand; PAM type: NRG; PAM sequence: AAG
tcccagcactttgggaggcc

SEQ ID NO: 131992 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggcca

SEQ ID NO: 131993 - DNA, 20 bp, Artificial Sequence
  Description of Artificial Sequence: Synthetic oligonucleotide
  Target: ATXN1; (+) strand; PAM type: NRG; PAM sequence: TGG
agcactttgggaggccaagg

SEQ ID NO: 131994 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccaaggt

SEQ ID NO: 131995 - DNA, 20 bp, Artificial Sequence
  Description of Artificial Sequence: Synthetic oligonucleotide
  Target: ATXN1; (+) strand; PAM type: NRG; PAM sequence: CGG
ctttgggaggccaaggtggg

SEQ ID NO: 131996 - DNA, 20 bp, Artificial Sequence
  Description of Artificial Sequence: Synthetic oligonucleotide
  Target: ATXN1; (+) strand; PAM type: NRG; PAM sequence: GAG
ccaaggtgggcggatcacct

SEQ ID NO: 131997 - DNA, 20 bp, Artificial Sequence
  Description of Artificial Sequence: Synthetic oligonucleotide
  Target: ATXN1; (+) strand; PAM type: NRG; PAM sequence: AGG
caaggtgggcggatcacctg

SEQ ID NO: 131998 - DNA, 20 bp, Artificial Sequence
  Description of Artificial Sequence: Synthetic oligonucleotide
  Target: ATXN1; (+) strand; PAM type: NRG; PAM sequence: CAG
gtgggcggatcacctgaggt

SEQ ID NO: 131999 - DNA, 20 bp, Artificial Sequence
  Description of Artificial Sequence: Synthetic oligonucleotide
  Target: ATXN1; (+) strand; PAM type: NRG; PAM sequence: AGG
tgggcggatcacctgaggtc

SEQ ID NO: 132000 - DNA, 20 bp, Artificial Sequence
  Description of Artificial Sequence: Synthetic oligonucleotide
  Target: ATXN1; (+) strand; PAM type: NRG; PAM sequence: GAG
ggcggatcacctgaggtcag

SEQ ID NO: 132001 - DNA, 20 bp, Artificial Sequence
  Description of Artificial Sequence: Synthetic oligonucleotide
  Target: ATXN1; (+) strand; PAM type: NRG; PAM sequence: GAG
tcacctgaggtcaggagttc

SEQ ID NO: 132002 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagttcgagac

SEQ ID NO: 132003 - DNA, 20 bp, Artificial Sequence
  Description of Artificial Sequence: Synthetic oligonucleotide
  Target: ATXN1; (+) strand; PAM type: NRG; PAM sequence: TGG
cgagaccagcctgaccaaca

SEQ ID NO: 132004 - DNA, 20 bp, Artificial Sequence
  Description of Artificial Sequence: Synthetic oligonucleotide
  Target: ATXN1; (+) strand; PAM type: NRG; PAM sequence: TAG
aaaataaaaaataaaaaatt

SEQ ID NO: 132005 - DNA, 20 bp, Artificial Sequence
  Description of Artificial Sequence: Synthetic oligonucleotide
  Target: ATXN1; (+) strand; PAM type: NRG; PAM sequence: TGG
taaaaaataaaaaatttagc

SEQ ID NO: 132006 - DNA, 20 bp, Artificial Sequence
  Description of Artificial Sequence: Synthetic oligonucleotide
  Target: ATXN1; (+) strand; PAM type: NRG; PAM sequence: GGG
aaaaaataaaaaatttagct

SEQ ID NO: 132007 - DNA, 20 bp, Artificial Sequence
  Description of Artificial Sequence: Synthetic oligonucleotide
  Target: ATXN1; (+) strand; PAM type: NRG; PAM sequence: TGG
ataaaaaatttagctgggca

SEQ ID NO: 132008 - DNA, 20 bp, Artificial Sequence
  Description of Artificial Sequence: Synthetic oligonucleotide
  Target: ATXN1; (+) strand; PAM type: NRG; PAM sequence: TGG
aaaaatttagctgggcatgg

SEQ ID NO: 132009 - DNA, 20 bp, Artificial Sequence
  Description of Artificial Sequence: Synthetic oligonucleotide
  Target: ATXN1; (+) strand; PAM type: NRG; PAM sequence: GAG
ttagctgggcatggtggtgt

SEQ ID NO: 132010 - DNA, 20 bp, Artificial Sequence
  Description of Artificial Sequence: Synthetic oligonucleotide
  Target: ATXN1; (+) strand; PAM type: NRG; PAM sequence: TAG
tggtgtgagccttgtaatcc

SEQ ID NO: 132011 - DNA, 20 bp, Artificial Sequence
  Description of Artificial Sequence: Synthetic oligonucleotide
  Target: ATXN1; (+) strand; PAM type: NRG; PAM sequence: TGG
agccttgtaatcctagctac

SEQ ID NO: 132012 - DNA, 20 bp, Artificial Sequence
  Description of Artificial Sequence: Synthetic oligonucleotide
  Target: ATXN1; (+) strand; PAM type: NRG; PAM sequence: GGG
gccttgtaatcctagctact

SEQ ID NO: 132013 - DNA, 20 bp, Artificial Sequence
  Description of Artificial Sequence: Synthetic oligonucleotide
  Target: ATXN1; (+) strand; PAM type: NRG; PAM sequence: GGG
ccttgtaatcctagctactg

SEQ ID NO: 132014 - DNA, 20 bp, Artificial Sequence
  Description of Artificial Sequence: Synthetic oligonucleotide
  Target: ATXN1; (+) strand; PAM type: NRG; PAM sequence: GAG
ttgtaatcctagctactggg

SEQ ID NO: 132015 - DNA, 20 bp, Artificial Sequence
  Description of Artificial Sequence: Synthetic oligonucleotide
  Target: ATXN1; (+) strand; PAM type: NRG; PAM sequence: AGG
tgtaatcctagctactgggg

SEQ ID NO: 132016 - DNA, 20 bp, Artificial Sequence
  Description of Artificial Sequence: Synthetic oligonucleotide
  Target: ATXN1; (+) strand; PAM type: NRG; PAM sequence: AAG
tcctagctactggggaggct

SEQ ID NO: 132017 - DNA, 20 bp, Artificial Sequence
  Description of Artificial Sequence: Synthetic oligonucleotide
  Target: ATXN1; (+) strand; PAM type: NRG; PAM sequence: CAG
agctactggggaggctaaga

SEQ ID NO: 132018 - DNA, 20 bp, Artificial Sequence
  Description of Artificial Sequence: Synthetic oligonucleotide
  Target: ATXN1; (+) strand; PAM type: NRG; PAM sequence: AGG
gctactggggaggctaagac

SEQ ID NO: 132019 - DNA, 20 bp, Artificial Sequence
  Description of Artificial Sequence: Synthetic oligonucleotide
  Target: ATXN1; (+) strand; PAM type: NRG; PAM sequence: GAG
tactggggaggctaagacag

SEQ ID NO: 132020 - DNA, 20 bp, Artificial Sequence
  Description of Artificial Sequence: Synthetic oligonucleotide
  Target: ATXN1; (+) strand; PAM type: NRG; PAM sequence: CAG
acaggagaatcgcttgaacc

SEQ ID NO: 132021 - DNA, 20 bp, Artificial Sequence
  Description of Artificial Sequence: Synthetic oligonucleotide
  Target: ATXN1; (+) strand; PAM type: NRG; PAM sequence: AGG
caggagaatcgcttgaaccc

SEQ ID NO: 132022 - DNA, 20 bp, Artificial Sequence
  Description of Artificial Sequence: Synthetic oligonucleotide
  Target: ATXN1; (+) strand; PAM type: NRG; PAM sequence: GAG
ggagaatcgcttgaacccag

SEQ ID NO: 132023 - DNA, 20 bp, Artificial Sequence
  Description of Artificial Sequence: Synthetic oligonucleotide
  Target: ATXN1; (+) strand; PAM type: NRG; PAM sequence: AGG
gagaatcgcttgaacccagg

SEQ ID NO: 132024 - DNA, 20 bp, Artificial Sequence
  Description of Artificial Sequence: Synthetic oligonucleotide
  Target: ATXN1; (+) strand; PAM type: NRG; PAM sequence: TGG
aatcgcttgaacccaggagg

SEQ ID NO: 132025 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaacccaggaggtg

SEQ ID NO: 132026 - DNA, 20 bp, Artificial Sequence
  Description of Artificial Sequence: Synthetic oligonucleotide
  Target: ATXN1; (+) strand; PAM type: NRG; PAM sequence: AGG
cgcttgaacccaggaggtgg

SEQ ID NO: 132027 - DNA, 20 bp, Artificial Sequence
  Description of Artificial Sequence: Synthetic oligonucleotide
  Target: ATXN1; (+) strand; PAM type: NRG; PAM sequence: TAG
aacccaggaggtggaggctg

SEQ ID NO: 132028 - DNA, 20 bp, Artificial Sequence
  Description of Artificial Sequence: Synthetic oligonucleotide
  Target: ATXN1; (+) strand; PAM type: NRG; PAM sequence: GAG
caggaggtggaggctgtagt

SEQ ID NO: 132029 - DNA, 20 bp, Artificial Sequence
  Description of Artificial Sequence: Synthetic oligonucleotide
  Target: ATXN1; (+) strand; PAM type: NRG; PAM sequence: AAG
ggtggaggctgtagtgagcc

SEQ ID NO: 132030 - DNA, 20 bp, Artificial Sequence
  Description of Artificial Sequence: Synthetic oligonucleotide
  Target: ATXN1; (+) strand; PAM type: NRG; PAM sequence: CAG
aagctcacaccactgcactc

SEQ ID NO: 132031 - DNA, 20 bp, Artificial Sequence
  Description of Artificial Sequence: Synthetic oligonucleotide
  Target: ATXN1; (+) strand; PAM type: NRG; PAM sequence: TGG
cacaccactgcactccagcc

SEQ ID NO: 132032 - DNA, 20 bp, Artificial Sequence
  Description of Artificial Sequence: Synthetic oligonucleotide
  Target: ATXN1; (+) strand; PAM type: NRG; PAM sequence: GGG
acaccactgcactccagcct

SEQ ID NO: 132033 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggcga

SEQ ID NO: 132034 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggcgaca

SEQ ID NO: 132035 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggcgacagagt

SEQ ID NO: 132036 - DNA, 20 bp, Artificial Sequence
  Description of Artificial Sequence: Synthetic oligonucleotide
  Target: ATXN1; (+) strand; PAM type: NRG; PAM sequence: CAG
gacagagtgagactccgtct

SEQ ID NO: 132037 - DNA, 20 bp, Artificial Sequence
  Description of Artificial Sequence: Synthetic oligonucleotide
  Target: ATXN1; (+) strand; PAM type: NRG; PAM sequence: CAG
agaaaaaaaaaaaaaaaaaa

SEQ ID NO: 132038 - DNA, 20 bp, Artificial Sequence
  Description of Artificial Sequence: Synthetic oligonucleotide
  Target: ATXN1; (+) strand; PAM type: NRG; PAM sequence: CAG
aaaaacagttccgattgact

SEQ ID NO: 132039 - DNA, 20 bp, Artificial Sequence
  Description of Artificial Sequence: Synthetic oligonucleotide
  Target: ATXN1; (+) strand; PAM type: NRG; PAM sequence: TGG
aacagttccgattgactcag

SEQ ID NO: 132040 - DNA, 20 bp, Artificial Sequence
  Description of Artificial Sequence: Synthetic oligonucleotide
  Target: ATXN1; (+) strand; PAM type: NRG; PAM sequence: GAG
agtggtctcctgctgttcct

SEQ ID NO: 132041 - DNA, 20 bp, Artificial Sequence
  Description of Artificial Sequence: Synthetic oligonucleotide
  Target: ATXN1; (+) strand; PAM type: NRG; PAM sequence: CAG
gtctcctgctgttcctgaga

SEQ ID NO: 132042 - DNA, 20 bp, Artificial Sequence
  Description of Artificial Sequence: Synthetic oligonucleotide
  Target: ATXN1; (+) strand; PAM type: NRG; PAM sequence: GAG
ctcctgctgttcctgagaca

SEQ ID NO: 132043 - DNA, 20 bp, Artificial Sequence
  Description of Artificial Sequence: Synthetic oligonucleotide
  Target: ATXN1; (+) strand; PAM type: NRG; PAM sequence: CAG
atataatgccctgcaaatta

SEQ ID NO: 132044 - DNA, 20 bp, Artificial Sequence
  Description of Artificial Sequence: Synthetic oligonucleotide
  Target: ATXN1; (+) strand; PAM type: NRG; PAM sequence: AGG
tataatgccctgcaaattac

SEQ ID NO: 132045 - DNA, 20 bp, Artificial Sequence
  Description of Artificial Sequence: Synthetic oligonucleotide
  Target: ATXN1; (+) strand; PAM type: NRG; PAM sequence: GGG
ataatgccctgcaaattaca

SEQ ID NO: 132046 - DNA, 20 bp, Artificial Sequence
  Description of Artificial Sequence: Synthetic oligonucleotide
  Target: ATXN1; (+) strand; PAM type: NRG; PAM sequence: TGG
tgcaaattacagggtactca

SEQ ID NO: 132047 - DNA, 20 bp, Artificial Sequence
  Description of Artificial Sequence: Synthetic oligonucleotide
  Target: ATXN1; (+) strand; PAM type: NRG; PAM sequence: CGG
gggtactcatggccaaatct

SEQ ID NO: 132048 - DNA, 20 bp, Artificial Sequence
  Description of Artificial Sequence: Synthetic oligonucleotide
  Target: ATXN1; (+) strand; PAM type: NRG; PAM sequence: GGG
ggtactcatggccaaatctc

SEQ ID NO: 132049 - DNA, 20 bp, Artificial Sequence
  Description of Artificial Sequence: Synthetic oligonucleotide
  Target: ATXN1; (+) strand; PAM type: NRG; PAM sequence: TGG
actcatggccaaatctcggg

SEQ ID NO: 132050 - DNA, 20 bp, Artificial Sequence
  Description of Artificial Sequence: Synthetic oligonucleotide
  Target: ATXN1; (+) strand; PAM type: NRG; PAM sequence: GGG
ctcatggccaaatctcgggt

SEQ ID NO: 132051 - DNA, 20 bp, Artificial Sequence
  Description of Artificial Sequence: Synthetic oligonucleotide
  Target: ATXN1; (+) strand; PAM type: NRG; PAM sequence: GGG
tcatggccaaatctcgggtg

SEQ ID NO: 132052 - DNA, 20 bp, Artificial Sequence
  Description of Artificial Sequence: Synthetic oligonucleotide
  Target: ATXN1; (+) strand; PAM type: NRG; PAM sequence: TGG
ggccaaatctcgggtggggc

SEQ ID NO: 132053 - DNA, 20 bp, Artificial Sequence
  Description of Artificial Sequence: Synthetic oligonucleotide
  Target: ATXN1; (+) strand; PAM type: NRG; PAM sequence: GGG
gccaaatctcgggtggggct

SEQ ID NO: 132054 - DNA, 20 bp, Artificial Sequence
  Description of Artificial Sequence: Synthetic oligonucleotide
  Target: ATXN1; (+) strand; PAM type: NRG; PAM sequence: TGG
aatctcgggtggggctggga

SEQ ID NO: 132055 - DNA, 20 bp, Artificial Sequence
  Description of Artificial Sequence: Synthetic oligonucleotide
  Target: ATXN1; (+) strand; PAM type: NRG; PAM sequence: GGG
atctcgggtggggctgggat

SEQ ID NO: 132056 - DNA, 20 bp, Artificial Sequence
  Description of Artificial Sequence: Synthetic oligonucleotide
  Target: ATXN1; (+) strand; PAM type: NRG; PAM sequence: GAG
ctcgggtggggctgggatgg

SEQ ID NO: 132057 - DNA, 20 bp, Artificial Sequence
  Description of Artificial Sequence: Synthetic oligonucleotide
  Target: ATXN1; (+) strand; PAM type: NRG; PAM sequence: AAG
gtggggctgggatgggagta

SEQ ID NO: 132058 - DNA, 20 bp, Artificial Sequence
  Description of Artificial Sequence: Synthetic oligonucleotide
  Target: ATXN1; (+) strand; PAM type: NRG; PAM sequence: CAG
gatgggagtaaagatgacgt

SEQ ID NO: 132059 - DNA, 20 bp, Artificial Sequence
  Description of Artificial Sequence: Synthetic oligonucleotide
  Target: ATXN1; (+) strand; PAM type: NRG; PAM sequence: AGG
atgggagtaaagatgacgtc

SEQ ID NO: 132060 - DNA, 20 bp, Artificial Sequence
  Description of Artificial Sequence: Synthetic oligonucleotide
  Target: ATXN1; (+) strand; PAM type: NRG; PAM sequence: AAG
ggagtaaagatgacgtcagg

SEQ ID NO: 132061 - DNA, 20 bp, Artificial Sequence
  Description of Artificial Sequence: Synthetic oligonucleotide
  Target: ATXN1; (+) strand; PAM type: NRG; PAM sequence: AGG
gagtaaagatgacgtcagga

SEQ ID NO: 132062 - DNA, 20 bp, Artificial Sequence
  Description of Artificial Sequence: Synthetic oligonucleotide
  Target: ATXN1; (+) strand; PAM type: NRG; PAM sequence: CAG
gatgacgtcaggaaggtatc

SEQ ID NO: 132063 - DNA, 20 bp, Artificial Sequence
  Description of Artificial Sequence: Synthetic oligonucleotide
  Target: ATXN1; (+) strand; PAM type: NRG; PAM sequence: TGG
gtcaggaaggtatccagttg

SEQ ID NO: 132064 - DNA, 20 bp, Artificial Sequence
  Description of Artificial Sequence: Synthetic oligonucleotide
  Target: ATXN1; (+) strand; PAM type: NRG; PAM sequence: CAG
aggaaggtatccagttgtgg

SEQ ID NO: 132065 - DNA, 20 bp, Artificial Sequence
  Description of Artificial Sequence: Synthetic oligonucleotide
  Target: ATXN1; (+) strand; PAM type: NRG; PAM sequence: TGG
tatccagttgtggcagaaac

SEQ ID NO: 132066 - DNA, 20 bp, Artificial Sequence
  Description of Artificial Sequence: Synthetic oligonucleotide
  Target: ATXN1; (+) strand; PAM type: NRG; PAM sequence: TAG
cagttgtggcagaaactggt

SEQ ID NO: 132067 - DNA, 20 bp, Artificial Sequence
  Description of Artificial Sequence: Synthetic oligonucleotide
  Target: ATXN1; (+) strand; PAM type: NRG; PAM sequence: CAG
ctggttagttgttgaaaaaa

SEQ ID NO: 132068 - DNA, 20 bp, Artificial Sequence
  Description of Artificial Sequence: Synthetic oligonucleotide
  Target: ATXN1; (+) strand; PAM type: NRG; PAM sequence: CAG
tccctgtactccttgacata

SEQ ID NO: 132069 - DNA, 20 bp, Artificial Sequence
  Description of Artificial Sequence: Synthetic oligonucleotide
  Target: ATXN1; (+) strand; PAM type: NRG; PAM sequence: AGG
ccctgtactccttgacatac

SEQ ID NO: 132070 - DNA, 20 bp, Artificial Sequence
  Description of Artificial Sequence: Synthetic oligonucleotide
  Target: ATXN1; (+) strand; PAM type: NRG; PAM sequence: CAG
acaattctccactttacctg

SEQ ID NO: 132071 - DNA, 20 bp, Artificial Sequence
  Description of Artificial Sequence: Synthetic oligonucleotide
  Target: ATXN1; (+) strand; PAM type: NRG; PAM sequence: TGG
atgtccacatgactaaattc

SEQ ID NO: 132072 - DNA, 20 bp, Artificial Sequence
  Description of Artificial Sequence: Synthetic oligonucleotide
  Target: ATXN1; (+) strand; PAM type: NRG; PAM sequence: AAG
cacatgactaaattctggtc

SEQ ID NO: 132073 - DNA, 20 bp, Artificial Sequence
  Description of Artificial Sequence: Synthetic oligonucleotide
  Target: ATXN1; (+) strand; PAM type: NRG; PAM sequence: AGG
acatgactaaattctggtca

SEQ ID NO: 132074 - DNA, 20 bp, Artificial Sequence
  Description of Artificial Sequence: Synthetic oligonucleotide
  Target: ATXN1; (+) strand; PAM type: NRG; PAM sequence: GGG
catgactaaattctggtcaa

SEQ ID NO: 132075 - DNA, 20 bp, Artificial Sequence
  Description of Artificial Sequence: Synthetic oligonucleotide
  Target: ATXN1; (+) strand; PAM type: NRG; PAM sequence: TGG
aaattctggtcaagggaaca

SEQ ID NO: 132076 - DNA, 20 bp, Artificial Sequence
  Description of Artificial Sequence: Synthetic oligonucleotide
  Target: ATXN1; (+) strand; PAM type: NRG; PAM sequence: AAG
ttctggtcaagggaacatgg

SEQ ID NO: 132077 - DNA, 20 bp, Artificial Sequence
  Description of Artificial Sequence: Synthetic oligonucleotide
  Target: ATXN1; (+) strand; PAM type: NRG; PAM sequence: AGG
tctggtcaagggaacatgga

SEQ ID NO: 132078 - DNA, 20 bp, Artificial Sequence
  Description of Artificial Sequence: Synthetic oligonucleotide
  Target: ATXN1; (+) strand; PAM type: NRG; PAM sequence: AAG
ggtcaagggaacatggaagg

SEQ ID NO: 132079 - DNA, 20 bp, Artificial Sequence
  Description of Artificial Sequence: Synthetic oligonucleotide
  Target: ATXN1; (+) strand; PAM type: NRG; PAM sequence: TGG
caagggaacatggaaggaag

SEQ ID NO: 132080 - DNA, 20 bp, Artificial Sequence
  Description of Artificial Sequence: Synthetic oligonucleotide
  Target: ATXN1; (+) strand; PAM type: NRG; PAM sequence: CAG
aatttcaccaacaaacctcc

SEQ ID NO: 132081 - DNA, 20 bp, Artificial Sequence
  Description of Artificial Sequence: Synthetic oligonucleotide
  Target: ATXN1; (+) strand; PAM type: NRG; PAM sequence: AGG
atttcaccaacaaacctccc

SEQ ID NO: 132082 - DNA, 20 bp, Artificial Sequence
  Description of Artificial Sequence: Synthetic oligonucleotide
  Target: ATXN1; (+) strand; PAM type: NRG; PAM sequence: GAG
ttcaccaacaaacctcccag

SEQ ID NO: 132083 - DNA, 20 bp, Artificial Sequence
  Description of Artificial Sequence: Synthetic oligonucleotide
  Target: ATXN1; (+) strand; PAM type: NRG; PAM sequence: CAG
tccccacttctctcttctgc

SEQ ID NO: 132084 - DNA, 20 bp, Artificial Sequence
  Description of Artificial Sequence: Synthetic oligonucleotide
  Target: ATXN1; (+) strand; PAM type: NRG; PAM sequence: AGG
ccccacttctctcttctgcc

SEQ ID NO: 132085 - DNA, 20 bp, Artificial Sequence
  Description of Artificial Sequence: Synthetic oligonucleotide
  Target: ATXN1; (+) strand; PAM type: NRG; PAM sequence: CAG
cttctctcttctgccaggtg

SEQ ID NO: 132086 - DNA, 20 bp, Artificial Sequence
  Description of Artificial Sequence: Synthetic oligonucleotide
  Target: ATXN1; (+) strand; PAM type: NRG; PAM sequence: AAG
ctctcttctgccaggtgcag

SEQ ID NO: 132087 - DNA, 20 bp, Artificial Sequence
  Description of Artificial Sequence: Synthetic oligonucleotide
  Target: ATXN1; (+) strand; PAM type: NRG; PAM sequence: TAG
tgccaggtgcagaagatcct

SEQ ID NO: 132088 - DNA, 20 bp, Artificial Sequence
  Description of Artificial Sequence: Synthetic oligonucleotide
  Target: ATXN1; (+) strand; PAM type: NRG; PAM sequence: AGG
gccaggtgcagaagatcctt

SEQ ID NO: 132089 - DNA, 20 bp, Artificial Sequence
  Description of Artificial Sequence: Synthetic oligonucleotide
  Target: ATXN1; (+) strand; PAM type: NRG; PAM sequence: GGG
ccaggtgcagaagatcctta

SEQ ID NO: 132090 - DNA, 20 bp, Artificial Sequence
  Description of Artificial Sequence: Synthetic oligonucleotide
  Target: ATXN1; (+) strand; PAM type: NRG; PAM sequence: GAG
ccttagggtctcccaacact

SEQ ID NO: 132091 - DNA, 20 bp, Artificial Sequence
  Description of Artificial Sequence: Synthetic oligonucleotide
  Target: ATXN1; (+) strand; PAM type: NRG; PAM sequence: AGG
cttagggtctcccaacactg

SEQ ID NO: 132092 - DNA, 20 bp, Artificial Sequence
  Description of Artificial Sequence: Synthetic oligonucleotide
  Target: ATXN1; (+) strand; PAM type: NRG; PAM sequence: GGG
ttagggtctcccaacactga

SEQ ID NO: 132093 - DNA, 20 bp, Artificial Sequence
  Description of Artificial Sequence: Synthetic oligonucleotide
  Target: ATXN1; (+) strand; PAM type: NRG; PAM sequence: GAG
ccaacactgagggaatgtct

SEQ ID NO: 132094 - DNA, 20 bp, Artificial Sequence
  Description of Artificial Sequence: Synthetic oligonucleotide
  Target: ATXN1; (+) strand; PAM type: NRG; PAM sequence: AAG
atgtctgagccttgcgatac

SEQ ID NO: 132095 - DNA, 20 bp, Artificial Sequence
  Description of Artificial Sequence: Synthetic oligonucleotide
  Target: ATXN1; (+) strand; PAM type: NRG; PAM sequence: AGG
tgtctgagccttgcgataca

SEQ ID NO: 132096 - DNA, 20 bp, Artificial Sequence
  Description of Artificial Sequence: Synthetic oligonucleotide
  Target: ATXN1; (+) strand; PAM type: NRG; PAM sequence: TGG
gccttgcgatacaaggaccc

SEQ ID NO: 132097 - DNA, 20 bp, Artificial Sequence
  Description of Artificial Sequence: Synthetic oligonucleotide
  Target: ATXN1; (+) strand; PAM type: NRG; PAM sequence: GGG
ccttgcgatacaaggaccct

SEQ ID NO: 132098 - DNA, 20 bp, Artificial Sequence
  Description of Artificial Sequence: Synthetic oligonucleotide
  Target: ATXN1; (+) strand; PAM type: NRG; PAM sequence: CAG
gcgatacaaggaccctgggt

SEQ ID NO: 132099 - DNA, 20 bp, Artificial Sequence
  Description of Artificial Sequence: Synthetic oligonucleotide
  Target: ATXN1; (+) strand; PAM type: NRG; PAM sequence: AGG
cgatacaaggaccctgggtc

SEQ ID NO: 132100 - DNA, 20 bp, Artificial Sequence
  Description of Artificial Sequence: Synthetic oligonucleotide
  Target: ATXN1; (+) strand; PAM type: NRG; PAM sequence: GGG
gatacaaggaccctgggtca

SEQ ID NO: 132101 - DNA, 20 bp, Artificial Sequence
  Description of Artificial Sequence: Synthetic oligonucleotide
  Target: ATXN1; (+) strand; PAM type: NRG; PAM sequence: CAG
gtcagggaatcaccaccata

SEQ ID NO: 132102 - DNA, 20 bp, Artificial Sequence
  Description of Artificial Sequence: Synthetic oligonucleotide
  Target: ATXN1; (+) strand; PAM type: NRG; PAM sequence: CAG
acagacgccctctccaactg

SEQ ID NO: 132103 - DNA, 20 bp, Artificial Sequence
  Description of Artificial Sequence: Synthetic oligonucleotide
  Target: ATXN1; (+) strand; PAM type: NRG; PAM sequence: AAG
ctccaactgcagaacacccc

SEQ ID NO: 132104 - DNA, 20 bp, Artificial Sequence
  Description of Artificial Sequence: Synthetic oligonucleotide
  Target: ATXN1; (+) strand; PAM type: NRG; PAM sequence: AAG
ttatccgtaacaccatcaaa

SEQ ID NO: 132105 - DNA, 20 bp, Artificial Sequence
  Description of Artificial Sequence: Synthetic oligonucleotide
  Target: ATXN1; (+) strand; PAM type: NRG; PAM sequence: AGG
tatccgtaacaccatcaaaa

SEQ ID NO: 132106 - DNA, 20 bp, Artificial Sequence
  Description of Artificial Sequence: Synthetic oligonucleotide
  Target: ATXN1; (+) strand; PAM type: NRG; PAM sequence: AAG
ttctactgtgttccaccctg

SEQ ID NO: 132107 - DNA, 20 bp, Artificial Sequence
  Description of Artificial Sequence: Synthetic oligonucleotide
  Target: ATXN1; (+) strand; PAM type: NRG; PAM sequence: GAG
ctactgtgttccaccctgaa

SEQ ID NO: 132108 - DNA, 20 bp, Artificial Sequence
  Description of Artificial Sequence: Synthetic oligonucleotide
  Target: ATXN1; (+) strand; PAM type: NRG; PAM sequence: TGG
tgtgttccaccctgaagagt

SEQ ID NO: 132109 - DNA, 20 bp, Artificial Sequence
  Description of Artificial Sequence: Synthetic oligonucleotide
  Target: ATXN1; (+) strand; PAM type: NRG; PAM sequence: GGG
gtgttccaccctgaagagtt

SEQ ID NO: 132110 - DNA, 20 bp, Artificial Sequence
  Description of Artificial Sequence: Synthetic oligonucleotide
  Target: ATXN1; (+) strand; PAM type: NRG; PAM sequence: GGG
tgttccaccctgaagagttg

SEQ ID NO: 132111 - DNA, 20 bp, Artificial Sequence
  Description of Artificial Sequence: Synthetic oligonucleotide
  Target: ATXN1; (+) strand; PAM type: NRG; PAM sequence: CAG
atcatctctttgttgcatct

SEQ ID NO: 132112 - DNA, 20 bp, Artificial Sequence
  Description of Artificial Sequence: Synthetic oligonucleotide
  Target: ATXN1; (+) strand; PAM type: NRG; PAM sequence: AGG
tcatctctttgttgcatctc

SEQ ID NO: 132113 - DNA, 20 bp, Artificial Sequence
  Description of Artificial Sequence: Synthetic oligonucleotide
  Target: ATXN1; (+) strand; PAM type: NRG; PAM sequence: TGG
tcctttacattcacctgccc

SEQ ID NO: 132114 - DNA, 20 bp, Artificial Sequence
  Description of Artificial Sequence: Synthetic oligonucleotide
  Target: ATXN1; (+) strand; PAM type: NRG; PAM sequence: TAG
acctgccctggacaatccac

SEQ ID NO: 132115 - DNA, 20 bp, Artificial Sequence
  Description of Artificial Sequence: Synthetic oligonucleotide
  Target: ATXN1; (+) strand; PAM type: NRG; PAM sequence: AGG
cctgccctggacaatccact

SEQ ID NO: 132116 - DNA, 20 bp, Artificial Sequence
  Description of Artificial Sequence: Synthetic oligonucleotide
  Target: ATXN1; (+) strand; PAM type: NRG; PAM sequence: TGG
ttgtttgtcctcaaacgaaa

SEQ ID NO: 132117 - DNA, 20 bp, Artificial Sequence
  Description of Artificial Sequence: Synthetic oligonucleotide
  Target: ATXN1; (+) strand; PAM type: NRG; PAM sequence: GAG
cgaaatggcctcacaccgct

SEQ ID NO: 132118 - DNA, 20 bp, Artificial Sequence
  Description of Artificial Sequence: Synthetic oligonucleotide
  Target: ATXN1; (+) strand; PAM type: NRG; PAM sequence: AAG
ctgagattttataatacttc

SEQ ID NO: 132119 - DNA, 20 bp, Artificial Sequence
  Description of Artificial Sequence: Synthetic oligonucleotide
  Target: ATXN1; (+) strand; PAM type: NRG; PAM sequence: TAG
tataatacttcaagttttta

SEQ ID NO: 132120 - DNA, 20 bp, Artificial Sequence
  Description of Artificial Sequence: Synthetic oligonucleotide
  Target: ATXN1; (+) strand; PAM type: NRG; PAM sequence: AGG
ataatacttcaagtttttat

SEQ ID NO: 132121 - DNA, 20 bp, Artificial Sequence
  Description of Artificial Sequence: Synthetic oligonucleotide
  Target: ATXN1; (+) strand; PAM type: NRG; PAM sequence: TGG
gttttctccttccttcactg

SEQ ID NO: 132122 - DNA, 20 bp, Artificial Sequence
  Description of Artificial Sequence: Synthetic oligonucleotide
  Target: ATXN1; (+) strand; PAM type: NRG; PAM sequence: TAG
tctccttccttcactgtggt

SEQ ID NO: 132123 - DNA, 20 bp, Artificial Sequence
  Description of Artificial Sequence: Synthetic oligonucleotide
  Target: ATXN1; (+) strand; PAM type: NRG; PAM sequence: AAG
cttccttcactgtggttagt

SEQ ID NO: 132124 - DNA, 20 bp, Artificial Sequence
  Description of Artificial Sequence: Synthetic oligonucleotide
  Target: ATXN1; (+) strand; PAM type: NRG; PAM sequence: AAG
gtggttagtaagtttaaccc

SEQ ID NO: 132125 - DNA, 20 bp, Artificial Sequence
  Description of Artificial Sequence: Synthetic oligonucleotide
  Target: ATXN1; (+) strand; PAM type: NRG; PAM sequence: AAG
ttagtaagtttaacccaaga

SEQ ID NO: 132126 - DNA, 20 bp, Artificial Sequence
  Description of Artificial Sequence: Synthetic oligonucleotide
  Target: ATXN1; (+) strand; PAM type: NRG; PAM sequence: TGG
cttattccttctaatctatt

SEQ ID NO: 132127 - DNA, 20 bp, Artificial Sequence
  Description of Artificial Sequence: Synthetic oligonucleotide
  Target: ATXN1; (+) strand; PAM type: NRG; PAM sequence: GGG
ttattccttctaatctattt

SEQ ID NO: 132128 - DNA, 20 bp, Artificial Sequence
  Description of Artificial Sequence: Synthetic oligonucleotide
  Target: ATXN1; (+) strand; PAM type: NRG; PAM sequence: AAG
ctaatctatttgggaaactg

SEQ ID NO: 132129 - DNA, 20 bp, Artificial Sequence
  Description of Artificial Sequence: Synthetic oligonucleotide
  Target: ATXN1; (+) strand; PAM type: NRG; PAM sequence: AAG
atctatttgggaaactgaag

SEQ ID NO: 132130 - DNA, 20 bp, Artificial Sequence
  Description of Artificial Sequence: Synthetic oligonucleotide
  Target: ATXN1; (+) strand; PAM type: NRG; PAM sequence: GAG
tgaatcactaatcttacttt

SEQ ID NO: 132131 - DNA, 20 bp, Artificial Sequence
  Description of Artificial Sequence: Synthetic oligonucleotide
  Target: ATXN1; (+) strand; PAM type: NRG; PAM sequence: GAG
cttactttgagtgtccttgt

SEQ ID NO: 132132 - DNA, 20 bp, Artificial Sequence
  Description of Artificial Sequence: Synthetic oligonucleotide
  Target: ATXN1; (+) strand; PAM type: NRG; PAM sequence: CAG
tgagtgtccttgtgagtcaa

SEQ ID NO: 132133 - DNA, 20 bp, Artificial Sequence
  Description of Artificial Sequence: Synthetic oligonucleotide
  Target: ATXN1; (+) strand; PAM type: NRG; PAM sequence: AGG
gagtgtccttgtgagtcaac

SEQ ID NO: 132134 - DNA, 20 bp, Artificial Sequence
  Description of Artificial Sequence: Synthetic oligonucleotide
  Target: ATXN1; (+) strand; PAM type: NRG; PAM sequence: GGG
agtgtccttgtgagtcaaca

SEQ ID NO: 132135 - DNA, 20 bp, Artificial Sequence
  Description of Artificial Sequence: Synthetic oligonucleotide
  Target: ATXN1; (+) strand; PAM type: NRG; PAM sequence: TGG
cttgtgagtcaacagggctc

SEQ ID NO: 132136 - DNA, 20 bp, Artificial Sequence
  Description of Artificial Sequence: Synthetic oligonucleotide
  Target: ATXN1; (+) strand; PAM type: NRG; PAM sequence: GGG
ttgtgagtcaacagggctct

SEQ ID NO: 132137 - DNA, 20 bp, Artificial Sequence
  Description of Artificial Sequence: Synthetic oligonucleotide
  Target: ATXN1; (+) strand; PAM type: NRG; PAM sequence: CAG
caacagggctctgggttcac

SEQ ID NO: 132138 - DNA, 20 bp, Artificial Sequence
  Description of Artificial Sequence: Synthetic oligonucleotide
  Target: ATXN1; (+) strand; PAM type: NRG; PAM sequence: AGG
aacagggctctgggttcacc

SEQ ID NO: 132139 - DNA, 20 bp, Artificial Sequence
  Description of Artificial Sequence: Synthetic oligonucleotide
  Target: ATXN1; (+) strand; PAM type: NRG; PAM sequence: GGG
acagggctctgggttcacca

SEQ ID NO: 132140 - DNA, 20 bp, Artificial Sequence
  Description of Artificial Sequence: Synthetic oligonucleotide
  Target: ATXN1; (+) strand; PAM type: NRG; PAM sequence: AAG
ttcaccagggcttcatctat

SEQ ID NO: 132141 - DNA, 20 bp, Artificial Sequence
  Description of Artificial Sequence: Synthetic oligonucleotide
  Target: ATXN1; (+) strand; PAM type: NRG; PAM sequence: CAG
cttcatctataagtataatt

SEQ ID NO: 132142 - DNA, 20 bp, Artificial Sequence
  Description of Artificial Sequence: Synthetic oligonucleotide
  Target: ATXN1; (+) strand; PAM type: NRG; PAM sequence: TGG
ataattcagaatttttttat

SEQ ID NO: 132143 - DNA, 20 bp, Artificial Sequence
  Description of Artificial Sequence: Synthetic oligonucleotide
  Target: ATXN1; (+) strand; PAM type: NRG; PAM sequence: AAG
tggtcatttttctccttccc

SEQ ID NO: 132144 - DNA, 20 bp, Artificial Sequence
  Description of Artificial Sequence: Synthetic oligonucleotide
  Target: ATXN1; (+) strand; PAM type: NRG; PAM sequence: AAG
tcatttttctccttcccaag

SEQ ID NO: 132145 - DNA, 20 bp, Artificial Sequence
  Description of Artificial Sequence: Synthetic oligonucleotide
  Target: ATXN1; (+) strand; PAM type: NRG; PAM sequence: AGG
catttttctccttcccaaga

SEQ ID NO: 132146 - DNA, 20 bp, Artificial Sequence
  Description of Artificial Sequence: Synthetic oligonucleotide
  Target: ATXN1; (+) strand; PAM type: NRG; PAM sequence: CAG
aaggtttttcctatcatttc

SEQ ID NO: 132147 - DNA, 20 bp, Artificial Sequence
  Description of Artificial Sequence: Synthetic oligonucleotide
  Target: ATXN1; (+) strand; PAM type: NRG; PAM sequence: AGG
aggtttttcctatcatttcc

SEQ ID NO: 132148 - DNA, 20 bp, Artificial Sequence
  Description of Artificial Sequence: Synthetic oligonucleotide
  Target: ATXN1; (+) strand; PAM type: NRG; PAM sequence: AAG
tcctatcatttccaggtttc

SEQ ID NO: 132149 - DNA, 20 bp, Artificial Sequence
  Description of Artificial Sequence: Synthetic oligonucleotide
  Target: ATXN1; (+) strand; PAM type: NRG; PAM sequence: TAG
tatcatttccaggtttcaag

SEQ ID NO: 132150 - DNA, 20 bp, Artificial Sequence
  Description of Artificial Sequence: Synthetic oligonucleotide
  Target: ATXN1; (+) strand; PAM type: NRG; PAM sequence: AGG
atcatttccaggtttcaagt

SEQ ID NO: 132151 - DNA, 20 bp, Artificial Sequence
  Description of Artificial Sequence: Synthetic oligonucleotide
  Target: ATXN1; (+) strand; PAM type: NRG; PAM sequence: TAG
ggtttcaagtaggacccacg

SEQ ID NO: 132152 - DNA, 20 bp, Artificial Sequence
  Description of Artificial Sequence: Synthetic oligonucleotide
  Target: ATXN1; (+) strand; PAM type: NRG; PAM sequence: TAG
caagtaggacccacgtagat

SEQ ID NO: 132153 - DNA, 20 bp, Artificial Sequence
  Description of Artificial Sequence: Synthetic oligonucleotide
  Target: ATXN1; (+) strand; PAM type: NRG; PAM sequence: AGG
aagtaggacccacgtagatt

SEQ ID NO: 132154 - DNA, 20 bp, Artificial Sequence
  Description of Artificial Sequence: Synthetic oligonucleotide
  Target: ATXN1; (+) strand; PAM type: NRG; PAM sequence: GGG
agtaggacccacgtagatta

SEQ ID NO: 132155 - DNA, 20 bp, Artificial Sequence
  Description of Artificial Sequence: Synthetic oligonucleotide
  Target: ATXN1; (+) strand; PAM type: NRG; PAM sequence: CAG
acccacgtagattagggtca

SEQ ID NO: 132156 - DNA, 20 bp, Artificial Sequence
  Description of Artificial Sequence: Synthetic oligonucleotide
  Target: ATXN1; (+) strand; PAM type: NRG; PAM sequence: AAG
cagaaatatgtattctgcct

SEQ ID NO: 132157 - DNA, 20 bp, Artificial Sequence
  Description of Artificial Sequence: Synthetic oligonucleotide
  Target: ATXN1; (+) strand; PAM type: NRG; PAM sequence: TAG
tgtattctgcctaagataac

SEQ ID NO: 132158 - DNA, 20 bp, Artificial Sequence
  Description of Artificial Sequence: Synthetic oligonucleotide
  Target: ATXN1; (+) strand; PAM type: NRG; PAM sequence: AGG
gtattctgcctaagataact

SEQ ID NO: 132159 - DNA, 20 bp, Artificial Sequence
  Description of Artificial Sequence: Synthetic oligonucleotide
  Target: ATXN1; (+) strand; PAM type: NRG; PAM sequence: TGG
cacttttataactaaatcca

SEQ ID NO: 132160 - DNA, 20 bp, Artificial Sequence
  Description of Artificial Sequence: Synthetic oligonucleotide
  Target: ATXN1; (+) strand; PAM type: NRG; PAM sequence: AAG
ttttataactaaatccatgg

SEQ ID NO: 132161 - DNA, 20 bp, Artificial Sequence
  Description of Artificial Sequence: Synthetic oligonucleotide
  Target: ATXN1; (+) strand; PAM type: NRG; PAM sequence: TGG
tataactaaatccatggaag

SEQ ID NO: 132162 - DNA, 20 bp, Artificial Sequence
  Description of Artificial Sequence: Synthetic oligonucleotide
  Target: ATXN1; (+) strand; PAM type: NRG; PAM sequence: AAG
aaatccatggaagtggcacc

SEQ ID NO: 132163 - DNA, 20 bp, Artificial Sequence
  Description of Artificial Sequence: Synthetic oligonucleotide
  Target: ATXN1; (+) strand; PAM type: NRG; PAM sequence: CAG
caagtgaactttgttgaaaa

SEQ ID NO: 132164 - DNA, 20 bp, Artificial Sequence
  Description of Artificial Sequence: Synthetic oligonucleotide
  Target: ATXN1; (+) strand; PAM type: NRG; PAM sequence: CAG
tcattcactattcatttatt

SEQ ID NO: 132165 - DNA, 20 bp, Artificial Sequence
  Description of Artificial Sequence: Synthetic oligonucleotide
  Target: ATXN1; (+) strand; PAM type: NRG; PAM sequence: TGG
tttattcagtttacctttaa

SEQ ID NO: 132166 - DNA, 20 bp, Artificial Sequence
  Description of Artificial Sequence: Synthetic oligonucleotide
  Target: ATXN1; (+) strand; PAM type: NRG; PAM sequence: AAG
attcagtttacctttaatgg

SEQ ID NO: 132167 - DNA, 20 bp, Artificial Sequence
  Description of Artificial Sequence: Synthetic oligonucleotide
  Target: ATXN1; (+) strand; PAM type: NRG; PAM sequence: GAG
tcagtttacctttaatggaa

SEQ ID NO: 132168 - DNA, 20 bp, Artificial Sequence
  Description of Artificial Sequence: Synthetic oligonucleotide
  Target: ATXN1; (+) strand; PAM type: NRG; PAM sequence: AGG
cagtttacctttaatggaag

SEQ ID NO: 132169 - DNA, 20 bp, Artificial Sequence
  Description of Artificial Sequence: Synthetic oligonucleotide
  Target: ATXN1; (+) strand; PAM type: NRG; PAM sequence: GGG
agtttacctttaatggaaga

SEQ ID NO: 132170 - DNA, 20 bp, Artificial Sequence
  Description of Artificial Sequence: Synthetic oligonucleotide
  Target: ATXN1; (+) strand; PAM type: NRG; PAM sequence: GGG
gtttacctttaatggaagag

SEQ ID NO: 132171 - DNA, 20 bp, Artificial Sequence
  Description of Artificial Sequence: Synthetic oligonucleotide
  Target: ATXN1; (+) strand; PAM type: NRG; PAM sequence: GAG
ttacctttaatggaagaggg

SEQ ID NO: 132172 - DNA, 20 bp, Artificial Sequence
  Description of Artificial Sequence: Synthetic oligonucleotide
  Target: ATXN1; (+) strand; PAM type: NRG; PAM sequence: AAG
cctttaatggaagaggggag

SEQ ID NO: 132173 - DNA, 20 bp, Artificial Sequence
  Description of Artificial Sequence: Synthetic oligonucleotide
  Target: ATXN1; (+) strand; PAM type: NRG; PAM sequence: GAG
tttaatggaagaggggagaa

SEQ ID NO: 132174 - DNA, 20 bp, Artificial Sequence
  Description of Artificial Sequence: Synthetic oligonucleotide
  Target: ATXN1; (+) strand; PAM type: NRG; PAM sequence: AAG
gaagaggggagaagagactg

SEQ ID NO: 132175 - DNA, 20 bp, Artificial Sequence
  Description of Artificial Sequence: Synthetic oligonucleotide
  Target: ATXN1; (+) strand; PAM type: NRG; PAM sequence: AAG
aggggagaagagactgaaga

SEQ ID NO: 132176 - DNA, 20 bp, Artificial Sequence
  Description of Artificial Sequence: Synthetic oligonucleotide
  Target: ATXN1; (+) strand; PAM type: NRG; PAM sequence: CAG
gagaagagactgaagaaaga

SEQ ID NO: 132177 - DNA, 20 bp, Artificial Sequence
  Description of Artificial Sequence: Synthetic oligonucleotide
  Target: ATXN1; (+) strand; PAM type: NRG; PAM sequence: AAG
gactgaagaaagacagatga

SEQ ID NO: 132178 - DNA, 20 bp, Artificial Sequence
  Description of Artificial Sequence: Synthetic oligonucleotide
  Target: ATXN1; (+) strand; PAM type: NRG; PAM sequence: AAG
aagaaagacagatgaaagtg

SEQ ID NO: 132179 - DNA, 20 bp, Artificial Sequence
  Description of Artificial Sequence: Synthetic oligonucleotide
  Target: ATXN1; (+) strand; PAM type: NRG; PAM sequence: AAG
aaagacagatgaaagtgaag

SEQ ID NO: 132180 - DNA, 20 bp, Artificial Sequence
  Description of Artificial Sequence: Synthetic oligonucleotide
  Target: ATXN1; (+) strand; PAM type: NRG; PAM sequence: GAG
agacagatgaaagtgaagaa

SEQ ID NO: 132181 - DNA, 20 bp, Artificial Sequence
  Description of Artificial Sequence: Synthetic oligonucleotide
  Target: ATXN1; (+) strand; PAM type: NRG; PAM sequence: AAG
tgaaagtgaagaagagaaat

SEQ ID NO: 132182 - DNA, 20 bp, Artificial Sequence
  Description of Artificial Sequence: Synthetic oligonucleotide
  Target: ATXN1; (+) strand; PAM type: NRG; PAM sequence: AAG
attccccttattttattcat

SEQ ID NO: 132183 - DNA, 20 bp, Artificial Sequence
  Description of Artificial Sequence: Synthetic oligonucleotide
  Target: ATXN1; (+) strand; PAM type: NRG; PAM sequence: TAG
ttattttattcataagttgt

SEQ ID NO: 132184 - DNA, 20 bp, Artificial Sequence
  Description of Artificial Sequence: Synthetic oligonucleotide
  Target: ATXN1; (+) strand; PAM type: NRG; PAM sequence: GAG
attttattcataagttgtta

SEQ ID NO: 132185 - DNA, 20 bp, Artificial Sequence
  Description of Artificial Sequence: Synthetic oligonucleotide
  Target: ATXN1; (+) strand; PAM type: NRG; PAM sequence: AGG
ttttattcataagttgttag

SEQ ID NO: 132186 - DNA, 20 bp, Artificial Sequence
  Description of Artificial Sequence: Synthetic oligonucleotide
  Target: ATXN1; (+) strand; PAM type: NRG; PAM sequence: GGG
tttattcataagttgttaga

SEQ ID NO: 132187 - DNA, 20 bp, Artificial Sequence
  Description of Artificial Sequence: Synthetic oligonucleotide
  Target: ATXN1; (+) strand; PAM type: NRG; PAM sequence: AAG
tagagggtacaataaaaact

SEQ ID NO: 132188 - DNA, 20 bp, Artificial Sequence
  Description of Artificial Sequence: Synthetic oligonucleotide
  Target: ATXN1; (+) strand; PAM type: NRG; PAM sequence: AAG
ggtacaataaaaactaagtt

SEQ ID NO: 132189 - DNA, 20 bp, Artificial Sequence
  Description of Artificial Sequence: Synthetic oligonucleotide
  Target: ATXN1; (+) strand; PAM type: NRG; PAM sequence: TGG
agttaagatgtaatttgaaa

SEQ ID NO: 132190 - DNA, 20 bp, Artificial Sequence
  Description of Artificial Sequence: Synthetic oligonucleotide
  Target: ATXN1; (+) strand; PAM type: NRG; PAM sequence: GAG
ttaagatgtaatttgaaatg

SEQ ID NO: 132191 - DNA, 20 bp, Artificial Sequence
  Description of Artificial Sequence: Synthetic oligonucleotide
  Target: ATXN1; (+) strand; PAM type: NRG; PAM sequence: TAG
gtctgtctaatccaaaaccc

SEQ ID NO: 132192 - DNA, 20 bp, Artificial Sequence
  Description of Artificial Sequence: Synthetic oligonucleotide
  Target: ATXN1; (+) strand; PAM type: NRG; PAM sequence: CAG
ttctacccttgctccttgca

SEQ ID NO: 132193 - DNA, 20 bp, Artificial Sequence
  Description of Artificial Sequence: Synthetic oligonucleotide
  Target: ATXN1; (+) strand; PAM type: NRG; PAM sequence: TGG
ctccttgcacagcgattttc

SEQ ID NO: 132194 - DNA, 20 bp, Artificial Sequence
  Description of Artificial Sequence: Synthetic oligonucleotide
  Target: ATXN1; (+) strand; PAM type: NRG; PAM sequence: GAG
ccttgcacagcgattttctg

SEQ ID NO: 132195 - DNA, 20 bp, Artificial Sequence
  Description of Artificial Sequence: Synthetic oligonucleotide
  Target: ATXN1; (+) strand; PAM type: NRG; PAM sequence: TAG
tcatcactttgttgcatctc

SEQ ID NO: 132196 - DNA, 20 bp, Artificial Sequence
  Description of Artificial Sequence: Synthetic oligonucleotide
  Target: ATXN1; (+) strand; PAM type: NRG; PAM sequence: AAG
cactttgttgcatctctaga

SEQ ID NO: 132197 - DNA, 20 bp, Artificial Sequence
  Description of Artificial Sequence: Synthetic oligonucleotide
  Target: ATXN1; (+) strand; PAM type: NRG; PAM sequence: CAG
gttgcatctctagaaagatc

SEQ ID NO: 132198 - DNA, 20 bp, Artificial Sequence
  Description of Artificial Sequence: Synthetic oligonucleotide
  Target: ATXN1; (+) strand; PAM type: NRG; PAM sequence: AGG
ttgcatctctagaaagatcc

SEQ ID NO: 132199 - DNA, 20 bp, Artificial Sequence
  Description of Artificial Sequence: Synthetic oligonucleotide
  Target: ATXN1; (+) strand; PAM type: NRG; PAM sequence: GGG
tgcatctctagaaagatcca

SEQ ID NO: 132200 - DNA, 20 bp, Artificial Sequence
  Description of Artificial Sequence: Synthetic oligonucleotide
  Target: ATXN1; (+) strand; PAM type: NRG; PAM sequence: TGG
ataattatgtgcttcctgtg

SEQ ID NO: 132201 - DNA, 20 bp, Artificial Sequence
  Description of Artificial Sequence: Synthetic oligonucleotide
  Target: ATXN1; (+) strand; PAM type: NRG; PAM sequence: TGG
attatgtgcttcctgtgtgg

SEQ ID NO: 132202 - DNA, 20 bp, Artificial Sequence
  Description of Artificial Sequence: Synthetic oligonucleotide
  Target: ATXN1; (+) strand; PAM type: NRG; PAM sequence: AAG
tgcttcctgtgtggtggcct

SEQ ID NO: 132203 - DNA, 20 bp, Artificial Sequence
  Description of Artificial Sequence: Synthetic oligonucleotide
  Target: ATXN1; (+) strand; PAM type: NRG; PAM sequence: AAG
tgtgtggtggcctaagaatt

SEQ ID NO: 132204 - DNA, 20 bp, Artificial Sequence
  Description of Artificial Sequence: Synthetic oligonucleotide
  Target: ATXN1; (+) strand; PAM type: NRG; PAM sequence: GAG
tgtggtggcctaagaattaa

SEQ ID NO: 132205 - DNA, 20 bp, Artificial Sequence
  Description of Artificial Sequence: Synthetic oligonucleotide
  Target: ATXN1; (+) strand; PAM type: NRG; PAM sequence: AAG
ggtggcctaagaattaagag

SEQ ID NO: 132206 - DNA, 20 bp, Artificial Sequence
  Description of Artificial Sequence: Synthetic oligonucleotide
  Target: ATXN1; (+) strand; PAM type: NRG; PAM sequence: AAG
tgtgcaccctctctttgaca

SEQ ID NO: 132207 - DNA, 20 bp, Artificial Sequence
  Description of Artificial Sequence: Synthetic oligonucleotide
  Target: ATXN1; (+) strand; PAM type: NRG; PAM sequence: TGG
accctctctttgacaaagca

SEQ ID NO: 132208 - DNA, 20 bp, Artificial Sequence
  Description of Artificial Sequence: Synthetic oligonucleotide
  Target: ATXN1; (+) strand; PAM type: NRG; PAM sequence: TGG
gcctgatttcccaatcctta

SEQ ID NO: 132209 - DNA, 20 bp, Artificial Sequence
  Description of Artificial Sequence: Synthetic oligonucleotide
  Target: ATXN1; (+) strand; PAM type: NRG; PAM sequence: GAG
ctgatttcccaatccttatg

SEQ ID NO: 132210 - DNA, 20 bp, Artificial Sequence
  Description of Artificial Sequence: Synthetic oligonucleotide
  Target: ATXN1; (+) strand; PAM type: NRG; PAM sequence: GAG
aatccttatggagctctgtt

SEQ ID NO: 132211 - DNA, 20 bp, Artificial Sequence
  Description of Artificial Sequence: Synthetic oligonucleotide
  Target: ATXN1; (+) strand; PAM type: NRG; PAM sequence: AGG
atccttatggagctctgttg

SEQ ID NO: 132212 - DNA, 20 bp, Artificial Sequence
  Description of Artificial Sequence: Synthetic oligonucleotide
  Target: ATXN1; (+) strand; PAM type: NRG; PAM sequence: GGG
tccttatggagctctgttga

SEQ ID NO: 132213 - DNA, 20 bp, Artificial Sequence
  Description of Artificial Sequence: Synthetic oligonucleotide
  Target: ATXN1; (+) strand; PAM type: NRG; PAM sequence: CAG
gagctctgttgagggttaca

SEQ ID NO: 132214 - DNA, 20 bp, Artificial Sequence
  Description of Artificial Sequence: Synthetic oligonucleotide
  Target: ATXN1; (+) strand; PAM type: NRG; PAM sequence: AAG
tctgttgagggttacacagc

SEQ ID NO: 132215 - DNA, 20 bp, Artificial Sequence
  Description of Artificial Sequence: Synthetic oligonucleotide
  Target: ATXN1; (+) strand; PAM type: NRG; PAM sequence: AGG
ctgttgagggttacacagca

SEQ ID NO: 132216 - DNA, 20 bp, Artificial Sequence
  Description of Artificial Sequence: Synthetic oligonucleotide
  Target: ATXN1; (+) strand; PAM type: NRG; PAM sequence: GAG
ctttaccttgcaattgctat

SEQ ID NO: 132217 - DNA, 20 bp, Artificial Sequence
  Description of Artificial Sequence: Synthetic oligonucleotide
  Target: ATXN1; (+) strand; PAM type: NRG; PAM sequence: TGG
ctatgagaataaattcaaaa

SEQ ID NO: 132218 - DNA, 20 bp, Artificial Sequence
  Description of Artificial Sequence: Synthetic oligonucleotide
  Target: ATXN1; (+) strand; PAM type: NRG; PAM sequence: GAG
ataaattcaaaatggttccc

SEQ ID NO: 132219 - DNA, 20 bp, Artificial Sequence
  Description of Artificial Sequence: Synthetic oligonucleotide
  Target: ATXN1; (+) strand; PAM type: NRG; PAM sequence: CAG
ttcaaaatggttcccgagtt

SEQ ID NO: 132220 - DNA, 20 bp, Artificial Sequence
  Description of Artificial Sequence: Synthetic oligonucleotide
  Target: ATXN1; (+) strand; PAM type: NRG; PAM sequence: AAG
acttctgctgctaaaaaaac

SEQ ID NO: 132221 - DNA, 20 bp, Artificial Sequence
  Description of Artificial Sequence: Synthetic oligonucleotide
  Target: ATXN1; (+) strand; PAM type: NRG; PAM sequence: CAG
ctgctgctaaaaaaacaaga

SEQ ID NO: 132222 - DNA, 20 bp, Artificial Sequence
  Description of Artificial Sequence: Synthetic oligonucleotide
  Target: ATXN1; (+) strand; PAM type: NRG; PAM sequence: CAG
attgaatgcactctactcat

SEQ ID NO: 132223 - DNA, 20 bp, Artificial Sequence
  Description of Artificial Sequence: Synthetic oligonucleotide
  Target: ATXN1; (+) strand; PAM type: NRG; PAM sequence: AGG
ttgaatgcactctactcatc

SEQ ID NO: 132224 - DNA, 20 bp, Artificial Sequence
  Description of Artificial Sequence: Synthetic oligonucleotide
  Target: ATXN1; (+) strand; PAM type: NRG; PAM sequence: GAG
ctctactcatcaggcactct

SEQ ID NO: 132225 - DNA, 20 bp, Artificial Sequence
  Description of Artificial Sequence: Synthetic oligonucleotide
  Target: ATXN1; (+) strand; PAM type: NRG; PAM sequence: AAG
catcaggcactctgagaatg

SEQ ID NO: 132226 - DNA, 20 bp, Artificial Sequence
  Description of Artificial Sequence: Synthetic oligonucleotide
  Target: ATXN1; (+) strand; PAM type: NRG; PAM sequence: AGG
atcaggcactctgagaatga

SEQ ID NO: 132227 - DNA, 20 bp, Artificial Sequence
  Description of Artificial Sequence: Synthetic oligonucleotide
  Target: ATXN1; (+) strand; PAM type: NRG; PAM sequence: TGG
ctctgagaatgaaggtgacc

SEQ ID NO: 132228 - DNA, 20 bp, Artificial Sequence
  Description of Artificial Sequence: Synthetic oligonucleotide
  Target: ATXN1; (+) strand; PAM type: NRG; PAM sequence: TGG
gagaatgaaggtgacctggc

SEQ ID NO: 132229 - DNA, 20 bp, Artificial Sequence
  Description of Artificial Sequence: Synthetic oligonucleotide
  Target: ATXN1; (+) strand; PAM type: NRG; PAM sequence: TGG
ggtgacctggctggtatata

SEQ ID NO: 132230 - DNA, 20 bp, Artificial Sequence
  Description of Artificial Sequence: Synthetic oligonucleotide
  Target: ATXN1; (+) strand; PAM type: NRG; PAM sequence: GGG
gtgacctggctggtatatat

SEQ ID NO: 132231 - DNA, 20 bp, Artificial Sequence
  Description of Artificial Sequence: Synthetic oligonucleotide
  Target: ATXN1; (+) strand; PAM type: NRG; PAM sequence: TGG
ggctggtatatatgggtctg

SEQ ID NO: 132232 - DNA, 20 bp, Artificial Sequence
  Description of Artificial Sequence: Synthetic oligonucleotide
  Target: ATXN1; (+) strand; PAM type: NRG; PAM sequence: AAG
ggtatatatgggtctgtgga

SEQ ID NO: 132233 - DNA, 20 bp, Artificial Sequence
  Description of Artificial Sequence: Synthetic oligonucleotide
  Target: ATXN1; (+) strand; PAM type: NRG; PAM sequence: AAG
tatgggtctgtggaaagaca

SEQ ID NO: 132234 - DNA, 20 bp, Artificial Sequence
  Description of Artificial Sequence: Synthetic oligonucleotide
  Target: ATXN1; (+) strand; PAM type: NRG; PAM sequence: TAG
aaagacaaagtatttttaca

SEQ ID NO: 132235 - DNA, 20 bp, Artificial Sequence
  Description of Artificial Sequence: Synthetic oligonucleotide
  Target: ATXN1; (+) strand; PAM type: NRG; PAM sequence: AAG
tccctataaaaaaaatactg

SEQ ID NO: 132236 - DNA, 20 bp, Artificial Sequence
  Description of Artificial Sequence: Synthetic oligonucleotide
  Target: ATXN1; (+) strand; PAM type: NRG; PAM sequence: TAG
aaatactgaagtcaatacat

SEQ ID NO: 132237 - DNA, 20 bp, Artificial Sequence
  Description of Artificial Sequence: Synthetic oligonucleotide
  Target: ATXN1; (+) strand; PAM type: NRG; PAM sequence: AAG
aagtcaatacattagtttaa

SEQ ID NO: 132238 - DNA, 20 bp, Artificial Sequence
  Description of Artificial Sequence: Synthetic oligonucleotide
  Target: ATXN1; (+) strand; PAM type: NRG; PAM sequence: AGG
agtcaatacattagtttaaa

SEQ ID NO: 132239 - DNA, 20 bp, Artificial Sequence
  Description of Artificial Sequence: Synthetic oligonucleotide
  Target: ATXN1; (+) strand; PAM type: NRG; PAM sequence: AAG
ttagtttaaaaggacataaa

SEQ ID NO: 132240 - DNA, 20 bp, Artificial Sequence
  Description of Artificial Sequence: Synthetic oligonucleotide
  Target: ATXN1; (+) strand; PAM type: NRG; PAM sequence: GAG
agtttaaaaggacataaaaa

SEQ ID NO: 132241 - DNA, 20 bp, Artificial Sequence
  Description of Artificial Sequence: Synthetic oligonucleotide
  Target: ATXN1; (+) strand; PAM type: NRG; PAM sequence: CAG
tgtgaacatatgtgcttcca

SEQ ID NO: 132242 - DNA, 20 bp, Artificial Sequence
  Description of Artificial Sequence: Synthetic oligonucleotide
  Target: ATXN1; (+) strand; PAM type: NRG; PAM sequence: AAG
aacatatgtgcttccacagc

SEQ ID NO: 132243 - DNA, 20 bp, Artificial Sequence
  Description of Artificial Sequence: Synthetic oligonucleotide
  Target: ATXN1; (+) strand; PAM type: NRG; PAM sequence: AAG
gcttccacagcaagcccata

SEQ ID NO: 132244 - DNA, 20 bp, Artificial Sequence
  Description of Artificial Sequence: Synthetic oligonucleotide
  Target: ATXN1; (+) strand; PAM type: NRG; PAM sequence: AGG
cttccacagcaagcccataa

SEQ ID NO: 132245 - DNA, 20 bp, Artificial Sequence
  Description of Artificial Sequence: Synthetic oligonucleotide
  Target: ATXN1; (+) strand; PAM type: NRG; PAM sequence: GGG
ttccacagcaagcccataaa

SEQ ID NO: 132246 - DNA, 20 bp, Artificial Sequence
  Description of Artificial Sequence: Synthetic oligonucleotide
  Target: ATXN1; (+) strand; PAM type: NRG; PAM sequence: TAG
gcaagcccataaagggaatc

SEQ ID NO: 132247 - DNA, 20 bp, Artificial Sequence
  Description of Artificial Sequence: Synthetic oligonucleotide
  Target: ATXN1; (+) strand; PAM type: NRG; PAM sequence: GAG
aagcccataaagggaatcta

SEQ ID NO: 132248 - DNA, 20 bp, Artificial Sequence
  Description of Artificial Sequence: Synthetic oligonucleotide
  Target: ATXN1; (+) strand; PAM type: NRG; PAM sequence: AGG
agcccataaagggaatctag

SEQ ID NO: 132249 - DNA, 20 bp, Artificial Sequence
  Description of Artificial Sequence: Synthetic oligonucleotide
  Target: ATXN1; (+) strand; PAM type: NRG; PAM sequence: TGG
ggaatctagaggctacttca

SEQ ID NO: 132250 - DNA, 20 bp, Artificial Sequence
  Description of Artificial Sequence: Synthetic oligonucleotide
  Target: ATXN1; (+) strand; PAM type: NRG; PAM sequence: GAG
aatctagaggctacttcatg

SEQ ID NO: 132251 - DNA, 20 bp, Artificial Sequence
  Description of Artificial Sequence: Synthetic oligonucleotide
  Target: ATXN1; (+) strand; PAM type: NRG; PAM sequence: AAG
ttccaatgtccgctctacaa

SEQ ID NO: 132252 - DNA, 20 bp, Artificial Sequence
  Description of Artificial Sequence: Synthetic oligonucleotide
  Target: ATXN1; (+) strand; PAM type: NRG; PAM sequence: TAG
tttcttttattttatttttc

SEQ ID NO: 132253 - DNA, 20 bp, Artificial Sequence
  Description of Artificial Sequence: Synthetic oligonucleotide
  Target: ATXN1; (+) strand; PAM type: NRG; PAM sequence: GAG
tcttttattttatttttcta

SEQ ID NO: 132254 - DNA, 20 bp, Artificial Sequence
  Description of Artificial Sequence: Synthetic oligonucleotide
  Target: ATXN1; (+) strand; PAM type: NRG; PAM sequence: CAG
ttattttatttttctagaga

SEQ ID NO: 132255 - DNA, 20 bp, Artificial Sequence
  Description of Artificial Sequence: Synthetic oligonucleotide
  Target: ATXN1; (+) strand; PAM type: NRG; PAM sequence: AGG
tattttatttttctagagac

SEQ ID NO: 132256 - DNA, 20 bp, Artificial Sequence
  Description of Artificial Sequence: Synthetic oligonucleotide
  Target: ATXN1; (+) strand; PAM type: NRG; PAM sequence: GGG
attttatttttctagagaca

SEQ ID NO: 132257 - DNA, 20 bp, Artificial Sequence
  Description of Artificial Sequence: Synthetic oligonucleotide
  Target: ATXN1; (+) strand; PAM type: NRG; PAM sequence: CAG
cagggtctcactttgccacc

SEQ ID NO: 132258 - DNA, 20 bp, Artificial Sequence
  Description of Artificial Sequence: Synthetic oligonucleotide
  Target: ATXN1; (+) strand; PAM type: NRG; PAM sequence: TGG
tctcactttgccacccagac

SEQ ID NO: 132259 - DNA, 20 bp, Artificial Sequence
  Description of Artificial Sequence: Synthetic oligonucleotide
  Target: ATXN1; (+) strand; PAM type: NRG; PAM sequence: CAG
ttgccacccagactggtgtg

SEQ ID NO: 132260 - DNA, 20 bp, Artificial Sequence
  Description of Artificial Sequence: Synthetic oligonucleotide
  Target: ATXN1; (+) strand; PAM type: NRG; PAM sequence: TGG
ccacccagactggtgtgcag

SEQ ID NO: 132261 - DNA, 20 bp, Artificial Sequence
  Description of Artificial Sequence: Synthetic oligonucleotide
  Target: ATXN1; (+) strand; PAM type: NRG; PAM sequence: TAG
ggtgtgcagtggtgcaatca

SEQ ID NO: 132262 - DNA, 20 bp, Artificial Sequence
  Description of Artificial Sequence: Synthetic oligonucleotide
  Target: ATXN1; (+) strand; PAM type: NRG; PAM sequence: TGG
tcactgtaaccttgaactcc

SEQ ID NO: 132263 - DNA, 20 bp, Artificial Sequence
  Description of Artificial Sequence: Synthetic oligonucleotide
  Target: ATXN1; (+) strand; PAM type: NRG; PAM sequence: GGG
cactgtaaccttgaactcct

SEQ ID NO: 132264 - DNA, 20 bp, Artificial Sequence
  Description of Artificial Sequence: Synthetic oligonucleotide
  Target: ATXN1; (+) strand; PAM type: NRG; PAM sequence: AAG
aaccttgaactcctgggctc

SEQ ID NO: 132265 - DNA, 20 bp, Artificial Sequence
  Description of Artificial Sequence: Synthetic oligonucleotide
  Target: ATXN1; (+) strand; PAM type: NRG; PAM sequence: CAG
ctcaagcaatcctcccacct

SEQ ID NO: 132266 - DNA, 20 bp, Artificial Sequence
  Description of Artificial Sequence: Synthetic oligonucleotide
  Target: ATXN1; (+) strand; PAM type: NRG; PAM sequence: GAG
tcctcccacctcagcctcct

SEQ ID NO: 132267 - DNA, 20 bp, Artificial Sequence
  Description of Artificial Sequence: Synthetic oligonucleotide
  Target: ATXN1; (+) strand; PAM type: NRG; PAM sequence: CAG
tcccacctcagcctcctgag

SEQ ID NO: 132268 - DNA, 20 bp, Artificial Sequence
  Description of Artificial Sequence: Synthetic oligonucleotide
  Target: ATXN1; (+) strand; PAM type: NRG; PAM sequence: TAG
acctcagcctcctgagcagc

SEQ ID NO: 132269 - DNA, 20 bp, Artificial Sequence
  Description of Artificial Sequence: Synthetic oligonucleotide
  Target: ATXN1; (+) strand; PAM type: NRG; PAM sequence: AGG
cctcagcctcctgagcagct

SEQ ID NO: 132270 - DNA, 20 bp, Artificial Sequence
  Description of Artificial Sequence: Synthetic oligonucleotide
  Target: ATXN1; (+) strand; PAM type: NRG; PAM sequence: CAG
ctcctgagcagctaggacta

SEQ ID NO: 132271 - DNA, 20 bp, Artificial Sequence
  Description of Artificial Sequence: Synthetic oligonucleotide
  Target: ATXN1; (+) strand; PAM type: NRG; PAM sequence: CAG
cagactcacaacattacact

SEQ ID NO: 132272 - DNA, 20 bp, Artificial Sequence
  Description of Artificial Sequence: Synthetic oligonucleotide
  Target: ATXN1; (+) strand; PAM type: NRG; PAM sequence: AAG
aattaaaaaaaaaaaactta

SEQ ID NO: 132273 - DNA, 20 bp, Artificial Sequence
  Description of Artificial Sequence: Synthetic oligonucleotide
  Target: ATXN1; (+) strand; PAM type: NRG; PAM sequence: GAG
ttaaaaaaaaaaaacttaaa

SEQ ID NO: 132274 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaacttaaagagaca

SEQ ID NO: 132275 - DNA, 20 bp, Artificial Sequence
  Description of Artificial Sequence: Synthetic oligonucleotide
  Target: ATXN1; (+) strand; PAM type: NRG; PAM sequence: CAG
caaagacttgttctgtcacc

SEQ ID NO: 132276 - DNA, 20 bp, Artificial Sequence
  Description of Artificial Sequence: Synthetic oligonucleotide
  Target: ATXN1; (+) strand; PAM type: NRG; PAM sequence: AGG
aaagacttgttctgtcaccc

SEQ ID NO: 132277 - DNA, 20 bp, Artificial Sequence
  Description of Artificial Sequence: Synthetic oligonucleotide
  Target: ATXN1; (+) strand; PAM type: NRG; PAM sequence: TGG
acttgttctgtcacccaggc

SEQ ID NO: 132278 - DNA, 20 bp, Artificial Sequence
  Description of Artificial Sequence: Synthetic oligonucleotide
  Target: ATXN1; (+) strand; PAM type: NRG; PAM sequence: GAG
ttgttctgtcacccaggctg

SEQ ID NO: 132279 - DNA, 20 bp, Artificial Sequence
  Description of Artificial Sequence: Synthetic oligonucleotide
  Target: ATXN1; (+) strand; PAM type: NRG; PAM sequence: TAG
ctgtcacccaggctggagtg

SEQ ID NO: 132280 - DNA, 20 bp, Artificial Sequence
  Description of Artificial Sequence: Synthetic oligonucleotide
  Target: ATXN1; (+) strand; PAM type: NRG; PAM sequence: TGG
tcacccaggctggagtgtag

SEQ ID NO: 132281 - DNA, 20 bp, Artificial Sequence
  Description of Artificial Sequence: Synthetic oligonucleotide
  Target: ATXN1; (+) strand; PAM type: NRG; PAM sequence: CAG
ggagtgtagtggtgcgatca

SEQ ID NO: 132282 - DNA, 20 bp, Artificial Sequence
  Description of Artificial Sequence: Synthetic oligonucleotide
  Target: ATXN1; (+) strand; PAM type: NRG; PAM sequence: CAG
ggtgcgatcacagctcactg

SEQ ID NO: 132283 - DNA, 20 bp, Artificial Sequence
  Description of Artificial Sequence: Synthetic oligonucleotide
  Target: ATXN1; (+) strand; PAM type: NRG; PAM sequence: TAG
tcactgcagcctcaaactcc

SEQ ID NO: 132284 - DNA, 20 bp, Artificial Sequence
  Description of Artificial Sequence: Synthetic oligonucleotide
  Target: ATXN1; (+) strand; PAM type: NRG; PAM sequence: AAG
agcctcaaactcctagactc

SEQ ID NO: 132285 - DNA, 20 bp, Artificial Sequence
  Description of Artificial Sequence: Synthetic oligonucleotide
  Target: ATXN1; (+) strand; PAM type: NRG; PAM sequence: AAG
ctcaagtgatcctcctacat

SEQ ID NO: 132286 - DNA, 20 bp, Artificial Sequence
  Description of Artificial Sequence: Synthetic oligonucleotide
  Target: ATXN1; (+) strand; PAM type: NRG; PAM sequence: AAG
tcctcctacataagcctccc

SEQ ID NO: 132287 - DNA, 20 bp, Artificial Sequence
  Description of Artificial Sequence: Synthetic oligonucleotide
  Target: ATXN1; (+) strand; PAM type: NRG; PAM sequence: TAG
tcctacataagcctcccaag

SEQ ID NO: 132288 - DNA, 20 bp, Artificial Sequence
  Description of Artificial Sequence: Synthetic oligonucleotide
  Target: ATXN1; (+) strand; PAM type: NRG; PAM sequence: TAG
acataagcctcccaagtagc

SEQ ID NO: 132289 - DNA, 20 bp, Artificial Sequence
  Description of Artificial Sequence: Synthetic oligonucleotide
  Target: ATXN1; (+) strand; PAM type: NRG; PAM sequence: AGG
cataagcctcccaagtagct

SEQ ID NO: 132290 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtagctaggacta

SEQ ID NO: 132291 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagctaggactac

SEQ ID NO: 132292 - DNA, 20 bp, Artificial Sequence
  Description of Artificial Sequence: Synthetic oligonucleotide
  Target: ATXN1; (+) strand; PAM type: NRG; PAM sequence: CAG
caggctcatgccaccatgct

SEQ ID NO: 132293 - DNA, 20 bp, Artificial Sequence
  Description of Artificial Sequence: Synthetic oligonucleotide
  Target: ATXN1; (+) strand; PAM type: NRG; PAM sequence: AAG
tcatgccaccatgctcagct

SEQ ID NO: 132294 - DNA, 20 bp, Artificial Sequence
  Description of Artificial Sequence: Synthetic oligonucleotide
  Target: ATXN1; (+) strand; PAM type: NRG; PAM sequence: TAG
taagttttaaattttttttg

SEQ ID NO: 132295 - DNA, 20 bp, Artificial Sequence
  Description of Artificial Sequence: Synthetic oligonucleotide
  Target: ATXN1; (+) strand; PAM type: NRG; PAM sequence: GAG
agttttaaattttttttgta

SEQ ID NO: 132296 - DNA, 20 bp, Artificial Sequence
  Description of Artificial Sequence: Synthetic oligonucleotide
  Target: ATXN1; (+) strand; PAM type: NRG; PAM sequence: TAG
ttaaattttttttgtagaga

SEQ ID NO: 132297 - DNA, 20 bp, Artificial Sequence
  Description of Artificial Sequence: Synthetic oligonucleotide
  Target: ATXN1; (+) strand; PAM type: NRG; PAM sequence: AGG
taaattttttttgtagagat

SEQ ID NO: 132298 - DNA, 20 bp, Artificial Sequence
  Description of Artificial Sequence: Synthetic oligonucleotide
  Target: ATXN1; (+) strand; PAM type: NRG; PAM sequence: GGG
aaattttttttgtagagata

SEQ ID NO: 132299 - DNA, 20 bp, Artificial Sequence
  Description of Artificial Sequence: Synthetic oligonucleotide
  Target: ATXN1; (+) strand; PAM type: NRG; PAM sequence: CAG
tagggtctcactacgctgtc

SEQ ID NO: 132300 - DNA, 20 bp, Artificial Sequence
  Description of Artificial Sequence: Synthetic oligonucleotide
  Target: ATXN1; (+) strand; PAM type: NRG; PAM sequence: AGG
agggtctcactacgctgtcc

SEQ ID NO: 132301 - DNA, 20 bp, Artificial Sequence
  Description of Artificial Sequence: Synthetic oligonucleotide
  Target: ATXN1; (+) strand; PAM type: NRG; PAM sequence: TGG
tctcactacgctgtccaggc

SEQ ID NO: 132302 - DNA, 20 bp, Artificial Sequence
  Description of Artificial Sequence: Synthetic oligonucleotide
  Target: ATXN1; (+) strand; PAM type: NRG; PAM sequence: TGG
ccaggctggtctcaaactcg

SEQ ID NO: 132303 - DNA, 20 bp, Artificial Sequence
  Description of Artificial Sequence: Synthetic oligonucleotide
  Target: ATXN1; (+) strand; PAM type: NRG; PAM sequence: AAG
ggtctcaaactcgtggcttc

SEQ ID NO: 132304 - DNA, 20 bp, Artificial Sequence
  Description of Artificial Sequence: Synthetic oligonucleotide
  Target: ATXN1; (+) strand; PAM type: NRG; PAM sequence: CAG
ttcaagtgatccttccacct

SEQ ID NO: 132305 - DNA, 20 bp, Artificial Sequence
  Description of Artificial Sequence: Synthetic oligonucleotide
  Target: ATXN1; (+) strand; PAM type: NRG; PAM sequence: AAG
ccttccacctcagcccccca

SEQ ID NO: 132306 - DNA, 20 bp, Artificial Sequence
  Description of Artificial Sequence: Synthetic oligonucleotide
  Target: ATXN1; (+) strand; PAM type: NRG; PAM sequence: TGG
acctcagccccccaaagtgc

SEQ ID NO: 132307 - DNA, 20 bp, Artificial Sequence
  Description of Artificial Sequence: Synthetic oligonucleotide
  Target: ATXN1; (+) strand; PAM type: NRG; PAM sequence: GGG
cctcagccccccaaagtgct

SEQ ID NO: 132308 - DNA, 20 bp, Artificial Sequence
  Description of Artificial Sequence: Synthetic oligonucleotide
  Target: ATXN1; (+) strand; PAM type: NRG; PAM sequence: CAG
cccccaaagtgctgggattg

SEQ ID NO: 132309 - DNA, 20 bp, Artificial Sequence
  Description of Artificial Sequence: Synthetic oligonucleotide
  Target: ATXN1; (+) strand; PAM type: NRG; PAM sequence: AGG
ccccaaagtgctgggattgc

SEQ ID NO: 132310 - DNA, 20 bp, Artificial Sequence
  Description of Artificial Sequence: Synthetic oligonucleotide
  Target: ATXN1; (+) strand; PAM type: NRG; PAM sequence: GGG
cccaaagtgctgggattgca

SEQ ID NO: 132311 - DNA, 20 bp, Artificial Sequence
  Description of Artificial Sequence: Synthetic oligonucleotide
  Target: ATXN1; (+) strand; PAM type: NRG; PAM sequence: GGG
ccaaagtgctgggattgcag

SEQ ID NO: 132312 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattgcaggggt

SEQ ID NO: 132313 - DNA, 20 bp, Artificial Sequence
  Description of Artificial Sequence: Synthetic oligonucleotide
  Target: ATXN1; (+) strand; PAM type: NRG; PAM sequence: CAG
caggggtgagccatcacgtt

SEQ ID NO: 132314 - DNA, 20 bp, Artificial Sequence
  Description of Artificial Sequence: Synthetic oligonucleotide
  Target: ATXN1; (+) strand; PAM type: NRG; PAM sequence: AAG
tatatcgtgcaatgctatgt

SEQ ID NO: 132315 - DNA, 20 bp, Artificial Sequence
  Description of Artificial Sequence: Synthetic oligonucleotide
  Target: ATXN1; (+) strand; PAM type: NRG; PAM sequence: TAG
atgctatgtaagtcatgttt

SEQ ID NO: 132316 - DNA, 20 bp, Artificial Sequence
  Description of Artificial Sequence: Synthetic oligonucleotide
  Target: ATXN1; (+) strand; PAM type: NRG; PAM sequence: TGG
gtcatgttttagatatgcca

SEQ ID NO: 132317 - DNA, 20 bp, Artificial Sequence
  Description of Artificial Sequence: Synthetic oligonucleotide
  Target: ATXN1; (+) strand; PAM type: NRG; PAM sequence: CGG
tgttttagatatgccatggc

SEQ ID NO: 132318 - DNA, 20 bp, Artificial Sequence
  Description of Artificial Sequence: Synthetic oligonucleotide
  Target: ATXN1; (+) strand; PAM type: NRG; PAM sequence: TGG
catggccggttcctattcca

SEQ ID NO: 132319 - DNA, 20 bp, Artificial Sequence
  Description of Artificial Sequence: Synthetic oligonucleotide
  Target: ATXN1; (+) strand; PAM type: NRG; PAM sequence: GGG
atggccggttcctattccat

SEQ ID NO: 132320 - DNA, 20 bp, Artificial Sequence
  Description of Artificial Sequence: Synthetic oligonucleotide
  Target: ATXN1; (+) strand; PAM type: NRG; PAM sequence: GGG
tggccggttcctattccatg

SEQ ID NO: 132321 - DNA, 20 bp, Artificial Sequence
  Description of Artificial Sequence: Synthetic oligonucleotide
  Target: ATXN1; (+) strand; PAM type: NRG; PAM sequence: GAG
gccggttcctattccatggg

SEQ ID NO: 132322 - DNA, 20 bp, Artificial Sequence
  Description of Artificial Sequence: Synthetic oligonucleotide
  Target: ATXN1; (+) strand; PAM type: NRG; PAM sequence: CAG
cctattccatggggagttct

SEQ ID NO: 132323 - DNA, 20 bp, Artificial Sequence
  Description of Artificial Sequence: Synthetic oligonucleotide
  Target: ATXN1; (+) strand; PAM type: NRG; PAM sequence: AAG
ggggagttctcagcatcata

SEQ ID NO: 132324 - DNA, 20 bp, Artificial Sequence
  Description of Artificial Sequence: Synthetic oligonucleotide
  Target: ATXN1; (+) strand; PAM type: NRG; PAM sequence: AGG
gggagttctcagcatcataa

SEQ ID NO: 132325 - DNA, 20 bp, Artificial Sequence
  Description of Artificial Sequence: Synthetic oligonucleotide
  Target: ATXN1; (+) strand; PAM type: NRG; PAM sequence: AAG
cagcatcataaaggtatttg

SEQ ID NO: 132326 - DNA, 20 bp, Artificial Sequence
  Description of Artificial Sequence: Synthetic oligonucleotide
  Target: ATXN1; (+) strand; PAM type: NRG; PAM sequence: AAG
cataaaggtatttgaagttt

SEQ ID NO: 132327 - DNA, 20 bp, Artificial Sequence
  Description of Artificial Sequence: Synthetic oligonucleotide
  Target: ATXN1; (+) strand; PAM type: NRG; PAM sequence: AAG
gtttaagtctacatgttgta

SEQ ID NO: 132328 - DNA, 20 bp, Artificial Sequence
  Description of Artificial Sequence: Synthetic oligonucleotide
  Target: ATXN1; (+) strand; PAM type: NRG; PAM sequence: AGG
tttaagtctacatgttgtaa

SEQ ID NO: 132329 - DNA, 20 bp, Artificial Sequence
  Description of Artificial Sequence: Synthetic oligonucleotide
  Target: ATXN1; (+) strand; PAM type: NRG; PAM sequence: CAG
gatgctcaatgctcaattct

SEQ ID NO: 132330 - DNA, 20 bp, Artificial Sequence
  Description of Artificial Sequence: Synthetic oligonucleotide
  Target: ATXN1; (+) strand; PAM type: NRG; PAM sequence: TAG
tcaatgctcaattctcagac

SEQ ID NO: 132331 - DNA, 20 bp, Artificial Sequence
  Description of Artificial Sequence: Synthetic oligonucleotide
  Target: ATXN1; (+) strand; PAM type: NRG; PAM sequence: CAG
ctcaattctcagactagaac

SEQ ID NO: 132332 - DNA, 20 bp, Artificial Sequence
  Description of Artificial Sequence: Synthetic oligonucleotide
  Target: ATXN1; (+) strand; PAM type: NRG; PAM sequence: AAG
ttccacaatttcatattttt

SEQ ID NO: 132333 - DNA, 20 bp, Artificial Sequence
  Description of Artificial Sequence: Synthetic oligonucleotide
  Target: ATXN1; (+) strand; PAM type: NRG; PAM sequence: AAG
ttcatatttttaagaatatc

SEQ ID NO: 132334 - DNA, 20 bp, Artificial Sequence
  Description of Artificial Sequence: Synthetic oligonucleotide
  Target: ATXN1; (+) strand; PAM type: NRG; PAM sequence: AAG
cacttacaattaactataaa

SEQ ID NO: 132335 - DNA, 20 bp, Artificial Sequence
  Description of Artificial Sequence: Synthetic oligonucleotide
  Target: ATXN1; (+) strand; PAM type: NRG; PAM sequence: AGG
acttacaattaactataaaa

SEQ ID NO: 132336 - DNA, 20 bp, Artificial Sequence
  Description of Artificial Sequence: Synthetic oligonucleotide
  Target: ATXN1; (+) strand; PAM type: NRG; PAM sequence: GGG
cttacaattaactataaaaa

SEQ ID NO: 132337 - DNA, 20 bp, Artificial Sequence
  Description of Artificial Sequence: Synthetic oligonucleotide
  Target: ATXN1; (+) strand; PAM type: NRG; PAM sequence: CAG
aaaagggttaattttctcct

SEQ ID NO: 132338 - DNA, 20 bp, Artificial Sequence
  Description of Artificial Sequence: Synthetic oligonucleotide
  Target: ATXN1; (+) strand; PAM type: NRG; PAM sequence: TGG
ttgtcaataaaatgtttact

SEQ ID NO: 132339 - DNA, 20 bp, Artificial Sequence
  Description of Artificial Sequence: Synthetic oligonucleotide
  Target: ATXN1; (+) strand; PAM type: NRG; PAM sequence: AAG
atgaccgactgataccaaaa

SEQ ID NO: 132340 - DNA, 20 bp, Artificial Sequence
  Description of Artificial Sequence: Synthetic oligonucleotide
  Target: ATXN1; (+) strand; PAM type: NRG; PAM sequence: AGG
tgaccgactgataccaaaaa

SEQ ID NO: 132341 - DNA, 20 bp, Artificial Sequence
  Description of Artificial Sequence: Synthetic oligonucleotide
  Target: ATXN1; (+) strand; PAM type: NRG; PAM sequence: AAG
actgataccaaaaaaggtat

SEQ ID NO: 132342 - DNA, 20 bp, Artificial Sequence
  Description of Artificial Sequence: Synthetic oligonucleotide
  Target: ATXN1; (+) strand; PAM type: NRG; PAM sequence: AGG
ctgataccaaaaaaggtata

SEQ ID NO: 132343 - DNA, 20 bp, Artificial Sequence
  Description of Artificial Sequence: Synthetic oligonucleotide
  Target: ATXN1; (+) strand; PAM type: NRG; PAM sequence: AAG
ggtataaggactcaactgtt

SEQ ID NO: 132344 - DNA, 20 bp, Artificial Sequence
  Description of Artificial Sequence: Synthetic oligonucleotide
  Target: ATXN1; (+) strand; PAM type: NRG; PAM sequence: GAG
aatgatgtataatgttgact

SEQ ID NO: 132345 - DNA, 20 bp, Artificial Sequence
  Description of Artificial Sequence: Synthetic oligonucleotide
  Target: ATXN1; (+) strand; PAM type: NRG; PAM sequence: AAG
atgtataatgttgactgaga

SEQ ID NO: 132346 - DNA, 20 bp, Artificial Sequence
  Description of Artificial Sequence: Synthetic oligonucleotide
  Target: ATXN1; (+) strand; PAM type: NRG; PAM sequence: AGG
tgtataatgttgactgagaa

SEQ ID NO: 132347 - DNA, 20 bp, Artificial Sequence
  Description of Artificial Sequence: Synthetic oligonucleotide
  Target: ATXN1; (+) strand; PAM type: NRG; PAM sequence: GGG
gtataatgttgactgagaaa

SEQ ID NO: 132348 - DNA, 20 bp, Artificial Sequence
  Description of Artificial Sequence: Synthetic oligonucleotide
  Target: ATXN1; (+) strand; PAM type: NRG; PAM sequence: CGG
aatgttgactgagaaaggga

SEQ ID NO: 132349 - DNA, 20 bp, Artificial Sequence
  Description of Artificial Sequence: Synthetic oligonucleotide
  Target: ATXN1; (+) strand; PAM type: NRG; PAM sequence: GAG
tgttgactgagaaagggacg

SEQ ID NO: 132350 - DNA, 20 bp, Artificial Sequence
  Description of Artificial Sequence: Synthetic oligonucleotide
  Target: ATXN1; (+) strand; PAM type: NRG; PAM sequence: AAG
gaaagggacggagatcttcg

SEQ ID NO: 132351 - DNA, 20 bp, Artificial Sequence
  Description of Artificial Sequence: Synthetic oligonucleotide
  Target: ATXN1; (+) strand; PAM type: NRG; PAM sequence: AAG
ataatcaaatgtgtatgtct

SEQ ID NO: 132352 - DNA, 20 bp, Artificial Sequence
  Description of Artificial Sequence: Synthetic oligonucleotide
  Target: ATXN1; (+) strand; PAM type: NRG; PAM sequence: CAG
gtgtatgtctaagtcttcca

SEQ ID NO: 132353 - DNA, 20 bp, Artificial Sequence
  Description of Artificial Sequence: Synthetic oligonucleotide
  Target: ATXN1; (+) strand; PAM type: NRG; PAM sequence: AGG
tgtatgtctaagtcttccac

SEQ ID NO: 132354 - DNA, 20 bp, Artificial Sequence
  Description of Artificial Sequence: Synthetic oligonucleotide
  Target: ATXN1; (+) strand; PAM type: NRG; PAM sequence: CGG
tccacaggtgaatacaccta

SEQ ID NO: 132355 - DNA, 20 bp, Artificial Sequence
  Description of Artificial Sequence: Synthetic oligonucleotide
  Target: ATXN1; (+) strand; PAM type: NRG; PAM sequence: AAG
cggttctgcccctgaaccgc

SEQ ID NO: 132356 - DNA, 20 bp, Artificial Sequence
  Description of Artificial Sequence: Synthetic oligonucleotide
  Target: ATXN1; (+) strand; PAM type: NRG; PAM sequence: AGG
ggttctgcccctgaaccgca

SEQ ID NO: 132357 - DNA, 20 bp, Artificial Sequence
  Description of Artificial Sequence: Synthetic oligonucleotide
  Target: ATXN1; (+) strand; PAM type: NRG; PAM sequence: AAG
ccgcaaggccatacctcccc

SEQ ID NO: 132358 - DNA, 20 bp, Artificial Sequence
  Description of Artificial Sequence: Synthetic oligonucleotide
  Target: ATXN1; (+) strand; PAM type: NRG; PAM sequence: GAG
ctccccaagactgactctgt

SEQ ID NO: 132359 - DNA, 20 bp, Artificial Sequence
  Description of Artificial Sequence: Synthetic oligonucleotide
  Target: ATXN1; (+) strand; PAM type: NRG; PAM sequence: AGG
tccccaagactgactctgtg

SEQ ID NO: 132360 - DNA, 20 bp, Artificial Sequence
  Description of Artificial Sequence: Synthetic oligonucleotide
  Target: ATXN1; (+) strand; PAM type: NRG; PAM sequence: GGG
ccccaagactgactctgtga

SEQ ID NO: 132361 - DNA, 20 bp, Artificial Sequence
  Description of Artificial Sequence: Synthetic oligonucleotide
  Target: ATXN1; (+) strand; PAM type: NRG; PAM sequence: CAG
actgactctgtgagggctaa

SEQ ID NO: 132362 - DNA, 20 bp, Artificial Sequence
  Description of Artificial Sequence: Synthetic oligonucleotide
  Target: ATXN1; (+) strand; PAM type: NRG; PAM sequence: AGG
ctgactctgtgagggctaac

SEQ ID NO: 132363 - DNA, 20 bp, Artificial Sequence
  Description of Artificial Sequence: Synthetic oligonucleotide
  Target: ATXN1; (+) strand; PAM type: NRG; PAM sequence: CAG
taacaggctataattgctga

SEQ ID NO: 132364 - DNA, 20 bp, Artificial Sequence
  Description of Artificial Sequence: Synthetic oligonucleotide
  Target: ATXN1; (+) strand; PAM type: NRG; PAM sequence: AGG
aacaggctataattgctgac

SEQ ID NO: 132365 - DNA, 20 bp, Artificial Sequence
  Description of Artificial Sequence: Synthetic oligonucleotide
  Target: ATXN1; (+) strand; PAM type: NRG; PAM sequence: GGG
acaggctataattgctgaca

SEQ ID NO: 132366 - DNA, 20 bp, Artificial Sequence
  Description of Artificial Sequence: Synthetic oligonucleotide
  Target: ATXN1; (+) strand; PAM type: NRG; PAM sequence: GAG
aggctataattgctgacagg

SEQ ID NO: 132367 - DNA, 20 bp, Artificial Sequence
  Description of Artificial Sequence: Synthetic oligonucleotide
  Target: ATXN1; (+) strand; PAM type: NRG; PAM sequence: AGG
ggctataattgctgacaggg

SEQ ID NO: 132368 - DNA, 20 bp, Artificial Sequence
  Description of Artificial Sequence: Synthetic oligonucleotide
  Target: ATXN1; (+) strand; PAM type: NRG; PAM sequence: CAG
attgctgacagggaggtttt

SEQ ID NO: 132369 - DNA, 20 bp, Artificial Sequence
  Description of Artificial Sequence: Synthetic oligonucleotide
  Target: ATXN1; (+) strand; PAM type: NRG; PAM sequence: TAG
gggaggttttcagcttgtca

SEQ ID NO: 132370 - DNA, 20 bp, Artificial Sequence
  Description of Artificial Sequence: Synthetic oligonucleotide
  Target: ATXN1; (+) strand; PAM type: NRG; PAM sequence: GAG
gaggttttcagcttgtcata

SEQ ID NO: 132371 - DNA, 20 bp, Artificial Sequence
  Description of Artificial Sequence: Synthetic oligonucleotide
  Target: ATXN1; (+) strand; PAM type: NRG; PAM sequence: TGG
gtcatagagataaaaaaata

SEQ ID NO: 132372 - DNA, 20 bp, Artificial Sequence
  Description of Artificial Sequence: Synthetic oligonucleotide
  Target: ATXN1; (+) strand; PAM type: NRG; PAM sequence: GAG
aaaaaaatatggttattctt

SEQ ID NO: 132373 - DNA, 20 bp, Artificial Sequence
  Description of Artificial Sequence: Synthetic oligonucleotide
  Target: ATXN1; (+) strand; PAM type: NRG; PAM sequence: AAG
tatggttattcttgagtaat

SEQ ID NO: 132374 - DNA, 20 bp, Artificial Sequence
  Description of Artificial Sequence: Synthetic oligonucleotide
  Target: ATXN1; (+) strand; PAM type: NRG; PAM sequence: TGG
ggttattcttgagtaataag

SEQ ID NO: 132375 - DNA, 20 bp, Artificial Sequence
  Description of Artificial Sequence: Synthetic oligonucleotide
  Target: ATXN1; (+) strand; PAM type: NRG; PAM sequence: AAG
taagtggaaattcgtgaaat

SEQ ID NO: 132376 - DNA, 20 bp, Artificial Sequence
  Description of Artificial Sequence: Synthetic oligonucleotide
  Target: ATXN1; (+) strand; PAM type: NRG; PAM sequence: AAG
gtgaaataagtgatgaaaac

SEQ ID NO: 132377 - DNA, 20 bp, Artificial Sequence
  Description of Artificial Sequence: Synthetic oligonucleotide
  Target: ATXN1; (+) strand; PAM type: NRG; PAM sequence: AGG
tgaaataagtgatgaaaaca

SEQ ID NO: 132378 - DNA, 20 bp, Artificial Sequence
  Description of Artificial Sequence: Synthetic oligonucleotide
  Target: ATXN1; (+) strand; PAM type: NRG; PAM sequence: GGG
gaaataagtgatgaaaacaa

SEQ ID NO: 132379 - DNA, 20 bp, Artificial Sequence
  Description of Artificial Sequence: Synthetic oligonucleotide
  Target: ATXN1; (+) strand; PAM type: NRG; PAM sequence: AAG
gtgatgaaaacaagggtata

SEQ ID NO: 132380 - DNA, 20 bp, Artificial Sequence
  Description of Artificial Sequence: Synthetic oligonucleotide
  Target: ATXN1; (+) strand; PAM type: NRG; PAM sequence: AGG
tgatgaaaacaagggtataa

SEQ ID NO: 132381 - DNA, 20 bp, Artificial Sequence
  Description of Artificial Sequence: Synthetic oligonucleotide
  Target: ATXN1; (+) strand; PAM type: NRG; PAM sequence: CAG
aaacaagggtataaaggcta

SEQ ID NO: 132382 - DNA, 20 bp, Artificial Sequence
  Description of Artificial Sequence: Synthetic oligonucleotide
  Target: ATXN1; (+) strand; PAM type: NRG; PAM sequence: CAG
aaaccctttcctacccaaca

SEQ ID NO: 132383 - DNA, 20 bp, Artificial Sequence
  Description of Artificial Sequence: Synthetic oligonucleotide
  Target: ATXN1; (+) strand; PAM type: NRG; PAM sequence: GAG
accctttcctacccaacaca

SEQ ID NO: 132384 - DNA, 20 bp, Artificial Sequence
  Description of Artificial Sequence: Synthetic oligonucleotide
  Target: ATXN1; (+) strand; PAM type: NRG; PAM sequence: GAG
tttcctacccaacacagagt

SEQ ID NO: 132385 - DNA, 20 bp, Artificial Sequence
  Description of Artificial Sequence: Synthetic oligonucleotide
  Target: ATXN1; (+) strand; PAM type: NRG; PAM sequence: AAG
cccaacacagagtgagacac

SEQ ID NO: 132386 - DNA, 20 bp, Artificial Sequence
  Description of Artificial Sequence: Synthetic oligonucleotide
  Target: ATXN1; (+) strand; PAM type: NRG; PAM sequence: AAG
acagagtgagacacaagccc

SEQ ID NO: 132387 - DNA, 20 bp, Artificial Sequence
  Description of Artificial Sequence: Synthetic oligonucleotide
  Target: ATXN1; (+) strand; PAM type: NRG; PAM sequence: GAG
agagtgagacacaagcccaa

SEQ ID NO: 132388 - DNA, 20 bp, Artificial Sequence
  Description of Artificial Sequence: Synthetic oligonucleotide
  Target: ATXN1; (+) strand; PAM type: NRG; PAM sequence: AAG
caagcccaagagaaaacaaa

SEQ ID NO: 132389 - DNA, 20 bp, Artificial Sequence
  Description of Artificial Sequence: Synthetic oligonucleotide
  Target: ATXN1; (+) strand; PAM type: NRG; PAM sequence: CAG
aagagaaaacaaaaagaaca

SEQ ID NO: 132390 - DNA, 20 bp, Artificial Sequence
  Description of Artificial Sequence: Synthetic oligonucleotide
  Target: ATXN1; (+) strand; PAM type: NRG; PAM sequence: AAG
aaaacaaaaagaacacagca

SEQ ID NO: 132391 - DNA, 20 bp, Artificial Sequence
  Description of Artificial Sequence: Synthetic oligonucleotide
  Target: ATXN1; (+) strand; PAM type: NRG; PAM sequence: CAG
caaaaagaacacagcaaagc

SEQ ID NO: 132392 - DNA, 20 bp, Artificial Sequence
  Description of Artificial Sequence: Synthetic oligonucleotide
  Target: ATXN1; (+) strand; PAM type: NRG; PAM sequence: CAG
aagaacacagcaaagccagc

SEQ ID NO: 132393 - DNA, 20 bp, Artificial Sequence
  Description of Artificial Sequence: Synthetic oligonucleotide
  Target: ATXN1; (+) strand; PAM type: NRG; PAM sequence: GAG
gaacacagcaaagccagcca

SEQ ID NO: 132394 - DNA, 20 bp, Artificial Sequence
  Description of Artificial Sequence: Synthetic oligonucleotide
  Target: ATXN1; (+) strand; PAM type: NRG; PAM sequence: CAG
agccagccagagcatgactt

SEQ ID NO: 132395 - DNA, 20 bp, Artificial Sequence
  Description of Artificial Sequence: Synthetic oligonucleotide
  Target: ATXN1; (+) strand; PAM type: NRG; PAM sequence: AGG
gccagccagagcatgacttc

SEQ ID NO: 132396 - DNA, 20 bp, Artificial Sequence
  Description of Artificial Sequence: Synthetic oligonucleotide
  Target: ATXN1; (+) strand; PAM type: NRG; PAM sequence: GGG
ccagccagagcatgacttca

SEQ ID NO: 132397 - DNA, 20 bp, Artificial Sequence
  Description of Artificial Sequence: Synthetic oligonucleotide
  Target: ATXN1; (+) strand; PAM type: NRG; PAM sequence: TAG
tgacttcagggtgtgctcac

SEQ ID NO: 132398 - DNA, 20 bp, Artificial Sequence
  Description of Artificial Sequence: Synthetic oligonucleotide
  Target: ATXN1; (+) strand; PAM type: NRG; PAM sequence: AGG
gacttcagggtgtgctcact

SEQ ID NO: 132399 - DNA, 20 bp, Artificial Sequence
  Description of Artificial Sequence: Synthetic oligonucleotide
  Target: ATXN1; (+) strand; PAM type: NRG; PAM sequence: AAG
gtgatattatctacgttgaa

SEQ ID NO: 132400 - DNA, 20 bp, Artificial Sequence
  Description of Artificial Sequence: Synthetic oligonucleotide
  Target: ATXN1; (+) strand; PAM type: NRG; PAM sequence: TGG
ttatctacgttgaaaagaca

SEQ ID NO: 132401 - DNA, 20 bp, Artificial Sequence
  Description of Artificial Sequence: Synthetic oligonucleotide
  Target: ATXN1; (+) strand; PAM type: NRG; PAM sequence: AAG
ttgaaaagacatggtacctg

SEQ ID NO: 132402 - DNA, 20 bp, Artificial Sequence
  Description of Artificial Sequence: Synthetic oligonucleotide
  Target: ATXN1; (+) strand; PAM type: NRG; PAM sequence: AAG
agacatggtacctgaagatc

SEQ ID NO: 132403 - DNA, 20 bp, Artificial Sequence
  Description of Artificial Sequence: Synthetic oligonucleotide
  Target: ATXN1; (+) strand; PAM type: NRG; PAM sequence: GAG
acatggtacctgaagatcaa

SEQ ID NO: 132404 - DNA, 20 bp, Artificial Sequence
  Description of Artificial Sequence: Synthetic oligonucleotide
  Target: ATXN1; (+) strand; PAM type: NRG; PAM sequence: GAG
tacctgaagatcaagagttt

SEQ ID NO: 132405 - DNA, 20 bp, Artificial Sequence
  Description of Artificial Sequence: Synthetic oligonucleotide
  Target: ATXN1; (+) strand; PAM type: NRG; PAM sequence: AGG
acctgaagatcaagagtttg

SEQ ID NO: 132406 - DNA, 20 bp, Artificial Sequence
  Description of Artificial Sequence: Synthetic oligonucleotide
  Target: ATXN1; (+) strand; PAM type: NRG; PAM sequence: AAG
agatcaagagtttgaggttt

SEQ ID NO: 132407 - DNA, 20 bp, Artificial Sequence
  Description of Artificial Sequence: Synthetic oligonucleotide
  Target: ATXN1; (+) strand; PAM type: NRG; PAM sequence: AAG
tttctgttttttcttctata

SEQ ID NO: 132408 - DNA, 20 bp, Artificial Sequence
  Description of Artificial Sequence: Synthetic oligonucleotide
  Target: ATXN1; (+) strand; PAM type: NRG; PAM sequence: CAG
gttttttcttctataaagtt

SEQ ID NO: 132409 - DNA, 20 bp, Artificial Sequence
  Description of Artificial Sequence: Synthetic oligonucleotide
  Target: ATXN1; (+) strand; PAM type: NRG; PAM sequence: TGG
taaagttcagtatactttta

SEQ ID NO: 132410 - DNA, 20 bp, Artificial Sequence
  Description of Artificial Sequence: Synthetic oligonucleotide
  Target: ATXN1; (+) strand; PAM type: NRG; PAM sequence: CAG
ttttatggcattttaacttt

SEQ ID NO: 132411 - DNA, 20 bp, Artificial Sequence
  Description of Artificial Sequence: Synthetic oligonucleotide
  Target: ATXN1; (+) strand; PAM type: NRG; PAM sequence: TGG
ggcattttaactttcagttt

SEQ ID NO: 132412 - DNA, 20 bp, Artificial Sequence
  Description of Artificial Sequence: Synthetic oligonucleotide
  Target: ATXN1; (+) strand; PAM type: NRG; PAM sequence: TGG
aactttcagttttggtacct

SEQ ID NO: 132413 - DNA, 20 bp, Artificial Sequence
  Description of Artificial Sequence: Synthetic oligonucleotide
  Target: ATXN1; (+) strand; PAM type: NRG; PAM sequence: GGG
actttcagttttggtacctt

SEQ ID NO: 132414 - DNA, 20 bp, Artificial Sequence
  Description of Artificial Sequence: Synthetic oligonucleotide
  Target: ATXN1; (+) strand; PAM type: NRG; PAM sequence: CAG
gttttggtaccttgggaaca

SEQ ID NO: 132415 - DNA, 20 bp, Artificial Sequence
  Description of Artificial Sequence: Synthetic oligonucleotide
  Target: ATXN1; (+) strand; PAM type: NRG; PAM sequence: TGG
gaacacagcatcctctatct

SEQ ID NO: 132416 - DNA, 20 bp, Artificial Sequence
  Description of Artificial Sequence: Synthetic oligonucleotide
  Target: ATXN1; (+) strand; PAM type: NRG; PAM sequence: CAG
cacagcatcctctatcttgg

SEQ ID NO: 132417 - DNA, 20 bp, Artificial Sequence
  Description of Artificial Sequence: Synthetic oligonucleotide
  Target: ATXN1; (+) strand; PAM type: NRG; PAM sequence: GAG
cagcatcctctatcttggca

SEQ ID NO: 132418 - DNA, 20 bp, Artificial Sequence
  Description of Artificial Sequence: Synthetic oligonucleotide
  Target: ATXN1; (+) strand; PAM type: NRG; PAM sequence: AAG
tcctctatcttggcagagtt

SEQ ID NO: 132419 - DNA, 20 bp, Artificial Sequence
  Description of Artificial Sequence: Synthetic oligonucleotide
  Target: ATXN1; (+) strand; PAM type: NRG; PAM sequence: TGG
tctatcttggcagagttaag

SEQ ID NO: 132420 - DNA, 20 bp, Artificial Sequence
  Description of Artificial Sequence: Synthetic oligonucleotide
  Target: ATXN1; (+) strand; PAM type: NRG; PAM sequence: GGG
ctatcttggcagagttaagt

SEQ ID NO: 132421 - DNA, 20 bp, Artificial Sequence
  Description of Artificial Sequence: Synthetic oligonucleotide
  Target: ATXN1; (+) strand; PAM type: NRG; PAM sequence: GGG
tatcttggcagagttaagtg

SEQ ID NO: 132422 - DNA, 20 bp, Artificial Sequence
  Description of Artificial Sequence: Synthetic oligonucleotide
  Target: ATXN1; (+) strand; PAM type: NRG; PAM sequence: TGG
agagttaagtggggcatgaa

SEQ ID NO: 132423 - DNA, 20 bp, Artificial Sequence
  Description of Artificial Sequence: Synthetic oligonucleotide
  Target: ATXN1; (+) strand; PAM type: NRG; PAM sequence: AAG
ggcatgaatggccttttcct

SEQ ID NO: 132424 - DNA, 20 bp, Artificial Sequence
  Description of Artificial Sequence: Synthetic oligonucleotide
  Target: ATXN1; (+) strand; PAM type: NRG; PAM sequence: TAG
atgaatggccttttcctaag

SEQ ID NO: 132425 - DNA, 20 bp, Artificial Sequence
  Description of Artificial Sequence: Synthetic oligonucleotide
  Target: ATXN1; (+) strand; PAM type: NRG; PAM sequence: TGG
tggccttttcctaagtagaa

SEQ ID NO: 132426 - DNA, 20 bp, Artificial Sequence
  Description of Artificial Sequence: Synthetic oligonucleotide
  Target: ATXN1; (+) strand; PAM type: NRG; PAM sequence: CAG
taagtagaatggtgatttaa

SEQ ID NO: 132427 - DNA, 20 bp, Artificial Sequence
  Description of Artificial Sequence: Synthetic oligonucleotide
  Target: ATXN1; (+) strand; PAM type: NRG; PAM sequence: GAG
agtagaatggtgatttaaca

SEQ ID NO: 132428 - DNA, 20 bp, Artificial Sequence
  Description of Artificial Sequence: Synthetic oligonucleotide
  Target: ATXN1; (+) strand; PAM type: NRG; PAM sequence: GAG
tgatttaacagagtttttat

SEQ ID NO: 132429 - DNA, 20 bp, Artificial Sequence
  Description of Artificial Sequence: Synthetic oligonucleotide
  Target: ATXN1; (+) strand; PAM type: NRG; PAM sequence: TGG
taacagagtttttatgagta

SEQ ID NO: 132430 - DNA, 20 bp, Artificial Sequence
  Description of Artificial Sequence: Synthetic oligonucleotide
  Target: ATXN1; (+) strand; PAM type: NRG; PAM sequence: CAG
tttttatgagtatggtccaa

SEQ ID NO: 132431 - DNA, 20 bp, Artificial Sequence
  Description of Artificial Sequence: Synthetic oligonucleotide
  Target: ATXN1; (+) strand; PAM type: NRG; PAM sequence: TAG
ttatgagtatggtccaacag

SEQ ID NO: 132432 - DNA, 20 bp, Artificial Sequence
  Description of Artificial Sequence: Synthetic oligonucleotide
  Target: ATXN1; (+) strand; PAM type: NRG; PAM sequence: AAG
gtagacctgacatttttatc

SEQ ID NO: 132433 - DNA, 20 bp, Artificial Sequence
  Description of Artificial Sequence: Synthetic oligonucleotide
  Target: ATXN1; (+) strand; PAM type: NRG; PAM sequence: GAG
agacctgacatttttatcaa

SEQ ID NO: 132434 - DNA, 20 bp, Artificial Sequence
  Description of Artificial Sequence: Synthetic oligonucleotide
  Target: ATXN1; (+) strand; PAM type: NRG; PAM sequence: AGG
gacctgacatttttatcaag

SEQ ID NO: 132435 - DNA, 20 bp, Artificial Sequence
  Description of Artificial Sequence: Synthetic oligonucleotide
  Target: ATXN1; (+) strand; PAM type: NRG; PAM sequence: CAG
tgacatttttatcaagagga

SEQ ID NO: 132436 - DNA, 20 bp, Artificial Sequence
  Description of Artificial Sequence: Synthetic oligonucleotide
  Target: ATXN1; (+) strand; PAM type: NRG; PAM sequence: AAG
catttttatcaagaggacag

SEQ ID NO: 132437 - DNA, 20 bp, Artificial Sequence
  Description of Artificial Sequence: Synthetic oligonucleotide
  Target: ATXN1; (+) strand; PAM type: NRG; PAM sequence: CAG
tatcaagaggacagaagtgt

SEQ ID NO: 132438 - DNA, 20 bp, Artificial Sequence
  Description of Artificial Sequence: Synthetic oligonucleotide
  Target: ATXN1; (+) strand; PAM type: NRG; PAM sequence: AAG
ggacagaagtgtcagtttga

SEQ ID NO: 132439 - DNA, 20 bp, Artificial Sequence
  Description of Artificial Sequence: Synthetic oligonucleotide
  Target: ATXN1; (+) strand; PAM type: NRG; PAM sequence: TGG
agatcttctaacactgttca

SEQ ID NO: 132440 - DNA, 20 bp, Artificial Sequence
  Description of Artificial Sequence: Synthetic oligonucleotide
  Target: ATXN1; (+) strand; PAM type: NRG; PAM sequence: TAG
acactgttcatggctactgc

SEQ ID NO: 132441 - DNA, 20 bp, Artificial Sequence
  Description of Artificial Sequence: Synthetic oligonucleotide
  Target: ATXN1; (+) strand; PAM type: NRG; PAM sequence: AGG
cactgttcatggctactgct

SEQ ID NO: 132442 - DNA, 20 bp, Artificial Sequence
  Description of Artificial Sequence: Synthetic oligonucleotide
  Target: ATXN1; (+) strand; PAM type: NRG; PAM sequence: CAG
ttcatggctactgctaggaa

SEQ ID NO: 132443 - DNA, 20 bp, Artificial Sequence
  Description of Artificial Sequence: Synthetic oligonucleotide
  Target: ATXN1; (+) strand; PAM type: NRG; PAM sequence: GAG
catggctactgctaggaaca

SEQ ID NO: 132444 - DNA, 20 bp, Artificial Sequence
  Description of Artificial Sequence: Synthetic oligonucleotide
  Target: ATXN1; (+) strand; PAM type: NRG; PAM sequence: TAG
ggctactgctaggaacagag

SEQ ID NO: 132445 - DNA, 20 bp, Artificial Sequence
  Description of Artificial Sequence: Synthetic oligonucleotide
  Target: ATXN1; (+) strand; PAM type: NRG; PAM sequence: AGG
gctactgctaggaacagagt

SEQ ID NO: 132446 - DNA, 20 bp, Artificial Sequence
  Description of Artificial Sequence: Synthetic oligonucleotide
  Target: ATXN1; (+) strand; PAM type: NRG; PAM sequence: GGG
ctactgctaggaacagagta

SEQ ID NO: 132447 - DNA, 20 bp, Artificial Sequence
  Description of Artificial Sequence: Synthetic oligonucleotide
  Target: ATXN1; (+) strand; PAM type: NRG; PAM sequence: TGG
atctttcccttctttttatg

SEQ ID NO: 132448 - DNA, 20 bp, Artificial Sequence
  Description of Artificial Sequence: Synthetic oligonucleotide
  Target: ATXN1; (+) strand; PAM type: NRG; PAM sequence: GAG
ctttcccttctttttatgtg

SEQ ID NO: 132449 - DNA, 20 bp, Artificial Sequence
  Description of Artificial Sequence: Synthetic oligonucleotide
  Target: ATXN1; (+) strand; PAM type: NRG; PAM sequence: AGG
tttcccttctttttatgtgg

SEQ ID NO: 132450 - DNA, 20 bp, Artificial Sequence
  Description of Artificial Sequence: Synthetic oligonucleotide
  Target: ATXN1; (+) strand; PAM type: NRG; PAM sequence: GGG
ttcccttctttttatgtgga

SEQ ID NO: 132451 - DNA, 20 bp, Artificial Sequence
  Description of Artificial Sequence: Synthetic oligonucleotide
  Target: ATXN1; (+) strand; PAM type: NRG; PAM sequence: CAG
ccttctttttatgtggaggg

SEQ ID NO: 132452 - DNA, 20 bp, Artificial Sequence
  Description of Artificial Sequence: Synthetic oligonucleotide
  Target: ATXN1; (+) strand; PAM type: NRG; PAM sequence: AGG
cttctttttatgtggagggc

SEQ ID NO: 132453 - DNA, 20 bp, Artificial Sequence
  Description of Artificial Sequence: Synthetic oligonucleotide
  Target: ATXN1; (+) strand; PAM type: NRG; PAM sequence: GGG
ttctttttatgtggagggca

SEQ ID NO: 132454 - DNA, 20 bp, Artificial Sequence
  Description of Artificial Sequence: Synthetic oligonucleotide
  Target: ATXN1; (+) strand; PAM type: NRG; PAM sequence: AAG
gtggagggcagggactcctt

SEQ ID NO: 132455 - DNA, 20 bp, Artificial Sequence
  Description of Artificial Sequence: Synthetic oligonucleotide
  Target: ATXN1; (+) strand; PAM type: NRG; PAM sequence: TAG
gagggcagggactccttaag

SEQ ID NO: 132456 - DNA, 20 bp, Artificial Sequence
  Description of Artificial Sequence: Synthetic oligonucleotide
  Target: ATXN1; (+) strand; PAM type: NRG; PAM sequence: AGG
agggcagggactccttaagt

SEQ ID NO: 132457 - DNA, 20 bp, Artificial Sequence
  Description of Artificial Sequence: Synthetic oligonucleotide
  Target: ATXN1; (+) strand; PAM type: NRG; PAM sequence: TGG
actccttaagtaggctgacc

SEQ ID NO: 132458 - DNA, 20 bp, Artificial Sequence
  Description of Artificial Sequence: Synthetic oligonucleotide
  Target: ATXN1; (+) strand; PAM type: NRG; PAM sequence: CAG
ggctgacctggccattcatt

SEQ ID NO: 132459 - DNA, 20 bp, Artificial Sequence
  Description of Artificial Sequence: Synthetic oligonucleotide
  Target: ATXN1; (+) strand; PAM type: NRG; PAM sequence: TAG
acctggccattcattcagtc

SEQ ID NO: 132460 - DNA, 20 bp, Artificial Sequence
  Description of Artificial Sequence: Synthetic oligonucleotide
  Target: ATXN1; (+) strand; PAM type: NRG; PAM sequence: AAG
ccattcattcagtctagcct

SEQ ID NO: 132461 - DNA, 20 bp, Artificial Sequence
  Description of Artificial Sequence: Synthetic oligonucleotide
  Target: ATXN1; (+) strand; PAM type: NRG; PAM sequence: CAG
attcagtctagcctaagcca

SEQ ID NO: 132462 - DNA, 20 bp, Artificial Sequence
  Description of Artificial Sequence: Synthetic oligonucleotide
  Target: ATXN1; (+) strand; PAM type: NRG; PAM sequence: AGG
ttcagtctagcctaagccac

SEQ ID NO: 132463 - DNA, 20 bp, Artificial Sequence
  Description of Artificial Sequence: Synthetic oligonucleotide
  Target: ATXN1; (+) strand; PAM type: NRG; PAM sequence: TGG
agcctaagccacaggctttc

SEQ ID NO: 132464 - DNA, 20 bp, Artificial Sequence
  Description of Artificial Sequence: Synthetic oligonucleotide
  Target: ATXN1; (+) strand; PAM type: NRG; PAM sequence: CAG
aggctttctggcccacattc

SEQ ID NO: 132465 - DNA, 20 bp, Artificial Sequence
  Description of Artificial Sequence: Synthetic oligonucleotide
  Target: ATXN1; (+) strand; PAM type: NRG; PAM sequence: AAG
tctggcccacattccagcgt

SEQ ID NO: 132466 - DNA, 20 bp, Artificial Sequence
  Description of Artificial Sequence: Synthetic oligonucleotide
  Target: ATXN1; (+) strand; PAM type: NRG; PAM sequence: CAG
ggcccacattccagcgtaag

SEQ ID NO: 132467 - DNA, 20 bp, Artificial Sequence
  Description of Artificial Sequence: Synthetic oligonucleotide
  Target: ATXN1; (+) strand; PAM type: NRG; PAM sequence: TAG
tttaatcctccttcctcacc

SEQ ID NO: 132468 - DNA, 20 bp, Artificial Sequence
  Description of Artificial Sequence: Synthetic oligonucleotide
  Target: ATXN1; (+) strand; PAM type: NRG; PAM sequence: TAG
gaatacattattcctcgatg

SEQ ID NO: 132469 - DNA, 20 bp, Artificial Sequence
  Description of Artificial Sequence: Synthetic oligonucleotide
  Target: ATXN1; (+) strand; PAM type: NRG; PAM sequence: AGG
aatacattattcctcgatgt

SEQ ID NO: 132470 - DNA, 20 bp, Artificial Sequence
  Description of Artificial Sequence: Synthetic oligonucleotide
  Target: ATXN1; (+) strand; PAM type: NRG; PAM sequence: TGG
gcatgcaaatatctgctgaa

SEQ ID NO: 132471 - DNA, 20 bp, Artificial Sequence
  Description of Artificial Sequence: Synthetic oligonucleotide
  Target: ATXN1; (+) strand; PAM type: NRG; PAM sequence: CAG
atctgctgaatggattattt

SEQ ID NO: 132472 - DNA, 20 bp, Artificial Sequence
  Description of Artificial Sequence: Synthetic oligonucleotide
  Target: ATXN1; (+) strand; PAM type: NRG; PAM sequence: TGG
tgaatggattatttcagtta

SEQ ID NO: 132473 - DNA, 20 bp, Artificial Sequence
  Description of Artificial Sequence: Synthetic oligonucleotide
  Target: ATXN1; (+) strand; PAM type: NRG; PAM sequence: TAG
atttcagttatggacaccaa

SEQ ID NO: 132474 - DNA, 20 bp, Artificial Sequence
  Description of Artificial Sequence: Synthetic oligonucleotide
  Target: ATXN1; (+) strand; PAM type: NRG; PAM sequence: CAG
ggacaccaatagtacctgtc

SEQ ID NO: 132475 - DNA, 20 bp, Artificial Sequence
  Description of Artificial Sequence: Synthetic oligonucleotide
  Target: ATXN1; (+) strand; PAM type: NRG; PAM sequence: CAG
cctgtccagtaaatatgacc

SEQ ID NO: 132476 - DNA, 20 bp, Artificial Sequence
  Description of Artificial Sequence: Synthetic oligonucleotide
  Target: ATXN1; (+) strand; PAM type: NRG; PAM sequence: AAG
ctccaaatccaacaattact

SEQ ID NO: 132477 - DNA, 20 bp, Artificial Sequence
  Description of Artificial Sequence: Synthetic oligonucleotide
  Target: ATXN1; (+) strand; PAM type: NRG; PAM sequence: TAG
tcccaacaccctcaaacgaa

SEQ ID NO: 132478 - DNA, 20 bp, Artificial Sequence
  Description of Artificial Sequence: Synthetic oligonucleotide
  Target: ATXN1; (+) strand; PAM type: NRG; PAM sequence: AGG
cccaacaccctcaaacgaat

SEQ ID NO: 132479 - DNA, 20 bp, Artificial Sequence
  Description of Artificial Sequence: Synthetic oligonucleotide
  Target: ATXN1; (+) strand; PAM type: NRG; PAM sequence: TGG
tcccctgtttctcccaactc

SEQ ID NO: 132480 - DNA, 20 bp, Artificial Sequence
  Description of Artificial Sequence: Synthetic oligonucleotide
  Target: ATXN1; (+) strand; PAM type: NRG; PAM sequence: CGG
caccctacatacattgtcac

SEQ ID NO: 132481 - DNA, 20 bp, Artificial Sequence
  Description of Artificial Sequence: Synthetic oligonucleotide
  Target: ATXN1; (+) strand; PAM type: NRG; PAM sequence: CAG
acatacattgtcaccggttt

SEQ ID NO: 132482 - DNA, 20 bp, Artificial Sequence
  Description of Artificial Sequence: Synthetic oligonucleotide
  Target: ATXN1; (+) strand; PAM type: NRG; PAM sequence: GAG
tatatacacacaaactcact

SEQ ID NO: 132483 - DNA, 20 bp, Artificial Sequence
  Description of Artificial Sequence: Synthetic oligonucleotide
  Target: ATXN1; (+) strand; PAM type: NRG; PAM sequence: AAG
actgagccccttccataaac

SEQ ID NO: 132484 - DNA, 20 bp, Artificial Sequence
  Description of Artificial Sequence: Synthetic oligonucleotide
  Target: ATXN1; (+) strand; PAM type: NRG; PAM sequence: TGG
ccccttccataaacaagaac

SEQ ID NO: 132485 - DNA, 20 bp, Artificial Sequence
  Description of Artificial Sequence: Synthetic oligonucleotide
  Target: ATXN1; (+) strand; PAM type: NRG; PAM sequence: GGG
cccttccataaacaagaact

SEQ ID NO: 132486 - DNA, 20 bp, Artificial Sequence
  Description of Artificial Sequence: Synthetic oligonucleotide
  Target: ATXN1; (+) strand; PAM type: NRG; PAM sequence: CAG
ttaacttcacattcctccgc

SEQ ID NO: 132487 - DNA, 20 bp, Artificial Sequence
  Description of Artificial Sequence: Synthetic oligonucleotide
  Target: ATXN1; (+) strand; PAM type: NRG; PAM sequence: AGG
taacttcacattcctccgcc

SEQ ID NO: 132488 - DNA, 20 bp, Artificial Sequence
  Description of Artificial Sequence: Synthetic oligonucleotide
  Target: ATXN1; (+) strand; PAM type: NRG; PAM sequence: TAG
cacattcctccgccaggtct

SEQ ID NO: 132489 - DNA, 20 bp, Artificial Sequence
  Description of Artificial Sequence: Synthetic oligonucleotide
  Target: ATXN1; (+) strand; PAM type: NRG; PAM sequence: TAG
gccaggtcttagtgatcctt

SEQ ID NO: 132490 - DNA, 20 bp, Artificial Sequence
  Description of Artificial Sequence: Synthetic oligonucleotide
  Target: ATXN1; (+) strand; PAM type: NRG; PAM sequence: CAG
ctttagctctgttatcccca

SEQ ID NO: 132491 - DNA, 20 bp, Artificial Sequence
  Description of Artificial Sequence: Synthetic oligonucleotide
  Target: ATXN1; (+) strand; PAM type: NRG; PAM sequence: CAG
ttctctttcataccaatctc

SEQ ID NO: 132492 - DNA, 20 bp, Artificial Sequence
  Description of Artificial Sequence: Synthetic oligonucleotide
  Target: ATXN1; (+) strand; PAM type: NRG; PAM sequence: TGG
caatgcacatataactccgc

SEQ ID NO: 132493 - DNA, 20 bp, Artificial Sequence
  Description of Artificial Sequence: Synthetic oligonucleotide
  Target: ATXN1; (+) strand; PAM type: NRG; PAM sequence: CAG
cccctccaacatatcccatg

SEQ ID NO: 132494 - DNA, 20 bp, Artificial Sequence
  Description of Artificial Sequence: Synthetic oligonucleotide
  Target: ATXN1; (+) strand; PAM type: NRG; PAM sequence: AGG
ccctccaacatatcccatgc

SEQ ID NO: 132495 - DNA, 20 bp, Artificial Sequence
  Description of Artificial Sequence: Synthetic oligonucleotide
  Target: ATXN1; (+) strand; PAM type: NRG; PAM sequence: CAG
ctgtgcctacaatgacccct

SEQ ID NO: 132496 - DNA, 20 bp, Artificial Sequence
  Description of Artificial Sequence: Synthetic oligonucleotide
  Target: ATXN1; (+) strand; PAM type: NRG; PAM sequence: AAG
tcatcactacacatcctgtt

SEQ ID NO: 132497 - DNA, 20 bp, Artificial Sequence
  Description of Artificial Sequence: Synthetic oligonucleotide
  Target: ATXN1; (+) strand; PAM type: NRG; PAM sequence: AGG
catcactacacatcctgtta

SEQ ID NO: 132498 - DNA, 20 bp, Artificial Sequence
  Description of Artificial Sequence: Synthetic oligonucleotide
  Target: ATXN1; (+) strand; PAM type: NRG; PAM sequence: CAG
catcctgttaaggtccctgt

SEQ ID NO: 132499 - DNA, 20 bp, Artificial Sequence
  Description of Artificial Sequence: Synthetic oligonucleotide
  Target: ATXN1; (+) strand; PAM type: NRG; PAM sequence: AGG
atcctgttaaggtccctgtc

SEQ ID NO: 132500 - DNA, 20 bp, Artificial Sequence
  Description of Artificial Sequence: Synthetic oligonucleotide
  Target: ATXN1; (+) strand; PAM type: NRG; PAM sequence: TAG
ctgtcaggctttgcttctca

SEQ ID NO: 132501 - DNA, 20 bp, Artificial Sequence
  Description of Artificial Sequence: Synthetic oligonucleotide
  Target: ATXN1; (+) strand; PAM type: NRG; PAM sequence: AGG
tgtcaggctttgcttctcat

SEQ ID NO: 132502 - DNA, 20 bp, Artificial Sequence
  Description of Artificial Sequence: Synthetic oligonucleotide
  Target: ATXN1; (+) strand; PAM type: NRG; PAM sequence: AAG
caggctttgcttctcatagg

SEQ ID NO: 132503 - DNA, 20 bp, Artificial Sequence
  Description of Artificial Sequence: Synthetic oligonucleotide
  Target: ATXN1; (+) strand; PAM type: NRG; PAM sequence: AAG
ctcataggaagctcttcctg

SEQ ID NO: 132504 - DNA, 20 bp, Artificial Sequence
  Description of Artificial Sequence: Synthetic oligonucleotide
  Target: ATXN1; (+) strand; PAM type: NRG; PAM sequence: CAG
ttcctgaagactccaatccc

SEQ ID NO: 132505 - DNA, 20 bp, Artificial Sequence
  Description of Artificial Sequence: Synthetic oligonucleotide
  Target: ATXN1; (+) strand; PAM type: NRG; PAM sequence: TGG
tcctcttctgaacctgacac

SEQ ID NO: 132506 - DNA, 20 bp, Artificial Sequence
  Description of Artificial Sequence: Synthetic oligonucleotide
  Target: ATXN1; (+) strand; PAM type: NRG; PAM sequence: CAG
ggcaccccattacaaattct

SEQ ID NO: 132507 - DNA, 20 bp, Artificial Sequence
  Description of Artificial Sequence: Synthetic oligonucleotide
  Target: ATXN1; (+) strand; PAM type: NRG; PAM sequence: TGG
ttctcagttgtctgttgtca

SEQ ID NO: 132508 - DNA, 20 bp, Artificial Sequence
  Description of Artificial Sequence: Synthetic oligonucleotide
  Target: ATXN1; (+) strand; PAM type: NRG; PAM sequence: TGG
tgctctataattgcttcctg

SEQ ID NO: 132509 - DNA, 20 bp, Artificial Sequence
  Description of Artificial Sequence: Synthetic oligonucleotide
  Target: ATXN1; (+) strand; PAM type: NRG; PAM sequence: TGG
tataattgcttcctgtggat

SEQ ID NO: 132510 - DNA, 20 bp, Artificial Sequence
  Description of Artificial Sequence: Synthetic oligonucleotide
  Target: ATXN1; (+) strand; PAM type: NRG; PAM sequence: TAG
attggtattgtgccctgaac

SEQ ID NO: 132511 - DNA, 20 bp, Artificial Sequence
  Description of Artificial Sequence: Synthetic oligonucleotide
  Target: ATXN1; (+) strand; PAM type: NRG; PAM sequence: TGG
tgttttgttttgttttttga

SEQ ID NO: 132512 - DNA, 20 bp, Artificial Sequence
  Description of Artificial Sequence: Synthetic oligonucleotide
  Target: ATXN1; (+) strand; PAM type: NRG; PAM sequence: GAG
ttttgttttgttttttgatg

SEQ ID NO: 132513 - DNA, 20 bp, Artificial Sequence
  Description of Artificial Sequence: Synthetic oligonucleotide
  Target: ATXN1; (+) strand; PAM type: NRG; PAM sequence: CAG
tggagtctcactctgtcacc

SEQ ID NO: 132514 - DNA, 20 bp, Artificial Sequence
  Description of Artificial Sequence: Synthetic oligonucleotide
  Target: ATXN1; (+) strand; PAM type: NRG; PAM sequence: AGG
ggagtctcactctgtcaccc

SEQ ID NO: 132515 - DNA, 20 bp, Artificial Sequence
  Description of Artificial Sequence: Synthetic oligonucleotide
  Target: ATXN1; (+) strand; PAM type: NRG; PAM sequence: TGG
tctcactctgtcacccaggc

SEQ ID NO: 132516 - DNA, 20 bp, Artificial Sequence
  Description of Artificial Sequence: Synthetic oligonucleotide
  Target: ATXN1; (+) strand; PAM type: NRG; PAM sequence: GAG
tcactctgtcacccaggctg

SEQ ID NO: 132517 - DNA, 20 bp, Artificial Sequence
  Description of Artificial Sequence: Synthetic oligonucleotide
  Target: ATXN1; (+) strand; PAM type: NRG; PAM sequence: CAG
ctgtcacccaggctggagtg

SEQ ID NO: 132518 - DNA, 20 bp, Artificial Sequence
  Description of Artificial Sequence: Synthetic oligonucleotide
  Target: ATXN1; (+) strand; PAM type: NRG; PAM sequence: TGG
tcacccaggctggagtgcag

SEQ ID NO: 132519 - DNA, 20 bp, Artificial Sequence
  Description of Artificial Sequence: Synthetic oligonucleotide
  Target: ATXN1; (+) strand; PAM type: NRG; PAM sequence: CGG
ccaggctggagtgcagtggc

SEQ ID NO: 132520 - DNA, 20 bp, Artificial Sequence
  Description of Artificial Sequence: Synthetic oligonucleotide
  Target: ATXN1; (+) strand; PAM type: NRG; PAM sequence: CAG
ggagtgcagtggccggatct

SEQ ID NO: 132521 - DNA, 20 bp, Artificial Sequence
  Description of Artificial Sequence: Synthetic oligonucleotide
  Target: ATXN1; (+) strand; PAM type: NRG; PAM sequence: CAG
tcactgcaacctctgccttc

SEQ ID NO: 132522 - DNA, 20 bp, Artificial Sequence
  Description of Artificial Sequence: Synthetic oligonucleotide
  Target: ATXN1; (+) strand; PAM type: NRG; PAM sequence: AGG
cactgcaacctctgccttcc

SEQ ID NO: 132523 - DNA, 20 bp, Artificial Sequence
  Description of Artificial Sequence: Synthetic oligonucleotide
  Target: ATXN1; (+) strand; PAM type: NRG; PAM sequence: AAG
aacctctgccttccaggttc

SEQ ID NO: 132524 - DNA, 20 bp, Artificial Sequence
  Description of Artificial Sequence: Synthetic oligonucleotide
  Target: ATXN1; (+) strand; PAM type: NRG; PAM sequence: CAG
ttcaagcaattctcttgcct

SEQ ID NO: 132525 - DNA, 20 bp, Artificial Sequence
  Description of Artificial Sequence: Synthetic oligonucleotide
  Target: ATXN1; (+) strand; PAM type: NRG; PAM sequence: AAG
ttctcttgcctcagcctccc

SEQ ID NO: 132526 - DNA, 20 bp, Artificial Sequence
  Description of Artificial Sequence: Synthetic oligonucleotide
  Target: ATXN1; (+) strand; PAM type: NRG; PAM sequence: TAG
tcttgcctcagcctcccaag

SEQ ID NO: 132527 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaagtagc

SEQ ID NO: 132528 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaagtagct

SEQ ID NO: 132529 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtagctgggatta

SEQ ID NO: 132530 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagctgggattac

SEQ ID NO: 132531 - DNA, 20 bp, Artificial Sequence
  Description of Artificial Sequence: Synthetic oligonucleotide
  Target: ATXN1; (+) strand; PAM type: NRG; PAM sequence: TAG
caggtacacaccaccatgcc

SEQ ID NO: 132532 - DNA, 20 bp, Artificial Sequence
  Description of Artificial Sequence: Synthetic oligonucleotide
  Target: ATXN1; (+) strand; PAM type: NRG; PAM sequence: GAG
atttatttatttatttattt

SEQ ID NO: 132533 - DNA, 20 bp, Artificial Sequence
  Description of Artificial Sequence: Synthetic oligonucleotide
  Target: ATXN1; (+) strand; PAM type: NRG; PAM sequence: CGG
atttatttatttatttgaga

SEQ ID NO: 132534 - DNA, 20 bp, Artificial Sequence
  Description of Artificial Sequence: Synthetic oligonucleotide
  Target: ATXN1; (+) strand; PAM type: NRG; PAM sequence: GAG
ttatttatttatttgagacg

SEQ ID NO: 132535 - DNA, 20 bp, Artificial Sequence
  Description of Artificial Sequence: Synthetic oligonucleotide
  Target: ATXN1; (+) strand; PAM type: NRG; PAM sequence: CAG
cggagtctcgctctgtcgcc

SEQ ID NO: 132536 - DNA, 20 bp, Artificial Sequence
  Description of Artificial Sequence: Synthetic oligonucleotide
  Target: ATXN1; (+) strand; PAM type: NRG; PAM sequence: AGG
ggagtctcgctctgtcgccc

SEQ ID NO: 132537 - DNA, 20 bp, Artificial Sequence
  Description of Artificial Sequence: Synthetic oligonucleotide
  Target: ATXN1; (+) strand; PAM type: NRG; PAM sequence: TGG
tctcgctctgtcgcccaggc

SEQ ID NO: 132538 - DNA, 20 bp, Artificial Sequence
  Description of Artificial Sequence: Synthetic oligonucleotide
  Target: ATXN1; (+) strand; PAM type: NRG; PAM sequence: CAG
ctgtcgcccaggctggcatg

SEQ ID NO: 132539 - DNA, 20 bp, Artificial Sequence
  Description of Artificial Sequence: Synthetic oligonucleotide
  Target: ATXN1; (+) strand; PAM type: NRG; PAM sequence: TGG
tcgcccaggctggcatgcag

SEQ ID NO: 132540 - DNA, 20 bp, Artificial Sequence
  Description of Artificial Sequence: Synthetic oligonucleotide
  Target: ATXN1; (+) strand; PAM type: NRG; PAM sequence: CGG
ggcatgcagtggcgcgatct

SEQ ID NO: 132541 - DNA, 20 bp, Artificial Sequence
  Description of Artificial Sequence: Synthetic oligonucleotide
  Target: ATXN1; (+) strand; PAM type: NRG; PAM sequence: CGG
ctcactgcaacctctgcctc

SEQ ID NO: 132542 - DNA, 20 bp, Artificial Sequence
  Description of Artificial Sequence: Synthetic oligonucleotide
  Target: ATXN1; (+) strand; PAM type: NRG; PAM sequence: GGG
tcactgcaacctctgcctcc

SEQ ID NO: 132543 - DNA, 20 bp, Artificial Sequence
  Description of Artificial Sequence: Synthetic oligonucleotide
  Target: ATXN1; (+) strand; PAM type: NRG; PAM sequence: GGG
cactgcaacctctgcctccg

SEQ ID NO: 132544 - DNA, 20 bp, Artificial Sequence
  Description of Artificial Sequence: Synthetic oligonucleotide
  Target: ATXN1; (+) strand; PAM type: NRG; PAM sequence: AAG
aacctctgcctccggggttc

SEQ ID NO: 132545 - DNA, 20 bp, Artificial Sequence
  Description of Artificial Sequence: Synthetic oligonucleotide
  Target: ATXN1; (+) strand; PAM type: NRG; PAM sequence: CAG
ttcaagtgcttctcctgcct

SEQ ID NO: 132546 - DNA, 20 bp, Artificial Sequence
  Description of Artificial Sequence: Synthetic oligonucleotide
  Target: ATXN1; (+) strand; PAM type: NRG; PAM sequence: GAG
ttctcctgcctcagcctctt

SEQ ID NO: 132547 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcttgag

SEQ ID NO: 132548 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcttgagtagc

SEQ ID NO: 132549 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcttgagtagct

SEQ ID NO: 132550 - DNA, 20 bp, Artificial Sequence
  Description of Artificial Sequence: Synthetic oligonucleotide
  Target: ATXN1; (+) strand; PAM type: NRG; PAM sequence: CAG
ctcttgagtagctgggatta

SEQ ID NO: 132551 - DNA, 20 bp, Artificial Sequence
  Description of Artificial Sequence: Synthetic oligonucleotide
  Target: ATXN1; (+) strand; PAM type: NRG; PAM sequence: AGG
tcttgagtagctgggattac

SEQ ID NO: 132552 - DNA, 20 bp, Artificial Sequence
  Description of Artificial Sequence: Synthetic oligonucleotide
  Target: ATXN1; (+) strand; PAM type: NRG; PAM sequence: CAG
caggcatgcgccaccatgcc

SEQ ID NO: 132553 - DNA, 20 bp, Artificial Sequence
  Description of Artificial Sequence: Synthetic oligonucleotide
  Target: ATXN1; (+) strand; PAM type: NRG; PAM sequence: TAG
gctaattttatttgtatttt

SEQ ID NO: 132554 - DNA, 20 bp, Artificial Sequence
  Description of Artificial Sequence: Synthetic oligonucleotide
  Target: ATXN1; (+) strand; PAM type: NRG; PAM sequence: TAG
aattttatttgtatttttag

SEQ ID NO: 132555 - DNA, 20 bp, Artificial Sequence
  Description of Artificial Sequence: Synthetic oligonucleotide
  Target: ATXN1; (+) strand; PAM type: NRG; PAM sequence: CGG
atttgtatttttagtagaaa

SEQ ID NO: 132556 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtagaaac

SEQ ID NO: 132557 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagaaacg

SEQ ID NO: 132558 - DNA, 20 bp, Artificial Sequence
  Description of Artificial Sequence: Synthetic oligonucleotide
  Target: ATXN1; (+) strand; PAM type: NRG; PAM sequence: CAG
cggggtttctccatgttgct

SEQ ID NO: 132559 - DNA, 20 bp, Artificial Sequence
  Description of Artificial Sequence: Synthetic oligonucleotide
  Target: ATXN1; (+) strand; PAM type: NRG; PAM sequence: AGG
ggggtttctccatgttgctc

SEQ ID NO: 132560 - DNA, 20 bp, Artificial Sequence
  Description of Artificial Sequence: Synthetic oligonucleotide
  Target: ATXN1; (+) strand; PAM type: NRG; PAM sequence: GGG
gggtttctccatgttgctca

SEQ ID NO: 132561 - DNA, 20 bp, Artificial Sequence
  Description of Artificial Sequence: Synthetic oligonucleotide
  Target: ATXN1; (+) strand; PAM type: NRG; PAM sequence: TGG
tttctccatgttgctcaggg

SEQ ID NO: 132562 - DNA, 20 bp, Artificial Sequence
  Description of Artificial Sequence: Synthetic oligonucleotide
  Target: ATXN1; (+) strand; PAM type: NRG; PAM sequence: CAG
tggtctcgaactcccgacct

SEQ ID NO: 132563 - DNA, 20 bp, Artificial Sequence
  Description of Artificial Sequence: Synthetic oligonucleotide
  Target: ATXN1; (+) strand; PAM type: NRG; PAM sequence: AGG
ggtctcgaactcccgacctc

SEQ ID NO: 132564 - DNA, 20 bp, Artificial Sequence
  Description of Artificial Sequence: Synthetic oligonucleotide
  Target: ATXN1; (+) strand; PAM type: NRG; PAM sequence: CGG
ctcaggtgatccgcccgcct

SEQ ID NO: 132565 - DNA, 20 bp, Artificial Sequence
  Description of Artificial Sequence: Synthetic oligonucleotide
  Target: ATXN1; (+) strand; PAM type: NRG; PAM sequence: AAG
ccgcccgcctcggcctccca

SEQ ID NO: 132566 - DNA, 20 bp, Artificial Sequence
  Description of Artificial Sequence: Synthetic oligonucleotide
  Target: ATXN1; (+) strand; PAM type: NRG; PAM sequence: TGG
gcctcggcctcccaaagtgt

SEQ ID NO: 132567 - DNA, 20 bp, Artificial Sequence
  Description of Artificial Sequence: Synthetic oligonucleotide
  Target: ATXN1; (+) strand; PAM type: NRG; PAM sequence: GGG
cctcggcctcccaaagtgtt

SEQ ID NO: 132568 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgttgggatta

SEQ ID NO: 132569 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgttgggattac

SEQ ID NO: 132570 - DNA, 20 bp, Artificial Sequence
  Description of Artificial Sequence: Synthetic oligonucleotide
  Target: ATXN1; (+) strand; PAM type: NRG; PAM sequence: GAG
agtgttgggattacaggcat

SEQ ID NO: 132571 - DNA, 20 bp, Artificial Sequence
  Description of Artificial Sequence: Synthetic oligonucleotide
  Target: ATXN1; (+) strand; PAM type: NRG; PAM sequence: CGG
caggcatgagccaccgcacc

SEQ ID NO: 132572 - DNA, 20 bp, Artificial Sequence
  Description of Artificial Sequence: Synthetic oligonucleotide
  Target: ATXN1; (+) strand; PAM type: NRG; PAM sequence: CAG
cggcctaatttttgtatttt

SEQ ID NO: 132573 - DNA, 20 bp, Artificial Sequence
  Description of Artificial Sequence: Synthetic oligonucleotide
  Target: ATXN1; (+) strand; PAM type: NRG; PAM sequence: TAG
cctaatttttgtattttcag

SEQ ID NO: 132574 - DNA, 20 bp, Artificial Sequence
  Description of Artificial Sequence: Synthetic oligonucleotide
  Target: ATXN1; (+) strand; PAM type: NRG; PAM sequence: GAG
taatttttgtattttcagta

SEQ ID NO: 132575 - DNA, 20 bp, Artificial Sequence
  Description of Artificial Sequence: Synthetic oligonucleotide
  Target: ATXN1; (+) strand; PAM type: NRG; PAM sequence: TGG
ttttgtattttcagtagaga

SEQ ID NO: 132576 - DNA, 20 bp, Artificial Sequence
  Description of Artificial Sequence: Synthetic oligonucleotide
  Target: ATXN1; (+) strand; PAM type: NRG; PAM sequence: GGG
tttgtattttcagtagagat

SEQ ID NO: 132577 - DNA, 20 bp, Artificial Sequence
  Description of Artificial Sequence: Synthetic oligonucleotide
  Target: ATXN1; (+) strand; PAM type: NRG; PAM sequence: GGG
ttgtattttcagtagagatg

SEQ ID NO: 132578 - DNA, 20 bp, Artificial Sequence
  Description of Artificial Sequence: Synthetic oligonucleotide
  Target: ATXN1; (+) strand; PAM type: NRG; PAM sequence: TGG
gagatggggtttcaccatgt

SEQ ID NO: 132579 - DNA, 20 bp, Artificial Sequence
  Description of Artificial Sequence: Synthetic oligonucleotide
  Target: ATXN1; (+) strand; PAM type: NRG; PAM sequence: CAG
tggggtttcaccatgttggc

SEQ ID NO: 132580 - DNA, 20 bp, Artificial Sequence
  Description of Artificial Sequence: Synthetic oligonucleotide
  Target: ATXN1; (+) strand; PAM type: NRG; PAM sequence: TGG
tttcaccatgttggccagtc

SEQ ID NO: 132581 - DNA, 20 bp, Artificial Sequence
  Description of Artificial Sequence: Synthetic oligonucleotide
  Target: ATXN1; (+) strand; PAM type: NRG; PAM sequence: AAG
ggtctcgatctcctgacctc

SEQ ID NO: 132582 - DNA, 20 bp, Artificial Sequence
  Description of Artificial Sequence: Synthetic oligonucleotide
  Target: ATXN1; (+) strand; PAM type: NRG; PAM sequence: CGG
ctcaagtgatctgcccacct

SEQ ID NO: 132583 - DNA, 20 bp, Artificial Sequence
  Description of Artificial Sequence: Synthetic oligonucleotide
  Target: ATXN1; (+) strand; PAM type: NRG; PAM sequence: AAG
ctgcccacctcggcctacct

SEQ ID NO: 132584 - DNA, 20 bp, Artificial Sequence
  Description of Artificial Sequence: Synthetic oligonucleotide
  Target: ATXN1; (+) strand; PAM type: NRG; PAM sequence: TAG
cggcctacctaagtgtcaac

SEQ ID NO: 132585 - DNA, 20 bp, Artificial Sequence
  Description of Artificial Sequence: Synthetic oligonucleotide
  Target: ATXN1; (+) strand; PAM type: NRG; PAM sequence: AGG
ggcctacctaagtgtcaact

SEQ ID NO: 132586 - DNA, 20 bp, Artificial Sequence
  Description of Artificial Sequence: Synthetic oligonucleotide
  Target: ATXN1; (+) strand; PAM type: NRG; PAM sequence: AAG
gtgtcaactaggtttttttg

SEQ ID NO: 132587 - DNA, 20 bp, Artificial Sequence
  Description of Artificial Sequence: Synthetic oligonucleotide
  Target: ATXN1; (+) strand; PAM type: NRG; PAM sequence: TAG
ggtttttttgaagataattt

SEQ ID NO: 132588 - DNA, 20 bp, Artificial Sequence
  Description of Artificial Sequence: Synthetic oligonucleotide
  Target: ATXN1; (+) strand; PAM type: NRG; PAM sequence: CAG
tgaagataattttagattta

SEQ ID NO: 132589 - DNA, 20 bp, Artificial Sequence
  Description of Artificial Sequence: Synthetic oligonucleotide
  Target: ATXN1; (+) strand; PAM type: NRG; PAM sequence: AAG
gataattttagatttacaga

SEQ ID NO: 132590 - DNA, 20 bp, Artificial Sequence
  Description of Artificial Sequence: Synthetic oligonucleotide
  Target: ATXN1; (+) strand; PAM type: NRG; PAM sequence: CGG
aattttagatttacagaaag

SEQ ID NO: 132591 - DNA, 20 bp, Artificial Sequence
  Description of Artificial Sequence: Synthetic oligonucleotide
  Target: ATXN1; (+) strand; PAM type: NRG; PAM sequence: TAG
tttacagaaagcggcaaaaa

SEQ ID NO: 132592 - DNA, 20 bp, Artificial Sequence
  Description of Artificial Sequence: Synthetic oligonucleotide
  Target: ATXN1; (+) strand; PAM type: NRG; PAM sequence: CAG
agaaagcggcaaaaatagta

SEQ ID NO: 132593 - DNA, 20 bp, Artificial Sequence
  Description of Artificial Sequence: Synthetic oligonucleotide
  Target: ATXN1; (+) strand; PAM type: NRG; PAM sequence: GAG
aaagcggcaaaaatagtaca

SEQ ID NO: 132594 - DNA, 20 bp, Artificial Sequence
  Description of Artificial Sequence: Synthetic oligonucleotide
  Target: ATXN1; (+) strand; PAM type: NRG; PAM sequence: CAG
gctcccttgtaccttccacc

SEQ ID NO: 132595 - DNA, 20 bp, Artificial Sequence
  Description of Artificial Sequence: Synthetic oligonucleotide
  Target: ATXN1; (+) strand; PAM type: NRG; PAM sequence: CAG
ccagtttccccctatattaa

SEQ ID NO: 132596 - DNA, 20 bp, Artificial Sequence
  Description of Artificial Sequence: Synthetic oligonucleotide
  Target: ATXN1; (+) strand; PAM type: NRG; PAM sequence: AAG
ccctatattaacagcttaca

SEQ ID NO: 132597 - DNA, 20 bp, Artificial Sequence
  Description of Artificial Sequence: Synthetic oligonucleotide
  Target: ATXN1; (+) strand; PAM type: NRG; PAM sequence: TAG
attaacagcttacaaagcca

SEQ ID NO: 132598 - DNA, 20 bp, Artificial Sequence
  Description of Artificial Sequence: Synthetic oligonucleotide
  Target: ATXN1; (+) strand; PAM type: NRG; PAM sequence: TAG
catagaaccacgatcaaaac

SEQ ID NO: 132599 - DNA, 20 bp, Artificial Sequence
  Description of Artificial Sequence: Synthetic oligonucleotide
  Target: ATXN1; (+) strand; PAM type: NRG; PAM sequence: AAG
gaaccacgatcaaaactaga

SEQ ID NO: 132600 - DNA, 20 bp, Artificial Sequence
  Description of Artificial Sequence: Synthetic oligonucleotide
  Target: ATXN1; (+) strand; PAM type: NRG; PAM sequence: TGG
tcaaaactagaaagttaacc

SEQ ID NO: 132601 - DNA, 20 bp, Artificial Sequence
  Description of Artificial Sequence: Synthetic oligonucleotide
  Target: ATXN1; (+) strand; PAM type: NRG; PAM sequence: GGG
caaaactagaaagttaacct

SEQ ID NO: 132602 - DNA, 20 bp, Artificial Sequence
  Description of Artificial Sequence: Synthetic oligonucleotide
  Target: ATXN1; (+) strand; PAM type: NRG; PAM sequence: TAG
cacgactactcaacaaaccg

SEQ ID NO: 132603 - DNA, 20 bp, Artificial Sequence
  Description of Artificial Sequence: Synthetic oligonucleotide
  Target: ATXN1; (+) strand; PAM type: NRG; PAM sequence: AGG
acgactactcaacaaaccgt

SEQ ID NO: 132604 - DNA, 20 bp, Artificial Sequence
  Description of Artificial Sequence: Synthetic oligonucleotide
  Target: ATXN1; (+) strand; PAM type: NRG; PAM sequence: GGG
cgactactcaacaaaccgta

SEQ ID NO: 132605 - DNA, 20 bp, Artificial Sequence
  Description of Artificial Sequence: Synthetic oligonucleotide
  Target: ATXN1; (+) strand; PAM type: NRG; PAM sequence: TAG
caacaaaccgtagggtgtat

SEQ ID NO: 132606 - DNA, 20 bp, Artificial Sequence
  Description of Artificial Sequence: Synthetic oligonucleotide
  Target: ATXN1; (+) strand; PAM type: NRG; PAM sequence: AGG
aacaaaccgtagggtgtatt

SEQ ID NO: 132607 - DNA, 20 bp, Artificial Sequence
  Description of Artificial Sequence: Synthetic oligonucleotide
  Target: ATXN1; (+) strand; PAM type: NRG; PAM sequence: CAG
agggtgtattaggatttcac

SEQ ID NO: 132608 - DNA, 20 bp, Artificial Sequence
  Description of Artificial Sequence: Synthetic oligonucleotide
  Target: ATXN1; (+) strand; PAM type: NRG; PAM sequence: CAG
tcaccagtttttgcaccaaa

SEQ ID NO: 132609 - DNA, 20 bp, Artificial Sequence
  Description of Artificial Sequence: Synthetic oligonucleotide
  Target: ATXN1; (+) strand; PAM type: NRG; PAM sequence: AGG
caccagtttttgcaccaaac

SEQ ID NO: 132610 - DNA, 20 bp, Artificial Sequence
  Description of Artificial Sequence: Synthetic oligonucleotide
  Target: ATXN1; (+) strand; PAM type: NRG; PAM sequence: CAG
tttttttttttttcctgttt

SEQ ID NO: 132611 - DNA, 20 bp, Artificial Sequence
  Description of Artificial Sequence: Synthetic oligonucleotide
  Target: ATXN1; (+) strand; PAM type: NRG; PAM sequence: AGG
ttttttttttttcctgtttc

SEQ ID NO: 132612 - DNA, 20 bp, Artificial Sequence
  Description of Artificial Sequence: Synthetic oligonucleotide
  Target: ATXN1; (+) strand; PAM type: NRG; PAM sequence: TAG
tcctgtttcaggatcatact

SEQ ID NO: 132613 - DNA, 20 bp, Artificial Sequence
  Description of Artificial Sequence: Synthetic oligonucleotide
  Target: ATXN1; (+) strand; PAM type: NRG; PAM sequence: TGG
atcatacttagaattttatg

SEQ ID NO: 132614 - DNA, 20 bp, Artificial Sequence
  Description of Artificial Sequence: Synthetic oligonucleotide
  Target: ATXN1; (+) strand; PAM type: NRG; PAM sequence: TAG
ttttatgtggtcatatttct

SEQ ID NO: 132615 - DNA, 20 bp, Artificial Sequence
  Description of Artificial Sequence: Synthetic oligonucleotide
  Target: ATXN1; (+) strand; PAM type: NRG; PAM sequence: CAG
tagtttctgctaatctgtga

SEQ ID NO: 132616 - DNA, 20 bp, Artificial Sequence
  Description of Artificial Sequence: Synthetic oligonucleotide
  Target: ATXN1; (+) strand; PAM type: NRG; PAM sequence: AAG
tgaatccttccttatcctta

SEQ ID NO: 132617 - DNA, 20 bp, Artificial Sequence
  Description of Artificial Sequence: Synthetic oligonucleotide
  Target: ATXN1; (+) strand; PAM type: NRG; PAM sequence: AAG
ttaaagaccttgacaatttt

SEQ ID NO: 132618 - DNA, 20 bp, Artificial Sequence
  Description of Artificial Sequence: Synthetic oligonucleotide
  Target: ATXN1; (+) strand; PAM type: NRG; PAM sequence: AGG
taaagaccttgacaatttta

SEQ ID NO: 132619 - DNA, 20 bp, Artificial Sequence
  Description of Artificial Sequence: Synthetic oligonucleotide
  Target: ATXN1; (+) strand; PAM type: NRG; PAM sequence: GGG
aaagaccttgacaattttaa

SEQ ID NO: 132620 - DNA, 20 bp, Artificial Sequence
  Description of Artificial Sequence: Synthetic oligonucleotide
  Target: ATXN1; (+) strand; PAM type: NRG; PAM sequence: GGG
aagaccttgacaattttaag

SEQ ID NO: 132621 - DNA, 20 bp, Artificial Sequence
  Description of Artificial Sequence: Synthetic oligonucleotide
  Target: ATXN1; (+) strand; PAM type: NRG; PAM sequence: GAG
gaccttgacaattttaaggg

SEQ ID NO: 132622 - DNA, 20 bp, Artificial Sequence
  Description of Artificial Sequence: Synthetic oligonucleotide
  Target: ATXN1; (+) strand; PAM type: NRG; PAM sequence: AGG
accttgacaattttaagggg

SEQ ID NO: 132623 - DNA, 20 bp, Artificial Sequence
  Description of Artificial Sequence: Synthetic oligonucleotide
  Target: ATXN1; (+) strand; PAM type: NRG; PAM sequence: GGG
ccttgacaattttaagggga

SEQ ID NO: 132624 - DNA, 20 bp, Artificial Sequence
  Description of Artificial Sequence: Synthetic oligonucleotide
  Target: ATXN1; (+) strand; PAM type: NRG; PAM sequence: GGG
cttgacaattttaaggggag

SEQ ID NO: 132625 - DNA, 20 bp, Artificial Sequence
  Description of Artificial Sequence: Synthetic oligonucleotide
  Target: ATXN1; (+) strand; PAM type: NRG; PAM sequence: CAG
acaattttaaggggaggggt

SEQ ID NO: 132626 - DNA, 20 bp, Artificial Sequence
  Description of Artificial Sequence: Synthetic oligonucleotide
  Target: ATXN1; (+) strand; PAM type: NRG; PAM sequence: GAG
tttcgaatgtccttccattt

SEQ ID NO: 132627 - DNA, 20 bp, Artificial Sequence
  Description of Artificial Sequence: Synthetic oligonucleotide
  Target: ATXN1; (+) strand; PAM type: NRG; PAM sequence: TAG
tttgctatttttttcttgat

SEQ ID NO: 132628 - DNA, 20 bp, Artificial Sequence
  Description of Artificial Sequence: Synthetic oligonucleotide
  Target: ATXN1; (+) strand; PAM type: NRG; PAM sequence: GAG
tgctatttttttcttgatta

SEQ ID NO: 132629 - DNA, 20 bp, Artificial Sequence
  Description of Artificial Sequence: Synthetic oligonucleotide
  Target: ATXN1; (+) strand; PAM type: NRG; PAM sequence: GAG
atttttttcttgattagagt

SEQ ID NO: 132630 - DNA, 20 bp, Artificial Sequence
  Description of Artificial Sequence: Synthetic oligonucleotide
  Target: ATXN1; (+) strand; PAM type: NRG; PAM sequence: CAG
agagtgagattatgcctttt

SEQ ID NO: 132631 - DNA, 20 bp, Artificial Sequence
  Description of Artificial Sequence: Synthetic oligonucleotide
  Target: ATXN1; (+) strand; PAM type: NRG; PAM sequence: AGG
gagtgagattatgccttttc

SEQ ID NO: 132632 - DNA, 20 bp, Artificial Sequence
  Description of Artificial Sequence: Synthetic oligonucleotide
  Target: ATXN1; (+) strand; PAM type: NRG; PAM sequence: GGG
agtgagattatgccttttca

SEQ ID NO: 132633 - DNA, 20 bp, Artificial Sequence
  Description of Artificial Sequence: Synthetic oligonucleotide
  Target: ATXN1; (+) strand; PAM type: NRG; PAM sequence: GAG
tgagattatgccttttcagg

SEQ ID NO: 132634 - DNA, 20 bp, Artificial Sequence
  Description of Artificial Sequence: Synthetic oligonucleotide
  Target: ATXN1; (+) strand; PAM type: NRG; PAM sequence: AGG
gagattatgccttttcaggg

SEQ ID NO: 132635 - DNA, 20 bp, Artificial Sequence
  Description of Artificial Sequence: Synthetic oligonucleotide
  Target: ATXN1; (+) strand; PAM type: NRG; PAM sequence: CAG
tgccttttcagggaggatat

SEQ ID NO: 132636 - DNA, 20 bp, Artificial Sequence
  Description of Artificial Sequence: Synthetic oligonucleotide
  Target: ATXN1; (+) strand; PAM type: NRG; PAM sequence: GAG
ccttttcagggaggatatca

SEQ ID NO: 132637 - DNA, 20 bp, Artificial Sequence
  Description of Artificial Sequence: Synthetic oligonucleotide
  Target: ATXN1; (+) strand; PAM type: NRG; PAM sequence: CAG
cagagatgacacgcccttct

SEQ ID NO: 132638 - DNA, 20 bp, Artificial Sequence
  Description of Artificial Sequence: Synthetic oligonucleotide
  Target: ATXN1; (+) strand; PAM type: NRG; PAM sequence: TGG
agatgacacgcccttctcag

SEQ ID NO: 132639 - DNA, 20 bp, Artificial Sequence
  Description of Artificial Sequence: Synthetic oligonucleotide
  Target: ATXN1; (+) strand; PAM type: NRG; PAM sequence: GGG
gatgacacgcccttctcagt

SEQ ID NO: 132640 - DNA, 20 bp, Artificial Sequence
  Description of Artificial Sequence: Synthetic oligonucleotide
  Target: ATXN1; (+) strand; PAM type: NRG; PAM sequence: TGG
acgatgtcaatatgtatcac

SEQ ID NO: 132641 - DNA, 20 bp, Artificial Sequence
  Description of Artificial Sequence: Synthetic oligonucleotide
  Target: ATXN1; (+) strand; PAM type: NRG; PAM sequence: CAG
tgacattaaccttgatcact

SEQ ID NO: 132642 - DNA, 20 bp, Artificial Sequence
  Description of Artificial Sequence: Synthetic oligonucleotide
  Target: ATXN1; (+) strand; PAM type: NRG; PAM sequence: AAG
ttaaccttgatcactcagtt

SEQ ID NO: 132643 - DNA, 20 bp, Artificial Sequence
  Description of Artificial Sequence: Synthetic oligonucleotide
  Target: ATXN1; (+) strand; PAM type: NRG; PAM sequence: AGG
taaccttgatcactcagtta

SEQ ID NO: 132644 - DNA, 20 bp, Artificial Sequence
  Description of Artificial Sequence: Synthetic oligonucleotide
  Target: ATXN1; (+) strand; PAM type: NRG; PAM sequence: CAG
tcagttaaggtgatgtctgc

SEQ ID NO: 132645 - DNA, 20 bp, Artificial Sequence
  Description of Artificial Sequence: Synthetic oligonucleotide
  Target: ATXN1; (+) strand; PAM type: NRG; PAM sequence: AGG
cagttaaggtgatgtctgcc

SEQ ID NO: 132646 - DNA, 20 bp, Artificial Sequence
  Description of Artificial Sequence: Synthetic oligonucleotide
  Target: ATXN1; (+) strand; PAM type: NRG; PAM sequence: TGG
ccttgtaattactaaatgtt

SEQ ID NO: 132647 - DNA, 20 bp, Artificial Sequence
  Description of Artificial Sequence: Synthetic oligonucleotide
  Target: ATXN1; (+) strand; PAM type: NRG; PAM sequence: GGG
cttgtaattactaaatgttt

SEQ ID NO: 132648 - DNA, 20 bp, Artificial Sequence
  Description of Artificial Sequence: Synthetic oligonucleotide
  Target: ATXN1; (+) strand; PAM type: NRG; PAM sequence: GGG
ttgtaattactaaatgtttg

SEQ ID NO: 132649 - DNA, 20 bp, Artificial Sequence
  Description of Artificial Sequence: Synthetic oligonucleotide
  Target: ATXN1; (+) strand; PAM type: NRG; PAM sequence: TAG
taattactaaatgtttgggg

SEQ ID NO: 132650 - DNA, 20 bp, Artificial Sequence
  Description of Artificial Sequence: Synthetic oligonucleotide
  Target: ATXN1; (+) strand; PAM type: NRG; PAM sequence: AGG
aattactaaatgtttggggt

SEQ ID NO: 132651 - DNA, 20 bp, Artificial Sequence
  Description of Artificial Sequence: Synthetic oligonucleotide
  Target: ATXN1; (+) strand; PAM type: NRG; PAM sequence: GGG
attactaaatgtttggggta

SEQ ID NO: 132652 - DNA, 20 bp, Artificial Sequence
  Description of Artificial Sequence: Synthetic oligonucleotide
  Target: ATXN1; (+) strand; PAM type: NRG; PAM sequence: CGG
tgcccatctaatgcatccat

SEQ ID NO: 132653 - DNA, 20 bp, Artificial Sequence
  Description of Artificial Sequence: Synthetic oligonucleotide
  Target: ATXN1; (+) strand; PAM type: NRG; PAM sequence: TGG
ccatctaatgcatccatcgg

SEQ ID NO: 132654 - DNA, 20 bp, Artificial Sequence
  Description of Artificial Sequence: Synthetic oligonucleotide
  Target: ATXN1; (+) strand; PAM type: NRG; PAM sequence: GGG
catctaatgcatccatcggt

SEQ ID NO: 132655 - DNA, 20 bp, Artificial Sequence
  Description of Artificial Sequence: Synthetic oligonucleotide
  Target: ATXN1; (+) strand; PAM type: NRG; PAM sequence: TGG
ccatcggtgggactttctcg

SEQ ID NO: 132656 - DNA, 20 bp, Artificial Sequence
  Description of Artificial Sequence: Synthetic oligonucleotide
  Target: ATXN1; (+) strand; PAM type: NRG; PAM sequence: GAG
ctcgtggcaattcttactat

SEQ ID NO: 132657 - DNA, 20 bp, Artificial Sequence
  Description of Artificial Sequence: Synthetic oligonucleotide
  Target: ATXN1; (+) strand; PAM type: NRG; PAM sequence: CAG
tattaactgaaattctgctg

SEQ ID NO: 132658 - DNA, 20 bp, Artificial Sequence
  Description of Artificial Sequence: Synthetic oligonucleotide
  Target: ATXN1; (+) strand; PAM type: NRG; PAM sequence: AGG
attaactgaaattctgctgc

SEQ ID NO: 132659 - DNA, 20 bp, Artificial Sequence
  Description of Artificial Sequence: Synthetic oligonucleotide
  Target: ATXN1; (+) strand; PAM type: NRG; PAM sequence: GGG
ttaactgaaattctgctgca

SEQ ID NO: 132660 - DNA, 20 bp, Artificial Sequence
  Description of Artificial Sequence: Synthetic oligonucleotide
  Target: ATXN1; (+) strand; PAM type: NRG; PAM sequence: AAG
actgaaattctgctgcaggg

SEQ ID NO: 132661 - DNA, 20 bp, Artificial Sequence
  Description of Artificial Sequence: Synthetic oligonucleotide
  Target: ATXN1; (+) strand; PAM type: NRG; PAM sequence: GAG
tgaaattctgctgcagggaa

SEQ ID NO: 132662 - DNA, 20 bp, Artificial Sequence
  Description of Artificial Sequence: Synthetic oligonucleotide
  Target: ATXN1; (+) strand; PAM type: NRG; PAM sequence: TGG
tcccttatttatttattcat

SEQ ID NO: 132663 - DNA, 20 bp, Artificial Sequence
  Description of Artificial Sequence: Synthetic oligonucleotide
  Target: ATXN1; (+) strand; PAM type: NRG; PAM sequence: TGG
tatttattcattggactcgt

SEQ ID NO: 132664 - DNA, 20 bp, Artificial Sequence
  Description of Artificial Sequence: Synthetic oligonucleotide
  Target: ATXN1; (+) strand; PAM type: NRG; PAM sequence: TGG
tcgttggatattttattctt

SEQ ID NO: 132665 - DNA, 20 bp, Artificial Sequence
  Description of Artificial Sequence: Synthetic oligonucleotide
  Target: ATXN1; (+) strand; PAM type: NRG; PAM sequence: GGG
cgttggatattttattcttt

SEQ ID NO: 132666 - DNA, 20 bp, Artificial Sequence
  Description of Artificial Sequence: Synthetic oligonucleotide
  Target: ATXN1; (+) strand; PAM type: NRG; PAM sequence: CAG
ttattctttgggttataatc

SEQ ID NO: 132667 - DNA, 20 bp, Artificial Sequence
  Description of Artificial Sequence: Synthetic oligonucleotide
  Target: ATXN1; (+) strand; PAM type: NRG; PAM sequence: CAG
ccagcatttatttccttacc

SEQ ID NO: 132668 - DNA, 20 bp, Artificial Sequence
  Description of Artificial Sequence: Synthetic oligonucleotide
  Target: ATXN1; (+) strand; PAM type: NRG; PAM sequence: AAG
tttccttacccagttattct

SEQ ID NO: 132669 - DNA, 20 bp, Artificial Sequence
  Description of Artificial Sequence: Synthetic oligonucleotide
  Target: ATXN1; (+) strand; PAM type: NRG; PAM sequence: TAG
tacccagttattctaagctg

SEQ ID NO: 132670 - DNA, 20 bp, Artificial Sequence
  Description of Artificial Sequence: Synthetic oligonucleotide
  Target: ATXN1; (+) strand; PAM type: NRG; PAM sequence: TAG
cagttattctaagctgtagc

SEQ ID NO: 132671 - DNA, 20 bp, Artificial Sequence
  Description of Artificial Sequence: Synthetic oligonucleotide
  Target: ATXN1; (+) strand; PAM type: NRG; PAM sequence: CAG
agctagatattctaccattt

SEQ ID NO: 132672 - DNA, 20 bp, Artificial Sequence
  Description of Artificial Sequence: Synthetic oligonucleotide
  Target: ATXN1; (+) strand; PAM type: NRG; PAM sequence: GAG
ctagatattctaccatttca

SEQ ID NO: 132673 - DNA, 20 bp, Artificial Sequence
  Description of Artificial Sequence: Synthetic oligonucleotide
  Target: ATXN1; (+) strand; PAM type: NRG; PAM sequence: CAG
gatattctaccatttcagag

SEQ ID NO: 132674 - DNA, 20 bp, Artificial Sequence
  Description of Artificial Sequence: Synthetic oligonucleotide
  Target: ATXN1; (+) strand; PAM type: NRG; PAM sequence: CAG
ctaccatttcagagcagaca

SEQ ID NO: 132675 - DNA, 20 bp, Artificial Sequence
  Description of Artificial Sequence: Synthetic oligonucleotide
  Target: ATXN1; (+) strand; PAM type: NRG; PAM sequence: CAG
ccacattgtgtcctgtgtta

SEQ ID NO: 132676 - DNA, 20 bp, Artificial Sequence
  Description of Artificial Sequence: Synthetic oligonucleotide
  Target: ATXN1; (+) strand; PAM type: NRG; PAM sequence: AGG
cacattgtgtcctgtgttac

SEQ ID NO: 132677 - DNA, 20 bp, Artificial Sequence
  Description of Artificial Sequence: Synthetic oligonucleotide
  Target: ATXN1; (+) strand; PAM type: NRG; PAM sequence: AAG
caggttgtccctcatgtctt

SEQ ID NO: 132678 - DNA, 20 bp, Artificial Sequence
  Description of Artificial Sequence: Synthetic oligonucleotide
  Target: ATXN1; (+) strand; PAM type: NRG; PAM sequence: AAG
tgtccctcatgtcttaagac

SEQ ID NO: 132679 - DNA, 20 bp, Artificial Sequence
  Description of Artificial Sequence: Synthetic oligonucleotide
  Target: ATXN1; (+) strand; PAM type: NRG; PAM sequence: CAG
ctcatgtcttaagacaagaa

SEQ ID NO: 132680 - DNA, 20 bp, Artificial Sequence
  Description of Artificial Sequence: Synthetic oligonucleotide
  Target: ATXN1; (+) strand; PAM type: NRG; PAM sequence: AGG
tcatgtcttaagacaagaac

SEQ ID NO: 132681 - DNA, 20 bp, Artificial Sequence
  Description of Artificial Sequence: Synthetic oligonucleotide
  Target: ATXN1; (+) strand; PAM type: NRG; PAM sequence: CAG
ttaagacaagaacaggcaca

SEQ ID NO: 132682 - DNA, 20 bp, Artificial Sequence
  Description of Artificial Sequence: Synthetic oligonucleotide
  Target: ATXN1; (+) strand; PAM type: NRG; PAM sequence: CGG
agacaagaacaggcacacag

SEQ ID NO: 132683 - DNA, 20 bp, Artificial Sequence
  Description of Artificial Sequence: Synthetic oligonucleotide
  Target: ATXN1; (+) strand; PAM type: NRG; PAM sequence: GGG
gacaagaacaggcacacagc

SEQ ID NO: 132684 - DNA, 20 bp, Artificial Sequence
  Description of Artificial Sequence: Synthetic oligonucleotide
  Target: ATXN1; (+) strand; PAM type: NRG; PAM sequence: CAG
acaggcacacagcgggtatt

SEQ ID NO: 132685 - DNA, 20 bp, Artificial Sequence
  Description of Artificial Sequence: Synthetic oligonucleotide
  Target: ATXN1; (+) strand; PAM type: NRG; PAM sequence: CAG
tcatctgttcattcatttga

SEQ ID NO: 132686 - DNA, 20 bp, Artificial Sequence
  Description of Artificial Sequence: Synthetic oligonucleotide
  Target: ATXN1; (+) strand; PAM type: NRG; PAM sequence: AGG
catctgttcattcatttgac

SEQ ID NO: 132687 - DNA, 20 bp, Artificial Sequence
  Description of Artificial Sequence: Synthetic oligonucleotide
  Target: ATXN1; (+) strand; PAM type: NRG; PAM sequence: GAG
ttcatttgacaggttatctt

SEQ ID NO: 132688 - DNA, 20 bp, Artificial Sequence
  Description of Artificial Sequence: Synthetic oligonucleotide
  Target: ATXN1; (+) strand; PAM type: NRG; PAM sequence: AGG
tcatttgacaggttatcttg

SEQ ID NO: 132689 - DNA, 20 bp, Artificial Sequence
  Description of Artificial Sequence: Synthetic oligonucleotide
  Target: ATXN1; (+) strand; PAM type: NRG; PAM sequence: GGG
catttgacaggttatcttga

SEQ ID NO: 132690 - DNA, 20 bp, Artificial Sequence
  Description of Artificial Sequence: Synthetic oligonucleotide
  Target: ATXN1; (+) strand; PAM type: NRG; PAM sequence: TAG
ttatcttgagggccttgtgt

SEQ ID NO: 132691 - DNA, 20 bp, Artificial Sequence
  Description of Artificial Sequence: Synthetic oligonucleotide
  Target: ATXN1; (+) strand; PAM type: NRG; PAM sequence: AGG
tatcttgagggccttgtgtt

SEQ ID NO: 132692 - DNA, 20 bp, Artificial Sequence
  Description of Artificial Sequence: Synthetic oligonucleotide
  Target: ATXN1; (+) strand; PAM type: NRG; PAM sequence: TAG
gagggccttgtgttaggtgt

SEQ ID NO: 132693 - DNA, 20 bp, Artificial Sequence
  Description of Artificial Sequence: Synthetic oligonucleotide
  Target: ATXN1; (+) strand; PAM type: NRG; PAM sequence: GAG
gggccttgtgttaggtgtta

SEQ ID NO: 132694 - DNA, 20 bp, Artificial Sequence
  Description of Artificial Sequence: Synthetic oligonucleotide
  Target: ATXN1; (+) strand; PAM type: NRG; PAM sequence: AAG
gtgttaggtgttagagttac

SEQ ID NO: 132695 - DNA, 20 bp, Artificial Sequence
  Description of Artificial Sequence: Synthetic oligonucleotide
  Target: ATXN1; (+) strand; PAM type: NRG; PAM sequence: GAG
ataaaacaattcctctgtcc

SEQ ID NO: 132696 - DNA, 20 bp, Artificial Sequence
  Description of Artificial Sequence: Synthetic oligonucleotide
  Target: ATXN1; (+) strand; PAM type: NRG; PAM sequence: TGG
aaacaattcctctgtccgag

SEQ ID NO: 132697 - DNA, 20 bp, Artificial Sequence
  Description of Artificial Sequence: Synthetic oligonucleotide
  Target: ATXN1; (+) strand; PAM type: NRG; PAM sequence: CAG
tcctctgtccgagtggttta

SEQ ID NO: 132698 - DNA, 20 bp, Artificial Sequence
  Description of Artificial Sequence: Synthetic oligonucleotide
  Target: ATXN1; (+) strand; PAM type: NRG; PAM sequence: TAG
tgtccgagtggtttacagcc

SEQ ID NO: 132699 - DNA, 20 bp, Artificial Sequence
  Description of Artificial Sequence: Synthetic oligonucleotide
  Target: ATXN1; (+) strand; PAM type: NRG; PAM sequence: TAG
cgagtggtttacagcctagt

SEQ ID NO: 132700 - DNA, 20 bp, Artificial Sequence
  Description of Artificial Sequence: Synthetic oligonucleotide
  Target: ATXN1; (+) strand; PAM type: NRG; PAM sequence: AAG
gtggtttacagcctagttag

SEQ ID NO: 132701 - DNA, 20 bp, Artificial Sequence
  Description of Artificial Sequence: Synthetic oligonucleotide
  Target: ATXN1; (+) strand; PAM type: NRG; PAM sequence: GAG
ggtttacagcctagttagaa

SEQ ID NO: 132702 - DNA, 20 bp, Artificial Sequence
  Description of Artificial Sequence: Synthetic oligonucleotide
  Target: ATXN1; (+) strand; PAM type: NRG; PAM sequence: CAG
gcctagttagaagagaccta

SEQ ID NO: 132703 - DNA, 20 bp, Artificial Sequence
  Description of Artificial Sequence: Synthetic oligonucleotide
  Target: ATXN1; (+) strand; PAM type: NRG; PAM sequence: AGG
cctagttagaagagacctac

SEQ ID NO: 132704 - DNA, 20 bp, Artificial Sequence
  Description of Artificial Sequence: Synthetic oligonucleotide
  Target: ATXN1; (+) strand; PAM type: NRG; PAM sequence: AAG
agacctacaggcacatttgc

SEQ ID NO: 132705 - DNA, 20 bp, Artificial Sequence
  Description of Artificial Sequence: Synthetic oligonucleotide
  Target: ATXN1; (+) strand; PAM type: NRG; PAM sequence: AAG
catttgcaagtccttattaa

SEQ ID NO: 132706 - DNA, 20 bp, Artificial Sequence
  Description of Artificial Sequence: Synthetic oligonucleotide
  Target: ATXN1; (+) strand; PAM type: NRG; PAM sequence: TAG
caagtccttattaaaagtat

SEQ ID NO: 132707 - DNA, 20 bp, Artificial Sequence
  Description of Artificial Sequence: Synthetic oligonucleotide
  Target: ATXN1; (+) strand; PAM type: NRG; PAM sequence: AGG
aagtccttattaaaagtatt

SEQ ID NO: 132708 - DNA, 20 bp, Artificial Sequence
  Description of Artificial Sequence: Synthetic oligonucleotide
  Target: ATXN1; (+) strand; PAM type: NRG; PAM sequence: AAG
ccttattaaaagtattaggc

SEQ ID NO: 132709 - DNA, 20 bp, Artificial Sequence
  Description of Artificial Sequence: Synthetic oligonucleotide
  Target: ATXN1; (+) strand; PAM type: NRG; PAM sequence: CAG
ttaaaagtattaggcaagta

SEQ ID NO: 132710 - DNA, 20 bp, Artificial Sequence
  Description of Artificial Sequence: Synthetic oligonucleotide
  Target: ATXN1; (+) strand; PAM type: NRG; PAM sequence: TGG
gtattaggcaagtacagcaa

SEQ ID NO: 132711 - DNA, 20 bp, Artificial Sequence
  Description of Artificial Sequence: Synthetic oligonucleotide
  Target: ATXN1; (+) strand; PAM type: NRG; PAM sequence: CAG
aggcaagtacagcaatggcc

SEQ ID NO: 132712 - DNA, 20 bp, Artificial Sequence
  Description of Artificial Sequence: Synthetic oligonucleotide
  Target: ATXN1; (+) strand; PAM type: NRG; PAM sequence: AAG
caagtacagcaatggcccag

SEQ ID NO: 132713 - DNA, 20 bp, Artificial Sequence
  Description of Artificial Sequence: Synthetic oligonucleotide
  Target: ATXN1; (+) strand; PAM type: NRG; PAM sequence: TAG
caatggcccagaagaaaaca

SEQ ID NO: 132714 - DNA, 20 bp, Artificial Sequence
  Description of Artificial Sequence: Synthetic oligonucleotide
  Target: ATXN1; (+) strand; PAM type: NRG; PAM sequence: TGG
aaaacatagtcaactctacc

SEQ ID NO: 132715 - DNA, 20 bp, Artificial Sequence
  Description of Artificial Sequence: Synthetic oligonucleotide
  Target: ATXN1; (+) strand; PAM type: NRG; PAM sequence: GAG
aacatagtcaactctacctg

SEQ ID NO: 132716 - DNA, 20 bp, Artificial Sequence
  Description of Artificial Sequence: Synthetic oligonucleotide
  Target: ATXN1; (+) strand; PAM type: NRG; PAM sequence: AAG
gtcaactctacctggagaaa

SEQ ID NO: 132717 - DNA, 20 bp, Artificial Sequence
  Description of Artificial Sequence: Synthetic oligonucleotide
  Target: ATXN1; (+) strand; PAM type: NRG; PAM sequence: AGG
tcaactctacctggagaaaa

SEQ ID NO: 132718 - DNA, 20 bp, Artificial Sequence
  Description of Artificial Sequence: Synthetic oligonucleotide
  Target: ATXN1; (+) strand; PAM type: NRG; PAM sequence: GGG
caactctacctggagaaaaa

SEQ ID NO: 132719 - DNA, 20 bp, Artificial Sequence
  Description of Artificial Sequence: Synthetic oligonucleotide
  Target: ATXN1; (+) strand; PAM type: NRG; PAM sequence: GGG
aactctacctggagaaaaag

SEQ ID NO: 132720 - DNA, 20 bp, Artificial Sequence
  Description of Artificial Sequence: Synthetic oligonucleotide
  Target: ATXN1; (+) strand; PAM type: NRG; PAM sequence: TGG
tacctggagaaaaaggggtg

SEQ ID NO: 132721 - DNA, 20 bp, Artificial Sequence
  Description of Artificial Sequence: Synthetic oligonucleotide
  Target: ATXN1; (+) strand; PAM type: NRG; PAM sequence: TGG
agaaaaaggggtgtggcaat

SEQ ID NO: 132722 - DNA, 20 bp, Artificial Sequence
  Description of Artificial Sequence: Synthetic oligonucleotide
  Target: ATXN1; (+) strand; PAM type: NRG; PAM sequence: TAG
aaaaggggtgtggcaattgg

SEQ ID NO: 132723 - DNA, 20 bp, Artificial Sequence
  Description of Artificial Sequence: Synthetic oligonucleotide
  Target: ATXN1; (+) strand; PAM type: NRG; PAM sequence: AGG
aaaggggtgtggcaattggt

SEQ ID NO: 132724 - DNA, 20 bp, Artificial Sequence
  Description of Artificial Sequence: Synthetic oligonucleotide
  Target: ATXN1; (+) strand; PAM type: NRG; PAM sequence: CAG
ggggtgtggcaattggtagg

SEQ ID NO: 132725 - DNA, 20 bp, Artificial Sequence
  Description of Artificial Sequence: Synthetic oligonucleotide
  Target: ATXN1; (+) strand; PAM type: NRG; PAM sequence: AGG
gggtgtggcaattggtaggc

SEQ ID NO: 132726 - DNA, 20 bp, Artificial Sequence
  Description of Artificial Sequence: Synthetic oligonucleotide
  Target: ATXN1; (+) strand; PAM type: NRG; PAM sequence: AAG
gtggcaattggtaggcagga

SEQ ID NO: 132727 - DNA, 20 bp, Artificial Sequence
  Description of Artificial Sequence: Synthetic oligonucleotide
  Target: ATXN1; (+) strand; PAM type: NRG; PAM sequence: AAG
taggcaggaaagacttcctt

SEQ ID NO: 132728 - DNA, 20 bp, Artificial Sequence
  Description of Artificial Sequence: Synthetic oligonucleotide
  Target: ATXN1; (+) strand; PAM type: NRG; PAM sequence: AAG
ggaaagacttccttaagacc

SEQ ID NO: 132729 - DNA, 20 bp, Artificial Sequence
  Description of Artificial Sequence: Synthetic oligonucleotide
  Target: ATXN1; (+) strand; PAM type: NRG; PAM sequence: CAG
aagacttccttaagaccaag

SEQ ID NO: 132730 - DNA, 20 bp, Artificial Sequence
  Description of Artificial Sequence: Synthetic oligonucleotide
  Target: ATXN1; (+) strand; PAM type: NRG; PAM sequence: TGG
gcttgctctataaaaatcaa

SEQ ID NO: 132731 - DNA, 20 bp, Artificial Sequence
  Description of Artificial Sequence: Synthetic oligonucleotide
  Target: ATXN1; (+) strand; PAM type: NRG; PAM sequence: GGG
cttgctctataaaaatcaat

SEQ ID NO: 132732 - DNA, 20 bp, Artificial Sequence
  Description of Artificial Sequence: Synthetic oligonucleotide
  Target: ATXN1; (+) strand; PAM type: NRG; PAM sequence: TAG
caatgggcatataaaatttc

SEQ ID NO: 132733 - DNA, 20 bp, Artificial Sequence
  Description of Artificial Sequence: Synthetic oligonucleotide
  Target: ATXN1; (+) strand; PAM type: NRG; PAM sequence: GAG
atgggcatataaaatttcta

SEQ ID NO: 132734 - DNA, 20 bp, Artificial Sequence
  Description of Artificial Sequence: Synthetic oligonucleotide
  Target: ATXN1; (+) strand; PAM type: NRG; PAM sequence: CAG
tagagacacacgccatcaca

SEQ ID NO: 132735 - DNA, 20 bp, Artificial Sequence
  Description of Artificial Sequence: Synthetic oligonucleotide
  Target: ATXN1; (+) strand; PAM type: NRG; PAM sequence: TAG
gacacacgccatcacacagt

SEQ ID NO: 132736 - DNA, 20 bp, Artificial Sequence
  Description of Artificial Sequence: Synthetic oligonucleotide
  Target: ATXN1; (+) strand; PAM type: NRG; PAM sequence: CAG
acacgccatcacacagttag

SEQ ID NO: 132737 - DNA, 20 bp, Artificial Sequence
  Description of Artificial Sequence: Synthetic oligonucleotide
  Target: ATXN1; (+) strand; PAM type: NRG; PAM sequence: AGG
cacgccatcacacagttagc

SEQ ID NO: 132738 - DNA, 20 bp, Artificial Sequence
  Description of Artificial Sequence: Synthetic oligonucleotide
  Target: ATXN1; (+) strand; PAM type: NRG; PAM sequence: AAG
acacagttagcaggtactcc

SEQ ID NO: 132739 - DNA, 20 bp, Artificial Sequence
  Description of Artificial Sequence: Synthetic oligonucleotide
  Target: ATXN1; (+) strand; PAM type: NRG; PAM sequence: AAG
aattccccacatcaaacctc

SEQ ID NO: 132740 - DNA, 20 bp, Artificial Sequence
  Description of Artificial Sequence: Synthetic oligonucleotide
  Target: ATXN1; (+) strand; PAM type: NRG; PAM sequence: AGG
attccccacatcaaacctca

SEQ ID NO: 132741 - DNA, 20 bp, Artificial Sequence
  Description of Artificial Sequence: Synthetic oligonucleotide
  Target: ATXN1; (+) strand; PAM type: NRG; PAM sequence: GGG
ttccccacatcaaacctcaa

SEQ ID NO: 132742 - DNA, 20 bp, Artificial Sequence
  Description of Artificial Sequence: Synthetic oligonucleotide
  Target: ATXN1; (+) strand; PAM type: NRG; PAM sequence: TAG
aacctcaagggcacactatt

SEQ ID NO: 132743 - DNA, 20 bp, Artificial Sequence
  Description of Artificial Sequence: Synthetic oligonucleotide
  Target: ATXN1; (+) strand; PAM type: NRG; PAM sequence: AGG
acctcaagggcacactattt

SEQ ID NO: 132744 - DNA, 20 bp, Artificial Sequence
  Description of Artificial Sequence: Synthetic oligonucleotide
  Target: ATXN1; (+) strand; PAM type: NRG; PAM sequence: AAG
tcaagggcacactatttagg

SEQ ID NO: 132745 - DNA, 20 bp, Artificial Sequence
  Description of Artificial Sequence: Synthetic oligonucleotide
  Target: ATXN1; (+) strand; PAM type: NRG; PAM sequence: CAG
aagatttaatgcaataaact

SEQ ID NO: 132746 - DNA, 20 bp, Artificial Sequence
  Description of Artificial Sequence: Synthetic oligonucleotide
  Target: ATXN1; (+) strand; PAM type: NRG; PAM sequence: TAG
ataaactcagactctttata

SEQ ID NO: 132747 - DNA, 20 bp, Artificial Sequence
  Description of Artificial Sequence: Synthetic oligonucleotide
  Target: ATXN1; (+) strand; PAM type: NRG; PAM sequence: TAG
atagtgactatgtgcttttc

SEQ ID NO: 132748 - DNA, 20 bp, Artificial Sequence
  Description of Artificial Sequence: Synthetic oligonucleotide
  Target: ATXN1; (+) strand; PAM type: NRG; PAM sequence: AGG
tagtgactatgtgcttttct

SEQ ID NO: 132749 - DNA, 20 bp, Artificial Sequence
  Description of Artificial Sequence: Synthetic oligonucleotide
  Target: ATXN1; (+) strand; PAM type: NRG; PAM sequence: TGG
atgtgcttttctaggaaaat

SEQ ID NO: 132750 - DNA, 20 bp, Artificial Sequence
  Description of Artificial Sequence: Synthetic oligonucleotide
  Target: ATXN1; (+) strand; PAM type: NRG; PAM sequence: CAG
ttttctaggaaaattggaaa

SEQ ID NO: 132751 - DNA, 20 bp, Artificial Sequence
  Description of Artificial Sequence: Synthetic oligonucleotide
  Target: ATXN1; (+) strand; PAM type: NRG; PAM sequence: AAG
taggaaaattggaaacagct

SEQ ID NO: 132752 - DNA, 20 bp, Artificial Sequence
  Description of Artificial Sequence: Synthetic oligonucleotide
  Target: ATXN1; (+) strand; PAM type: NRG; PAM sequence: AGG
aggaaaattggaaacagcta

SEQ ID NO: 132753 - DNA, 20 bp, Artificial Sequence
  Description of Artificial Sequence: Synthetic oligonucleotide
  Target: ATXN1; (+) strand; PAM type: NRG; PAM sequence: AAG
taaaaaaaaaaaaatctgaa

SEQ ID NO: 132754 - DNA, 20 bp, Artificial Sequence
  Description of Artificial Sequence: Synthetic oligonucleotide
  Target: ATXN1; (+) strand; PAM type: NRG; PAM sequence: CAG
aaaagtcatttgtcttaatc

SEQ ID NO: 132755 - DNA, 20 bp, Artificial Sequence
  Description of Artificial Sequence: Synthetic oligonucleotide
  Target: ATXN1; (+) strand; PAM type: NRG; PAM sequence: CAG
tcatcgtttttattccttca

SEQ ID NO: 132756 - DNA, 20 bp, Artificial Sequence
  Description of Artificial Sequence: Synthetic oligonucleotide
  Target: ATXN1; (+) strand; PAM type: NRG; PAM sequence: AGG
catcgtttttattccttcac

SEQ ID NO: 132757 - DNA, 20 bp, Artificial Sequence
  Description of Artificial Sequence: Synthetic oligonucleotide
  Target: ATXN1; (+) strand; PAM type: NRG; PAM sequence: GGG
atcgtttttattccttcaca

SEQ ID NO: 132758 - DNA, 20 bp, Artificial Sequence
  Description of Artificial Sequence: Synthetic oligonucleotide
  Target: ATXN1; (+) strand; PAM type: NRG; PAM sequence: AAG
ttccttcacagggaataatg

SEQ ID NO: 132759 - DNA, 20 bp, Artificial Sequence
  Description of Artificial Sequence: Synthetic oligonucleotide
  Target: ATXN1; (+) strand; PAM type: NRG; PAM sequence: GAG
ccttcacagggaataatgaa

SEQ ID NO: 132760 - DNA, 20 bp, Artificial Sequence
  Description of Artificial Sequence: Synthetic oligonucleotide
  Target: ATXN1; (+) strand; PAM type: NRG; PAM sequence: AAG
gggaataatgaagagcaaat

SEQ ID NO: 132761 - DNA, 20 bp, Artificial Sequence
  Description of Artificial Sequence: Synthetic oligonucleotide
  Target: ATXN1; (+) strand; PAM type: NRG; PAM sequence: AGG
ggaataatgaagagcaaata

SEQ ID NO: 132762 - DNA, 20 bp, Artificial Sequence
  Description of Artificial Sequence: Synthetic oligonucleotide
  Target: ATXN1; (+) strand; PAM type: NRG; PAM sequence: CAG
gagcaaataaggaatatcat

SEQ ID NO: 132763 - DNA, 20 bp, Artificial Sequence
  Description of Artificial Sequence: Synthetic oligonucleotide
  Target: ATXN1; (+) strand; PAM type: NRG; PAM sequence: GAG
gcaaataaggaatatcatca

SEQ ID NO: 132764 - DNA, 20 bp, Artificial Sequence
  Description of Artificial Sequence: Synthetic oligonucleotide
  Target: ATXN1; (+) strand; PAM type: NRG; PAM sequence: AAG
ataaggaatatcatcagaga

SEQ ID NO: 132765 - DNA, 20 bp, Artificial Sequence
  Description of Artificial Sequence: Synthetic oligonucleotide
  Target: ATXN1; (+) strand; PAM type: NRG; PAM sequence: TGG
ggaatatcatcagagaaaga

SEQ ID NO: 132766 - DNA, 20 bp, Artificial Sequence
  Description of Artificial Sequence: Synthetic oligonucleotide
  Target: ATXN1; (+) strand; PAM type: NRG; PAM sequence: AAG
cagagaaagatggactccct

SEQ ID NO: 132767 - DNA, 20 bp, Artificial Sequence
  Description of Artificial Sequence: Synthetic oligonucleotide
  Target: ATXN1; (+) strand; PAM type: NRG; PAM sequence: CAG
attttcttgtactgctctta

SEQ ID NO: 132768 - DNA, 20 bp, Artificial Sequence
  Description of Artificial Sequence: Synthetic oligonucleotide
  Target: ATXN1; (+) strand; PAM type: NRG; PAM sequence: AAG
cttacagtattttccaaaca

SEQ ID NO: 132769 - DNA, 20 bp, Artificial Sequence
  Description of Artificial Sequence: Synthetic oligonucleotide
  Target: ATXN1; (+) strand; PAM type: NRG; PAM sequence: TAG
ctgttcttttctacatatga

SEQ ID NO: 132770 - DNA, 20 bp, Artificial Sequence
  Description of Artificial Sequence: Synthetic oligonucleotide
  Target: ATXN1; (+) strand; PAM type: NRG; PAM sequence: CAG
cttttctacatatgatagtt

SEQ ID NO: 132771 - DNA, 20 bp, Artificial Sequence
  Description of Artificial Sequence: Synthetic oligonucleotide
  Target: ATXN1; (+) strand; PAM type: NRG; PAM sequence: CAG
ctacatatgatagttcagcc

SEQ ID NO: 132772 - DNA, 20 bp, Artificial Sequence
  Description of Artificial Sequence: Synthetic oligonucleotide
  Target: ATXN1; (+) strand; PAM type: NRG; PAM sequence: CAG
ttcagcccagcaaatgtcct

SEQ ID NO: 132773 - DNA, 20 bp, Artificial Sequence
  Description of Artificial Sequence: Synthetic oligonucleotide
  Target: ATXN1; (+) strand; PAM type: NRG; PAM sequence: AGG
tcagcccagcaaatgtcctc

SEQ ID NO: 132774 - DNA, 20 bp, Artificial Sequence
  Description of Artificial Sequence: Synthetic oligonucleotide
  Target: ATXN1; (+) strand; PAM type: NRG; PAM sequence: CAG
cctcaggaataataaacaaa

SEQ ID NO: 132775 - DNA, 20 bp, Artificial Sequence
  Description of Artificial Sequence: Synthetic oligonucleotide
  Target: ATXN1; (+) strand; PAM type: NRG; PAM sequence: TGG
caggaataataaacaaacag

SEQ ID NO: 132776 - DNA, 20 bp, Artificial Sequence
  Description of Artificial Sequence: Synthetic oligonucleotide
  Target: ATXN1; (+) strand; PAM type: NRG; PAM sequence: GGG
aggaataataaacaaacagt

SEQ ID NO: 132777 - DNA, 20 bp, Artificial Sequence
  Description of Artificial Sequence: Synthetic oligonucleotide
  Target: ATXN1; (+) strand; PAM type: NRG; PAM sequence: GGG
ggaataataaacaaacagtg

SEQ ID NO: 132778 - DNA, 20 bp, Artificial Sequence
  Description of Artificial Sequence: Synthetic oligonucleotide
  Target: ATXN1; (+) strand; PAM type: NRG; PAM sequence: GGG
gaataataaacaaacagtgg

SEQ ID NO: 132779 - DNA, 20 bp, Artificial Sequence
  Description of Artificial Sequence: Synthetic oligonucleotide
  Target: ATXN1; (+) strand; PAM type: NRG; PAM sequence: AAG
tctgcaacattcttcatcca

SEQ ID NO: 132780 - DNA, 20 bp, Artificial Sequence
  Description of Artificial Sequence: Synthetic oligonucleotide
  Target: ATXN1; (+) strand; PAM type: NRG; PAM sequence: AAG
tccaaagcattttcaattcc

SEQ ID NO: 132781 - DNA, 20 bp, Artificial Sequence
  Description of Artificial Sequence: Synthetic oligonucleotide
  Target: ATXN1; (+) strand; PAM type: NRG; PAM sequence: AAG
aagcattttcaattccaagc

SEQ ID NO: 132782 - DNA, 20 bp, Artificial Sequence
  Description of Artificial Sequence: Synthetic oligonucleotide
  Target: ATXN1; (+) strand; PAM type: NRG; PAM sequence: AAG
ttttcaattccaagcaagca

SEQ ID NO: 132783 - DNA, 20 bp, Artificial Sequence
  Description of Artificial Sequence: Synthetic oligonucleotide
  Target: ATXN1; (+) strand; PAM type: NRG; PAM sequence: AAG
ttccaagcaagcaaagacac

SEQ ID NO: 132784 - DNA, 20 bp, Artificial Sequence
  Description of Artificial Sequence: Synthetic oligonucleotide
  Target: ATXN1; (+) strand; PAM type: NRG; PAM sequence: AGG
tccaagcaagcaaagacaca

SEQ ID NO: 132785 - DNA, 20 bp, Artificial Sequence
  Description of Artificial Sequence: Synthetic oligonucleotide
  Target: ATXN1; (+) strand; PAM type: NRG; PAM sequence: AAG
aaaatacactgccttattac

SEQ ID NO: 132786 - DNA, 20 bp, Artificial Sequence
  Description of Artificial Sequence: Synthetic oligonucleotide
  Target: ATXN1; (+) strand; PAM type: NRG; PAM sequence: TAG
attacaagaactgcacacaa

SEQ ID NO: 132787 - DNA, 20 bp, Artificial Sequence
  Description of Artificial Sequence: Synthetic oligonucleotide
  Target: ATXN1; (+) strand; PAM type: NRG; PAM sequence: GAG
tacaagaactgcacacaata

SEQ ID NO: 132788 - DNA, 20 bp, Artificial Sequence
  Description of Artificial Sequence: Synthetic oligonucleotide
  Target: ATXN1; (+) strand; PAM type: NRG; PAM sequence: CAG
cacaatagagaatctgtatt

SEQ ID NO: 132789 - DNA, 20 bp, Artificial Sequence
  Description of Artificial Sequence: Synthetic oligonucleotide
  Target: ATXN1; (+) strand; PAM type: NRG; PAM sequence: AAG
taactcctactattgttcta

SEQ ID NO: 132790 - DNA, 20 bp, Artificial Sequence
  Description of Artificial Sequence: Synthetic oligonucleotide
  Target: ATXN1; (+) strand; PAM type: NRG; PAM sequence: AGG
aactcctactattgttctaa

SEQ ID NO: 132791 - DNA, 20 bp, Artificial Sequence
  Description of Artificial Sequence: Synthetic oligonucleotide
  Target: ATXN1; (+) strand; PAM type: NRG; PAM sequence: AAG
tattgttctaaaggatgaat

SEQ ID NO: 132792 - DNA, 20 bp, Artificial Sequence
  Description of Artificial Sequence: Synthetic oligonucleotide
  Target: ATXN1; (+) strand; PAM type: NRG; PAM sequence: TAG
atcatgcactttaattacaa

SEQ ID NO: 132793 - DNA, 20 bp, Artificial Sequence
  Description of Artificial Sequence: Synthetic oligonucleotide
  Target: ATXN1; (+) strand; PAM type: NRG; PAM sequence: AAG
acaatagtaaatactgccga

SEQ ID NO: 132794 - DNA, 20 bp, Artificial Sequence
  Description of Artificial Sequence: Synthetic oligonucleotide
  Target: ATXN1; (+) strand; PAM type: NRG; PAM sequence: AGG
caatagtaaatactgccgaa

SEQ ID NO: 132795 - DNA, 20 bp, Artificial Sequence
  Description of Artificial Sequence: Synthetic oligonucleotide
  Target: ATXN1; (+) strand; PAM type: NRG; PAM sequence: AAG
tcaatgtgtcttttccatgt

SEQ ID NO: 132796 - DNA, 20 bp, Artificial Sequence
  Description of Artificial Sequence: Synthetic oligonucleotide
  Target: ATXN1; (+) strand; PAM type: NRG; PAM sequence: GAG
aatgtgtcttttccatgtaa

SEQ ID NO: 132797 - DNA, 20 bp, Artificial Sequence
  Description of Artificial Sequence: Synthetic oligonucleotide
  Target: ATXN1; (+) strand; PAM type: NRG; PAM sequence: GAG
tgtgtcttttccatgtaaga

SEQ ID NO: 132798 - DNA, 20 bp, Artificial Sequence
  Description of Artificial Sequence: Synthetic oligonucleotide
  Target: ATXN1; (+) strand; PAM type: NRG; PAM sequence: CAG
tttccatgtaagagagcata

SEQ ID NO: 132799 - DNA, 20 bp, Artificial Sequence
  Description of Artificial Sequence: Synthetic oligonucleotide
  Target: ATXN1; (+) strand; PAM type: NRG; PAM sequence: CAG
ccatgtaagagagcatacag

SEQ ID NO: 132800 - DNA, 20 bp, Artificial Sequence
  Description of Artificial Sequence: Synthetic oligonucleotide
  Target: ATXN1; (+) strand; PAM type: NRG; PAM sequence: GAG
atgtaagagagcatacagca

SEQ ID NO: 132801 - DNA, 20 bp, Artificial Sequence
  Description of Artificial Sequence: Synthetic oligonucleotide
  Target: ATXN1; (+) strand; PAM type: NRG; PAM sequence: AGG
tgtaagagagcatacagcag

SEQ ID NO: 132802 - DNA, 20 bp, Artificial Sequence
  Description of Artificial Sequence: Synthetic oligonucleotide
  Target: ATXN1; (+) strand; PAM type: NRG; PAM sequence: AAG
tcatgaatgcacatacaaat

SEQ ID NO: 132803 - DNA, 20 bp, Artificial Sequence
  Description of Artificial Sequence: Synthetic oligonucleotide
  Target: ATXN1; (+) strand; PAM type: NRG; PAM sequence: CAG
caaataagctcttatgcaca

SEQ ID NO: 132804 - DNA, 20 bp, Artificial Sequence
  Description of Artificial Sequence: Synthetic oligonucleotide
  Target: ATXN1; (+) strand; PAM type: NRG; PAM sequence: GAG
aataagctcttatgcacaca

SEQ ID NO: 132805 - DNA, 20 bp, Artificial Sequence
  Description of Artificial Sequence: Synthetic oligonucleotide
  Target: ATXN1; (+) strand; PAM type: NRG; PAM sequence: TAG
acacagagtaacccccatgt

SEQ ID NO: 132806 - DNA, 20 bp, Artificial Sequence
  Description of Artificial Sequence: Synthetic oligonucleotide
  Target: ATXN1; (+) strand; PAM type: NRG; PAM sequence: CAG
ttagcatgcatttataaata

SEQ ID NO: 132807 - DNA, 20 bp, Artificial Sequence
  Description of Artificial Sequence: Synthetic oligonucleotide
  Target: ATXN1; (+) strand; PAM type: NRG; PAM sequence: TGG
catgcatttataaatacagc

SEQ ID NO: 132808 - DNA, 20 bp, Artificial Sequence
  Description of Artificial Sequence: Synthetic oligonucleotide
  Target: ATXN1; (+) strand; PAM type: NRG; PAM sequence: GAG
aatacagctggccccacccc

SEQ ID NO: 132809 - DNA, 20 bp, Artificial Sequence
  Description of Artificial Sequence: Synthetic oligonucleotide
  Target: ATXN1; (+) strand; PAM type: NRG; PAM sequence: TGG
ggccccaccccgagcatgca

SEQ ID NO: 132810 - DNA, 20 bp, Artificial Sequence
  Description of Artificial Sequence: Synthetic oligonucleotide
  Target: ATXN1; (+) strand; PAM type: NRG; PAM sequence: GAG
ccccaccccgagcatgcatg

SEQ ID NO: 132811 - DNA, 20 bp, Artificial Sequence
  Description of Artificial Sequence: Synthetic oligonucleotide
  Target: ATXN1; (+) strand; PAM type: NRG; PAM sequence: CAG
atgcatggagtatacacaaa

SEQ ID NO: 132812 - DNA, 20 bp, Artificial Sequence
  Description of Artificial Sequence: Synthetic oligonucleotide
  Target: ATXN1; (+) strand; PAM type: NRG; PAM sequence: AAG
gagtatacacaaacagcata

SEQ ID NO: 132813 - DNA, 20 bp, Artificial Sequence
  Description of Artificial Sequence: Synthetic oligonucleotide
  Target: ATXN1; (+) strand; PAM type: NRG; PAM sequence: AGG
agtatacacaaacagcataa

SEQ ID NO: 132814 - DNA, 20 bp, Artificial Sequence
  Description of Artificial Sequence: Synthetic oligonucleotide
  Target: ATXN1; (+) strand; PAM type: NRG; PAM sequence: CAG
tacacaaacagcataaaggc

SEQ ID NO: 132815 - DNA, 20 bp, Artificial Sequence
  Description of Artificial Sequence: Synthetic oligonucleotide
  Target: ATXN1; (+) strand; PAM type: NRG; PAM sequence: TAG
ttgacttccttttgctttta

SEQ ID NO: 132816 - DNA, 20 bp, Artificial Sequence
  Description of Artificial Sequence: Synthetic oligonucleotide
  Target: ATXN1; (+) strand; PAM type: NRG; PAM sequence: AGG
tgacttccttttgcttttat

SEQ ID NO: 132817 - DNA, 20 bp, Artificial Sequence
  Description of Artificial Sequence: Synthetic oligonucleotide
  Target: ATXN1; (+) strand; PAM type: NRG; PAM sequence: GAG
acttccttttgcttttatag

SEQ ID NO: 132818 - DNA, 20 bp, Artificial Sequence
  Description of Artificial Sequence: Synthetic oligonucleotide
  Target: ATXN1; (+) strand; PAM type: NRG; PAM sequence: AAG
ttataggagattgacataaa

SEQ ID NO: 132819 - DNA, 20 bp, Artificial Sequence
  Description of Artificial Sequence: Synthetic oligonucleotide
  Target: ATXN1; (+) strand; PAM type: NRG; PAM sequence: AAG
ttgacataaaaagctaaaaa

SEQ ID NO: 132820 - DNA, 20 bp, Artificial Sequence
  Description of Artificial Sequence: Synthetic oligonucleotide
  Target: ATXN1; (+) strand; PAM type: NRG; PAM sequence: AAG
ataaaaagctaaaaaaagac

SEQ ID NO: 132821 - DNA, 20 bp, Artificial Sequence
  Description of Artificial Sequence: Synthetic oligonucleotide
  Target: ATXN1; (+) strand; PAM type: NRG; PAM sequence: TAG
aaaagctaaaaaaagacaag

SEQ ID NO: 132822 - DNA, 20 bp, Artificial Sequence
  Description of Artificial Sequence: Synthetic oligonucleotide
  Target: ATXN1; (+) strand; PAM type: NRG; PAM sequence: TGG
aaagacaagtagacacttca

SEQ ID NO: 132823 - DNA, 20 bp, Artificial Sequence
  Description of Artificial Sequence: Synthetic oligonucleotide
  Target: ATXN1; (+) strand; PAM type: NRG; PAM sequence: GAG
agacaagtagacacttcatg

SEQ ID NO: 132824 - DNA, 20 bp, Artificial Sequence
  Description of Artificial Sequence: Synthetic oligonucleotide
  Target: ATXN1; (+) strand; PAM type: NRG; PAM sequence: AAG
acttcatggagcctgtgatt

SEQ ID NO: 132825 - DNA, 20 bp, Artificial Sequence
  Description of Artificial Sequence: Synthetic oligonucleotide
  Target: ATXN1; (+) strand; PAM type: NRG; PAM sequence: GAG
ttcatggagcctgtgattaa

SEQ ID NO: 132826 - DNA, 20 bp, Artificial Sequence
  Description of Artificial Sequence: Synthetic oligonucleotide
  Target: ATXN1; (+) strand; PAM type: NRG; PAM sequence: GAG
catggagcctgtgattaaga

SEQ ID NO: 132827 - DNA, 20 bp, Artificial Sequence
  Description of Artificial Sequence: Synthetic oligonucleotide
  Target: ATXN1; (+) strand; PAM type: NRG; PAM sequence: AAG
ggagcctgtgattaagagag

SEQ ID NO: 132828 - DNA, 20 bp, Artificial Sequence
  Description of Artificial Sequence: Synthetic oligonucleotide
  Target: ATXN1; (+) strand; PAM type: NRG; PAM sequence: GAG
tgattaagagagaagctaat

SEQ ID NO: 132829 - DNA, 20 bp, Artificial Sequence
  Description of Artificial Sequence: Synthetic oligonucleotide
  Target: ATXN1; (+) strand; PAM type: NRG; PAM sequence: CAG
taagagagaagctaatgaga

SEQ ID NO: 132830 - DNA, 20 bp, Artificial Sequence
  Description of Artificial Sequence: Synthetic oligonucleotide
  Target: ATXN1; (+) strand; PAM type: NRG; PAM sequence: TGG
agagaagctaatgagacaga

SEQ ID NO: 132831 - DNA, 20 bp, Artificial Sequence
  Description of Artificial Sequence: Synthetic oligonucleotide
  Target: ATXN1; (+) strand; PAM type: NRG; PAM sequence: GGG
gagaagctaatgagacagat

SEQ ID NO: 132832 - DNA, 20 bp, Artificial Sequence
  Description of Artificial Sequence: Synthetic oligonucleotide
  Target: ATXN1; (+) strand; PAM type: NRG; PAM sequence: AAG
gacagatgggctgatgcata

SEQ ID NO: 132833 - DNA, 20 bp, Artificial Sequence
  Description of Artificial Sequence: Synthetic oligonucleotide
  Target: ATXN1; (+) strand; PAM type: NRG; PAM sequence: AGG
acagatgggctgatgcataa

SEQ ID NO: 132834 - DNA, 20 bp, Artificial Sequence
  Description of Artificial Sequence: Synthetic oligonucleotide
  Target: ATXN1; (+) strand; PAM type: NRG; PAM sequence: GGG
cagatgggctgatgcataaa

SEQ ID NO: 132835 - DNA, 20 bp, Artificial Sequence
  Description of Artificial Sequence: Synthetic oligonucleotide
  Target: ATXN1; (+) strand; PAM type: NRG; PAM sequence: CAG
ctgatgcataaagggaactt

SEQ ID NO: 132836 - DNA, 20 bp, Artificial Sequence
  Description of Artificial Sequence: Synthetic oligonucleotide
  Target: ATXN1; (+) strand; PAM type: NRG; PAM sequence: CAG
taaagggaacttcagcacac

SEQ ID NO: 132837 - DNA, 20 bp, Artificial Sequence
  Description of Artificial Sequence: Synthetic oligonucleotide
  Target: ATXN1; (+) strand; PAM type: NRG; PAM sequence: CAG
tcagcacaccagcccacact

SEQ ID NO: 132838 - DNA, 20 bp, Artificial Sequence
  Description of Artificial Sequence: Synthetic oligonucleotide
  Target: ATXN1; (+) strand; PAM type: NRG; PAM sequence: AAG
acaccagcccacactcagta

SEQ ID NO: 132839 - DNA, 20 bp, Artificial Sequence
  Description of Artificial Sequence: Synthetic oligonucleotide
  Target: ATXN1; (+) strand; PAM type: NRG; PAM sequence: CAG
gtgcttcactgtctccgttt

SEQ ID NO: 132840 - DNA, 20 bp, Artificial Sequence
  Description of Artificial Sequence: Synthetic oligonucleotide
  Target: ATXN1; (+) strand; PAM type: NRG; PAM sequence: TGG
ccgtttcagtcttcatcatg

SEQ ID NO: 132841 - DNA, 20 bp, Artificial Sequence
  Description of Artificial Sequence: Synthetic oligonucleotide
  Target: ATXN1; (+) strand; PAM type: NRG; PAM sequence: CAG
acttacattactcttgtccc

SEQ ID NO: 132842 - DNA, 20 bp, Artificial Sequence
  Description of Artificial Sequence: Synthetic oligonucleotide
  Target: ATXN1; (+) strand; PAM type: NRG; PAM sequence: CAG
ttactcttgtccccagacca

SEQ ID NO: 132843 - DNA, 20 bp, Artificial Sequence
  Description of Artificial Sequence: Synthetic oligonucleotide
  Target: ATXN1; (+) strand; PAM type: NRG; PAM sequence: CAG
acaccccgcttttctctgcc

SEQ ID NO: 132844 - DNA, 20 bp, Artificial Sequence
  Description of Artificial Sequence: Synthetic oligonucleotide
  Target: ATXN1; (+) strand; PAM type: NRG; PAM sequence: TAG
ctgcccagacctccctaaat

SEQ ID NO: 132845 - DNA, 20 bp, Artificial Sequence
  Description of Artificial Sequence: Synthetic oligonucleotide
  Target: ATXN1; (+) strand; PAM type: NRG; PAM sequence: AGG
tgcccagacctccctaaatt

SEQ ID NO: 132846 - DNA, 20 bp, Artificial Sequence
  Description of Artificial Sequence: Synthetic oligonucleotide
  Target: ATXN1; (+) strand; PAM type: NRG; PAM sequence: AAG
ttaggattatcaaatgacac

SEQ ID NO: 132847 - DNA, 20 bp, Artificial Sequence
  Description of Artificial Sequence: Synthetic oligonucleotide
  Target: ATXN1; (+) strand; PAM type: NRG; PAM sequence: TAG
gattatcaaatgacacaaga

SEQ ID NO: 132848 - DNA, 20 bp, Artificial Sequence
  Description of Artificial Sequence: Synthetic oligonucleotide
  Target: ATXN1; (+) strand; PAM type: NRG; PAM sequence: CAG
tatcaaatgacacaagatag

SEQ ID NO: 132849 - DNA, 20 bp, Artificial Sequence
  Description of Artificial Sequence: Synthetic oligonucleotide
  Target: ATXN1; (+) strand; PAM type: NRG; PAM sequence: AAG
ctgctttaatgttgttattc

SEQ ID NO: 132850 - DNA, 20 bp, Artificial Sequence
  Description of Artificial Sequence: Synthetic oligonucleotide
  Target: ATXN1; (+) strand; PAM type: NRG; PAM sequence: AGG
tgctttaatgttgttattca

SEQ ID NO: 132851 - DNA, 20 bp, Artificial Sequence
  Description of Artificial Sequence: Synthetic oligonucleotide
  Target: ATXN1; (+) strand; PAM type: NRG; PAM sequence: CAG
tgttattcaaggtttactca

SEQ ID NO: 132852 - DNA, 20 bp, Artificial Sequence
  Description of Artificial Sequence: Synthetic oligonucleotide
  Target: ATXN1; (+) strand; PAM type: NRG; PAM sequence: AGG
gttattcaaggtttactcac

SEQ ID NO: 132853 - DNA, 20 bp, Artificial Sequence
  Description of Artificial Sequence: Synthetic oligonucleotide
  Target: ATXN1; (+) strand; PAM type: NRG; PAM sequence: TGG
atatttactataaaatcttg

SEQ ID NO: 132854 - DNA, 20 bp, Artificial Sequence
  Description of Artificial Sequence: Synthetic oligonucleotide
  Target: ATXN1; (+) strand; PAM type: NRG; PAM sequence: TGG
tactataaaatcttgtggtt

SEQ ID NO: 132855 - DNA, 20 bp, Artificial Sequence
  Description of Artificial Sequence: Synthetic oligonucleotide
  Target: ATXN1; (+) strand; PAM type: NRG; PAM sequence: CGG
ataaaatcttgtggtttggc

SEQ ID NO: 132856 - DNA, 20 bp, Artificial Sequence
  Description of Artificial Sequence: Synthetic oligonucleotide
  Target: ATXN1; (+) strand; PAM type: NRG; PAM sequence: GGG
taaaatcttgtggtttggcc

SEQ ID NO: 132857 - DNA, 20 bp, Artificial Sequence
  Description of Artificial Sequence: Synthetic oligonucleotide
  Target: ATXN1; (+) strand; PAM type: NRG; PAM sequence: CGG
tcttgtggtttggccgggca

SEQ ID NO: 132858 - DNA, 20 bp, Artificial Sequence
  Description of Artificial Sequence: Synthetic oligonucleotide
  Target: ATXN1; (+) strand; PAM type: NRG; PAM sequence: TGG
tgtggtttggccgggcacgg

SEQ ID NO: 132859 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgcaatcc

SEQ ID NO: 132860 - DNA, 20 bp, Artificial Sequence
  Description of Artificial Sequence: Synthetic oligonucleotide
  Target: ATXN1; (+) strand; PAM type: NRG; PAM sequence: TGG
tgcctgcaatcccagccctt

SEQ ID NO: 132861 - DNA, 20 bp, Artificial Sequence
  Description of Artificial Sequence: Synthetic oligonucleotide
  Target: ATXN1; (+) strand; PAM type: NRG; PAM sequence: GGG
gcctgcaatcccagcccttt

SEQ ID NO: 132862 - DNA, 20 bp, Artificial Sequence
  Description of Artificial Sequence: Synthetic oligonucleotide
  Target: ATXN1; (+) strand; PAM type: NRG; PAM sequence: GAG
ctgcaatcccagccctttgg

SEQ ID NO: 132863 - DNA, 20 bp, Artificial Sequence
  Description of Artificial Sequence: Synthetic oligonucleotide
  Target: ATXN1; (+) strand; PAM type: NRG; PAM sequence: AGG
tgcaatcccagccctttggg

SEQ ID NO: 132864 - DNA, 20 bp, Artificial Sequence
  Description of Artificial Sequence: Synthetic oligonucleotide
  Target: ATXN1; (+) strand; PAM type: NRG; PAM sequence: GAG
tcccagccctttgggaggcc

SEQ ID NO: 132865 - DNA, 20 bp, Artificial Sequence
  Description of Artificial Sequence: Synthetic oligonucleotide
  Target: ATXN1; (+) strand; PAM type: NRG; PAM sequence: AGG
cccagccctttgggaggccg

SEQ ID NO: 132866 - DNA, 20 bp, Artificial Sequence
  Description of Artificial Sequence: Synthetic oligonucleotide
  Target: ATXN1; (+) strand; PAM type: NRG; PAM sequence: GAG
cagccctttgggaggccgag

SEQ ID NO: 132867 - DNA, 20 bp, Artificial Sequence
  Description of Artificial Sequence: Synthetic oligonucleotide
  Target: ATXN1; (+) strand; PAM type: NRG; PAM sequence: AGG
agccctttgggaggccgagg

SEQ ID NO: 132868 - DNA, 20 bp, Artificial Sequence
  Description of Artificial Sequence: Synthetic oligonucleotide
  Target: ATXN1; (+) strand; PAM type: NRG; PAM sequence: GGG
gccctttgggaggccgagga

SEQ ID NO: 132869 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccgaggaggg

SEQ ID NO: 132870 - DNA, 20 bp, Artificial Sequence
  Description of Artificial Sequence: Synthetic oligonucleotide
  Target: ATXN1; (+) strand; PAM type: NRG; PAM sequence: GAG
ccgaggagggtggatcacct

SEQ ID NO: 132871 - DNA, 20 bp, Artificial Sequence
  Description of Artificial Sequence: Synthetic oligonucleotide
  Target: ATXN1; (+) strand; PAM type: NRG; PAM sequence: AGG
cgaggagggtggatcacctg

SEQ ID NO: 132872 - DNA, 20 bp, Artificial Sequence
  Description of Artificial Sequence: Synthetic oligonucleotide
  Target: ATXN1; (+) strand; PAM type: NRG; PAM sequence: CAG
gagggtggatcacctgaggc

SEQ ID NO: 132873 - DNA, 20 bp, Artificial Sequence
  Description of Artificial Sequence: Synthetic oligonucleotide
  Target: ATXN1; (+) strand; PAM type: NRG; PAM sequence: AGG
agggtggatcacctgaggcc

SEQ ID NO: 132874 - DNA, 20 bp, Artificial Sequence
  Description of Artificial Sequence: Synthetic oligonucleotide
  Target: ATXN1; (+) strand; PAM type: NRG; PAM sequence: GAG
ggtggatcacctgaggccag

SEQ ID NO: 132875 - DNA, 20 bp, Artificial Sequence
  Description of Artificial Sequence: Synthetic oligonucleotide
  Target: ATXN1; (+) strand; PAM type: NRG; PAM sequence: GAG
tcacctgaggccaggagttc

SEQ ID NO: 132876 - DNA, 20 bp, Artificial Sequence
  Description of Artificial Sequence: Synthetic oligonucleotide
  Target: ATXN1; (+) strand; PAM type: NRG; PAM sequence: CAG
tgaggccaggagttcgagac

SEQ ID NO: 132877 - DNA, 20 bp, Artificial Sequence
  Description of Artificial Sequence: Synthetic oligonucleotide
  Target: ATXN1; (+) strand; PAM type: NRG; PAM sequence: TAG
ccaggagttcgagaccagcc

SEQ ID NO: 132878 - DNA, 20 bp, Artificial Sequence
  Description of Artificial Sequence: Synthetic oligonucleotide
  Target: ATXN1; (+) strand; PAM type: NRG; PAM sequence: TAG
cgagaccagcctagccaaca

SEQ ID NO: 132879 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 132880 - DNA, 20 bp, Artificial Sequence
  Description of Artificial Sequence: Synthetic oligonucleotide
  Target: ATXN1; (+) strand; PAM type: NRG; PAM sequence: CAG
ctaaaaatacaaaaattagc

SEQ ID NO: 132881 - DNA, 20 bp, Artificial Sequence
  Description of Artificial Sequence: Synthetic oligonucleotide
  Target: ATXN1; (+) strand; PAM type: NRG; PAM sequence: AGG
taaaaatacaaaaattagcc

SEQ ID NO: 132882 - DNA, 20 bp, Artificial Sequence
  Description of Artificial Sequence: Synthetic oligonucleotide
  Target: ATXN1; (+) strand; PAM type: NRG; PAM sequence: CAG
atacaaaaattagccaggtg

SEQ ID NO: 132883 - DNA, 20 bp, Artificial Sequence
  Description of Artificial Sequence: Synthetic oligonucleotide
  Target: ATXN1; (+) strand; PAM type: NRG; PAM sequence: TGG
caaaaattagccaggtgcag

SEQ ID NO: 132884 - DNA, 20 bp, Artificial Sequence
  Description of Artificial Sequence: Synthetic oligonucleotide
  Target: ATXN1; (+) strand; PAM type: NRG; PAM sequence: TAG
ggtgcagtggcgcacacctg

SEQ ID NO: 132885 - DNA, 20 bp, Artificial Sequence
  Description of Artificial Sequence: Synthetic oligonucleotide
  Target: ATXN1; (+) strand; PAM type: NRG; PAM sequence: CAG
gtggcgcacacctgtagtcc

SEQ ID NO: 132886 - DNA, 20 bp, Artificial Sequence
  Description of Artificial Sequence: Synthetic oligonucleotide
  Target: ATXN1; (+) strand; PAM type: NRG; PAM sequence: TGG
cacctgtagtcccagctact

SEQ ID NO: 132887 - DNA, 20 bp, Artificial Sequence
  Description of Artificial Sequence: Synthetic oligonucleotide
  Target: ATXN1; (+) strand; PAM type: NRG; PAM sequence: GGG
acctgtagtcccagctactt

SEQ ID NO: 132888 - DNA, 20 bp, Artificial Sequence
  Description of Artificial Sequence: Synthetic oligonucleotide
  Target: ATXN1; (+) strand; PAM type: NRG; PAM sequence: AAG
tgtagtcccagctacttggg

SEQ ID NO: 132889 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttgggaagct

SEQ ID NO: 132890 - DNA, 20 bp, Artificial Sequence
  Description of Artificial Sequence: Synthetic oligonucleotide
  Target: ATXN1; (+) strand; PAM type: NRG; PAM sequence: AGG
cccagctacttgggaagctg

SEQ ID NO: 132891 - DNA, 20 bp, Artificial Sequence
  Description of Artificial Sequence: Synthetic oligonucleotide
  Target: ATXN1; (+) strand; PAM type: NRG; PAM sequence: AAG
tacttgggaagctgaggcaa

SEQ ID NO: 132892 - DNA, 20 bp, Artificial Sequence
  Description of Artificial Sequence: Synthetic oligonucleotide
  Target: ATXN1; (+) strand; PAM type: NRG; PAM sequence: AGG
acttgggaagctgaggcaaa

SEQ ID NO: 132893 - DNA, 20 bp, Artificial Sequence
  Description of Artificial Sequence: Synthetic oligonucleotide
  Target: ATXN1; (+) strand; PAM type: NRG; PAM sequence: TGG
gcaaaaggattgcttgaacc

SEQ ID NO: 132894 - DNA, 20 bp, Artificial Sequence
  Description of Artificial Sequence: Synthetic oligonucleotide
  Target: ATXN1; (+) strand; PAM type: NRG; PAM sequence: GGG
caaaaggattgcttgaacct

SEQ ID NO: 132895 - DNA, 20 bp, Artificial Sequence
  Description of Artificial Sequence: Synthetic oligonucleotide
  Target: ATXN1; (+) strand; PAM type: NRG; PAM sequence: GAG
aaaggattgcttgaacctgg

SEQ ID NO: 132896 - DNA, 20 bp, Artificial Sequence
  Description of Artificial Sequence: Synthetic oligonucleotide
  Target: ATXN1; (+) strand; PAM type: NRG; PAM sequence: AGG
aaggattgcttgaacctggg

SEQ ID NO: 132897 - DNA, 20 bp, Artificial Sequence
  Description of Artificial Sequence: Synthetic oligonucleotide
  Target: ATXN1; (+) strand; PAM type: NRG; PAM sequence: CAG
gattgcttgaacctgggagg

SEQ ID NO: 132898 - DNA, 20 bp, Artificial Sequence
  Description of Artificial Sequence: Synthetic oligonucleotide
  Target: ATXN1; (+) strand; PAM type: NRG; PAM sequence: GAG
ttgcttgaacctgggaggca

SEQ ID NO: 132899 - DNA, 20 bp, Artificial Sequence
  Description of Artificial Sequence: Synthetic oligonucleotide
  Target: ATXN1; (+) strand; PAM type: NRG; PAM sequence: AGG
tgcttgaacctgggaggcag

SEQ ID NO: 132900 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggcagaggttg

SEQ ID NO: 132901 - DNA, 20 bp, Artificial Sequence
  Description of Artificial Sequence: Synthetic oligonucleotide
  Target: ATXN1; (+) strand; PAM type: NRG; PAM sequence: GAG
tgggaggcagaggttgcagt

SEQ ID NO: 132902 - DNA, 20 bp, Artificial Sequence
  Description of Artificial Sequence: Synthetic oligonucleotide
  Target: ATXN1; (+) strand; PAM type: NRG; PAM sequence: GAG
ggcagaggttgcagtgagcc

SEQ ID NO: 132903 - DNA, 20 bp, Artificial Sequence
  Description of Artificial Sequence: Synthetic oligonucleotide
  Target: ATXN1; (+) strand; PAM type: NRG; PAM sequence: CAG
gagatcgtgccattgcactc

SEQ ID NO: 132904 - DNA, 20 bp, Artificial Sequence
  Description of Artificial Sequence: Synthetic oligonucleotide
  Target: ATXN1; (+) strand; PAM type: NRG; PAM sequence: TGG
cgtgccattgcactccagct

SEQ ID NO: 132905 - DNA, 20 bp, Artificial Sequence
  Description of Artificial Sequence: Synthetic oligonucleotide
  Target: ATXN1; (+) strand; PAM type: NRG; PAM sequence: GGG
gtgccattgcactccagctt

SEQ ID NO: 132906 - DNA, 20 bp, Artificial Sequence
  Description of Artificial Sequence: Synthetic oligonucleotide
  Target: ATXN1; (+) strand; PAM type: NRG; PAM sequence: CAG
ttgcactccagcttgggcaa

SEQ ID NO: 132907 - DNA, 20 bp, Artificial Sequence
  Description of Artificial Sequence: Synthetic oligonucleotide
  Target: ATXN1; (+) strand; PAM type: NRG; PAM sequence: GAG
gcactccagcttgggcaaca

SEQ ID NO: 132908 - DNA, 20 bp, Artificial Sequence
  Description of Artificial Sequence: Synthetic oligonucleotide
  Target: ATXN1; (+) strand; PAM type: NRG; PAM sequence: AAG
tccagcttgggcaacagagc

SEQ ID NO: 132909 - DNA, 20 bp, Artificial Sequence
  Description of Artificial Sequence: Synthetic oligonucleotide
  Target: ATXN1; (+) strand; PAM type: NRG; PAM sequence: AAG
tctcaaaaaaaaaaaaaaaa

SEQ ID NO: 132910 - DNA, 20 bp, Artificial Sequence
  Description of Artificial Sequence: Synthetic oligonucleotide
  Target: ATXN1; (+) strand; PAM type: NRG; PAM sequence: AGG
ctcaaaaaaaaaaaaaaaaa

SEQ ID NO: 132911 - DNA, 20 bp, Artificial Sequence
  Description of Artificial Sequence: Synthetic oligonucleotide
  Target: ATXN1; (+) strand; PAM type: NRG; PAM sequence: TGG
aaaaaggaaaaaaaatcatg

SEQ ID NO: 132912 - DNA, 20 bp, Artificial Sequence
  Description of Artificial Sequence: Synthetic oligonucleotide
  Target: ATXN1; (+) strand; PAM type: NRG; PAM sequence: CAG
tcatgtggtttaccgcttaa

SEQ ID NO: 132913 - DNA, 20 bp, Artificial Sequence
  Description of Artificial Sequence: Synthetic oligonucleotide
  Target: ATXN1; (+) strand; PAM type: NRG; PAM sequence: GAG
atgtggtttaccgcttaaca

SEQ ID NO: 132914 - DNA, 20 bp, Artificial Sequence
  Description of Artificial Sequence: Synthetic oligonucleotide
  Target: ATXN1; (+) strand; PAM type: NRG; PAM sequence: GAG
gtggtttaccgcttaacaga

SEQ ID NO: 132915 - DNA, 20 bp, Artificial Sequence
  Description of Artificial Sequence: Synthetic oligonucleotide
  Target: ATXN1; (+) strand; PAM type: NRG; PAM sequence: TGG
gtttaccgcttaacagagag

SEQ ID NO: 132916 - DNA, 20 bp, Artificial Sequence
  Description of Artificial Sequence: Synthetic oligonucleotide
  Target: ATXN1; (+) strand; PAM type: NRG; PAM sequence: CAG
gagagtggacaattctgtta

SEQ ID NO: 132917 - DNA, 20 bp, Artificial Sequence
  Description of Artificial Sequence: Synthetic oligonucleotide
  Target: ATXN1; (+) strand; PAM type: NRG; PAM sequence: AGG
agagtggacaattctgttac

SEQ ID NO: 132918 - DNA, 20 bp, Artificial Sequence
  Description of Artificial Sequence: Synthetic oligonucleotide
  Target: ATXN1; (+) strand; PAM type: NRG; PAM sequence: GGG
gagtggacaattctgttaca

SEQ ID NO: 132919 - DNA, 20 bp, Artificial Sequence
  Description of Artificial Sequence: Synthetic oligonucleotide
  Target: ATXN1; (+) strand; PAM type: NRG; PAM sequence: CAG
aattctgttacagggcttac

SEQ ID NO: 132920 - DNA, 20 bp, Artificial Sequence
  Description of Artificial Sequence: Synthetic oligonucleotide
  Target: ATXN1; (+) strand; PAM type: NRG; PAM sequence: TGG
agggcttaccagaatatttt

SEQ ID NO: 132921 - DNA, 20 bp, Artificial Sequence
  Description of Artificial Sequence: Synthetic oligonucleotide
  Target: ATXN1; (+) strand; PAM type: NRG; PAM sequence: TAG
ttggaaaaattctgtaaaca

SEQ ID NO: 132922 - DNA, 20 bp, Artificial Sequence
  Description of Artificial Sequence: Synthetic oligonucleotide
  Target: ATXN1; (+) strand; PAM type: NRG; PAM sequence: AAG
gaaaaattctgtaaacatag

SEQ ID NO: 132923 - DNA, 20 bp, Artificial Sequence
  Description of Artificial Sequence: Synthetic oligonucleotide
  Target: ATXN1; (+) strand; PAM type: NRG; PAM sequence: GAG
gtaaacatagaagaatttct

SEQ ID NO: 132924 - DNA, 20 bp, Artificial Sequence
  Description of Artificial Sequence: Synthetic oligonucleotide
  Target: ATXN1; (+) strand; PAM type: NRG; PAM sequence: CAG
acatagaagaatttctgagc

SEQ ID NO: 132925 - DNA, 20 bp, Artificial Sequence
  Description of Artificial Sequence: Synthetic oligonucleotide
  Target: ATXN1; (+) strand; PAM type: NRG; PAM sequence: GAG
aatttctgagccagaaaaat

SEQ ID NO: 132926 - DNA, 20 bp, Artificial Sequence
  Description of Artificial Sequence: Synthetic oligonucleotide
  Target: ATXN1; (+) strand; PAM type: NRG; PAM sequence: AAG
ttctgagccagaaaaatgag

SEQ ID NO: 132927 - DNA, 20 bp, Artificial Sequence
  Description of Artificial Sequence: Synthetic oligonucleotide
  Target: ATXN1; (+) strand; PAM type: NRG; PAM sequence: CAG
tgagccagaaaaatgagaag

SEQ ID NO: 132928 - DNA, 20 bp, Artificial Sequence
  Description of Artificial Sequence: Synthetic oligonucleotide
  Target: ATXN1; (+) strand; PAM type: NRG; PAM sequence: TAG
atttttaaatttttatacaa

SEQ ID NO: 132929 - DNA, 20 bp, Artificial Sequence
  Description of Artificial Sequence: Synthetic oligonucleotide
  Target: ATXN1; (+) strand; PAM type: NRG; PAM sequence: AAG
tctgatatgactgcttctct

SEQ ID NO: 132930 - DNA, 20 bp, Artificial Sequence
  Description of Artificial Sequence: Synthetic oligonucleotide
  Target: ATXN1; (+) strand; PAM type: NRG; PAM sequence: GAG
cacatgtgattactgtctct

SEQ ID NO: 132931 - DNA, 20 bp, Artificial Sequence
  Description of Artificial Sequence: Synthetic oligonucleotide
  Target: ATXN1; (+) strand; PAM type: NRG; PAM sequence: GAG
catgtgattactgtctctga

SEQ ID NO: 132932 - DNA, 20 bp, Artificial Sequence
  Description of Artificial Sequence: Synthetic oligonucleotide
  Target: ATXN1; (+) strand; PAM type: NRG; PAM sequence: AAG
gagagctcactccatgccat

SEQ ID NO: 132933 - DNA, 20 bp, Artificial Sequence
  Description of Artificial Sequence: Synthetic oligonucleotide
  Target: ATXN1; (+) strand; PAM type: NRG; PAM sequence: CAG
ctccatgccataagaaattg

SEQ ID NO: 132934 - DNA, 20 bp, Artificial Sequence
  Description of Artificial Sequence: Synthetic oligonucleotide
  Target: ATXN1; (+) strand; PAM type: NRG; PAM sequence: GAG
ccatgccataagaaattgca

SEQ ID NO: 132935 - DNA, 20 bp, Artificial Sequence
  Description of Artificial Sequence: Synthetic oligonucleotide
  Target: ATXN1; (+) strand; PAM type: NRG; PAM sequence: TAG
cataagaaattgcagagtta

SEQ ID NO: 132936 - DNA, 20 bp, Artificial Sequence
  Description of Artificial Sequence: Synthetic oligonucleotide
  Target: ATXN1; (+) strand; PAM type: NRG; PAM sequence: TAG
aaattgcagagttatagaaa

SEQ ID NO: 132937 - DNA, 20 bp, Artificial Sequence
  Description of Artificial Sequence: Synthetic oligonucleotide
  Target: ATXN1; (+) strand; PAM type: NRG; PAM sequence: TAG
agttatagaaatagcatatg

SEQ ID NO: 132938 - DNA, 20 bp, Artificial Sequence
  Description of Artificial Sequence: Synthetic oligonucleotide
  Target: ATXN1; (+) strand; PAM type: NRG; PAM sequence: GAG
ttatagaaatagcatatgta

SEQ ID NO: 132939 - DNA, 20 bp, Artificial Sequence
  Description of Artificial Sequence: Synthetic oligonucleotide
  Target: ATXN1; (+) strand; PAM type: NRG; PAM sequence: AGG
tatagaaatagcatatgtag

SEQ ID NO: 132940 - DNA, 20 bp, Artificial Sequence
  Description of Artificial Sequence: Synthetic oligonucleotide
  Target: ATXN1; (+) strand; PAM type: NRG; PAM sequence: GGG
atagaaatagcatatgtaga

SEQ ID NO: 132941 - DNA, 20 bp, Artificial Sequence
  Description of Artificial Sequence: Synthetic oligonucleotide
  Target: ATXN1; (+) strand; PAM type: NRG; PAM sequence: GAG
gatcatcacaatacccctgt

SEQ ID NO: 132942 - DNA, 20 bp, Artificial Sequence
  Description of Artificial Sequence: Synthetic oligonucleotide
  Target: ATXN1; (+) strand; PAM type: NRG; PAM sequence: CAG
atcacaatacccctgtgaga

SEQ ID NO: 132943 - DNA, 20 bp, Artificial Sequence
  Description of Artificial Sequence: Synthetic oligonucleotide
  Target: ATXN1; (+) strand; PAM type: NRG; PAM sequence: TAG
ttataattatttctatttta

SEQ ID NO: 132944 - DNA, 20 bp, Artificial Sequence
  Description of Artificial Sequence: Synthetic oligonucleotide
  Target: ATXN1; (+) strand; PAM type: NRG; PAM sequence: GAG
ataattatttctattttata

SEQ ID NO: 132945 - DNA, 20 bp, Artificial Sequence
  Description of Artificial Sequence: Synthetic oligonucleotide
  Target: ATXN1; (+) strand; PAM type: NRG; PAM sequence: CGG
atttctattttatagagatg

SEQ ID NO: 132946 - DNA, 20 bp, Artificial Sequence
  Description of Artificial Sequence: Synthetic oligonucleotide
  Target: ATXN1; (+) strand; PAM type: NRG; PAM sequence: CAG
agagatgcggaaaaaaccct

SEQ ID NO: 132947 - DNA, 20 bp, Artificial Sequence
  Description of Artificial Sequence: Synthetic oligonucleotide
  Target: ATXN1; (+) strand; PAM type: NRG; PAM sequence: GAG
ggaaaaaaccctcagatttt

SEQ ID NO: 132948 - DNA, 20 bp, Artificial Sequence
  Description of Artificial Sequence: Synthetic oligonucleotide
  Target: ATXN1; (+) strand; PAM type: NRG; PAM sequence: AAG
agattttgagtgatttccct

SEQ ID NO: 132949 - DNA, 20 bp, Artificial Sequence
  Description of Artificial Sequence: Synthetic oligonucleotide
  Target: ATXN1; (+) strand; PAM type: NRG; PAM sequence: AGG
gattttgagtgatttcccta

SEQ ID NO: 132950 - DNA, 20 bp, Artificial Sequence
  Description of Artificial Sequence: Synthetic oligonucleotide
  Target: ATXN1; (+) strand; PAM type: NRG; PAM sequence: AAG
gtgatttccctaaggtcaca

SEQ ID NO: 132951 - DNA, 20 bp, Artificial Sequence
  Description of Artificial Sequence: Synthetic oligonucleotide
  Target: ATXN1; (+) strand; PAM type: NRG; PAM sequence: AAG
cctaaggtcacaaagctgat

SEQ ID NO: 132952 - DNA, 20 bp, Artificial Sequence
  Description of Artificial Sequence: Synthetic oligonucleotide
  Target: ATXN1; (+) strand; PAM type: NRG; PAM sequence: CAG
gtcacaaagctgataagttg

SEQ ID NO: 132953 - DNA, 20 bp, Artificial Sequence
  Description of Artificial Sequence: Synthetic oligonucleotide
  Target: ATXN1; (+) strand; PAM type: NRG; PAM sequence: GAG
agctgataagttgcagaact

SEQ ID NO: 132954 - DNA, 20 bp, Artificial Sequence
  Description of Artificial Sequence: Synthetic oligonucleotide
  Target: ATXN1; (+) strand; PAM type: NRG; PAM sequence: TAG
gcagaactgagattcaaaac

SEQ ID NO: 132955 - DNA, 20 bp, Artificial Sequence
  Description of Artificial Sequence: Synthetic oligonucleotide
  Target: ATXN1; (+) strand; PAM type: NRG; PAM sequence: TGG
atttttcttgaattcatttt

SEQ ID NO: 132956 - DNA, 20 bp, Artificial Sequence
  Description of Artificial Sequence: Synthetic oligonucleotide
  Target: ATXN1; (+) strand; PAM type: NRG; PAM sequence: TAG
tttttggttctattttataa

SEQ ID NO: 132957 - DNA, 20 bp, Artificial Sequence
  Description of Artificial Sequence: Synthetic oligonucleotide
  Target: ATXN1; (+) strand; PAM type: NRG; PAM sequence: TAG
ttggttctattttataatag

SEQ ID NO: 132958 - DNA, 20 bp, Artificial Sequence
  Description of Artificial Sequence: Synthetic oligonucleotide
  Target: ATXN1; (+) strand; PAM type: NRG; PAM sequence: TGG
tctttaatctctaaattttt

SEQ ID NO: 132959 - DNA, 20 bp, Artificial Sequence
  Description of Artificial Sequence: Synthetic oligonucleotide
  Target: ATXN1; (+) strand; PAM type: NRG; PAM sequence: TGG
tttggtaacgttctattttc

SEQ ID NO: 132960 - DNA, 20 bp, Artificial Sequence
  Description of Artificial Sequence: Synthetic oligonucleotide
  Target: ATXN1; (+) strand; PAM type: NRG; PAM sequence: CAG
tctggttaaactaaaatgcc

SEQ ID NO: 132961 - DNA, 20 bp, Artificial Sequence
  Description of Artificial Sequence: Synthetic oligonucleotide
  Target: ATXN1; (+) strand; PAM type: NRG; PAM sequence: AGG
ctggttaaactaaaatgccc

SEQ ID NO: 132962 - DNA, 20 bp, Artificial Sequence
  Description of Artificial Sequence: Synthetic oligonucleotide
  Target: ATXN1; (+) strand; PAM type: NRG; PAM sequence: TGG
catctgctttctttattccc

SEQ ID NO: 132963 - DNA, 20 bp, Artificial Sequence
  Description of Artificial Sequence: Synthetic oligonucleotide
  Target: ATXN1; (+) strand; PAM type: NRG; PAM sequence: GAG
ttccctggaatcttcctttt

SEQ ID NO: 132964 - DNA, 20 bp, Artificial Sequence
  Description of Artificial Sequence: Synthetic oligonucleotide
  Target: ATXN1; (+) strand; PAM type: NRG; PAM sequence: GAG
ccctggaatcttccttttga

SEQ ID NO: 132965 - DNA, 20 bp, Artificial Sequence
  Description of Artificial Sequence: Synthetic oligonucleotide
  Target: ATXN1; (+) strand; PAM type: NRG; PAM sequence: GAG
gatatgatgttccattatct

SEQ ID NO: 132966 - DNA, 20 bp, Artificial Sequence
  Description of Artificial Sequence: Synthetic oligonucleotide
  Target: ATXN1; (+) strand; PAM type: NRG; PAM sequence: AGG
atatgatgttccattatctg

SEQ ID NO: 132967 - DNA, 20 bp, Artificial Sequence
  Description of Artificial Sequence: Synthetic oligonucleotide
  Target: ATXN1; (+) strand; PAM type: NRG; PAM sequence: GAG
gttccattatctgaggatct

SEQ ID NO: 132968 - DNA, 20 bp, Artificial Sequence
  Description of Artificial Sequence: Synthetic oligonucleotide
  Target: ATXN1; (+) strand; PAM type: NRG; PAM sequence: AGG
ttccattatctgaggatctg

SEQ ID NO: 132969 - DNA, 20 bp, Artificial Sequence
  Description of Artificial Sequence: Synthetic oligonucleotide
  Target: ATXN1; (+) strand; PAM type: NRG; PAM sequence: GAG
ctgttgctgcacatattgct

SEQ ID NO: 132970 - DNA, 20 bp, Artificial Sequence
  Description of Artificial Sequence: Synthetic oligonucleotide
  Target: ATXN1; (+) strand; PAM type: NRG; PAM sequence: TAG
ttgctgcacatattgctgag

SEQ ID NO: 132971 - DNA, 20 bp, Artificial Sequence
  Description of Artificial Sequence: Synthetic oligonucleotide
  Target: ATXN1; (+) strand; PAM type: NRG; PAM sequence: TGG
tatcctaatatttatcacaa

SEQ ID NO: 132972 - DNA, 20 bp, Artificial Sequence
  Description of Artificial Sequence: Synthetic oligonucleotide
  Target: ATXN1; (+) strand; PAM type: NRG; PAM sequence: CAG
tcacaatggctaccccattc

SEQ ID NO: 132973 - DNA, 20 bp, Artificial Sequence
  Description of Artificial Sequence: Synthetic oligonucleotide
  Target: ATXN1; (+) strand; PAM type: NRG; PAM sequence: AAG
accccattccagaaaatctg

SEQ ID NO: 132974 - DNA, 20 bp, Artificial Sequence
  Description of Artificial Sequence: Synthetic oligonucleotide
  Target: ATXN1; (+) strand; PAM type: NRG; PAM sequence: GAG
cccattccagaaaatctgaa

SEQ ID NO: 132975 - DNA, 20 bp, Artificial Sequence
  Description of Artificial Sequence: Synthetic oligonucleotide
  Target: ATXN1; (+) strand; PAM type: NRG; PAM sequence: AAG
tctctgtcactgttattccc

SEQ ID NO: 132976 - DNA, 20 bp, Artificial Sequence
  Description of Artificial Sequence: Synthetic oligonucleotide
  Target: ATXN1; (+) strand; PAM type: NRG; PAM sequence: TGG
cactgttattcccaagatcc

SEQ ID NO: 132977 - DNA, 20 bp, Artificial Sequence
  Description of Artificial Sequence: Synthetic oligonucleotide
  Target: ATXN1; (+) strand; PAM type: NRG; PAM sequence: CAG
cccaagatcctggaattaaa

SEQ ID NO: 132978 - DNA, 20 bp, Artificial Sequence
  Description of Artificial Sequence: Synthetic oligonucleotide
  Target: ATXN1; (+) strand; PAM type: NRG; PAM sequence: AAG
aagatcctggaattaaacag

SEQ ID NO: 132979 - DNA, 20 bp, Artificial Sequence
  Description of Artificial Sequence: Synthetic oligonucleotide
  Target: ATXN1; (+) strand; PAM type: NRG; PAM sequence: GAG
gatcctggaattaaacagaa

SEQ ID NO: 132980 - DNA, 20 bp, Artificial Sequence
  Description of Artificial Sequence: Synthetic oligonucleotide
  Target: ATXN1; (+) strand; PAM type: NRG; PAM sequence: TGG
aacagaagagttttcctttc

SEQ ID NO: 132981 - DNA, 20 bp, Artificial Sequence
  Description of Artificial Sequence: Synthetic oligonucleotide
  Target: ATXN1; (+) strand; PAM type: NRG; PAM sequence: CAG
gaagagttttcctttctggt

SEQ ID NO: 132982 - DNA, 20 bp, Artificial Sequence
  Description of Artificial Sequence: Synthetic oligonucleotide
  Target: ATXN1; (+) strand; PAM type: NRG; PAM sequence: CAG
agttttcctttctggtcagt

SEQ ID NO: 132983 - DNA, 20 bp, Artificial Sequence
  Description of Artificial Sequence: Synthetic oligonucleotide
  Target: ATXN1; (+) strand; PAM type: NRG; PAM sequence: CAG
ggtcagtcagttcatccttc

SEQ ID NO: 132984 - DNA, 20 bp, Artificial Sequence
  Description of Artificial Sequence: Synthetic oligonucleotide
  Target: ATXN1; (+) strand; PAM type: NRG; PAM sequence: GAG
tcagtcagttcatccttcca

SEQ ID NO: 132985 - DNA, 20 bp, Artificial Sequence
  Description of Artificial Sequence: Synthetic oligonucleotide
  Target: ATXN1; (+) strand; PAM type: NRG; PAM sequence: CAG
tcagttcatccttccagagc

SEQ ID NO: 132986 - DNA, 20 bp, Artificial Sequence
  Description of Artificial Sequence: Synthetic oligonucleotide
  Target: ATXN1; (+) strand; PAM type: NRG; PAM sequence: AAG
atccttccagagccagccca

SEQ ID NO: 132987 - DNA, 20 bp, Artificial Sequence
  Description of Artificial Sequence: Synthetic oligonucleotide
  Target: ATXN1; (+) strand; PAM type: NRG; PAM sequence: AGG
tccttccagagccagcccaa

SEQ ID NO: 132988 - DNA, 20 bp, Artificial Sequence
  Description of Artificial Sequence: Synthetic oligonucleotide
  Target: ATXN1; (+) strand; PAM type: NRG; PAM sequence: GGG
ccttccagagccagcccaaa

SEQ ID NO: 132989 - DNA, 20 bp, Artificial Sequence
  Description of Artificial Sequence: Synthetic oligonucleotide
  Target: ATXN1; (+) strand; PAM type: NRG; PAM sequence: CAG
gctttaacatcactccttct

SEQ ID NO: 132990 - DNA, 20 bp, Artificial Sequence
  Description of Artificial Sequence: Synthetic oligonucleotide
  Target: ATXN1; (+) strand; PAM type: NRG; PAM sequence: GAG
aacatcactccttctcagct

SEQ ID NO: 132991 - DNA, 20 bp, Artificial Sequence
  Description of Artificial Sequence: Synthetic oligonucleotide
  Target: ATXN1; (+) strand; PAM type: NRG; PAM sequence: CAG
acctacaacactatcttatg

SEQ ID NO: 132992 - DNA, 20 bp, Artificial Sequence
  Description of Artificial Sequence: Synthetic oligonucleotide
  Target: ATXN1; (+) strand; PAM type: NRG; PAM sequence: AGG
cctacaacactatcttatgc

SEQ ID NO: 132993 - DNA, 20 bp, Artificial Sequence
  Description of Artificial Sequence: Synthetic oligonucleotide
  Target: ATXN1; (+) strand; PAM type: NRG; PAM sequence: GGG
ctacaacactatcttatgca

SEQ ID NO: 132994 - DNA, 20 bp, Artificial Sequence
  Description of Artificial Sequence: Synthetic oligonucleotide
  Target: ATXN1; (+) strand; PAM type: NRG; PAM sequence: GGG
tacaacactatcttatgcag

SEQ ID NO: 132995 - DNA, 20 bp, Artificial Sequence
  Description of Artificial Sequence: Synthetic oligonucleotide
  Target: ATXN1; (+) strand; PAM type: NRG; PAM sequence: GGG
acaacactatcttatgcagg

SEQ ID NO: 132996 - DNA, 20 bp, Artificial Sequence
  Description of Artificial Sequence: Synthetic oligonucleotide
  Target: ATXN1; (+) strand; PAM type: NRG; PAM sequence: AAG
ctatcttatgcagggggcaa

SEQ ID NO: 132997 - DNA, 20 bp, Artificial Sequence
  Description of Artificial Sequence: Synthetic oligonucleotide
  Target: ATXN1; (+) strand; PAM type: NRG; PAM sequence: AGG
tatcttatgcagggggcaaa

SEQ ID NO: 132998 - DNA, 20 bp, Artificial Sequence
  Description of Artificial Sequence: Synthetic oligonucleotide
  Target: ATXN1; (+) strand; PAM type: NRG; PAM sequence: AAG
cttatgcagggggcaaaagg

SEQ ID NO: 132999 - DNA, 20 bp, Artificial Sequence
  Description of Artificial Sequence: Synthetic oligonucleotide
  Target: ATXN1; (+) strand; PAM type: NRG; PAM sequence: GAG
tatgcagggggcaaaaggaa

SEQ ID NO: 133000 - DNA, 20 bp, Artificial Sequence
  Description of Artificial Sequence: Synthetic oligonucleotide
  Target: ATXN1; (+) strand; PAM type: NRG; PAM sequence: AGG
atgcagggggcaaaaggaag

SEQ ID NO: 133001 - DNA, 20 bp, Artificial Sequence
  Description of Artificial Sequence: Synthetic oligonucleotide
  Target: ATXN1; (+) strand; PAM type: NRG; PAM sequence: TAG
cagggggcaaaaggaagagg

SEQ ID NO: 133002 - DNA, 20 bp, Artificial Sequence
  Description of Artificial Sequence: Synthetic oligonucleotide
  Target: ATXN1; (+) strand; PAM type: NRG; PAM sequence: AAG
aaggaagaggtagctttaaa

SEQ ID NO: 133003 - DNA, 20 bp, Artificial Sequence
  Description of Artificial Sequence: Synthetic oligonucleotide
  Target: ATXN1; (+) strand; PAM type: NRG; PAM sequence: CAG
aagaggtagctttaaaaaga

SEQ ID NO: 133004 - DNA, 20 bp, Artificial Sequence
  Description of Artificial Sequence: Synthetic oligonucleotide
  Target: ATXN1; (+) strand; PAM type: NRG; PAM sequence: CAG
agacagatccatttatgtgc

SEQ ID NO: 133005 - DNA, 20 bp, Artificial Sequence
  Description of Artificial Sequence: Synthetic oligonucleotide
  Target: ATXN1; (+) strand; PAM type: NRG; PAM sequence: CAG
gatccatttatgtgccagca

SEQ ID NO: 133006 - DNA, 20 bp, Artificial Sequence
  Description of Artificial Sequence: Synthetic oligonucleotide
  Target: ATXN1; (+) strand; PAM type: NRG; PAM sequence: TAG
tgccagcacagcctgataac

SEQ ID NO: 133007 - DNA, 20 bp, Artificial Sequence
  Description of Artificial Sequence: Synthetic oligonucleotide
  Target: ATXN1; (+) strand; PAM type: NRG; PAM sequence: GAG
ccagcacagcctgataacta

SEQ ID NO: 133008 - DNA, 20 bp, Artificial Sequence
  Description of Artificial Sequence: Synthetic oligonucleotide
  Target: ATXN1; (+) strand; PAM type: NRG; PAM sequence: TAG
gcacagcctgataactagag

SEQ ID NO: 133009 - DNA, 20 bp, Artificial Sequence
  Description of Artificial Sequence: Synthetic oligonucleotide
  Target: ATXN1; (+) strand; PAM type: NRG; PAM sequence: CAG
cagcctgataactagagtag

SEQ ID NO: 133010 - DNA, 20 bp, Artificial Sequence
  Description of Artificial Sequence: Synthetic oligonucleotide
  Target: ATXN1; (+) strand; PAM type: NRG; PAM sequence: AGG
agcctgataactagagtagc

SEQ ID NO: 133011 - DNA, 20 bp, Artificial Sequence
  Description of Artificial Sequence: Synthetic oligonucleotide
  Target: ATXN1; (+) strand; PAM type: NRG; PAM sequence: AAG
ataactagagtagcaggaaa

SEQ ID NO: 133012 - DNA, 20 bp, Artificial Sequence
  Description of Artificial Sequence: Synthetic oligonucleotide
  Target: ATXN1; (+) strand; PAM type: NRG; PAM sequence: GAG
aactagagtagcaggaaaaa

SEQ ID NO: 133013 - DNA, 20 bp, Artificial Sequence
  Description of Artificial Sequence: Synthetic oligonucleotide
  Target: ATXN1; (+) strand; PAM type: NRG; PAM sequence: AAG
gagaaaaaaaaaaaaatcac

SEQ ID NO: 133014 - DNA, 20 bp, Artificial Sequence
  Description of Artificial Sequence: Synthetic oligonucleotide
  Target: ATXN1; (+) strand; PAM type: NRG; PAM sequence: TAG
aaaaaaaaatcacaagacga

SEQ ID NO: 133015 - DNA, 20 bp, Artificial Sequence
  Description of Artificial Sequence: Synthetic oligonucleotide
  Target: ATXN1; (+) strand; PAM type: NRG; PAM sequence: TGG
atcacaagacgatagatcaa

SEQ ID NO: 133016 - DNA, 20 bp, Artificial Sequence
  Description of Artificial Sequence: Synthetic oligonucleotide
  Target: ATXN1; (+) strand; PAM type: NRG; PAM sequence: GGG
tcacaagacgatagatcaat

SEQ ID NO: 133017 - DNA, 20 bp, Artificial Sequence
  Description of Artificial Sequence: Synthetic oligonucleotide
  Target: ATXN1; (+) strand; PAM type: NRG; PAM sequence: TAG
acgatagatcaatgggacat

SEQ ID NO: 133018 - DNA, 20 bp, Artificial Sequence
  Description of Artificial Sequence: Synthetic oligonucleotide
  Target: ATXN1; (+) strand; PAM type: NRG; PAM sequence: AAG
agatcaatgggacattagat

SEQ ID NO: 133019 - DNA, 20 bp, Artificial Sequence
  Description of Artificial Sequence: Synthetic oligonucleotide
  Target: ATXN1; (+) strand; PAM type: NRG; PAM sequence: TGG
attagataagcccccctttt

SEQ ID NO: 133020 - DNA, 20 bp, Artificial Sequence
  Description of Artificial Sequence: Synthetic oligonucleotide
  Target: ATXN1; (+) strand; PAM type: NRG; PAM sequence: GGG
ttagataagccccccttttt

SEQ ID NO: 133021 - DNA, 20 bp, Artificial Sequence
  Description of Artificial Sequence: Synthetic oligonucleotide
  Target: ATXN1; (+) strand; PAM type: NRG; PAM sequence: GGG
tagataagcccccctttttg

SEQ ID NO: 133022 - DNA, 20 bp, Artificial Sequence
  Description of Artificial Sequence: Synthetic oligonucleotide
  Target: ATXN1; (+) strand; PAM type: NRG; PAM sequence: TAG
ccccctttttggggtgtgtg

SEQ ID NO: 133023 - DNA, 20 bp, Artificial Sequence
  Description of Artificial Sequence: Synthetic oligonucleotide
  Target: ATXN1; (+) strand; PAM type: NRG; PAM sequence: AGG
cccctttttggggtgtgtgt

SEQ ID NO: 133024 - DNA, 20 bp, Artificial Sequence
  Description of Artificial Sequence: Synthetic oligonucleotide
  Target: ATXN1; (+) strand; PAM type: NRG; PAM sequence: GGG
ccctttttggggtgtgtgta

SEQ ID NO: 133025 - DNA, 20 bp, Artificial Sequence
  Description of Artificial Sequence: Synthetic oligonucleotide
  Target: ATXN1; (+) strand; PAM type: NRG; PAM sequence: GGG
cctttttggggtgtgtgtag

SEQ ID NO: 133026 - DNA, 20 bp, Artificial Sequence
  Description of Artificial Sequence: Synthetic oligonucleotide
  Target: ATXN1; (+) strand; PAM type: NRG; PAM sequence: TGG
gtgtaggggattcttgactg

SEQ ID NO: 133027 - DNA, 20 bp, Artificial Sequence
  Description of Artificial Sequence: Synthetic oligonucleotide
  Target: ATXN1; (+) strand; PAM type: NRG; PAM sequence: CAG
tgactgtggtcactatattc

SEQ ID NO: 133028 - DNA, 20 bp, Artificial Sequence
  Description of Artificial Sequence: Synthetic oligonucleotide
  Target: ATXN1; (+) strand; PAM type: NRG; PAM sequence: CAG
ctgtggtcactatattccag

SEQ ID NO: 133029 - DNA, 20 bp, Artificial Sequence
  Description of Artificial Sequence: Synthetic oligonucleotide
  Target: ATXN1; (+) strand; PAM type: NRG; PAM sequence: AAG
ctatattccagcagtgacac

SEQ ID NO: 133030 - DNA, 20 bp, Artificial Sequence
  Description of Artificial Sequence: Synthetic oligonucleotide
  Target: ATXN1; (+) strand; PAM type: NRG; PAM sequence: TAG
attccagcagtgacacaagt

SEQ ID NO: 133031 - DNA, 20 bp, Artificial Sequence
  Description of Artificial Sequence: Synthetic oligonucleotide
  Target: ATXN1; (+) strand; PAM type: NRG; PAM sequence: GAG
tccagcagtgacacaagtta

SEQ ID NO: 133032 - DNA, 20 bp, Artificial Sequence
  Description of Artificial Sequence: Synthetic oligonucleotide
  Target: ATXN1; (+) strand; PAM type: NRG; PAM sequence: TGG
gtgacacaagttagagcttc

SEQ ID NO: 133033 - DNA, 20 bp, Artificial Sequence
  Description of Artificial Sequence: Synthetic oligonucleotide
  Target: ATXN1; (+) strand; PAM type: NRG; PAM sequence: GGG
tgacacaagttagagcttct

SEQ ID NO: 133034 - DNA, 20 bp, Artificial Sequence
  Description of Artificial Sequence: Synthetic oligonucleotide
  Target: ATXN1; (+) strand; PAM type: NRG; PAM sequence: GGG
gacacaagttagagcttctg

SEQ ID NO: 133035 - DNA, 20 bp, Artificial Sequence
  Description of Artificial Sequence: Synthetic oligonucleotide
  Target: ATXN1; (+) strand; PAM type: NRG; PAM sequence: AAG
agttagagcttctggggctg

SEQ ID NO: 133036 - DNA, 20 bp, Artificial Sequence
  Description of Artificial Sequence: Synthetic oligonucleotide
  Target: ATXN1; (+) strand; PAM type: NRG; PAM sequence: CAG
tgaagtccgcattgtctaaa

SEQ ID NO: 133037 - DNA, 20 bp, Artificial Sequence
  Description of Artificial Sequence: Synthetic oligonucleotide
  Target: ATXN1; (+) strand; PAM type: NRG; PAM sequence: AGG
gaagtccgcattgtctaaac

SEQ ID NO: 133038 - DNA, 20 bp, Artificial Sequence
  Description of Artificial Sequence: Synthetic oligonucleotide
  Target: ATXN1; (+) strand; PAM type: NRG; PAM sequence: CAG
tccgcattgtctaaacagga

SEQ ID NO: 133039 - DNA, 20 bp, Artificial Sequence
  Description of Artificial Sequence: Synthetic oligonucleotide
  Target: ATXN1; (+) strand; PAM type: NRG; PAM sequence: CAG
cattgtctaaacaggacagt

SEQ ID NO: 133040 - DNA, 20 bp, Artificial Sequence
  Description of Artificial Sequence: Synthetic oligonucleotide
  Target: ATXN1; (+) strand; PAM type: NRG; PAM sequence: TGG
taaacaggacagtcagactt

SEQ ID NO: 133041 - DNA, 20 bp, Artificial Sequence
  Description of Artificial Sequence: Synthetic oligonucleotide
  Target: ATXN1; (+) strand; PAM type: NRG; PAM sequence: GGG
aaacaggacagtcagacttt

SEQ ID NO: 133042 - DNA, 20 bp, Artificial Sequence
  Description of Artificial Sequence: Synthetic oligonucleotide
  Target: ATXN1; (+) strand; PAM type: NRG; PAM sequence: GGG
aacaggacagtcagactttg

SEQ ID NO: 133043 - DNA, 20 bp, Artificial Sequence
  Description of Artificial Sequence: Synthetic oligonucleotide
  Target: ATXN1; (+) strand; PAM type: NRG; PAM sequence: TGG
cactttccctgctgttttaa

SEQ ID NO: 133044 - DNA, 20 bp, Artificial Sequence
  Description of Artificial Sequence: Synthetic oligonucleotide
  Target: ATXN1; (+) strand; PAM type: NRG; PAM sequence: GGG
actttccctgctgttttaat

SEQ ID NO: 133045 - DNA, 20 bp, Artificial Sequence
  Description of Artificial Sequence: Synthetic oligonucleotide
  Target: ATXN1; (+) strand; PAM type: NRG; PAM sequence: TGG
ctgttttaatgggattattt

SEQ ID NO: 133046 - DNA, 20 bp, Artificial Sequence
  Description of Artificial Sequence: Synthetic oligonucleotide
  Target: ATXN1; (+) strand; PAM type: NRG; PAM sequence: AAG
ttttccccaaactgtcatat

SEQ ID NO: 133047 - DNA, 20 bp, Artificial Sequence
  Description of Artificial Sequence: Synthetic oligonucleotide
  Target: ATXN1; (+) strand; PAM type: NRG; PAM sequence: CAG
aaactgtcatataagtactg

SEQ ID NO: 133048 - DNA, 20 bp, Artificial Sequence
  Description of Artificial Sequence: Synthetic oligonucleotide
  Target: ATXN1; (+) strand; PAM type: NRG; PAM sequence: CAG
actgcagcttgactacttcc

SEQ ID NO: 133049 - DNA, 20 bp, Artificial Sequence
  Description of Artificial Sequence: Synthetic oligonucleotide
  Target: ATXN1; (+) strand; PAM type: NRG; PAM sequence: CAG
ccagctgccaaatttcactc

SEQ ID NO: 133050 - DNA, 20 bp, Artificial Sequence
  Description of Artificial Sequence: Synthetic oligonucleotide
  Target: ATXN1; (+) strand; PAM type: NRG; PAM sequence: GAG
agctgccaaatttcactcca

SEQ ID NO: 133051 - DNA, 20 bp, Artificial Sequence
  Description of Artificial Sequence: Synthetic oligonucleotide
  Target: ATXN1; (+) strand; PAM type: NRG; PAM sequence: TGG
gccaaatttcactccagaga

SEQ ID NO: 133052 - DNA, 20 bp, Artificial Sequence
  Description of Artificial Sequence: Synthetic oligonucleotide
  Target: ATXN1; (+) strand; PAM type: NRG; PAM sequence: CAG
ctccagagatggctgtattt

SEQ ID NO: 133053 - DNA, 20 bp, Artificial Sequence
  Description of Artificial Sequence: Synthetic oligonucleotide
  Target: ATXN1; (+) strand; PAM type: NRG; PAM sequence: TGG
cagagatggctgtatttcag

SEQ ID NO: 133054 - DNA, 20 bp, Artificial Sequence
  Description of Artificial Sequence: Synthetic oligonucleotide
  Target: ATXN1; (+) strand; PAM type: NRG; PAM sequence: AAG
gatggctgtatttcagtggc

SEQ ID NO: 133055 - DNA, 20 bp, Artificial Sequence
  Description of Artificial Sequence: Synthetic oligonucleotide
  Target: ATXN1; (+) strand; PAM type: NRG; PAM sequence: AAG
ctgtatttcagtggcaagtg

SEQ ID NO: 133056 - DNA, 20 bp, Artificial Sequence
  Description of Artificial Sequence: Synthetic oligonucleotide
  Target: ATXN1; (+) strand; PAM type: NRG; PAM sequence: AAG
tgtcatcgaaatactcattt

SEQ ID NO: 133057 - DNA, 20 bp, Artificial Sequence
  Description of Artificial Sequence: Synthetic oligonucleotide
  Target: ATXN1; (+) strand; PAM type: NRG; PAM sequence: AGG
gtcatcgaaatactcattta

SEQ ID NO: 133058 - DNA, 20 bp, Artificial Sequence
  Description of Artificial Sequence: Synthetic oligonucleotide
  Target: ATXN1; (+) strand; PAM type: NRG; PAM sequence: GGG
tcatcgaaatactcatttaa

SEQ ID NO: 133059 - DNA, 20 bp, Artificial Sequence
  Description of Artificial Sequence: Synthetic oligonucleotide
  Target: ATXN1; (+) strand; PAM type: NRG; PAM sequence: GGG
catcgaaatactcatttaag

SEQ ID NO: 133060 - DNA, 20 bp, Artificial Sequence
  Description of Artificial Sequence: Synthetic oligonucleotide
  Target: ATXN1; (+) strand; PAM type: NRG; PAM sequence: AAG
aaatactcatttaaggggtt

SEQ ID NO: 133061 - DNA, 20 bp, Artificial Sequence
  Description of Artificial Sequence: Synthetic oligonucleotide
  Target: ATXN1; (+) strand; PAM type: NRG; PAM sequence: TGG
catttaaggggttaagcatc

SEQ ID NO: 133062 - DNA, 20 bp, Artificial Sequence
  Description of Artificial Sequence: Synthetic oligonucleotide
  Target: ATXN1; (+) strand; PAM type: NRG; PAM sequence: AAG
ttaaggggttaagcatctgg

SEQ ID NO: 133063 - DNA, 20 bp, Artificial Sequence
  Description of Artificial Sequence: Synthetic oligonucleotide
  Target: ATXN1; (+) strand; PAM type: NRG; PAM sequence: GAG
aaggggttaagcatctggaa

SEQ ID NO: 133064 - DNA, 20 bp, Artificial Sequence
  Description of Artificial Sequence: Synthetic oligonucleotide
  Target: ATXN1; (+) strand; PAM type: NRG; PAM sequence: AGG
aggggttaagcatctggaag

SEQ ID NO: 133065 - DNA, 20 bp, Artificial Sequence
  Description of Artificial Sequence: Synthetic oligonucleotide
  Target: ATXN1; (+) strand; PAM type: NRG; PAM sequence: GGG
ggggttaagcatctggaaga

SEQ ID NO: 133066 - DNA, 20 bp, Artificial Sequence
  Description of Artificial Sequence: Synthetic oligonucleotide
  Target: ATXN1; (+) strand; PAM type: NRG; PAM sequence: CAG
gggttgcctttgtgcatgaa

SEQ ID NO: 133067 - DNA, 20 bp, Artificial Sequence
  Description of Artificial Sequence: Synthetic oligonucleotide
  Target: ATXN1; (+) strand; PAM type: NRG; PAM sequence: GAG
gttgcctttgtgcatgaaca

SEQ ID NO: 133068 - DNA, 20 bp, Artificial Sequence
  Description of Artificial Sequence: Synthetic oligonucleotide
  Target: ATXN1; (+) strand; PAM type: NRG; PAM sequence: TGG
tgaacagagtgtttttgttt

SEQ ID NO: 133069 - DNA, 20 bp, Artificial Sequence
  Description of Artificial Sequence: Synthetic oligonucleotide
  Target: ATXN1; (+) strand; PAM type: NRG; PAM sequence: TGG
gtttgttttattgtctatcc

SEQ ID NO: 133070 - DNA, 20 bp, Artificial Sequence
  Description of Artificial Sequence: Synthetic oligonucleotide
  Target: ATXN1; (+) strand; PAM type: NRG; PAM sequence: GAG
ttgttttattgtctatcctg

SEQ ID NO: 133071 - DNA, 20 bp, Artificial Sequence
  Description of Artificial Sequence: Synthetic oligonucleotide
  Target: ATXN1; (+) strand; PAM type: NRG; PAM sequence: AAG
ttttattgtctatcctggag

SEQ ID NO: 133072 - DNA, 20 bp, Artificial Sequence
  Description of Artificial Sequence: Synthetic oligonucleotide
  Target: ATXN1; (+) strand; PAM type: NRG; PAM sequence: AGG
tttattgtctatcctggaga

SEQ ID NO: 133073 - DNA, 20 bp, Artificial Sequence
  Description of Artificial Sequence: Synthetic oligonucleotide
  Target: ATXN1; (+) strand; PAM type: NRG; PAM sequence: GAG
tattgtctatcctggagaag

SEQ ID NO: 133074 - DNA, 20 bp, Artificial Sequence
  Description of Artificial Sequence: Synthetic oligonucleotide
  Target: ATXN1; (+) strand; PAM type: NRG; PAM sequence: AGG
attgtctatcctggagaagg

SEQ ID NO: 133075 - DNA, 20 bp, Artificial Sequence
  Description of Artificial Sequence: Synthetic oligonucleotide
  Target: ATXN1; (+) strand; PAM type: NRG; PAM sequence: TAG
atcctggagaaggaggtcat

SEQ ID NO: 133076 - DNA, 20 bp, Artificial Sequence
  Description of Artificial Sequence: Synthetic oligonucleotide
  Target: ATXN1; (+) strand; PAM type: NRG; PAM sequence: GAG
ggaggtcattagctccacct

SEQ ID NO: 133077 - DNA, 20 bp, Artificial Sequence
  Description of Artificial Sequence: Synthetic oligonucleotide
  Target: ATXN1; (+) strand; PAM type: NRG; PAM sequence: AAG
gtcattagctccacctgagc

SEQ ID NO: 133078 - DNA, 20 bp, Artificial Sequence
  Description of Artificial Sequence: Synthetic oligonucleotide
  Target: ATXN1; (+) strand; PAM type: NRG; PAM sequence: TGG
ttagctccacctgagcaaga

SEQ ID NO: 133079 - DNA, 20 bp, Artificial Sequence
  Description of Artificial Sequence: Synthetic oligonucleotide
  Target: ATXN1; (+) strand; PAM type: NRG; PAM sequence: AAG
gctccacctgagcaagatgg

SEQ ID NO: 133080 - DNA, 20 bp, Artificial Sequence
  Description of Artificial Sequence: Synthetic oligonucleotide
  Target: ATXN1; (+) strand; PAM type: NRG; PAM sequence: CAG
acaccaaaaaacactctatg

SEQ ID NO: 133081 - DNA, 20 bp, Artificial Sequence
  Description of Artificial Sequence: Synthetic oligonucleotide
  Target: ATXN1; (+) strand; PAM type: NRG; PAM sequence: CGG
tatgcagccactaaaatgca

SEQ ID NO: 133082 - DNA, 20 bp, Artificial Sequence
  Description of Artificial Sequence: Synthetic oligonucleotide
  Target: ATXN1; (+) strand; PAM type: NRG; PAM sequence: GGG
atgcagccactaaaatgcac

SEQ ID NO: 133083 - DNA, 20 bp, Artificial Sequence
  Description of Artificial Sequence: Synthetic oligonucleotide
  Target: ATXN1; (+) strand; PAM type: NRG; PAM sequence: GGG
tgcagccactaaaatgcacg

SEQ ID NO: 133084 - DNA, 20 bp, Artificial Sequence
  Description of Artificial Sequence: Synthetic oligonucleotide
  Target: ATXN1; (+) strand; PAM type: NRG; PAM sequence: CAG
actaaaatgcacggggaaaa

SEQ ID NO: 133085 - DNA, 20 bp, Artificial Sequence
  Description of Artificial Sequence: Synthetic oligonucleotide
  Target: ATXN1; (+) strand; PAM type: NRG; PAM sequence: CAG
atgcacggggaaaacagaaa

SEQ ID NO: 133086 - DNA, 20 bp, Artificial Sequence
  Description of Artificial Sequence: Synthetic oligonucleotide
  Target: ATXN1; (+) strand; PAM type: NRG; PAM sequence: TAG
gaaacagtgaccgcttttca

SEQ ID NO: 133087 - DNA, 20 bp, Artificial Sequence
  Description of Artificial Sequence: Synthetic oligonucleotide
  Target: ATXN1; (+) strand; PAM type: NRG; PAM sequence: AGG
aaacagtgaccgcttttcat

SEQ ID NO: 133088 - DNA, 20 bp, Artificial Sequence
  Description of Artificial Sequence: Synthetic oligonucleotide
  Target: ATXN1; (+) strand; PAM type: NRG; PAM sequence: CAG
ttttcataggttcttttcca

SEQ ID NO: 133089 - DNA, 20 bp, Artificial Sequence
  Description of Artificial Sequence: Synthetic oligonucleotide
  Target: ATXN1; (+) strand; PAM type: NRG; PAM sequence: AGG
tttcataggttcttttccac

SEQ ID NO: 133090 - DNA, 20 bp, Artificial Sequence
  Description of Artificial Sequence: Synthetic oligonucleotide
  Target: ATXN1; (+) strand; PAM type: NRG; PAM sequence: GGG
ttcataggttcttttccaca

SEQ ID NO: 133091 - DNA, 20 bp, Artificial Sequence
  Description of Artificial Sequence: Synthetic oligonucleotide
  Target: ATXN1; (+) strand; PAM type: NRG; PAM sequence: AAG
tcttttccacagggacttca

SEQ ID NO: 133092 - DNA, 20 bp, Artificial Sequence
  Description of Artificial Sequence: Synthetic oligonucleotide
  Target: ATXN1; (+) strand; PAM type: NRG; PAM sequence: AAG
acagggacttcaaagtctta

SEQ ID NO: 133093 - DNA, 20 bp, Artificial Sequence
  Description of Artificial Sequence: Synthetic oligonucleotide
  Target: ATXN1; (+) strand; PAM type: NRG; PAM sequence: AAG
cttcaaagtcttaaagcatc

SEQ ID NO: 133094 - DNA, 20 bp, Artificial Sequence
  Description of Artificial Sequence: Synthetic oligonucleotide
  Target: ATXN1; (+) strand; PAM type: NRG; PAM sequence: AGG
ttcaaagtcttaaagcatca

SEQ ID NO: 133095 - DNA, 20 bp, Artificial Sequence
  Description of Artificial Sequence: Synthetic oligonucleotide
  Target: ATXN1; (+) strand; PAM type: NRG; PAM sequence: TGG
gcatcaaggttgcaaaatga

SEQ ID NO: 133096 - DNA, 20 bp, Artificial Sequence
  Description of Artificial Sequence: Synthetic oligonucleotide
  Target: ATXN1; (+) strand; PAM type: NRG; PAM sequence: TAG
tgcaaaatgatggtaatttt

SEQ ID NO: 133097 - DNA, 20 bp, Artificial Sequence
  Description of Artificial Sequence: Synthetic oligonucleotide
  Target: ATXN1; (+) strand; PAM type: NRG; PAM sequence: GAG
caaaatgatggtaattttta

SEQ ID NO: 133098 - DNA, 20 bp, Artificial Sequence
  Description of Artificial Sequence: Synthetic oligonucleotide
  Target: ATXN1; (+) strand; PAM type: NRG; PAM sequence: AGG
aaaatgatggtaatttttag

SEQ ID NO: 133099 - DNA, 20 bp, Artificial Sequence
  Description of Artificial Sequence: Synthetic oligonucleotide
  Target: ATXN1; (+) strand; PAM type: NRG; PAM sequence: TGG
atgatggtaatttttagagg

SEQ ID NO: 133100 - DNA, 20 bp, Artificial Sequence
  Description of Artificial Sequence: Synthetic oligonucleotide
  Target: ATXN1; (+) strand; PAM type: NRG; PAM sequence: AAG
atggtaatttttagaggtgg

SEQ ID NO: 133101 - DNA, 20 bp, Artificial Sequence
  Description of Artificial Sequence: Synthetic oligonucleotide
  Target: ATXN1; (+) strand; PAM type: NRG; PAM sequence: GAG
tagaggtggaagaaacctct

SEQ ID NO: 133102 - DNA, 20 bp, Artificial Sequence
  Description of Artificial Sequence: Synthetic oligonucleotide
  Target: ATXN1; (+) strand; PAM type: NRG; PAM sequence: GAG
gaggtggaagaaacctctga

SEQ ID NO: 133103 - DNA, 20 bp, Artificial Sequence
  Description of Artificial Sequence: Synthetic oligonucleotide
  Target: ATXN1; (+) strand; PAM type: NRG; PAM sequence: CAG
agagcaaaccactcatgtta

SEQ ID NO: 133104 - DNA, 20 bp, Artificial Sequence
  Description of Artificial Sequence: Synthetic oligonucleotide
  Target: ATXN1; (+) strand; PAM type: NRG; PAM sequence: TGG
caaaccactcatgttacaga

SEQ ID NO: 133105 - DNA, 20 bp, Artificial Sequence
  Description of Artificial Sequence: Synthetic oligonucleotide
  Target: ATXN1; (+) strand; PAM type: NRG; PAM sequence: GAG
aaccactcatgttacagatg

SEQ ID NO: 133106 - DNA, 20 bp, Artificial Sequence
  Description of Artificial Sequence: Synthetic oligonucleotide
  Target: ATXN1; (+) strand; PAM type: NRG; PAM sequence: TGG
catgttacagatggagaact

SEQ ID NO: 133107 - DNA, 20 bp, Artificial Sequence
  Description of Artificial Sequence: Synthetic oligonucleotide
  Target: ATXN1; (+) strand; PAM type: NRG; PAM sequence: AAG
gttacagatggagaacttgg

SEQ ID NO: 133108 - DNA, 20 bp, Artificial Sequence
  Description of Artificial Sequence: Synthetic oligonucleotide
  Target: ATXN1; (+) strand; PAM type: NRG; PAM sequence: CAG
agatggagaacttggaagca

SEQ ID NO: 133109 - DNA, 20 bp, Artificial Sequence
  Description of Artificial Sequence: Synthetic oligonucleotide
  Target: ATXN1; (+) strand; PAM type: NRG; PAM sequence: AGG
gatggagaacttggaagcac

SEQ ID NO: 133110 - DNA, 20 bp, Artificial Sequence
  Description of Artificial Sequence: Synthetic oligonucleotide
  Target: ATXN1; (+) strand; PAM type: NRG; PAM sequence: GGG
atggagaacttggaagcaca

SEQ ID NO: 133111 - DNA, 20 bp, Artificial Sequence
  Description of Artificial Sequence: Synthetic oligonucleotide
  Target: ATXN1; (+) strand; PAM type: NRG; PAM sequence: GAG
cttggaagcacagggtcact

SEQ ID NO: 133112 - DNA, 20 bp, Artificial Sequence
  Description of Artificial Sequence: Synthetic oligonucleotide
  Target: ATXN1; (+) strand; PAM type: NRG; PAM sequence: TGG
cacagggtcactgagtacct

SEQ ID NO: 133113 - DNA, 20 bp, Artificial Sequence
  Description of Artificial Sequence: Synthetic oligonucleotide
  Target: ATXN1; (+) strand; PAM type: NRG; PAM sequence: AAG
gtcactgagtaccttggtca

SEQ ID NO: 133114 - DNA, 20 bp, Artificial Sequence
  Description of Artificial Sequence: Synthetic oligonucleotide
  Target: ATXN1; (+) strand; PAM type: NRG; PAM sequence: AAG
ccacccgccgattcattccc

SEQ ID NO: 133115 - DNA, 20 bp, Artificial Sequence
  Description of Artificial Sequence: Synthetic oligonucleotide
  Target: ATXN1; (+) strand; PAM type: NRG; PAM sequence: AAG
gccgattcattcccaagtcc

SEQ ID NO: 133116 - DNA, 20 bp, Artificial Sequence
  Description of Artificial Sequence: Synthetic oligonucleotide
  Target: ATXN1; (+) strand; PAM type: NRG; PAM sequence: AGG
ccgattcattcccaagtcca

SEQ ID NO: 133117 - DNA, 20 bp, Artificial Sequence
  Description of Artificial Sequence: Synthetic oligonucleotide
  Target: ATXN1; (+) strand; PAM type: NRG; PAM sequence: GGG
cgattcattcccaagtccaa

SEQ ID NO: 133118 - DNA, 20 bp, Artificial Sequence
  Description of Artificial Sequence: Synthetic oligonucleotide
  Target: ATXN1; (+) strand; PAM type: NRG; PAM sequence: TGG
tttcacttgaattttgaatt

SEQ ID NO: 133119 - DNA, 20 bp, Artificial Sequence
  Description of Artificial Sequence: Synthetic oligonucleotide
  Target: ATXN1; (+) strand; PAM type: NRG; PAM sequence: CAG
tttgaatttggctttatctg

SEQ ID NO: 133120 - DNA, 20 bp, Artificial Sequence
  Description of Artificial Sequence: Synthetic oligonucleotide
  Target: ATXN1; (+) strand; PAM type: NRG; PAM sequence: CAG
gctttatctgcagacacact

SEQ ID NO: 133121 - DNA, 20 bp, Artificial Sequence
  Description of Artificial Sequence: Synthetic oligonucleotide
  Target: ATXN1; (+) strand; PAM type: NRG; PAM sequence: GAG
tttatctgcagacacactca

SEQ ID NO: 133122 - DNA, 20 bp, Artificial Sequence
  Description of Artificial Sequence: Synthetic oligonucleotide
  Target: ATXN1; (+) strand; PAM type: NRG; PAM sequence: CAG
tcagagtatcacatctccgt

SEQ ID NO: 133123 - DNA, 20 bp, Artificial Sequence
  Description of Artificial Sequence: Synthetic oligonucleotide
  Target: ATXN1; (+) strand; PAM type: NRG; PAM sequence: AAG
gtatcacatctccgtcagtc

SEQ ID NO: 133124 - DNA, 20 bp, Artificial Sequence
  Description of Artificial Sequence: Synthetic oligonucleotide
  Target: ATXN1; (+) strand; PAM type: NRG; PAM sequence: AAG
acatctccgtcagtcaagtc

SEQ ID NO: 133125 - DNA, 20 bp, Artificial Sequence
  Description of Artificial Sequence: Synthetic oligonucleotide
  Target: ATXN1; (+) strand; PAM type: NRG; PAM sequence: CAG
tccgtcagtcaagtcaagca

SEQ ID NO: 133126 - DNA, 20 bp, Artificial Sequence
  Description of Artificial Sequence: Synthetic oligonucleotide
  Target: ATXN1; (+) strand; PAM type: NRG; PAM sequence: CAG
agtcaagtcaagcacagacc

SEQ ID NO: 133127 - DNA, 20 bp, Artificial Sequence
  Description of Artificial Sequence: Synthetic oligonucleotide
  Target: ATXN1; (+) strand; PAM type: NRG; PAM sequence: AAG
aagcacagacccagcttcta

SEQ ID NO: 133128 - DNA, 20 bp, Artificial Sequence
  Description of Artificial Sequence: Synthetic oligonucleotide
  Target: ATXN1; (+) strand; PAM type: NRG; PAM sequence: CGG
gacccagcttctaaagcaca

SEQ ID NO: 133129 - DNA, 20 bp, Artificial Sequence
  Description of Artificial Sequence: Synthetic oligonucleotide
  Target: ATXN1; (+) strand; PAM type: NRG; PAM sequence: CAG
gcttctaaagcacacggcat

SEQ ID NO: 133130 - DNA, 20 bp, Artificial Sequence
  Description of Artificial Sequence: Synthetic oligonucleotide
  Target: ATXN1; (+) strand; PAM type: NRG; PAM sequence: TGG
cactgaattcttgttttgtt

SEQ ID NO: 133131 - DNA, 20 bp, Artificial Sequence
  Description of Artificial Sequence: Synthetic oligonucleotide
  Target: ATXN1; (+) strand; PAM type: NRG; PAM sequence: TAG
tttggctatgtttatttgtt

SEQ ID NO: 133132 - DNA, 20 bp, Artificial Sequence
  Description of Artificial Sequence: Synthetic oligonucleotide
  Target: ATXN1; (+) strand; PAM type: NRG; PAM sequence: AGG
ttggctatgtttatttgttt

SEQ ID NO: 133133 - DNA, 20 bp, Artificial Sequence
  Description of Artificial Sequence: Synthetic oligonucleotide
  Target: ATXN1; (+) strand; PAM type: NRG; PAM sequence: CAG
tgtttatttgtttaggtact

SEQ ID NO: 133134 - DNA, 20 bp, Artificial Sequence
  Description of Artificial Sequence: Synthetic oligonucleotide
  Target: ATXN1; (+) strand; PAM type: NRG; PAM sequence: AGG
gtttatttgtttaggtactc

SEQ ID NO: 133135 - DNA, 20 bp, Artificial Sequence
  Description of Artificial Sequence: Synthetic oligonucleotide
  Target: ATXN1; (+) strand; PAM type: NRG; PAM sequence: CAG
gtactcaggaaaatctccac

SEQ ID NO: 133136 - DNA, 20 bp, Artificial Sequence
  Description of Artificial Sequence: Synthetic oligonucleotide
  Target: ATXN1; (+) strand; PAM type: NRG; PAM sequence: AGG
tactcaggaaaatctccacc

SEQ ID NO: 133137 - DNA, 20 bp, Artificial Sequence
  Description of Artificial Sequence: Synthetic oligonucleotide
  Target: ATXN1; (+) strand; PAM type: NRG; PAM sequence: CAG
atctccaccaggaaaaaata

SEQ ID NO: 133138 - DNA, 20 bp, Artificial Sequence
  Description of Artificial Sequence: Synthetic oligonucleotide
  Target: ATXN1; (+) strand; PAM type: NRG; PAM sequence: AGG
tctccaccaggaaaaaatac

SEQ ID NO: 133139 - DNA, 20 bp, Artificial Sequence
  Description of Artificial Sequence: Synthetic oligonucleotide
  Target: ATXN1; (+) strand; PAM type: NRG; PAM sequence: GGG
ctccaccaggaaaaaataca

SEQ ID NO: 133140 - DNA, 20 bp, Artificial Sequence
  Description of Artificial Sequence: Synthetic oligonucleotide
  Target: ATXN1; (+) strand; PAM type: NRG; PAM sequence: CAG
aaaaaatacagggtgttgaa

SEQ ID NO: 133141 - DNA, 20 bp, Artificial Sequence
  Description of Artificial Sequence: Synthetic oligonucleotide
  Target: ATXN1; (+) strand; PAM type: NRG; PAM sequence: GAG
aaaatacagggtgttgaaca

SEQ ID NO: 133142 - DNA, 20 bp, Artificial Sequence
  Description of Artificial Sequence: Synthetic oligonucleotide
  Target: ATXN1; (+) strand; PAM type: NRG; PAM sequence: AGG
aaatacagggtgttgaacag

SEQ ID NO: 133143 - DNA, 20 bp, Artificial Sequence
  Description of Artificial Sequence: Synthetic oligonucleotide
  Target: ATXN1; (+) strand; PAM type: NRG; PAM sequence: GGG
aatacagggtgttgaacaga

SEQ ID NO: 133144 - DNA, 20 bp, Artificial Sequence
  Description of Artificial Sequence: Synthetic oligonucleotide
  Target: ATXN1; (+) strand; PAM type: NRG; PAM sequence: GGG
atacagggtgttgaacagag

SEQ ID NO: 133145 - DNA, 20 bp, Artificial Sequence
  Description of Artificial Sequence: Synthetic oligonucleotide
  Target: ATXN1; (+) strand; PAM type: NRG; PAM sequence: GGG
tacagggtgttgaacagagg

SEQ ID NO: 133146 - DNA, 20 bp, Artificial Sequence
  Description of Artificial Sequence: Synthetic oligonucleotide
  Target: ATXN1; (+) strand; PAM type: NRG; PAM sequence: CAG
ggtgttgaacagagggggaa

SEQ ID NO: 133147 - DNA, 20 bp, Artificial Sequence
  Description of Artificial Sequence: Synthetic oligonucleotide
  Target: ATXN1; (+) strand; PAM type: NRG; PAM sequence: CAG
aacagagggggaacagaaca

SEQ ID NO: 133148 - DNA, 20 bp, Artificial Sequence
  Description of Artificial Sequence: Synthetic oligonucleotide
  Target: ATXN1; (+) strand; PAM type: NRG; PAM sequence: TAG
agagggggaacagaacacag

SEQ ID NO: 133149 - DNA, 20 bp, Artificial Sequence
  Description of Artificial Sequence: Synthetic oligonucleotide
  Target: ATXN1; (+) strand; PAM type: NRG; PAM sequence: CAG
ggaacagaacacagtagata

SEQ ID NO: 133150 - DNA, 20 bp, Artificial Sequence
  Description of Artificial Sequence: Synthetic oligonucleotide
  Target: ATXN1; (+) strand; PAM type: NRG; PAM sequence: TAG
acagaacacagtagatacag

SEQ ID NO: 133151 - DNA, 20 bp, Artificial Sequence
  Description of Artificial Sequence: Synthetic oligonucleotide
  Target: ATXN1; (+) strand; PAM type: NRG; PAM sequence: AAG
aacacagtagatacagtagc

SEQ ID NO: 133152 - DNA, 20 bp, Artificial Sequence
  Description of Artificial Sequence: Synthetic oligonucleotide
  Target: ATXN1; (+) strand; PAM type: NRG; PAM sequence: GAG
agtagcaagaaatgtttatt

SEQ ID NO: 133153 - DNA, 20 bp, Artificial Sequence
  Description of Artificial Sequence: Synthetic oligonucleotide
  Target: ATXN1; (+) strand; PAM type: NRG; PAM sequence: CAG
attgagcattgactatgtgc

SEQ ID NO: 133154 - DNA, 20 bp, Artificial Sequence
  Description of Artificial Sequence: Synthetic oligonucleotide
  Target: ATXN1; (+) strand; PAM type: NRG; PAM sequence: AGG
ttgagcattgactatgtgcc

SEQ ID NO: 133155 - DNA, 20 bp, Artificial Sequence
  Description of Artificial Sequence: Synthetic oligonucleotide
  Target: ATXN1; (+) strand; PAM type: NRG; PAM sequence: CAG
gcattgactatgtgccaggc

SEQ ID NO: 133156 - DNA, 20 bp, Artificial Sequence
  Description of Artificial Sequence: Synthetic oligonucleotide
  Target: ATXN1; (+) strand; PAM type: NRG; PAM sequence: AGG
cattgactatgtgccaggcc

SEQ ID NO: 133157 - DNA, 20 bp, Artificial Sequence
  Description of Artificial Sequence: Synthetic oligonucleotide
  Target: ATXN1; (+) strand; PAM type: NRG; PAM sequence: CAG
gccaggccaggcaatgttct

SEQ ID NO: 133158 - DNA, 20 bp, Artificial Sequence
  Description of Artificial Sequence: Synthetic oligonucleotide
  Target: ATXN1; (+) strand; PAM type: NRG; PAM sequence: AGG
ccaggccaggcaatgttctc

SEQ ID NO: 133159 - DNA, 20 bp, Artificial Sequence
  Description of Artificial Sequence: Synthetic oligonucleotide
  Target: ATXN1; (+) strand; PAM type: NRG; PAM sequence: CAG
ttatatgtatacaattctga

SEQ ID NO: 133160 - DNA, 20 bp, Artificial Sequence
  Description of Artificial Sequence: Synthetic oligonucleotide
  Target: ATXN1; (+) strand; PAM type: NRG; PAM sequence: TGG
tatgtatacaattctgacag

SEQ ID NO: 133161 - DNA, 20 bp, Artificial Sequence
  Description of Artificial Sequence: Synthetic oligonucleotide
  Target: ATXN1; (+) strand; PAM type: NRG; PAM sequence: TGG
caattctgacagtggctctg

SEQ ID NO: 133162 - DNA, 20 bp, Artificial Sequence
  Description of Artificial Sequence: Synthetic oligonucleotide
  Target: ATXN1; (+) strand; PAM type: NRG; PAM sequence: TAG
tggctctgtggctcccattt

SEQ ID NO: 133163 - DNA, 20 bp, Artificial Sequence
  Description of Artificial Sequence: Synthetic oligonucleotide
  Target: ATXN1; (+) strand; PAM type: NRG; PAM sequence: GAG
gctctgtggctcccatttta

SEQ ID NO: 133164 - DNA, 20 bp, Artificial Sequence
  Description of Artificial Sequence: Synthetic oligonucleotide
  Target: ATXN1; (+) strand; PAM type: NRG; PAM sequence: GAG
tctgtggctcccattttaga

SEQ ID NO: 133165 - DNA, 20 bp, Artificial Sequence
  Description of Artificial Sequence: Synthetic oligonucleotide
  Target: ATXN1; (+) strand; PAM type: NRG; PAM sequence: GAG
tgtggctcccattttagaga

SEQ ID NO: 133166 - DNA, 20 bp, Artificial Sequence
  Description of Artificial Sequence: Synthetic oligonucleotide
  Target: ATXN1; (+) strand; PAM type: NRG; PAM sequence: GAG
tggctcccattttagagaga

SEQ ID NO: 133167 - DNA, 20 bp, Artificial Sequence
  Description of Artificial Sequence: Synthetic oligonucleotide
  Target: ATXN1; (+) strand; PAM type: NRG; PAM sequence: GAG
gctcccattttagagagaga

SEQ ID NO: 133168 - DNA, 20 bp, Artificial Sequence
  Description of Artificial Sequence: Synthetic oligonucleotide
  Target: ATXN1; (+) strand; PAM type: NRG; PAM sequence: GAG
tcccattttagagagagaga

SEQ ID NO: 133169 - DNA, 20 bp, Artificial Sequence
  Description of Artificial Sequence: Synthetic oligonucleotide
  Target: ATXN1; (+) strand; PAM type: NRG; PAM sequence: GAG
ccattttagagagagagaga

SEQ ID NO: 133170 - DNA, 20 bp, Artificial Sequence
  Description of Artificial Sequence: Synthetic oligonucleotide
  Target: ATXN1; (+) strand; PAM type: NRG; PAM sequence: GAG
attttagagagagagagaga

SEQ ID NO: 133171 - DNA, 20 bp, Artificial Sequence
  Description of Artificial Sequence: Synthetic oligonucleotide
  Target: ATXN1; (+) strand; PAM type: NRG; PAM sequence: AAG
ttagagagagagagagagag

SEQ ID NO: 133172 - DNA, 20 bp, Artificial Sequence
  Description of Artificial Sequence: Synthetic oligonucleotide
  Target: ATXN1; (+) strand; PAM type: NRG; PAM sequence: TGG
agagagaagaatgattattt

SEQ ID NO: 133173 - DNA, 20 bp, Artificial Sequence
  Description of Artificial Sequence: Synthetic oligonucleotide
  Target: ATXN1; (+) strand; PAM type: NRG; PAM sequence: AAG
gagaagaatgattattttgg

SEQ ID NO: 133174 - DNA, 20 bp, Artificial Sequence
  Description of Artificial Sequence: Synthetic oligonucleotide
  Target: ATXN1; (+) strand; PAM type: NRG; PAM sequence: GAG
gaagaatgattattttggaa

SEQ ID NO: 133175 - DNA, 20 bp, Artificial Sequence
  Description of Artificial Sequence: Synthetic oligonucleotide
  Target: ATXN1; (+) strand; PAM type: NRG; PAM sequence: AAG
attattttggaagagaaaac

SEQ ID NO: 133176 - DNA, 20 bp, Artificial Sequence
  Description of Artificial Sequence: Synthetic oligonucleotide
  Target: ATXN1; (+) strand; PAM type: NRG; PAM sequence: GAG
tattttggaagagaaaacaa

SEQ ID NO: 133177 - DNA, 20 bp, Artificial Sequence
  Description of Artificial Sequence: Synthetic oligonucleotide
  Target: ATXN1; (+) strand; PAM type: NRG; PAM sequence: AGG
attttggaagagaaaacaag

SEQ ID NO: 133178 - DNA, 20 bp, Artificial Sequence
  Description of Artificial Sequence: Synthetic oligonucleotide
  Target: ATXN1; (+) strand; PAM type: NRG; PAM sequence: GGG
ttttggaagagaaaacaaga

SEQ ID NO: 133179 - DNA, 20 bp, Artificial Sequence
  Description of Artificial Sequence: Synthetic oligonucleotide
  Target: ATXN1; (+) strand; PAM type: NRG; PAM sequence: CAG
ggaagagaaaacaagaggga

SEQ ID NO: 133180 - DNA, 20 bp, Artificial Sequence
  Description of Artificial Sequence: Synthetic oligonucleotide
  Target: ATXN1; (+) strand; PAM type: NRG; PAM sequence: CAG
ccaaattttactaaaacatt

SEQ ID NO: 133181 - DNA, 20 bp, Artificial Sequence
  Description of Artificial Sequence: Synthetic oligonucleotide
  Target: ATXN1; (+) strand; PAM type: NRG; PAM sequence: CAG
gcaaaaatctaaaaaattac

SEQ ID NO: 133182 - DNA, 20 bp, Artificial Sequence
  Description of Artificial Sequence: Synthetic oligonucleotide
  Target: ATXN1; (+) strand; PAM type: NRG; PAM sequence: AAG
tatacttctcacttattctg

SEQ ID NO: 133183 - DNA, 20 bp, Artificial Sequence
  Description of Artificial Sequence: Synthetic oligonucleotide
  Target: ATXN1; (+) strand; PAM type: NRG; PAM sequence: GAG
tacttctcacttattctgaa

SEQ ID NO: 133184 - DNA, 20 bp, Artificial Sequence
  Description of Artificial Sequence: Synthetic oligonucleotide
  Target: ATXN1; (+) strand; PAM type: NRG; PAM sequence: TGG
atgatccttcttaatacttt

SEQ ID NO: 133185 - DNA, 20 bp, Artificial Sequence
  Description of Artificial Sequence: Synthetic oligonucleotide
  Target: ATXN1; (+) strand; PAM type: NRG; PAM sequence: TAG
ttcttaatacttttggcata

SEQ ID NO: 133186 - DNA, 20 bp, Artificial Sequence
  Description of Artificial Sequence: Synthetic oligonucleotide
  Target: ATXN1; (+) strand; PAM type: NRG; PAM sequence: AAG
gcttcttgctaataaaaaaa

SEQ ID NO: 133187 - DNA, 20 bp, Artificial Sequence
  Description of Artificial Sequence: Synthetic oligonucleotide
  Target: ATXN1; (+) strand; PAM type: NRG; PAM sequence: AAG
aataaaaaaaaagtacttcc

SEQ ID NO: 133188 - DNA, 20 bp, Artificial Sequence
  Description of Artificial Sequence: Synthetic oligonucleotide
  Target: ATXN1; (+) strand; PAM type: NRG; PAM sequence: CAG
attatttccaaatcttataa

SEQ ID NO: 133189 - DNA, 20 bp, Artificial Sequence
  Description of Artificial Sequence: Synthetic oligonucleotide
  Target: ATXN1; (+) strand; PAM type: NRG; PAM sequence: CAG
ataacagttgtttcaacaat

SEQ ID NO: 133190 - DNA, 20 bp, Artificial Sequence
  Description of Artificial Sequence: Synthetic oligonucleotide
  Target: ATXN1; (+) strand; PAM type: NRG; PAM sequence: GAG
tatttgaacactgatgaaat

SEQ ID NO: 133191 - DNA, 20 bp, Artificial Sequence
  Description of Artificial Sequence: Synthetic oligonucleotide
  Target: ATXN1; (+) strand; PAM type: NRG; PAM sequence: AAG
ttgaacactgatgaaatgag

SEQ ID NO: 133192 - DNA, 20 bp, Artificial Sequence
  Description of Artificial Sequence: Synthetic oligonucleotide
  Target: ATXN1; (+) strand; PAM type: NRG; PAM sequence: CAG
tgagaagcactaatgatatt

SEQ ID NO: 133193 - DNA, 20 bp, Artificial Sequence
  Description of Artificial Sequence: Synthetic oligonucleotide
  Target: ATXN1; (+) strand; PAM type: NRG; PAM sequence: AGG
gagaagcactaatgatattc

SEQ ID NO: 133194 - DNA, 20 bp, Artificial Sequence
  Description of Artificial Sequence: Synthetic oligonucleotide
  Target: ATXN1; (+) strand; PAM type: NRG; PAM sequence: GGG
agaagcactaatgatattca

SEQ ID NO: 133195 - DNA, 20 bp, Artificial Sequence
  Description of Artificial Sequence: Synthetic oligonucleotide
  Target: ATXN1; (+) strand; PAM type: NRG; PAM sequence: GAG
aagcactaatgatattcagg

SEQ ID NO: 133196 - DNA, 20 bp, Artificial Sequence
  Description of Artificial Sequence: Synthetic oligonucleotide
  Target: ATXN1; (+) strand; PAM type: NRG; PAM sequence: CAG
ctaatgatattcagggagca

SEQ ID NO: 133197 - DNA, 20 bp, Artificial Sequence
  Description of Artificial Sequence: Synthetic oligonucleotide
  Target: ATXN1; (+) strand; PAM type: NRG; PAM sequence: GAG
attcagggagcacagatctt

SEQ ID NO: 133198 - DNA, 20 bp, Artificial Sequence
  Description of Artificial Sequence: Synthetic oligonucleotide
  Target: ATXN1; (+) strand; PAM type: NRG; PAM sequence: TAG
agggagcacagatcttgagt

SEQ ID NO: 133199 - DNA, 20 bp, Artificial Sequence
  Description of Artificial Sequence: Synthetic oligonucleotide
  Target: ATXN1; (+) strand; PAM type: NRG; PAM sequence: AGG
gggagcacagatcttgagtt

SEQ ID NO: 133200 - DNA, 20 bp, Artificial Sequence
  Description of Artificial Sequence: Synthetic oligonucleotide
  Target: ATXN1; (+) strand; PAM type: NRG; PAM sequence: GGG
ggagcacagatcttgagtta

SEQ ID NO: 133201 - DNA, 20 bp, Artificial Sequence
  Description of Artificial Sequence: Synthetic oligonucleotide
  Target: ATXN1; (+) strand; PAM type: NRG; PAM sequence: GAG
agcacagatcttgagttagg

SEQ ID NO: 133202 - DNA, 20 bp, Artificial Sequence
  Description of Artificial Sequence: Synthetic oligonucleotide
  Target: ATXN1; (+) strand; PAM type: NRG; PAM sequence: AAG
cagatcttgagttagggaga

SEQ ID NO: 133203 - DNA, 20 bp, Artificial Sequence
  Description of Artificial Sequence: Synthetic oligonucleotide
  Target: ATXN1; (+) strand; PAM type: NRG; PAM sequence: AGG
agatcttgagttagggagaa

SEQ ID NO: 133204 - DNA, 20 bp, Artificial Sequence
  Description of Artificial Sequence: Synthetic oligonucleotide
  Target: ATXN1; (+) strand; PAM type: NRG; PAM sequence: GGG
gatcttgagttagggagaaa

SEQ ID NO: 133205 - DNA, 20 bp, Artificial Sequence
  Description of Artificial Sequence: Synthetic oligonucleotide
  Target: ATXN1; (+) strand; PAM type: NRG; PAM sequence: TGG
gagttagggagaaagggaac

SEQ ID NO: 133206 - DNA, 20 bp, Artificial Sequence
  Description of Artificial Sequence: Synthetic oligonucleotide
  Target: ATXN1; (+) strand; PAM type: NRG; PAM sequence: AAG
gctgaatcctataatgtcaa

SEQ ID NO: 133207 - DNA, 20 bp, Artificial Sequence
  Description of Artificial Sequence: Synthetic oligonucleotide
  Target: ATXN1; (+) strand; PAM type: NRG; PAM sequence: TAG
ctatctcacattcctgaatt

SEQ ID NO: 133208 - DNA, 20 bp, Artificial Sequence
  Description of Artificial Sequence: Synthetic oligonucleotide
  Target: ATXN1; (+) strand; PAM type: NRG; PAM sequence: AAG
catttcatttgataacctct

SEQ ID NO: 133209 - DNA, 20 bp, Artificial Sequence
  Description of Artificial Sequence: Synthetic oligonucleotide
  Target: ATXN1; (+) strand; PAM type: NRG; PAM sequence: GAG
tttcatttgataacctctaa

SEQ ID NO: 133210 - DNA, 20 bp, Artificial Sequence
  Description of Artificial Sequence: Synthetic oligonucleotide
  Target: ATXN1; (+) strand; PAM type: NRG; PAM sequence: TAG
taacctctaagagaaaaaaa

SEQ ID NO: 133211 - DNA, 20 bp, Artificial Sequence
  Description of Artificial Sequence: Synthetic oligonucleotide
  Target: ATXN1; (+) strand; PAM type: NRG; PAM sequence: AAG
gaaaaaaatagtgatttgaa

SEQ ID NO: 133212 - DNA, 20 bp, Artificial Sequence
  Description of Artificial Sequence: Synthetic oligonucleotide
  Target: ATXN1; (+) strand; PAM type: NRG; PAM sequence: TAG
tagtgatttgaaaagtacca

SEQ ID NO: 133213 - DNA, 20 bp, Artificial Sequence
  Description of Artificial Sequence: Synthetic oligonucleotide
  Target: ATXN1; (+) strand; PAM type: NRG; PAM sequence: AAG
agaatactgtcattttgata

SEQ ID NO: 133214 - DNA, 20 bp, Artificial Sequence
  Description of Artificial Sequence: Synthetic oligonucleotide
  Target: ATXN1; (+) strand; PAM type: NRG; PAM sequence: AAG
attttgataaagctgtatga

SEQ ID NO: 133215 - DNA, 20 bp, Artificial Sequence
  Description of Artificial Sequence: Synthetic oligonucleotide
  Target: ATXN1; (+) strand; PAM type: NRG; PAM sequence: TGG
tgataaagctgtatgaaagt

SEQ ID NO: 133216 - DNA, 20 bp, Artificial Sequence
  Description of Artificial Sequence: Synthetic oligonucleotide
  Target: ATXN1; (+) strand; PAM type: NRG; PAM sequence: GAG
gaaagttggatttctacctc

SEQ ID NO: 133217 - DNA, 20 bp, Artificial Sequence
  Description of Artificial Sequence: Synthetic oligonucleotide
  Target: ATXN1; (+) strand; PAM type: NRG; PAM sequence: GAG
tcgagttttgcccgcacttt

SEQ ID NO: 133218 - DNA, 20 bp, Artificial Sequence
  Description of Artificial Sequence: Synthetic oligonucleotide
  Target: ATXN1; (+) strand; PAM type: NRG; PAM sequence: TAG
agttttgcccgcactttgag

SEQ ID NO: 133219 - DNA, 20 bp, Artificial Sequence
  Description of Artificial Sequence: Synthetic oligonucleotide
  Target: ATXN1; (+) strand; PAM type: NRG; PAM sequence: TGG
tgcccgcactttgagtagta

SEQ ID NO: 133220 - DNA, 20 bp, Artificial Sequence
  Description of Artificial Sequence: Synthetic oligonucleotide
  Target: ATXN1; (+) strand; PAM type: NRG; PAM sequence: AAG
gtatggtttgccaacattga

SEQ ID NO: 133221 - DNA, 20 bp, Artificial Sequence
  Description of Artificial Sequence: Synthetic oligonucleotide
  Target: ATXN1; (+) strand; PAM type: NRG; PAM sequence: CAG
tggtttgccaacattgaaag

SEQ ID NO: 133222 - DNA, 20 bp, Artificial Sequence
  Description of Artificial Sequence: Synthetic oligonucleotide
  Target: ATXN1; (+) strand; PAM type: NRG; PAM sequence: TAG
gccaacattgaaagcagcat

SEQ ID NO: 133223 - DNA, 20 bp, Artificial Sequence
  Description of Artificial Sequence: Synthetic oligonucleotide
  Target: ATXN1; (+) strand; PAM type: NRG; PAM sequence: TAG
cattgaaagcagcattagtg

SEQ ID NO: 133224 - DNA, 20 bp, Artificial Sequence
  Description of Artificial Sequence: Synthetic oligonucleotide
  Target: ATXN1; (+) strand; PAM type: NRG; PAM sequence: CAG
tgaaagcagcattagtgtag

SEQ ID NO: 133225 - DNA, 20 bp, Artificial Sequence
  Description of Artificial Sequence: Synthetic oligonucleotide
  Target: ATXN1; (+) strand; PAM type: NRG; PAM sequence: AGG
gaaagcagcattagtgtagc

SEQ ID NO: 133226 - DNA, 20 bp, Artificial Sequence
  Description of Artificial Sequence: Synthetic oligonucleotide
  Target: ATXN1; (+) strand; PAM type: NRG; PAM sequence: GGG
aaagcagcattagtgtagca

SEQ ID NO: 133227 - DNA, 20 bp, Artificial Sequence
  Description of Artificial Sequence: Synthetic oligonucleotide
  Target: ATXN1; (+) strand; PAM type: NRG; PAM sequence: GGG
aagcagcattagtgtagcag

SEQ ID NO: 133228 - DNA, 20 bp, Artificial Sequence
  Description of Artificial Sequence: Synthetic oligonucleotide
  Target: ATXN1; (+) strand; PAM type: NRG; PAM sequence: AAG
cagcattagtgtagcagggg

SEQ ID NO: 133229 - DNA, 20 bp, Artificial Sequence
  Description of Artificial Sequence: Synthetic oligonucleotide
  Target: ATXN1; (+) strand; PAM type: NRG; PAM sequence: AGG
agcattagtgtagcagggga

SEQ ID NO: 133230 - DNA, 20 bp, Artificial Sequence
  Description of Artificial Sequence: Synthetic oligonucleotide
  Target: ATXN1; (+) strand; PAM type: NRG; PAM sequence: CAG
gtagcaggggaaggtctgtg

SEQ ID NO: 133231 - DNA, 20 bp, Artificial Sequence
  Description of Artificial Sequence: Synthetic oligonucleotide
  Target: ATXN1; (+) strand; PAM type: NRG; PAM sequence: CAG
gcaggggaaggtctgtgcag

SEQ ID NO: 133232 - DNA, 20 bp, Artificial Sequence
  Description of Artificial Sequence: Synthetic oligonucleotide
  Target: ATXN1; (+) strand; PAM type: NRG; PAM sequence: TAG
gtctgtgcagcagtctgctt

SEQ ID NO: 133233 - DNA, 20 bp, Artificial Sequence
  Description of Artificial Sequence: Synthetic oligonucleotide
  Target: ATXN1; (+) strand; PAM type: NRG; PAM sequence: AGG
tctgtgcagcagtctgcttt

SEQ ID NO: 133234 - DNA, 20 bp, Artificial Sequence
  Description of Artificial Sequence: Synthetic oligonucleotide
  Target: ATXN1; (+) strand; PAM type: NRG; PAM sequence: GGG
ctgtgcagcagtctgcttta

SEQ ID NO: 133235 - DNA, 20 bp, Artificial Sequence
  Description of Artificial Sequence: Synthetic oligonucleotide
  Target: ATXN1; (+) strand; PAM type: NRG; PAM sequence: TAG
tgcagcagtctgctttaggg

SEQ ID NO: 133236 - DNA, 20 bp, Artificial Sequence
  Description of Artificial Sequence: Synthetic oligonucleotide
  Target: ATXN1; (+) strand; PAM type: NRG; PAM sequence: AAG
gtctgctttagggtagcaat

SEQ ID NO: 133237 - DNA, 20 bp, Artificial Sequence
  Description of Artificial Sequence: Synthetic oligonucleotide
  Target: ATXN1; (+) strand; PAM type: NRG; PAM sequence: AAG
gctttagggtagcaataaga

SEQ ID NO: 133238 - DNA, 20 bp, Artificial Sequence
  Description of Artificial Sequence: Synthetic oligonucleotide
  Target: ATXN1; (+) strand; PAM type: NRG; PAM sequence: AAG
aataagaaagacaaaattgt

SEQ ID NO: 133239 - DNA, 20 bp, Artificial Sequence
  Description of Artificial Sequence: Synthetic oligonucleotide
  Target: ATXN1; (+) strand; PAM type: NRG; PAM sequence: AAG
accattttctaatgtgtttt

SEQ ID NO: 133240 - DNA, 20 bp, Artificial Sequence
  Description of Artificial Sequence: Synthetic oligonucleotide
  Target: ATXN1; (+) strand; PAM type: NRG; PAM sequence: GAG
cattttctaatgtgttttaa

SEQ ID NO: 133241 - DNA, 20 bp, Artificial Sequence
  Description of Artificial Sequence: Synthetic oligonucleotide
  Target: ATXN1; (+) strand; PAM type: NRG; PAM sequence: CAG
atgtgttttaagagtaaaca

SEQ ID NO: 133242 - DNA, 20 bp, Artificial Sequence
  Description of Artificial Sequence: Synthetic oligonucleotide
  Target: ATXN1; (+) strand; PAM type: NRG; PAM sequence: TGG
ttaagagtaaacacagatga

SEQ ID NO: 133243 - DNA, 20 bp, Artificial Sequence
  Description of Artificial Sequence: Synthetic oligonucleotide
  Target: ATXN1; (+) strand; PAM type: NRG; PAM sequence: TAG
agtaaacacagatgatggaa

SEQ ID NO: 133244 - DNA, 20 bp, Artificial Sequence
  Description of Artificial Sequence: Synthetic oligonucleotide
  Target: ATXN1; (+) strand; PAM type: NRG; PAM sequence: GAG
aatagtctaccttatttcat

SEQ ID NO: 133245 - DNA, 20 bp, Artificial Sequence
  Description of Artificial Sequence: Synthetic oligonucleotide
  Target: ATXN1; (+) strand; PAM type: NRG; PAM sequence: GAG
tagtctaccttatttcatga

SEQ ID NO: 133246 - DNA, 20 bp, Artificial Sequence
  Description of Artificial Sequence: Synthetic oligonucleotide
  Target: ATXN1; (+) strand; PAM type: NRG; PAM sequence: CAG
gaatgtttccatactgacac

SEQ ID NO: 133247 - DNA, 20 bp, Artificial Sequence
  Description of Artificial Sequence: Synthetic oligonucleotide
  Target: ATXN1; (+) strand; PAM type: NRG; PAM sequence: AAG
tattatttataaaactttca

SEQ ID NO: 133248 - DNA, 20 bp, Artificial Sequence
  Description of Artificial Sequence: Synthetic oligonucleotide
  Target: ATXN1; (+) strand; PAM type: NRG; PAM sequence: AAG
aaagaataaaatgcttcata

SEQ ID NO: 133249 - DNA, 20 bp, Artificial Sequence
  Description of Artificial Sequence: Synthetic oligonucleotide
  Target: ATXN1; (+) strand; PAM type: NRG; PAM sequence: AAG
gaataaaatgcttcataaag

SEQ ID NO: 133250 - DNA, 20 bp, Artificial Sequence
  Description of Artificial Sequence: Synthetic oligonucleotide
  Target: ATXN1; (+) strand; PAM type: NRG; PAM sequence: TGG
aaatgcttcataaagaagcc

SEQ ID NO: 133251 - DNA, 20 bp, Artificial Sequence
  Description of Artificial Sequence: Synthetic oligonucleotide
  Target: ATXN1; (+) strand; PAM type: NRG; PAM sequence: AAG
gcttcataaagaagcctggt

SEQ ID NO: 133252 - DNA, 20 bp, Artificial Sequence
  Description of Artificial Sequence: Synthetic oligonucleotide
  Target: ATXN1; (+) strand; PAM type: NRG; PAM sequence: AAG
taagttattttaaaacttta

SEQ ID NO: 133253 - DNA, 20 bp, Artificial Sequence
  Description of Artificial Sequence: Synthetic oligonucleotide
  Target: ATXN1; (+) strand; PAM type: NRG; PAM sequence: TAG
aaactttaaagtatccaaaa

SEQ ID NO: 133254 - DNA, 20 bp, Artificial Sequence
  Description of Artificial Sequence: Synthetic oligonucleotide
  Target: ATXN1; (+) strand; PAM type: NRG; PAM sequence: AAG
aagtatccaaaatagtttaa

SEQ ID NO: 133255 - DNA, 20 bp, Artificial Sequence
  Description of Artificial Sequence: Synthetic oligonucleotide
  Target: ATXN1; (+) strand; PAM type: NRG; PAM sequence: TGG
aataatgcctttacccaaac

SEQ ID NO: 133256 - DNA, 20 bp, Artificial Sequence
  Description of Artificial Sequence: Synthetic oligonucleotide
  Target: ATXN1; (+) strand; PAM type: NRG; PAM sequence: TGG
cccaaactggctatgaatta

SEQ ID NO: 133257 - DNA, 20 bp, Artificial Sequence
  Description of Artificial Sequence: Synthetic oligonucleotide
  Target: ATXN1; (+) strand; PAM type: NRG; PAM sequence: GAG
caaactggctatgaattatg

SEQ ID NO: 133258 - DNA, 20 bp, Artificial Sequence
  Description of Artificial Sequence: Synthetic oligonucleotide
  Target: ATXN1; (+) strand; PAM type: NRG; PAM sequence: AGG
aaactggctatgaattatgg

SEQ ID NO: 133259 - DNA, 20 bp, Artificial Sequence
  Description of Artificial Sequence: Synthetic oligonucleotide
  Target: ATXN1; (+) strand; PAM type: NRG; PAM sequence: CAG
tgaattatggaggctatcta

SEQ ID NO: 133260 - DNA, 20 bp, Artificial Sequence
  Description of Artificial Sequence: Synthetic oligonucleotide
  Target: ATXN1; (+) strand; PAM type: NRG; PAM sequence: AAG
tggaggctatctacagattg

SEQ ID NO: 133261 - DNA, 20 bp, Artificial Sequence
  Description of Artificial Sequence: Synthetic oligonucleotide
  Target: ATXN1; (+) strand; PAM type: NRG; PAM sequence: AGG
ggaggctatctacagattga

SEQ ID NO: 133262 - DNA, 20 bp, Artificial Sequence
  Description of Artificial Sequence: Synthetic oligonucleotide
  Target: ATXN1; (+) strand; PAM type: NRG; PAM sequence: AAG
ggctatctacagattgaagg

SEQ ID NO: 133263 - DNA, 20 bp, Artificial Sequence
  Description of Artificial Sequence: Synthetic oligonucleotide
  Target: ATXN1; (+) strand; PAM type: NRG; PAM sequence: AGG
gctatctacagattgaagga

SEQ ID NO: 133264 - DNA, 20 bp, Artificial Sequence
  Description of Artificial Sequence: Synthetic oligonucleotide
  Target: ATXN1; (+) strand; PAM type: NRG; PAM sequence: GGG
ctatctacagattgaaggaa

SEQ ID NO: 133265 - DNA, 20 bp, Artificial Sequence
  Description of Artificial Sequence: Synthetic oligonucleotide
  Target: ATXN1; (+) strand; PAM type: NRG; PAM sequence: TGG
tctacagattgaaggaaggg

SEQ ID NO: 133266 - DNA, 20 bp, Artificial Sequence
  Description of Artificial Sequence: Synthetic oligonucleotide
  Target: ATXN1; (+) strand; PAM type: NRG; PAM sequence: GGG
ctacagattgaaggaagggt

SEQ ID NO: 133267 - DNA, 20 bp, Artificial Sequence
  Description of Artificial Sequence: Synthetic oligonucleotide
  Target: ATXN1; (+) strand; PAM type: NRG; PAM sequence: GAG
acagattgaaggaagggtgg

SEQ ID NO: 133268 - DNA, 20 bp, Artificial Sequence
  Description of Artificial Sequence: Synthetic oligonucleotide
  Target: ATXN1; (+) strand; PAM type: NRG; PAM sequence: AAG
ttgaaggaagggtgggagaa

SEQ ID NO: 133269 - DNA, 20 bp, Artificial Sequence
  Description of Artificial Sequence: Synthetic oligonucleotide
  Target: ATXN1; (+) strand; PAM type: NRG; PAM sequence: AGG
tgaaggaagggtgggagaaa

SEQ ID NO: 133270 - DNA, 20 bp, Artificial Sequence
  Description of Artificial Sequence: Synthetic oligonucleotide
  Target: ATXN1; (+) strand; PAM type: NRG; PAM sequence: GGG
gaaggaagggtgggagaaaa

SEQ ID NO: 133271 - DNA, 20 bp, Artificial Sequence
  Description of Artificial Sequence: Synthetic oligonucleotide
  Target: ATXN1; (+) strand; PAM type: NRG; PAM sequence: AAG
ggaagggtgggagaaaaggg

SEQ ID NO: 133272 - DNA, 20 bp, Artificial Sequence
  Description of Artificial Sequence: Synthetic oligonucleotide
  Target: ATXN1; (+) strand; PAM type: NRG; PAM sequence: AGG
gaagggtgggagaaaaggga

SEQ ID NO: 133273 - DNA, 20 bp, Artificial Sequence
  Description of Artificial Sequence: Synthetic oligonucleotide
  Target: ATXN1; (+) strand; PAM type: NRG; PAM sequence: GGG
aagggtgggagaaaagggaa

SEQ ID NO: 133274 - DNA, 20 bp, Artificial Sequence
  Description of Artificial Sequence: Synthetic oligonucleotide
  Target: ATXN1; (+) strand; PAM type: NRG; PAM sequence: AAG
gaagggcatatttatgctga

SEQ ID NO: 133275 - DNA, 20 bp, Artificial Sequence
  Description of Artificial Sequence: Synthetic oligonucleotide
  Target: ATXN1; (+) strand; PAM type: NRG; PAM sequence: TGG
ttatgctgaaagataaattt

SEQ ID NO: 133276 - DNA, 20 bp, Artificial Sequence
  Description of Artificial Sequence: Synthetic oligonucleotide
  Target: ATXN1; (+) strand; PAM type: NRG; PAM sequence: GGG
tatgctgaaagataaatttt

SEQ ID NO: 133277 - DNA, 20 bp, Artificial Sequence
  Description of Artificial Sequence: Synthetic oligonucleotide
  Target: ATXN1; (+) strand; PAM type: NRG; PAM sequence: GGG
atgctgaaagataaattttg

SEQ ID NO: 133278 - DNA, 20 bp, Artificial Sequence
  Description of Artificial Sequence: Synthetic oligonucleotide
  Target: ATXN1; (+) strand; PAM type: NRG; PAM sequence: AAG
ctgaaagataaattttgggg

SEQ ID NO: 133279 - DNA, 20 bp, Artificial Sequence
  Description of Artificial Sequence: Synthetic oligonucleotide
  Target: ATXN1; (+) strand; PAM type: NRG; PAM sequence: CAG
gtgttttaaatacttaatat

SEQ ID NO: 133280 - DNA, 20 bp, Artificial Sequence
  Description of Artificial Sequence: Synthetic oligonucleotide
  Target: ATXN1; (+) strand; PAM type: NRG; PAM sequence: TAG
ttttaaatacttaatatcag

SEQ ID NO: 133281 - DNA, 20 bp, Artificial Sequence
  Description of Artificial Sequence: Synthetic oligonucleotide
  Target: ATXN1; (+) strand; PAM type: NRG; PAM sequence: AGG
tttaaatacttaatatcagt

SEQ ID NO: 133282 - DNA, 20 bp, Artificial Sequence
  Description of Artificial Sequence: Synthetic oligonucleotide
  Target: ATXN1; (+) strand; PAM type: NRG; PAM sequence: TAG
cagtaggattttcttaacct

SEQ ID NO: 133283 - DNA, 20 bp, Artificial Sequence
  Description of Artificial Sequence: Synthetic oligonucleotide
  Target: ATXN1; (+) strand; PAM type: NRG; PAM sequence: TAG
tcattttcaaccttatgata

SEQ ID NO: 133284 - DNA, 20 bp, Artificial Sequence
  Description of Artificial Sequence: Synthetic oligonucleotide
  Target: ATXN1; (+) strand; PAM type: NRG; PAM sequence: TAG
tcaaccttatgatatagatg

SEQ ID NO: 133285 - DNA, 20 bp, Artificial Sequence
  Description of Artificial Sequence: Synthetic oligonucleotide
  Target: ATXN1; (+) strand; PAM type: NRG; PAM sequence: AAG
ttatgatatagatgtagtcg

SEQ ID NO: 133286 - DNA, 20 bp, Artificial Sequence
  Description of Artificial Sequence: Synthetic oligonucleotide
  Target: ATXN1; (+) strand; PAM type: NRG; PAM sequence: AGG
tatgatatagatgtagtcga

SEQ ID NO: 133287 - DNA, 20 bp, Artificial Sequence
  Description of Artificial Sequence: Synthetic oligonucleotide
  Target: ATXN1; (+) strand; PAM type: NRG; PAM sequence: GGG
atgatatagatgtagtcgaa

SEQ ID NO: 133288 - DNA, 20 bp, Artificial Sequence
  Description of Artificial Sequence: Synthetic oligonucleotide
  Target: ATXN1; (+) strand; PAM type: NRG; PAM sequence: GAG
atagatgtagtcgaagggtt

SEQ ID NO: 133289 - DNA, 20 bp, Artificial Sequence
  Description of Artificial Sequence: Synthetic oligonucleotide
  Target: ATXN1; (+) strand; PAM type: NRG; PAM sequence: GAG
agatgtagtcgaagggttga

SEQ ID NO: 133290 - DNA, 20 bp, Artificial Sequence
  Description of Artificial Sequence: Synthetic oligonucleotide
  Target: ATXN1; (+) strand; PAM type: NRG; PAM sequence: AGG
gatgtagtcgaagggttgag

SEQ ID NO: 133291 - DNA, 20 bp, Artificial Sequence
  Description of Artificial Sequence: Synthetic oligonucleotide
  Target: ATXN1; (+) strand; PAM type: NRG; PAM sequence: GGG
atgtagtcgaagggttgaga

SEQ ID NO: 133292 - DNA, 20 bp, Artificial Sequence
  Description of Artificial Sequence: Synthetic oligonucleotide
  Target: ATXN1; (+) strand; PAM type: NRG; PAM sequence: CAG
gagagggactcacaacccta

SEQ ID NO: 133293 - DNA, 20 bp, Artificial Sequence
  Description of Artificial Sequence: Synthetic oligonucleotide
  Target: ATXN1; (+) strand; PAM type: NRG; PAM sequence: TAG
tttttctttttgtgtttctg

SEQ ID NO: 133294 - DNA, 20 bp, Artificial Sequence
  Description of Artificial Sequence: Synthetic oligonucleotide
  Target: ATXN1; (+) strand; PAM type: NRG; PAM sequence: AGG
ttttctttttgtgtttctgt

SEQ ID NO: 133295 - DNA, 20 bp, Artificial Sequence
  Description of Artificial Sequence: Synthetic oligonucleotide
  Target: ATXN1; (+) strand; PAM type: NRG; PAM sequence: AAG
ttttgtgtttctgtaggata

SEQ ID NO: 133296 - DNA, 20 bp, Artificial Sequence
  Description of Artificial Sequence: Synthetic oligonucleotide
  Target: ATXN1; (+) strand; PAM type: NRG; PAM sequence: AGG
tttgtgtttctgtaggataa

SEQ ID NO: 133297 - DNA, 20 bp, Artificial Sequence
  Description of Artificial Sequence: Synthetic oligonucleotide
  Target: ATXN1; (+) strand; PAM type: NRG; PAM sequence: AAG
ggataaaggaaacatttcct

SEQ ID NO: 133298 - DNA, 20 bp, Artificial Sequence
  Description of Artificial Sequence: Synthetic oligonucleotide
  Target: ATXN1; (+) strand; PAM type: NRG; PAM sequence: GAG
ataaaggaaacatttcctaa

SEQ ID NO: 133299 - DNA, 20 bp, Artificial Sequence
  Description of Artificial Sequence: Synthetic oligonucleotide
  Target: ATXN1; (+) strand; PAM type: NRG; PAM sequence: GAG
ggaaacatttcctaagagct

SEQ ID NO: 133300 - DNA, 20 bp, Artificial Sequence
  Description of Artificial Sequence: Synthetic oligonucleotide
  Target: ATXN1; (+) strand; PAM type: NRG; PAM sequence: AGG
gaaacatttcctaagagctg

SEQ ID NO: 133301 - DNA, 20 bp, Artificial Sequence
  Description of Artificial Sequence: Synthetic oligonucleotide
  Target: ATXN1; (+) strand; PAM type: NRG; PAM sequence: GGG
aaacatttcctaagagctga

SEQ ID NO: 133302 - DNA, 20 bp, Artificial Sequence
  Description of Artificial Sequence: Synthetic oligonucleotide
  Target: ATXN1; (+) strand; PAM type: NRG; PAM sequence: GGG
aacatttcctaagagctgag

SEQ ID NO: 133303 - DNA, 20 bp, Artificial Sequence
  Description of Artificial Sequence: Synthetic oligonucleotide
  Target: ATXN1; (+) strand; PAM type: NRG; PAM sequence: CGG
atttcctaagagctgagggg

SEQ ID NO: 133304 - DNA, 20 bp, Artificial Sequence
  Description of Artificial Sequence: Synthetic oligonucleotide
  Target: ATXN1; (+) strand; PAM type: NRG; PAM sequence: GGG
tttcctaagagctgaggggc

SEQ ID NO: 133305 - DNA, 20 bp, Artificial Sequence
  Description of Artificial Sequence: Synthetic oligonucleotide
  Target: ATXN1; (+) strand; PAM type: NRG; PAM sequence: GGG
ttcctaagagctgaggggcg

SEQ ID NO: 133306 - DNA, 20 bp, Artificial Sequence
  Description of Artificial Sequence: Synthetic oligonucleotide
  Target: ATXN1; (+) strand; PAM type: NRG; PAM sequence: TGG
ctaagagctgaggggcgggg

SEQ ID NO: 133307 - DNA, 20 bp, Artificial Sequence
  Description of Artificial Sequence: Synthetic oligonucleotide
  Target: ATXN1; (+) strand; PAM type: NRG; PAM sequence: GGG
taagagctgaggggcggggt

SEQ ID NO: 133308 - DNA, 20 bp, Artificial Sequence
  Description of Artificial Sequence: Synthetic oligonucleotide
  Target: ATXN1; (+) strand; PAM type: NRG; PAM sequence: CGG
ggggcggggtgggttacata

SEQ ID NO: 133309 - DNA, 20 bp, Artificial Sequence
  Description of Artificial Sequence: Synthetic oligonucleotide
  Target: ATXN1; (+) strand; PAM type: NRG; PAM sequence: AAG
tgggttacatacggtgcctg

SEQ ID NO: 133310 - DNA, 20 bp, Artificial Sequence
  Description of Artificial Sequence: Synthetic oligonucleotide
  Target: ATXN1; (+) strand; PAM type: NRG; PAM sequence: AGG
gggttacatacggtgcctga

SEQ ID NO: 133311 - DNA, 20 bp, Artificial Sequence
  Description of Artificial Sequence: Synthetic oligonucleotide
  Target: ATXN1; (+) strand; PAM type: NRG; PAM sequence: GGG
ggttacatacggtgcctgaa

SEQ ID NO: 133312 - DNA, 20 bp, Artificial Sequence
  Description of Artificial Sequence: Synthetic oligonucleotide
  Target: ATXN1; (+) strand; PAM type: NRG; PAM sequence: GGG
gttacatacggtgcctgaag

SEQ ID NO: 133313 - DNA, 20 bp, Artificial Sequence
  Description of Artificial Sequence: Synthetic oligonucleotide
  Target: ATXN1; (+) strand; PAM type: NRG; PAM sequence: AAG
atacggtgcctgaaggggaa

SEQ ID NO: 133314 - DNA, 20 bp, Artificial Sequence
  Description of Artificial Sequence: Synthetic oligonucleotide
  Target: ATXN1; (+) strand; PAM type: NRG; PAM sequence: GAG
ggggaaaagaccccatgttc

SEQ ID NO: 133315 - DNA, 20 bp, Artificial Sequence
  Description of Artificial Sequence: Synthetic oligonucleotide
  Target: ATXN1; (+) strand; PAM type: NRG; PAM sequence: TGG
gtgtgtgtgtgtgtgtgtgc

SEQ ID NO: 133316 - DNA, 20 bp, Artificial Sequence
  Description of Artificial Sequence: Synthetic oligonucleotide
  Target: ATXN1; (+) strand; PAM type: NRG; PAM sequence: GGG
tgtgtgtgtgtgtgtgtgct

SEQ ID NO: 133317 - DNA, 20 bp, Artificial Sequence
  Description of Artificial Sequence: Synthetic oligonucleotide
  Target: ATXN1; (+) strand; PAM type: NRG; PAM sequence: TGG
gtgtgtgtgtgtgtgctggg

SEQ ID NO: 133318 - DNA, 20 bp, Artificial Sequence
  Description of Artificial Sequence: Synthetic oligonucleotide
  Target: ATXN1; (+) strand; PAM type: NRG; PAM sequence: GGG
tgtgtgtgtgtgtgctgggt

SEQ ID NO: 133319 - DNA, 20 bp, Artificial Sequence
  Description of Artificial Sequence: Synthetic oligonucleotide
  Target: ATXN1; (+) strand; PAM type: NRG; PAM sequence: TGG
gtgtgtgctgggtgggtgtg

SEQ ID NO: 133320 - DNA, 20 bp, Artificial Sequence
  Description of Artificial Sequence: Synthetic oligonucleotide
  Target: ATXN1; (+) strand; PAM type: NRG; PAM sequence: TGG
gtgctgggtgggtgtgtgga

SEQ ID NO: 133321 - DNA, 20 bp, Artificial Sequence
  Description of Artificial Sequence: Synthetic oligonucleotide
  Target: ATXN1; (+) strand; PAM type: NRG; PAM sequence: GGG
tgctgggtgggtgtgtggat

SEQ ID NO: 133322 - DNA, 20 bp, Artificial Sequence
  Description of Artificial Sequence: Synthetic oligonucleotide
  Target: ATXN1; (+) strand; PAM type: NRG; PAM sequence: GGG
gctgggtgggtgtgtggatg

SEQ ID NO: 133323 - DNA, 20 bp, Artificial Sequence
  Description of Artificial Sequence: Synthetic oligonucleotide
  Target: ATXN1; (+) strand; PAM type: NRG; PAM sequence: GAG
tgggtgggtgtgtggatggg

SEQ ID NO: 133324 - DNA, 20 bp, Artificial Sequence
  Description of Artificial Sequence: Synthetic oligonucleotide
  Target: ATXN1; (+) strand; PAM type: NRG; PAM sequence: TAG
gtgggtgtgtggatggggag

SEQ ID NO: 133325 - DNA, 20 bp, Artificial Sequence
  Description of Artificial Sequence: Synthetic oligonucleotide
  Target: ATXN1; (+) strand; PAM type: NRG; PAM sequence: AGG
tgggtgtgtggatggggagt

SEQ ID NO: 133326 - DNA, 20 bp, Artificial Sequence
  Description of Artificial Sequence: Synthetic oligonucleotide
  Target: ATXN1; (+) strand; PAM type: NRG; PAM sequence: GGG
gggtgtgtggatggggagta

SEQ ID NO: 133327 - DNA, 20 bp, Artificial Sequence
  Description of Artificial Sequence: Synthetic oligonucleotide
  Target: ATXN1; (+) strand; PAM type: NRG; PAM sequence: GGG
ggtgtgtggatggggagtag

SEQ ID NO: 133328 - DNA, 20 bp, Artificial Sequence
  Description of Artificial Sequence: Synthetic oligonucleotide
  Target: ATXN1; (+) strand; PAM type: NRG; PAM sequence: TGG
atggggagtaggggatgata

SEQ ID NO: 133329 - DNA, 20 bp, Artificial Sequence
  Description of Artificial Sequence: Synthetic oligonucleotide
  Target: ATXN1; (+) strand; PAM type: NRG; PAM sequence: GGG
tggggagtaggggatgatat

SEQ ID NO: 133330 - DNA, 20 bp, Artificial Sequence
  Description of Artificial Sequence: Synthetic oligonucleotide
  Target: ATXN1; (+) strand; PAM type: NRG; PAM sequence: TGG
gatgatatgggcaactcaac

SEQ ID NO: 133331 - DNA, 20 bp, Artificial Sequence
  Description of Artificial Sequence: Synthetic oligonucleotide
  Target: ATXN1; (+) strand; PAM type: NRG; PAM sequence: AAG
caactcaactggacatgtta

SEQ ID NO: 133332 - DNA, 20 bp, Artificial Sequence
  Description of Artificial Sequence: Synthetic oligonucleotide
  Target: ATXN1; (+) strand; PAM type: NRG; PAM sequence: AAG
tcaactggacatgttaaaga

SEQ ID NO: 133333 - DNA, 20 bp, Artificial Sequence
  Description of Artificial Sequence: Synthetic oligonucleotide
  Target: ATXN1; (+) strand; PAM type: NRG; PAM sequence: AAG
actggacatgttaaagaaag

SEQ ID NO: 133334 - DNA, 20 bp, Artificial Sequence
  Description of Artificial Sequence: Synthetic oligonucleotide
  Target: ATXN1; (+) strand; PAM type: NRG; PAM sequence: TGG
taaagaaagaagaaaacatc

SEQ ID NO: 133335 - DNA, 20 bp, Artificial Sequence
  Description of Artificial Sequence: Synthetic oligonucleotide
  Target: ATXN1; (+) strand; PAM type: NRG; PAM sequence: GGG
aaagaaagaagaaaacatct

SEQ ID NO: 133336 - DNA, 20 bp, Artificial Sequence
  Description of Artificial Sequence: Synthetic oligonucleotide
  Target: ATXN1; (+) strand; PAM type: NRG; PAM sequence: TAG
gaaagaagaaaacatctggg

SEQ ID NO: 133337 - DNA, 20 bp, Artificial Sequence
  Description of Artificial Sequence: Synthetic oligonucleotide
  Target: ATXN1; (+) strand; PAM type: NRG; PAM sequence: GAG
aagaagaaaacatctgggta

SEQ ID NO: 133338 - DNA, 20 bp, Artificial Sequence
  Description of Artificial Sequence: Synthetic oligonucleotide
  Target: ATXN1; (+) strand; PAM type: NRG; PAM sequence: TGG
aaacatctgggtagagtacg

SEQ ID NO: 133339 - DNA, 20 bp, Artificial Sequence
  Description of Artificial Sequence: Synthetic oligonucleotide
  Target: ATXN1; (+) strand; PAM type: NRG; PAM sequence: TGG
catctgggtagagtacgtgg

SEQ ID NO: 133340 - DNA, 20 bp, Artificial Sequence
  Description of Artificial Sequence: Synthetic oligonucleotide
  Target: ATXN1; (+) strand; PAM type: NRG; PAM sequence: GAG
agagtacgtggtggatgttt

SEQ ID NO: 133341 - DNA, 20 bp, Artificial Sequence
  Description of Artificial Sequence: Synthetic oligonucleotide
  Target: ATXN1; (+) strand; PAM type: NRG; PAM sequence: AGG
gagtacgtggtggatgtttg

SEQ ID NO: 133342 - DNA, 20 bp, Artificial Sequence
  Description of Artificial Sequence: Synthetic oligonucleotide
  Target: ATXN1; (+) strand; PAM type: NRG; PAM sequence: GGG
agtacgtggtggatgtttga

SEQ ID NO: 133343 - DNA, 20 bp, Artificial Sequence
  Description of Artificial Sequence: Synthetic oligonucleotide
  Target: ATXN1; (+) strand; PAM type: NRG; PAM sequence: AAG
ggtggatgtttgagggcccg

SEQ ID NO: 133344 - DNA, 20 bp, Artificial Sequence
  Description of Artificial Sequence: Synthetic oligonucleotide
  Target: ATXN1; (+) strand; PAM type: NRG; PAM sequence: GAG
tggatgtttgagggcccgaa

SEQ ID NO: 133345 - DNA, 20 bp, Artificial Sequence
  Description of Artificial Sequence: Synthetic oligonucleotide
  Target: ATXN1; (+) strand; PAM type: NRG; PAM sequence: GAG
gatgtttgagggcccgaaga

SEQ ID NO: 133346 - DNA, 20 bp, Artificial Sequence
  Description of Artificial Sequence: Synthetic oligonucleotide
  Target: ATXN1; (+) strand; PAM type: NRG; PAM sequence: CAG
gtttgagggcccgaagagag

SEQ ID NO: 133347 - DNA, 20 bp, Artificial Sequence
  Description of Artificial Sequence: Synthetic oligonucleotide
  Target: ATXN1; (+) strand; PAM type: NRG; PAM sequence: CAG
gcccgaagagagcagctgac

SEQ ID NO: 133348 - DNA, 20 bp, Artificial Sequence
  Description of Artificial Sequence: Synthetic oligonucleotide
  Target: ATXN1; (+) strand; PAM type: NRG; PAM sequence: AGG
cccgaagagagcagctgacc

SEQ ID NO: 133349 - DNA, 20 bp, Artificial Sequence
  Description of Artificial Sequence: Synthetic oligonucleotide
  Target: ATXN1; (+) strand; PAM type: NRG; PAM sequence: GGG
ccgaagagagcagctgacca

SEQ ID NO: 133350 - DNA, 20 bp, Artificial Sequence
  Description of Artificial Sequence: Synthetic oligonucleotide
  Target: ATXN1; (+) strand; PAM type: NRG; PAM sequence: GAG
gaagagagcagctgaccagg

SEQ ID NO: 133351 - DNA, 20 bp, Artificial Sequence
  Description of Artificial Sequence: Synthetic oligonucleotide
  Target: ATXN1; (+) strand; PAM type: NRG; PAM sequence: AGG
aagagagcagctgaccaggg

SEQ ID NO: 133352 - DNA, 20 bp, Artificial Sequence
  Description of Artificial Sequence: Synthetic oligonucleotide
  Target: ATXN1; (+) strand; PAM type: NRG; PAM sequence: GGG
agagagcagctgaccaggga

SEQ ID NO: 133353 - DNA, 20 bp, Artificial Sequence
  Description of Artificial Sequence: Synthetic oligonucleotide
  Target: ATXN1; (+) strand; PAM type: NRG; PAM sequence: TAG
ctgaccagggagggatacaa

SEQ ID NO: 133354 - DNA, 20 bp, Artificial Sequence
  Description of Artificial Sequence: Synthetic oligonucleotide
  Target: ATXN1; (+) strand; PAM type: NRG; PAM sequence: GAG
gaccagggagggatacaata

SEQ ID NO: 133355 - DNA, 20 bp, Artificial Sequence
  Description of Artificial Sequence: Synthetic oligonucleotide
  Target: ATXN1; (+) strand; PAM type: NRG; PAM sequence: AAG
ggagggatacaatagagaaa

SEQ ID NO: 133356 - DNA, 20 bp, Artificial Sequence
  Description of Artificial Sequence: Synthetic oligonucleotide
  Target: ATXN1; (+) strand; PAM type: NRG; PAM sequence: AGG
gagggatacaatagagaaaa

SEQ ID NO: 133357 - DNA, 20 bp, Artificial Sequence
  Description of Artificial Sequence: Synthetic oligonucleotide
  Target: ATXN1; (+) strand; PAM type: NRG; PAM sequence: AAG
atagagaaaaaggttcgtca

SEQ ID NO: 133358 - DNA, 20 bp, Artificial Sequence
  Description of Artificial Sequence: Synthetic oligonucleotide
  Target: ATXN1; (+) strand; PAM type: NRG; PAM sequence: CAG
agaaaaaggttcgtcaaaga

SEQ ID NO: 133359 - DNA, 20 bp, Artificial Sequence
  Description of Artificial Sequence: Synthetic oligonucleotide
  Target: ATXN1; (+) strand; PAM type: NRG; PAM sequence: AAG
cgtcaaagacagtaaatccg

SEQ ID NO: 133360 - DNA, 20 bp, Artificial Sequence
  Description of Artificial Sequence: Synthetic oligonucleotide
  Target: ATXN1; (+) strand; PAM type: NRG; PAM sequence: CAG
taaatccgaagctaaaaatg

SEQ ID NO: 133361 - DNA, 20 bp, Artificial Sequence
  Description of Artificial Sequence: Synthetic oligonucleotide
  Target: ATXN1; (+) strand; PAM type: NRG; PAM sequence: CAG
aatgcagcctttaccaaatg

SEQ ID NO: 133362 - DNA, 20 bp, Artificial Sequence
  Description of Artificial Sequence: Synthetic oligonucleotide
  Target: ATXN1; (+) strand; PAM type: NRG; PAM sequence: AGG
atgcagcctttaccaaatgc

SEQ ID NO: 133363 - DNA, 20 bp, Artificial Sequence
  Description of Artificial Sequence: Synthetic oligonucleotide
  Target: ATXN1; (+) strand; PAM type: NRG; PAM sequence: AAG
gcctttaccaaatgcaggtc

SEQ ID NO: 133364 - DNA, 20 bp, Artificial Sequence
  Description of Artificial Sequence: Synthetic oligonucleotide
  Target: ATXN1; (+) strand; PAM type: NRG; PAM sequence: AGG
cctttaccaaatgcaggtca

SEQ ID NO: 133365 - DNA, 20 bp, Artificial Sequence
  Description of Artificial Sequence: Synthetic oligonucleotide
  Target: ATXN1; (+) strand; PAM type: NRG; PAM sequence: AAG
ccaaatgcaggtcaaggcct

SEQ ID NO: 133366 - DNA, 20 bp, Artificial Sequence
  Description of Artificial Sequence: Synthetic oligonucleotide
  Target: ATXN1; (+) strand; PAM type: NRG; PAM sequence: AGG
caaatgcaggtcaaggccta

SEQ ID NO: 133367 - DNA, 20 bp, Artificial Sequence
  Description of Artificial Sequence: Synthetic oligonucleotide
  Target: ATXN1; (+) strand; PAM type: NRG; PAM sequence: GAG
aatgcaggtcaaggcctaag

SEQ ID NO: 133368 - DNA, 20 bp, Artificial Sequence
  Description of Artificial Sequence: Synthetic oligonucleotide
  Target: ATXN1; (+) strand; PAM type: NRG; PAM sequence: AAG
gtcaaggcctaaggagataa

SEQ ID NO: 133369 - DNA, 20 bp, Artificial Sequence
  Description of Artificial Sequence: Synthetic oligonucleotide
  Target: ATXN1; (+) strand; PAM type: NRG; PAM sequence: GAG
aggagataaaagaaatctct

SEQ ID NO: 133370 - DNA, 20 bp, Artificial Sequence
  Description of Artificial Sequence: Synthetic oligonucleotide
  Target: ATXN1; (+) strand; PAM type: NRG; PAM sequence: CAG
agataaaagaaatctctgag

SEQ ID NO: 133371 - DNA, 20 bp, Artificial Sequence
  Description of Artificial Sequence: Synthetic oligonucleotide
  Target: ATXN1; (+) strand; PAM type: NRG; PAM sequence: GAG
ataaaagaaatctctgagca

SEQ ID NO: 133372 - DNA, 20 bp, Artificial Sequence
  Description of Artificial Sequence: Synthetic oligonucleotide
  Target: ATXN1; (+) strand; PAM type: NRG; PAM sequence: AAG
ctgagcagagcctgttattt

SEQ ID NO: 133373 - DNA, 20 bp, Artificial Sequence
  Description of Artificial Sequence: Synthetic oligonucleotide
  Target: ATXN1; (+) strand; PAM type: NRG; PAM sequence: GAG
gagcagagcctgttatttaa

SEQ ID NO: 133374 - DNA, 20 bp, Artificial Sequence
  Description of Artificial Sequence: Synthetic oligonucleotide
  Target: ATXN1; (+) strand; PAM type: NRG; PAM sequence: AAG
gttatttaagagaccactaa

SEQ ID NO: 133375 - DNA, 20 bp, Artificial Sequence
  Description of Artificial Sequence: Synthetic oligonucleotide
  Target: ATXN1; (+) strand; PAM type: NRG; PAM sequence: CAG
aagagaccactaaaagcacc

SEQ ID NO: 133376 - DNA, 20 bp, Artificial Sequence
  Description of Artificial Sequence: Synthetic oligonucleotide
  Target: ATXN1; (+) strand; PAM type: NRG; PAM sequence: AGG
agagaccactaaaagcaccc

SEQ ID NO: 133377 - DNA, 20 bp, Artificial Sequence
  Description of Artificial Sequence: Synthetic oligonucleotide
  Target: ATXN1; (+) strand; PAM type: NRG; PAM sequence: TGG
ccactaaaagcacccaggaa

SEQ ID NO: 133378 - DNA, 20 bp, Artificial Sequence
  Description of Artificial Sequence: Synthetic oligonucleotide
  Target: ATXN1; (+) strand; PAM type: NRG; PAM sequence: GAG
actaaaagcacccaggaatg

SEQ ID NO: 133379 - DNA, 20 bp, Artificial Sequence
  Description of Artificial Sequence: Synthetic oligonucleotide
  Target: ATXN1; (+) strand; PAM type: NRG; PAM sequence: AGG
ctaaaagcacccaggaatgg

SEQ ID NO: 133380 - DNA, 20 bp, Artificial Sequence
  Description of Artificial Sequence: Synthetic oligonucleotide
  Target: ATXN1; (+) strand; PAM type: NRG; PAM sequence: GGG
taaaagcacccaggaatgga

SEQ ID NO: 133381 - DNA, 20 bp, Artificial Sequence
  Description of Artificial Sequence: Synthetic oligonucleotide
  Target: ATXN1; (+) strand; PAM type: NRG; PAM sequence: GAG
aaagcacccaggaatggagg

SEQ ID NO: 133382 - DNA, 20 bp, Artificial Sequence
  Description of Artificial Sequence: Synthetic oligonucleotide
  Target: ATXN1; (+) strand; PAM type: NRG; PAM sequence: AGG
aagcacccaggaatggaggg

SEQ ID NO: 133383 - DNA, 20 bp, Artificial Sequence
  Description of Artificial Sequence: Synthetic oligonucleotide
  Target: ATXN1; (+) strand; PAM type: NRG; PAM sequence: AAG
cacccaggaatggagggagg

SEQ ID NO: 133384 - DNA, 20 bp, Artificial Sequence
  Description of Artificial Sequence: Synthetic oligonucleotide
  Target: ATXN1; (+) strand; PAM type: NRG; PAM sequence: AGG
acccaggaatggagggagga

SEQ ID NO: 133385 - DNA, 20 bp, Artificial Sequence
  Description of Artificial Sequence: Synthetic oligonucleotide
  Target: ATXN1; (+) strand; PAM type: NRG; PAM sequence: AAG
aggaatggagggaggaaggt

SEQ ID NO: 133386 - DNA, 20 bp, Artificial Sequence
  Description of Artificial Sequence: Synthetic oligonucleotide
  Target: ATXN1; (+) strand; PAM type: NRG; PAM sequence: AAG
aatggagggaggaaggtaag

SEQ ID NO: 133387 - DNA, 20 bp, Artificial Sequence
  Description of Artificial Sequence: Synthetic oligonucleotide
  Target: ATXN1; (+) strand; PAM type: NRG; PAM sequence: GAG
acaatcccacaaacaatgct

SEQ ID NO: 133388 - DNA, 20 bp, Artificial Sequence
  Description of Artificial Sequence: Synthetic oligonucleotide
  Target: ATXN1; (+) strand; PAM type: NRG; PAM sequence: TGG
atcccacaaacaatgctgag

SEQ ID NO: 133389 - DNA, 20 bp, Artificial Sequence
  Description of Artificial Sequence: Synthetic oligonucleotide
  Target: ATXN1; (+) strand; PAM type: NRG; PAM sequence: AAG
ccacaaacaatgctgagtgg

SEQ ID NO: 133390 - DNA, 20 bp, Artificial Sequence
  Description of Artificial Sequence: Synthetic oligonucleotide
  Target: ATXN1; (+) strand; PAM type: NRG; PAM sequence: AGG
cacaaacaatgctgagtgga

SEQ ID NO: 133391 - DNA, 20 bp, Artificial Sequence
  Description of Artificial Sequence: Synthetic oligonucleotide
  Target: ATXN1; (+) strand; PAM type: NRG; PAM sequence: GGG
acaaacaatgctgagtggaa

SEQ ID NO: 133392 - DNA, 20 bp, Artificial Sequence
  Description of Artificial Sequence: Synthetic oligonucleotide
  Target: ATXN1; (+) strand; PAM type: NRG; PAM sequence: TAG
ctgagtggaagggtaccaaa

SEQ ID NO: 133393 - DNA, 20 bp, Artificial Sequence
  Description of Artificial Sequence: Synthetic oligonucleotide
  Target: ATXN1; (+) strand; PAM type: NRG; PAM sequence: AAG
tggaagggtaccaaatagta

SEQ ID NO: 133394 - DNA, 20 bp, Artificial Sequence
  Description of Artificial Sequence: Synthetic oligonucleotide
  Target: ATXN1; (+) strand; PAM type: NRG; PAM sequence: GAG
gaagggtaccaaatagtaaa

SEQ ID NO: 133395 - DNA, 20 bp, Artificial Sequence
  Description of Artificial Sequence: Synthetic oligonucleotide
  Target: ATXN1; (+) strand; PAM type: NRG; PAM sequence: AGG
aagggtaccaaatagtaaag

SEQ ID NO: 133396 - DNA, 20 bp, Artificial Sequence
  Description of Artificial Sequence: Synthetic oligonucleotide
  Target: ATXN1; (+) strand; PAM type: NRG; PAM sequence: AAG
taccaaatagtaaagaggtc

SEQ ID NO: 133397 - DNA, 20 bp, Artificial Sequence
  Description of Artificial Sequence: Synthetic oligonucleotide
  Target: ATXN1; (+) strand; PAM type: NRG; PAM sequence: TGG
agaggtcaagatgtgacaaa

SEQ ID NO: 133398 - DNA, 20 bp, Artificial Sequence
  Description of Artificial Sequence: Synthetic oligonucleotide
  Target: ATXN1; (+) strand; PAM type: NRG; PAM sequence: GAG
aggtcaagatgtgacaaatg

SEQ ID NO: 133399 - DNA, 20 bp, Artificial Sequence
  Description of Artificial Sequence: Synthetic oligonucleotide
  Target: ATXN1; (+) strand; PAM type: NRG; PAM sequence: AGG
ggtcaagatgtgacaaatgg

SEQ ID NO: 133400 - DNA, 20 bp, Artificial Sequence
  Description of Artificial Sequence: Synthetic oligonucleotide
  Target: ATXN1; (+) strand; PAM type: NRG; PAM sequence: GGG
gtcaagatgtgacaaatgga

SEQ ID NO: 133401 - DNA, 20 bp, Artificial Sequence
  Description of Artificial Sequence: Synthetic oligonucleotide
  Target: ATXN1; (+) strand; PAM type: NRG; PAM sequence: GGG
tcaagatgtgacaaatggag

SEQ ID NO: 133402 - DNA, 20 bp, Artificial Sequence
  Description of Artificial Sequence: Synthetic oligonucleotide
  Target: ATXN1; (+) strand; PAM type: NRG; PAM sequence: TAG
caaatggaggggctattatt

SEQ ID NO: 133403 - DNA, 20 bp, Artificial Sequence
  Description of Artificial Sequence: Synthetic oligonucleotide
  Target: ATXN1; (+) strand; PAM type: NRG; PAM sequence: TGG
gaggggctattatttagatc

SEQ ID NO: 133404 - DNA, 20 bp, Artificial Sequence
  Description of Artificial Sequence: Synthetic oligonucleotide
  Target: ATXN1; (+) strand; PAM type: NRG; PAM sequence: AAG
tggaacctaaaatctgttta

SEQ ID NO: 133405 - DNA, 20 bp, Artificial Sequence
  Description of Artificial Sequence: Synthetic oligonucleotide
  Target: ATXN1; (+) strand; PAM type: NRG; PAM sequence: AAG
tgtttaaagtgaactaaata

SEQ ID NO: 133406 - DNA, 20 bp, Artificial Sequence
  Description of Artificial Sequence: Synthetic oligonucleotide
  Target: ATXN1; (+) strand; PAM type: NRG; PAM sequence: AAG
ttaattatgcatgtgcacaa

SEQ ID NO: 133407 - DNA, 20 bp, Artificial Sequence
  Description of Artificial Sequence: Synthetic oligonucleotide
  Target: ATXN1; (+) strand; PAM type: NRG; PAM sequence: AGG
taattatgcatgtgcacaaa

SEQ ID NO: 133408 - DNA, 20 bp, Artificial Sequence
  Description of Artificial Sequence: Synthetic oligonucleotide
  Target: ATXN1; (+) strand; PAM type: NRG; PAM sequence: TAG
ttatgcatgtgcacaaaagg

SEQ ID NO: 133409 - DNA, 20 bp, Artificial Sequence
  Description of Artificial Sequence: Synthetic oligonucleotide
  Target: ATXN1; (+) strand; PAM type: NRG; PAM sequence: AGG
tatgcatgtgcacaaaaggt

SEQ ID NO: 133410 - DNA, 20 bp, Artificial Sequence
  Description of Artificial Sequence: Synthetic oligonucleotide
  Target: ATXN1; (+) strand; PAM type: NRG; PAM sequence: GAG
tataattaatctcactctct

SEQ ID NO: 133411 - DNA, 20 bp, Artificial Sequence
  Description of Artificial Sequence: Synthetic oligonucleotide
  Target: ATXN1; (+) strand; PAM type: NRG; PAM sequence: AGG
ataattaatctcactctctg

SEQ ID NO: 133412 - DNA, 20 bp, Artificial Sequence
  Description of Artificial Sequence: Synthetic oligonucleotide
  Target: ATXN1; (+) strand; PAM type: NRG; PAM sequence: TAG
tcactctctgaggtgaatta

SEQ ID NO: 133413 - DNA, 20 bp, Artificial Sequence
  Description of Artificial Sequence: Synthetic oligonucleotide
  Target: ATXN1; (+) strand; PAM type: NRG; PAM sequence: TGG
ctctctgaggtgaattatag

SEQ ID NO: 133414 - DNA, 20 bp, Artificial Sequence
  Description of Artificial Sequence: Synthetic oligonucleotide
  Target: ATXN1; (+) strand; PAM type: NRG; PAM sequence: GGG
tctctgaggtgaattatagt

SEQ ID NO: 133415 - DNA, 20 bp, Artificial Sequence
  Description of Artificial Sequence: Synthetic oligonucleotide
  Target: ATXN1; (+) strand; PAM type: NRG; PAM sequence: AAG
gaggtgaattatagtgggta

SEQ ID NO: 133416 - DNA, 20 bp, Artificial Sequence
  Description of Artificial Sequence: Synthetic oligonucleotide
  Target: ATXN1; (+) strand; PAM type: NRG; PAM sequence: AAG
tgaattatagtgggtaaagt

SEQ ID NO: 133417 - DNA, 20 bp, Artificial Sequence
  Description of Artificial Sequence: Synthetic oligonucleotide
  Target: ATXN1; (+) strand; PAM type: NRG; PAM sequence: AAG
atagtgggtaaagtaagaaa

SEQ ID NO: 133418 - DNA, 20 bp, Artificial Sequence
  Description of Artificial Sequence: Synthetic oligonucleotide
  Target: ATXN1; (+) strand; PAM type: NRG; PAM sequence: AGG
tagtgggtaaagtaagaaaa

SEQ ID NO: 133419 - DNA, 20 bp, Artificial Sequence
  Description of Artificial Sequence: Synthetic oligonucleotide
  Target: ATXN1; (+) strand; PAM type: NRG; PAM sequence: TGG
gtaaagtaagaaaaaggata

SEQ ID NO: 133420 - DNA, 20 bp, Artificial Sequence
  Description of Artificial Sequence: Synthetic oligonucleotide
  Target: ATXN1; (+) strand; PAM type: NRG; PAM sequence: AAG
agaaaaaggatatggttaat

SEQ ID NO: 133421 - DNA, 20 bp, Artificial Sequence
  Description of Artificial Sequence: Synthetic oligonucleotide
  Target: ATXN1; (+) strand; PAM type: NRG; PAM sequence: GAG
aaaaaggatatggttaataa

SEQ ID NO: 133422 - DNA, 20 bp, Artificial Sequence
  Description of Artificial Sequence: Synthetic oligonucleotide
  Target: ATXN1; (+) strand; PAM type: NRG; PAM sequence: AAG
gatatggttaataagagaac

SEQ ID NO: 133423 - DNA, 20 bp, Artificial Sequence
  Description of Artificial Sequence: Synthetic oligonucleotide
  Target: ATXN1; (+) strand; PAM type: NRG; PAM sequence: AGG
atatggttaataagagaaca

SEQ ID NO: 133424 - DNA, 20 bp, Artificial Sequence
  Description of Artificial Sequence: Synthetic oligonucleotide
  Target: ATXN1; (+) strand; PAM type: NRG; PAM sequence: TGG
agaacaaggtacacgtgttc

SEQ ID NO: 133425 - DNA, 20 bp, Artificial Sequence
  Description of Artificial Sequence: Synthetic oligonucleotide
  Target: ATXN1; (+) strand; PAM type: NRG; PAM sequence: TGG
gtgcacctcgattcttcctt

SEQ ID NO: 133426 - DNA, 20 bp, Artificial Sequence
  Description of Artificial Sequence: Synthetic oligonucleotide
  Target: ATXN1; (+) strand; PAM type: NRG; PAM sequence: GGG
tgcacctcgattcttccttt

SEQ ID NO: 133427 - DNA, 20 bp, Artificial Sequence
  Description of Artificial Sequence: Synthetic oligonucleotide
  Target: ATXN1; (+) strand; PAM type: NRG; PAM sequence: TGG
acctcgattcttcctttggg

SEQ ID NO: 133428 - DNA, 20 bp, Artificial Sequence
  Description of Artificial Sequence: Synthetic oligonucleotide
  Target: ATXN1; (+) strand; PAM type: NRG; PAM sequence: AAG
gattcttcctttgggtggtt

SEQ ID NO: 133429 - DNA, 20 bp, Artificial Sequence
  Description of Artificial Sequence: Synthetic oligonucleotide
  Target: ATXN1; (+) strand; PAM type: NRG; PAM sequence: AAG
aaaatcaccatactgtgata

SEQ ID NO: 133430 - DNA, 20 bp, Artificial Sequence
  Description of Artificial Sequence: Synthetic oligonucleotide
  Target: ATXN1; (+) strand; PAM type: NRG; PAM sequence: CGG
accatactgtgataaagaca

SEQ ID NO: 133431 - DNA, 20 bp, Artificial Sequence
  Description of Artificial Sequence: Synthetic oligonucleotide
  Target: ATXN1; (+) strand; PAM type: NRG; PAM sequence: TAG
ccatctttctaacatgtttg

SEQ ID NO: 133432 - DNA, 20 bp, Artificial Sequence
  Description of Artificial Sequence: Synthetic oligonucleotide
  Target: ATXN1; (+) strand; PAM type: NRG; PAM sequence: GAG
atctttctaacatgtttgta

SEQ ID NO: 133433 - DNA, 20 bp, Artificial Sequence
  Description of Artificial Sequence: Synthetic oligonucleotide
  Target: ATXN1; (+) strand; PAM type: NRG; PAM sequence: AAG
catgtttgtagagttataaa

SEQ ID NO: 133434 - DNA, 20 bp, Artificial Sequence
  Description of Artificial Sequence: Synthetic oligonucleotide
  Target: ATXN1; (+) strand; PAM type: NRG; PAM sequence: AAG
tgtagagttataaaaagtaa

SEQ ID NO: 133435 - DNA, 20 bp, Artificial Sequence
  Description of Artificial Sequence: Synthetic oligonucleotide
  Target: ATXN1; (+) strand; PAM type: NRG; PAM sequence: AAG
gactcatttcacaatttctt

SEQ ID NO: 133436 - DNA, 20 bp, Artificial Sequence
  Description of Artificial Sequence: Synthetic oligonucleotide
  Target: ATXN1; (+) strand; PAM type: NRG; PAM sequence: AGG
actcatttcacaatttctta

SEQ ID NO: 133437 - DNA, 20 bp, Artificial Sequence
  Description of Artificial Sequence: Synthetic oligonucleotide
  Target: ATXN1; (+) strand; PAM type: NRG; PAM sequence: TGG
ttcacaatttcttaaggata

SEQ ID NO: 133438 - DNA, 20 bp, Artificial Sequence
  Description of Artificial Sequence: Synthetic oligonucleotide
  Target: ATXN1; (+) strand; PAM type: NRG; PAM sequence: AAG
taaggatatggattgtcaat

SEQ ID NO: 133439 - DNA, 20 bp, Artificial Sequence
  Description of Artificial Sequence: Synthetic oligonucleotide
  Target: ATXN1; (+) strand; PAM type: NRG; PAM sequence: GAG
tcatttacattacctaaatt

SEQ ID NO: 133440 - DNA, 20 bp, Artificial Sequence
  Description of Artificial Sequence: Synthetic oligonucleotide
  Target: ATXN1; (+) strand; PAM type: NRG; PAM sequence: GAG
atttacattacctaaattga

SEQ ID NO: 133441 - DNA, 20 bp, Artificial Sequence
  Description of Artificial Sequence: Synthetic oligonucleotide
  Target: ATXN1; (+) strand; PAM type: NRG; PAM sequence: GAG
cattacctaaattgagagat

SEQ ID NO: 133442 - DNA, 20 bp, Artificial Sequence
  Description of Artificial Sequence: Synthetic oligonucleotide
  Target: ATXN1; (+) strand; PAM type: NRG; PAM sequence: TAG
tacctaaattgagagatgag

SEQ ID NO: 133443 - DNA, 20 bp, Artificial Sequence
  Description of Artificial Sequence: Synthetic oligonucleotide
  Target: ATXN1; (+) strand; PAM type: NRG; PAM sequence: TGG
agtagcccgatgatctttac

SEQ ID NO: 133444 - DNA, 20 bp, Artificial Sequence
  Description of Artificial Sequence: Synthetic oligonucleotide
  Target: ATXN1; (+) strand; PAM type: NRG; PAM sequence: TAG
ccgatgatctttactggccc

SEQ ID NO: 133445 - DNA, 20 bp, Artificial Sequence
  Description of Artificial Sequence: Synthetic oligonucleotide
  Target: ATXN1; (+) strand; PAM type: NRG; PAM sequence: GAG
gccctagcaactgtgcattc

SEQ ID NO: 133446 - DNA, 20 bp, Artificial Sequence
  Description of Artificial Sequence: Synthetic oligonucleotide
  Target: ATXN1; (+) strand; PAM type: NRG; PAM sequence: AGG
ccctagcaactgtgcattcg

SEQ ID NO: 133447 - DNA, 20 bp, Artificial Sequence
  Description of Artificial Sequence: Synthetic oligonucleotide
  Target: ATXN1; (+) strand; PAM type: NRG; PAM sequence: GGG
cctagcaactgtgcattcga

SEQ ID NO: 133448 - DNA, 20 bp, Artificial Sequence
  Description of Artificial Sequence: Synthetic oligonucleotide
  Target: ATXN1; (+) strand; PAM type: NRG; PAM sequence: GGG
ctagcaactgtgcattcgag

SEQ ID NO: 133449 - DNA, 20 bp, Artificial Sequence
  Description of Artificial Sequence: Synthetic oligonucleotide
  Target: ATXN1; (+) strand; PAM type: NRG; PAM sequence: TAG
actgtgcattcgaggggtgt

SEQ ID NO: 133450 - DNA, 20 bp, Artificial Sequence
  Description of Artificial Sequence: Synthetic oligonucleotide
  Target: ATXN1; (+) strand; PAM type: NRG; PAM sequence: CAG
tgcattcgaggggtgttaga

SEQ ID NO: 133451 - DNA, 20 bp, Artificial Sequence
  Description of Artificial Sequence: Synthetic oligonucleotide
  Target: ATXN1; (+) strand; PAM type: NRG; PAM sequence: TGG
tccttaccttcttcatttcc

SEQ ID NO: 133452 - DNA, 20 bp, Artificial Sequence
  Description of Artificial Sequence: Synthetic oligonucleotide
  Target: ATXN1; (+) strand; PAM type: NRG; PAM sequence: TGG
accttcttcatttcctggcc

SEQ ID NO: 133453 - DNA, 20 bp, Artificial Sequence
  Description of Artificial Sequence: Synthetic oligonucleotide
  Target: ATXN1; (+) strand; PAM type: NRG; PAM sequence: CGG
cttcatttcctggcctggtc

SEQ ID NO: 133454 - DNA, 20 bp, Artificial Sequence
  Description of Artificial Sequence: Synthetic oligonucleotide
  Target: ATXN1; (+) strand; PAM type: NRG; PAM sequence: CAG
aacaatcacaacctcattgt

SEQ ID NO: 133455 - DNA, 20 bp, Artificial Sequence
  Description of Artificial Sequence: Synthetic oligonucleotide
  Target: ATXN1; (+) strand; PAM type: NRG; PAM sequence: TGG
gtcagtccctgactattctc

SEQ ID NO: 133456 - DNA, 20 bp, Artificial Sequence
  Description of Artificial Sequence: Synthetic oligonucleotide
  Target: ATXN1; (+) strand; PAM type: NRG; PAM sequence: CAG
tctttctgttctatgccttc

SEQ ID NO: 133457 - DNA, 20 bp, Artificial Sequence
  Description of Artificial Sequence: Synthetic oligonucleotide
  Target: ATXN1; (+) strand; PAM type: NRG; PAM sequence: CAG
ttctatgccttccagatcaa

SEQ ID NO: 133458 - DNA, 20 bp, Artificial Sequence
  Description of Artificial Sequence: Synthetic oligonucleotide
  Target: ATXN1; (+) strand; PAM type: NRG; PAM sequence: AGG
tctatgccttccagatcaac

SEQ ID NO: 133459 - DNA, 20 bp, Artificial Sequence
  Description of Artificial Sequence: Synthetic oligonucleotide
  Target: ATXN1; (+) strand; PAM type: NRG; PAM sequence: TGG
atcaacaggtctgtctcccc

SEQ ID NO: 133460 - DNA, 20 bp, Artificial Sequence
  Description of Artificial Sequence: Synthetic oligonucleotide
  Target: ATXN1; (+) strand; PAM type: NRG; PAM sequence: CAG
tctgtctcccctggtttctc

SEQ ID NO: 133461 - DNA, 20 bp, Artificial Sequence
  Description of Artificial Sequence: Synthetic oligonucleotide
  Target: ATXN1; (+) strand; PAM type: NRG; PAM sequence: CAG
gtttctccagtttccaattt

SEQ ID NO: 133462 - DNA, 20 bp, Artificial Sequence
  Description of Artificial Sequence: Synthetic oligonucleotide
  Target: ATXN1; (+) strand; PAM type: NRG; PAM sequence: TAG
atgcacctcttgcctccttt

SEQ ID NO: 133463 - DNA, 20 bp, Artificial Sequence
  Description of Artificial Sequence: Synthetic oligonucleotide
  Target: ATXN1; (+) strand; PAM type: NRG; PAM sequence: TGG
cctcttgcctccttttagaa

SEQ ID NO: 133464 - DNA, 20 bp, Artificial Sequence
  Description of Artificial Sequence: Synthetic oligonucleotide
  Target: ATXN1; (+) strand; PAM type: NRG; PAM sequence: CAG
tgcctccttttagaatggtc

SEQ ID NO: 133465 - DNA, 20 bp, Artificial Sequence
  Description of Artificial Sequence: Synthetic oligonucleotide
  Target: ATXN1; (+) strand; PAM type: NRG; PAM sequence: CAG
tctcccctgttcccccaaac

SEQ ID NO: 133466 - DNA, 20 bp, Artificial Sequence
  Description of Artificial Sequence: Synthetic oligonucleotide
  Target: ATXN1; (+) strand; PAM type: NRG; PAM sequence: TGG
ttcccccaaaccagttatga

SEQ ID NO: 133467 - DNA, 20 bp, Artificial Sequence
  Description of Artificial Sequence: Synthetic oligonucleotide
  Target: ATXN1; (+) strand; PAM type: NRG; PAM sequence: GAG
ggtgttgactgtatctccct

SEQ ID NO: 133468 - DNA, 20 bp, Artificial Sequence
  Description of Artificial Sequence: Synthetic oligonucleotide
  Target: ATXN1; (+) strand; PAM type: NRG; PAM sequence: TAG
ctgagaactgtaaactccat

SEQ ID NO: 133469 - DNA, 20 bp, Artificial Sequence
  Description of Artificial Sequence: Synthetic oligonucleotide
  Target: ATXN1; (+) strand; PAM type: NRG; PAM sequence: AGG
tgagaactgtaaactccatt

SEQ ID NO: 133470 - DNA, 20 bp, Artificial Sequence
  Description of Artificial Sequence: Synthetic oligonucleotide
  Target: ATXN1; (+) strand; PAM type: NRG; PAM sequence: GGG
gagaactgtaaactccatta

SEQ ID NO: 133471 - DNA, 20 bp, Artificial Sequence
  Description of Artificial Sequence: Synthetic oligonucleotide
  Target: ATXN1; (+) strand; PAM type: NRG; PAM sequence: CAG
actgtaaactccattagggc

SEQ ID NO: 133472 - DNA, 20 bp, Artificial Sequence
  Description of Artificial Sequence: Synthetic oligonucleotide
  Target: ATXN1; (+) strand; PAM type: NRG; PAM sequence: CAG
cctccattatcttcaatgcc

SEQ ID NO: 133473 - DNA, 20 bp, Artificial Sequence
  Description of Artificial Sequence: Synthetic oligonucleotide
  Target: ATXN1; (+) strand; PAM type: NRG; PAM sequence: TGG
ttcaatgcccagccctatac

SEQ ID NO: 133474 - DNA, 20 bp, Artificial Sequence
  Description of Artificial Sequence: Synthetic oligonucleotide
  Target: ATXN1; (+) strand; PAM type: NRG; PAM sequence: GGG
tcaatgcccagccctatact

SEQ ID NO: 133475 - DNA, 20 bp, Artificial Sequence
  Description of Artificial Sequence: Synthetic oligonucleotide
  Target: ATXN1; (+) strand; PAM type: NRG; PAM sequence: TAG
cccagccctatactgggaca

SEQ ID NO: 133476 - DNA, 20 bp, Artificial Sequence
  Description of Artificial Sequence: Synthetic oligonucleotide
  Target: ATXN1; (+) strand; PAM type: NRG; PAM sequence: AAG
gggacatagctgcccctaaa

SEQ ID NO: 133477 - DNA, 20 bp, Artificial Sequence
  Description of Artificial Sequence: Synthetic oligonucleotide
  Target: ATXN1; (+) strand; PAM type: NRG; PAM sequence: AGG
ggacatagctgcccctaaaa

SEQ ID NO: 133478 - DNA, 20 bp, Artificial Sequence
  Description of Artificial Sequence: Synthetic oligonucleotide
  Target: ATXN1; (+) strand; PAM type: NRG; PAM sequence: GAG
cctttgctaaattaataaat

SEQ ID NO: 133479 - DNA, 20 bp, Artificial Sequence
  Description of Artificial Sequence: Synthetic oligonucleotide
  Target: ATXN1; (+) strand; PAM type: NRG; PAM sequence: GAG
tgctaaattaataaatgagt

SEQ ID NO: 133480 - DNA, 20 bp, Artificial Sequence
  Description of Artificial Sequence: Synthetic oligonucleotide
  Target: ATXN1; (+) strand; PAM type: NRG; PAM sequence: AGG
gctaaattaataaatgagtg

SEQ ID NO: 133481 - DNA, 20 bp, Artificial Sequence
  Description of Artificial Sequence: Synthetic oligonucleotide
  Target: ATXN1; (+) strand; PAM type: NRG; PAM sequence: TGG
atgagtgaggaatgactgaa

SEQ ID NO: 133482 - DNA, 20 bp, Artificial Sequence
  Description of Artificial Sequence: Synthetic oligonucleotide
  Target: ATXN1; (+) strand; PAM type: NRG; PAM sequence: GGG
tgagtgaggaatgactgaat

SEQ ID NO: 133483 - DNA, 20 bp, Artificial Sequence
  Description of Artificial Sequence: Synthetic oligonucleotide
  Target: ATXN1; (+) strand; PAM type: NRG; PAM sequence: AAG
actgaatgggattaaaatta

SEQ ID NO: 133484 - DNA, 20 bp, Artificial Sequence
  Description of Artificial Sequence: Synthetic oligonucleotide
  Target: ATXN1; (+) strand; PAM type: NRG; PAM sequence: CAG
taaaattaaagaccttgtct

SEQ ID NO: 133485 - DNA, 20 bp, Artificial Sequence
  Description of Artificial Sequence: Synthetic oligonucleotide
  Target: ATXN1; (+) strand; PAM type: NRG; PAM sequence: AAG
ctcagtttctcacaattcaa

SEQ ID NO: 133486 - DNA, 20 bp, Artificial Sequence
  Description of Artificial Sequence: Synthetic oligonucleotide
  Target: ATXN1; (+) strand; PAM type: NRG; PAM sequence: TGG
gttgtgctttaactttgtgc

SEQ ID NO: 133487 - DNA, 20 bp, Artificial Sequence
  Description of Artificial Sequence: Synthetic oligonucleotide
  Target: ATXN1; (+) strand; PAM type: NRG; PAM sequence: AAG
ctttgtgctggcaaaatcct

SEQ ID NO: 133488 - DNA, 20 bp, Artificial Sequence
  Description of Artificial Sequence: Synthetic oligonucleotide
  Target: ATXN1; (+) strand; PAM type: NRG; PAM sequence: AAG
caaaatcctaagacacccca

SEQ ID NO: 133489 - DNA, 20 bp, Artificial Sequence
  Description of Artificial Sequence: Synthetic oligonucleotide
  Target: ATXN1; (+) strand; PAM type: NRG; PAM sequence: TGG
aagacaccccaaagtcccca

SEQ ID NO: 133490 - DNA, 20 bp, Artificial Sequence
  Description of Artificial Sequence: Synthetic oligonucleotide
  Target: ATXN1; (+) strand; PAM type: NRG; PAM sequence: GGG
agacaccccaaagtccccat

SEQ ID NO: 133491 - DNA, 20 bp, Artificial Sequence
  Description of Artificial Sequence: Synthetic oligonucleotide
  Target: ATXN1; (+) strand; PAM type: NRG; PAM sequence: AAG
cccatgggactttgcgaact

SEQ ID NO: 133492 - DNA, 20 bp, Artificial Sequence
  Description of Artificial Sequence: Synthetic oligonucleotide
  Target: ATXN1; (+) strand; PAM type: NRG; PAM sequence: TGG
atttcaacaatgattctgcc

SEQ ID NO: 133493 - DNA, 20 bp, Artificial Sequence
  Description of Artificial Sequence: Synthetic oligonucleotide
  Target: ATXN1; (+) strand; PAM type: NRG; PAM sequence: CAG
aatgattctgcctggtcttg

SEQ ID NO: 133494 - DNA, 20 bp, Artificial Sequence
  Description of Artificial Sequence: Synthetic oligonucleotide
  Target: ATXN1; (+) strand; PAM type: NRG; PAM sequence: TAG
attctgcctggtcttgcaga

SEQ ID NO: 133495 - DNA, 20 bp, Artificial Sequence
  Description of Artificial Sequence: Synthetic oligonucleotide
  Target: ATXN1; (+) strand; PAM type: NRG; PAM sequence: AGG
ttctgcctggtcttgcagat

SEQ ID NO: 133496 - DNA, 20 bp, Artificial Sequence
  Description of Artificial Sequence: Synthetic oligonucleotide
  Target: ATXN1; (+) strand; PAM type: NRG; PAM sequence: TGG
cttgtacatgaatgcaaaaa

SEQ ID NO: 133497 - DNA, 20 bp, Artificial Sequence
  Description of Artificial Sequence: Synthetic oligonucleotide
  Target: ATXN1; (+) strand; PAM type: NRG; PAM sequence: TGG
acatgaatgcaaaaatggtg

SEQ ID NO: 133498 - DNA, 20 bp, Artificial Sequence
  Description of Artificial Sequence: Synthetic oligonucleotide
  Target: ATXN1; (+) strand; PAM type: NRG; PAM sequence: GGG
catgaatgcaaaaatggtgt

SEQ ID NO: 133499 - DNA, 20 bp, Artificial Sequence
  Description of Artificial Sequence: Synthetic oligonucleotide
  Target: ATXN1; (+) strand; PAM type: NRG; PAM sequence: CAG
atggtgtgggcaaccatgtg

SEQ ID NO: 133500 - DNA, 20 bp, Artificial Sequence
  Description of Artificial Sequence: Synthetic oligonucleotide
  Target: ATXN1; (+) strand; PAM type: NRG; PAM sequence: TGG
gggcaaccatgtgcagtata

SEQ ID NO: 133501 - DNA, 20 bp, Artificial Sequence
  Description of Artificial Sequence: Synthetic oligonucleotide
  Target: ATXN1; (+) strand; PAM type: NRG; PAM sequence: CAG
caaccaaaaactgctgacca

SEQ ID NO: 133502 - DNA, 20 bp, Artificial Sequence
  Description of Artificial Sequence: Synthetic oligonucleotide
  Target: ATXN1; (+) strand; PAM type: NRG; PAM sequence: GAG
aaactgctgaccacagatct

SEQ ID NO: 133503 - DNA, 20 bp, Artificial Sequence
  Description of Artificial Sequence: Synthetic oligonucleotide
  Target: ATXN1; (+) strand; PAM type: NRG; PAM sequence: AGG
aactgctgaccacagatctg

SEQ ID NO: 133504 - DNA, 20 bp, Artificial Sequence
  Description of Artificial Sequence: Synthetic oligonucleotide
  Target: ATXN1; (+) strand; PAM type: NRG; PAM sequence: CAG
tgaccacagatctgaggtca

SEQ ID NO: 133505 - DNA, 20 bp, Artificial Sequence
  Description of Artificial Sequence: Synthetic oligonucleotide
  Target: ATXN1; (+) strand; PAM type: NRG; PAM sequence: TGG
aggtcacagcacaattaata

SEQ ID NO: 133506 - DNA, 20 bp, Artificial Sequence
  Description of Artificial Sequence: Synthetic oligonucleotide
  Target: ATXN1; (+) strand; PAM type: NRG; PAM sequence: AAG
acagcacaattaatatggtt

SEQ ID NO: 133507 - DNA, 20 bp, Artificial Sequence
  Description of Artificial Sequence: Synthetic oligonucleotide
  Target: ATXN1; (+) strand; PAM type: NRG; PAM sequence: TAG
ttcccactctcctgtctccc

SEQ ID NO: 133508 - DNA, 20 bp, Artificial Sequence
  Description of Artificial Sequence: Synthetic oligonucleotide
  Target: ATXN1; (+) strand; PAM type: NRG; PAM sequence: GAG
cccactctcctgtctcccta

SEQ ID NO: 133509 - DNA, 20 bp, Artificial Sequence
  Description of Artificial Sequence: Synthetic oligonucleotide
  Target: ATXN1; (+) strand; PAM type: NRG; PAM sequence: TGG
ctccctagagaaatttattc

SEQ ID NO: 133510 - DNA, 20 bp, Artificial Sequence
  Description of Artificial Sequence: Synthetic oligonucleotide
  Target: ATXN1; (+) strand; PAM type: NRG; PAM sequence: AAG
ctagagaaatttattctggt

SEQ ID NO: 133511 - DNA, 20 bp, Artificial Sequence
  Description of Artificial Sequence: Synthetic oligonucleotide
  Target: ATXN1; (+) strand; PAM type: NRG; PAM sequence: CAG
acgtctgcatttctgcacac

SEQ ID NO: 133512 - DNA, 20 bp, Artificial Sequence
  Description of Artificial Sequence: Synthetic oligonucleotide
  Target: ATXN1; (+) strand; PAM type: NRG; PAM sequence: CAG
ctgcatttctgcacaccagc

SEQ ID NO: 133513 - DNA, 20 bp, Artificial Sequence
  Description of Artificial Sequence: Synthetic oligonucleotide
  Target: ATXN1; (+) strand; PAM type: NRG; PAM sequence: CAG
gcacaccagccagtgatcca

SEQ ID NO: 133514 - DNA, 20 bp, Artificial Sequence
  Description of Artificial Sequence: Synthetic oligonucleotide
  Target: ATXN1; (+) strand; PAM type: NRG; PAM sequence: AAG
accagccagtgatccacagc

SEQ ID NO: 133515 - DNA, 20 bp, Artificial Sequence
  Description of Artificial Sequence: Synthetic oligonucleotide
  Target: ATXN1; (+) strand; PAM type: NRG; PAM sequence: GAG
cagccagtgatccacagcaa

SEQ ID NO: 133516 - DNA, 20 bp, Artificial Sequence
  Description of Artificial Sequence: Synthetic oligonucleotide
  Target: ATXN1; (+) strand; PAM type: NRG; PAM sequence: GAG
agaatcctttcttcctctct

SEQ ID NO: 133517 - DNA, 20 bp, Artificial Sequence
  Description of Artificial Sequence: Synthetic oligonucleotide
  Target: ATXN1; (+) strand; PAM type: NRG; PAM sequence: TAG
ctgagtctttattgattttg

SEQ ID NO: 133518 - DNA, 20 bp, Artificial Sequence
  Description of Artificial Sequence: Synthetic oligonucleotide
  Target: ATXN1; (+) strand; PAM type: NRG; PAM sequence: TGG
tctttattgattttgtagtt

SEQ ID NO: 133519 - DNA, 20 bp, Artificial Sequence
  Description of Artificial Sequence: Synthetic oligonucleotide
  Target: ATXN1; (+) strand; PAM type: NRG; PAM sequence: GGG
ctttattgattttgtagttt

SEQ ID NO: 133520 - DNA, 20 bp, Artificial Sequence
  Description of Artificial Sequence: Synthetic oligonucleotide
  Target: ATXN1; (+) strand; PAM type: NRG; PAM sequence: GAG
ttattgattttgtagtttgg

SEQ ID NO: 133521 - DNA, 20 bp, Artificial Sequence
  Description of Artificial Sequence: Synthetic oligonucleotide
  Target: ATXN1; (+) strand; PAM type: NRG; PAM sequence: AGG
tattgattttgtagtttggg

SEQ ID NO: 133522 - DNA, 20 bp, Artificial Sequence
  Description of Artificial Sequence: Synthetic oligonucleotide
  Target: ATXN1; (+) strand; PAM type: NRG; PAM sequence: AAG
tgattttgtagtttgggagg

SEQ ID NO: 133523 - DNA, 20 bp, Artificial Sequence
  Description of Artificial Sequence: Synthetic oligonucleotide
  Target: ATXN1; (+) strand; PAM type: NRG; PAM sequence: AAG
ttgtagtttgggaggaagct

SEQ ID NO: 133524 - DNA, 20 bp, Artificial Sequence
  Description of Artificial Sequence: Synthetic oligonucleotide
  Target: ATXN1; (+) strand; PAM type: NRG; PAM sequence: TGG
caaataccaaatgttccata

SEQ ID NO: 133525 - DNA, 20 bp, Artificial Sequence
  Description of Artificial Sequence: Synthetic oligonucleotide
  Target: ATXN1; (+) strand; PAM type: NRG; PAM sequence: TAG
ataccaaatgttccatatgg

SEQ ID NO: 133526 - DNA, 20 bp, Artificial Sequence
  Description of Artificial Sequence: Synthetic oligonucleotide
  Target: ATXN1; (+) strand; PAM type: NRG; PAM sequence: GAG
cattcccactaccgttactt

SEQ ID NO: 133527 - DNA, 20 bp, Artificial Sequence
  Description of Artificial Sequence: Synthetic oligonucleotide
  Target: ATXN1; (+) strand; PAM type: NRG; PAM sequence: AGG
attcccactaccgttacttg

SEQ ID NO: 133528 - DNA, 20 bp, Artificial Sequence
  Description of Artificial Sequence: Synthetic oligonucleotide
  Target: ATXN1; (+) strand; PAM type: NRG; PAM sequence: GAG
ggccttctacctacactcat

SEQ ID NO: 133529 - DNA, 20 bp, Artificial Sequence
  Description of Artificial Sequence: Synthetic oligonucleotide
  Target: ATXN1; (+) strand; PAM type: NRG; PAM sequence: AGG
gccttctacctacactcatg

SEQ ID NO: 133530 - DNA, 20 bp, Artificial Sequence
  Description of Artificial Sequence: Synthetic oligonucleotide
  Target: ATXN1; (+) strand; PAM type: NRG; PAM sequence: CAG
acactcatgaggtgcctcat

SEQ ID NO: 133531 - DNA, 20 bp, Artificial Sequence
  Description of Artificial Sequence: Synthetic oligonucleotide
  Target: ATXN1; (+) strand; PAM type: NRG; PAM sequence: TGG
tgaggtgcctcatcagaatc

SEQ ID NO: 133532 - DNA, 20 bp, Artificial Sequence
  Description of Artificial Sequence: Synthetic oligonucleotide
  Target: ATXN1; (+) strand; PAM type: NRG; PAM sequence: CAG
ggtgcctcatcagaatctgg

SEQ ID NO: 133533 - DNA, 20 bp, Artificial Sequence
  Description of Artificial Sequence: Synthetic oligonucleotide
  Target: ATXN1; (+) strand; PAM type: NRG; PAM sequence: AAG
atacatgtgtgtataaatcc

SEQ ID NO: 133534 - DNA, 20 bp, Artificial Sequence
  Description of Artificial Sequence: Synthetic oligonucleotide
  Target: ATXN1; (+) strand; PAM type: NRG; PAM sequence: TAG
tgttttcttattcatcctca

SEQ ID NO: 133535 - DNA, 20 bp, Artificial Sequence
  Description of Artificial Sequence: Synthetic oligonucleotide
  Target: ATXN1; (+) strand; PAM type: NRG; PAM sequence: CAG
cttattcatcctcatagtca

SEQ ID NO: 133536 - DNA, 20 bp, Artificial Sequence
  Description of Artificial Sequence: Synthetic oligonucleotide
  Target: ATXN1; (+) strand; PAM type: NRG; PAM sequence: AGG
ttattcatcctcatagtcac

SEQ ID NO: 133537 - DNA, 20 bp, Artificial Sequence
  Description of Artificial Sequence: Synthetic oligonucleotide
  Target: ATXN1; (+) strand; PAM type: NRG; PAM sequence: GGG
tattcatcctcatagtcaca

SEQ ID NO: 133538 - DNA, 20 bp, Artificial Sequence
  Description of Artificial Sequence: Synthetic oligonucleotide
  Target: ATXN1; (+) strand; PAM type: NRG; PAM sequence: GGG
attcatcctcatagtcacag

SEQ ID NO: 133539 - DNA, 20 bp, Artificial Sequence
  Description of Artificial Sequence: Synthetic oligonucleotide
  Target: ATXN1; (+) strand; PAM type: NRG; PAM sequence: AAG
ggaatgatttatgacacatt

SEQ ID NO: 133540 - DNA, 20 bp, Artificial Sequence
  Description of Artificial Sequence: Synthetic oligonucleotide
  Target: ATXN1; (+) strand; PAM type: NRG; PAM sequence: AGG
gaatgatttatgacacatta

SEQ ID NO: 133541 - DNA, 20 bp, Artificial Sequence
  Description of Artificial Sequence: Synthetic oligonucleotide
  Target: ATXN1; (+) strand; PAM type: NRG; PAM sequence: GAG
atgatttatgacacattaag

SEQ ID NO: 133542 - DNA, 20 bp, Artificial Sequence
  Description of Artificial Sequence: Synthetic oligonucleotide
  Target: ATXN1; (+) strand; PAM type: NRG; PAM sequence: AGG
tgatttatgacacattaagg

SEQ ID NO: 133543 - DNA, 20 bp, Artificial Sequence
  Description of Artificial Sequence: Synthetic oligonucleotide
  Target: ATXN1; (+) strand; PAM type: NRG; PAM sequence: AAG
cacattaaggaggtattctt

SEQ ID NO: 133544 - DNA, 20 bp, Artificial Sequence
  Description of Artificial Sequence: Synthetic oligonucleotide
  Target: ATXN1; (+) strand; PAM type: NRG; PAM sequence: TAG
ttaagctaacatgtcttaat

SEQ ID NO: 133545 - DNA, 20 bp, Artificial Sequence
  Description of Artificial Sequence: Synthetic oligonucleotide
  Target: ATXN1; (+) strand; PAM type: NRG; PAM sequence: AGG
taagctaacatgtcttaatt

SEQ ID NO: 133546 - DNA, 20 bp, Artificial Sequence
  Description of Artificial Sequence: Synthetic oligonucleotide
  Target: ATXN1; (+) strand; PAM type: NRG; PAM sequence: CAG
acatgtcttaattaggaatt

SEQ ID NO: 133547 - DNA, 20 bp, Artificial Sequence
  Description of Artificial Sequence: Synthetic oligonucleotide
  Target: ATXN1; (+) strand; PAM type: NRG; PAM sequence: GAG
tcagatattcctcttctgct

SEQ ID NO: 133548 - DNA, 20 bp, Artificial Sequence
  Description of Artificial Sequence: Synthetic oligonucleotide
  Target: ATXN1; (+) strand; PAM type: NRG; PAM sequence: CAG
tcctcttctgctgagaaata

SEQ ID NO: 133549 - DNA, 20 bp, Artificial Sequence
  Description of Artificial Sequence: Synthetic oligonucleotide
  Target: ATXN1; (+) strand; PAM type: NRG; PAM sequence: GAG
ctcttctgctgagaaataca

SEQ ID NO: 133550 - DNA, 20 bp, Artificial Sequence
  Description of Artificial Sequence: Synthetic oligonucleotide
  Target: ATXN1; (+) strand; PAM type: NRG; PAM sequence: TAG
aaatacagagctgttcaaat

SEQ ID NO: 133551 - DNA, 20 bp, Artificial Sequence
  Description of Artificial Sequence: Synthetic oligonucleotide
  Target: ATXN1; (+) strand; PAM type: NRG; PAM sequence: CAG
cagagctgttcaaattagac

SEQ ID NO: 133552 - DNA, 20 bp, Artificial Sequence
  Description of Artificial Sequence: Synthetic oligonucleotide
  Target: ATXN1; (+) strand; PAM type: NRG; PAM sequence: TAG
gttcaaattagaccagaaat

SEQ ID NO: 133553 - DNA, 20 bp, Artificial Sequence
  Description of Artificial Sequence: Synthetic oligonucleotide
  Target: ATXN1; (+) strand; PAM type: NRG; PAM sequence: AGG
ttcaaattagaccagaaatt

SEQ ID NO: 133554 - DNA, 20 bp, Artificial Sequence
  Description of Artificial Sequence: Synthetic oligonucleotide
  Target: ATXN1; (+) strand; PAM type: NRG; PAM sequence: GGG
tcaaattagaccagaaatta

SEQ ID NO: 133555 - DNA, 20 bp, Artificial Sequence
  Description of Artificial Sequence: Synthetic oligonucleotide
  Target: ATXN1; (+) strand; PAM type: NRG; PAM sequence: CAG
aattagggccaaaacgaatg

SEQ ID NO: 133556 - DNA, 20 bp, Artificial Sequence
  Description of Artificial Sequence: Synthetic oligonucleotide
  Target: ATXN1; (+) strand; PAM type: NRG; PAM sequence: AAG
aatgcagcgtctacatacac

SEQ ID NO: 133557 - DNA, 20 bp, Artificial Sequence
  Description of Artificial Sequence: Synthetic oligonucleotide
  Target: ATXN1; (+) strand; PAM type: NRG; PAM sequence: TAG
cgtctacatacacaagctca

SEQ ID NO: 133558 - DNA, 20 bp, Artificial Sequence
  Description of Artificial Sequence: Synthetic oligonucleotide
  Target: ATXN1; (+) strand; PAM type: NRG; PAM sequence: CAG
ctacatacacaagctcatag

SEQ ID NO: 133559 - DNA, 20 bp, Artificial Sequence
  Description of Artificial Sequence: Synthetic oligonucleotide
  Target: ATXN1; (+) strand; PAM type: NRG; PAM sequence: AGG
tacatacacaagctcatagc

SEQ ID NO: 133560 - DNA, 20 bp, Artificial Sequence
  Description of Artificial Sequence: Synthetic oligonucleotide
  Target: ATXN1; (+) strand; PAM type: NRG; PAM sequence: GGG
acatacacaagctcatagca

SEQ ID NO: 133561 - DNA, 20 bp, Artificial Sequence
  Description of Artificial Sequence: Synthetic oligonucleotide
  Target: ATXN1; (+) strand; PAM type: NRG; PAM sequence: CAG
caagctcatagcagggtaac

SEQ ID NO: 133562 - DNA, 20 bp, Artificial Sequence
  Description of Artificial Sequence: Synthetic oligonucleotide
  Target: ATXN1; (+) strand; PAM type: NRG; PAM sequence: AAG
catagcagggtaaccagtga

SEQ ID NO: 133563 - DNA, 20 bp, Artificial Sequence
  Description of Artificial Sequence: Synthetic oligonucleotide
  Target: ATXN1; (+) strand; PAM type: NRG; PAM sequence: AGG
atagcagggtaaccagtgaa

SEQ ID NO: 133564 - DNA, 20 bp, Artificial Sequence
  Description of Artificial Sequence: Synthetic oligonucleotide
  Target: ATXN1; (+) strand; PAM type: NRG; PAM sequence: CAG
gcagggtaaccagtgaaagg

SEQ ID NO: 133565 - DNA, 20 bp, Artificial Sequence
  Description of Artificial Sequence: Synthetic oligonucleotide
  Target: ATXN1; (+) strand; PAM type: NRG; PAM sequence: GAG
agggtaaccagtgaaaggca

SEQ ID NO: 133566 - DNA, 20 bp, Artificial Sequence
  Description of Artificial Sequence: Synthetic oligonucleotide
  Target: ATXN1; (+) strand; PAM type: NRG; PAM sequence: AGG
gggtaaccagtgaaaggcag

SEQ ID NO: 133567 - DNA, 20 bp, Artificial Sequence
  Description of Artificial Sequence: Synthetic oligonucleotide
  Target: ATXN1; (+) strand; PAM type: NRG; PAM sequence: AAG
ccagtgaaaggcagaggctg

SEQ ID NO: 133568 - DNA, 20 bp, Artificial Sequence
  Description of Artificial Sequence: Synthetic oligonucleotide
  Target: ATXN1; (+) strand; PAM type: NRG; PAM sequence: TGG
ttcacttttcaacgttacga

SEQ ID NO: 133569 - DNA, 20 bp, Artificial Sequence
  Description of Artificial Sequence: Synthetic oligonucleotide
  Target: ATXN1; (+) strand; PAM type: NRG; PAM sequence: GAG
cacttttcaacgttacgatg

SEQ ID NO: 133570 - DNA, 20 bp, Artificial Sequence
  Description of Artificial Sequence: Synthetic oligonucleotide
  Target: ATXN1; (+) strand; PAM type: NRG; PAM sequence: AAG
tcaacgttacgatggagcca

SEQ ID NO: 133571 - DNA, 20 bp, Artificial Sequence
  Description of Artificial Sequence: Synthetic oligonucleotide
  Target: ATXN1; (+) strand; PAM type: NRG; PAM sequence: AGG
caacgttacgatggagccaa

SEQ ID NO: 133572 - DNA, 20 bp, Artificial Sequence
  Description of Artificial Sequence: Synthetic oligonucleotide
  Target: ATXN1; (+) strand; PAM type: NRG; PAM sequence: GGG
aacgttacgatggagccaaa

SEQ ID NO: 133573 - DNA, 20 bp, Artificial Sequence
  Description of Artificial Sequence: Synthetic oligonucleotide
  Target: ATXN1; (+) strand; PAM type: NRG; PAM sequence: AAG
tacgatggagccaaagggtc

SEQ ID NO: 133574 - DNA, 20 bp, Artificial Sequence
  Description of Artificial Sequence: Synthetic oligonucleotide
  Target: ATXN1; (+) strand; PAM type: NRG; PAM sequence: GAG
cgatggagccaaagggtcaa

SEQ ID NO: 133575 - DNA, 20 bp, Artificial Sequence
  Description of Artificial Sequence: Synthetic oligonucleotide
  Target: ATXN1; (+) strand; PAM type: NRG; PAM sequence: CAG
tcaagagattcacaaaccta

SEQ ID NO: 133576 - DNA, 20 bp, Artificial Sequence
  Description of Artificial Sequence: Synthetic oligonucleotide
  Target: ATXN1; (+) strand; PAM type: NRG; PAM sequence: TAG
ccttccccttcatgcatctg

SEQ ID NO: 133577 - DNA, 20 bp, Artificial Sequence
  Description of Artificial Sequence: Synthetic oligonucleotide
  Target: ATXN1; (+) strand; PAM type: NRG; PAM sequence: AGG
cttccccttcatgcatctgt

SEQ ID NO: 133578 - DNA, 20 bp, Artificial Sequence
  Description of Artificial Sequence: Synthetic oligonucleotide
  Target: ATXN1; (+) strand; PAM type: NRG; PAM sequence: AAG
cttcatgcatctgtaggata

SEQ ID NO: 133579 - DNA, 20 bp, Artificial Sequence
  Description of Artificial Sequence: Synthetic oligonucleotide
  Target: ATXN1; (+) strand; PAM type: NRG; PAM sequence: AAG
ggataaagcatgcgtttcct

SEQ ID NO: 133580 - DNA, 20 bp, Artificial Sequence
  Description of Artificial Sequence: Synthetic oligonucleotide
  Target: ATXN1; (+) strand; PAM type: NRG; PAM sequence: GAG
ataaagcatgcgtttcctaa

SEQ ID NO: 133581 - DNA, 20 bp, Artificial Sequence
  Description of Artificial Sequence: Synthetic oligonucleotide
  Target: ATXN1; (+) strand; PAM type: NRG; PAM sequence: TGG
agcatgcgtttcctaagagc

SEQ ID NO: 133582 - DNA, 20 bp, Artificial Sequence
  Description of Artificial Sequence: Synthetic oligonucleotide
  Target: ATXN1; (+) strand; PAM type: NRG; PAM sequence: GGG
gcatgcgtttcctaagagct

SEQ ID NO: 133583 - DNA, 20 bp, Artificial Sequence
  Description of Artificial Sequence: Synthetic oligonucleotide
  Target: ATXN1; (+) strand; PAM type: NRG; PAM sequence: TGG
cgtttcctaagagctgggtg

SEQ ID NO: 133584 - DNA, 20 bp, Artificial Sequence
  Description of Artificial Sequence: Synthetic oligonucleotide
  Target: ATXN1; (+) strand; PAM type: NRG; PAM sequence: CGG
ttcctaagagctgggtgtgg

SEQ ID NO: 133585 - DNA, 20 bp, Artificial Sequence
  Description of Artificial Sequence: Synthetic oligonucleotide
  Target: ATXN1; (+) strand; PAM type: NRG; PAM sequence: GGG
tcctaagagctgggtgtggc

SEQ ID NO: 133586 - DNA, 20 bp, Artificial Sequence
  Description of Artificial Sequence: Synthetic oligonucleotide
  Target: ATXN1; (+) strand; PAM type: NRG; PAM sequence: GGG
cctaagagctgggtgtggcg

SEQ ID NO: 133587 - DNA, 20 bp, Artificial Sequence
  Description of Artificial Sequence: Synthetic oligonucleotide
  Target: ATXN1; (+) strand; PAM type: NRG; PAM sequence: GGG
ctaagagctgggtgtggcgg

SEQ ID NO: 133588 - DNA, 20 bp, Artificial Sequence
  Description of Artificial Sequence: Synthetic oligonucleotide
  Target: ATXN1; (+) strand; PAM type: NRG; PAM sequence: GGG
taagagctgggtgtggcggg

SEQ ID NO: 133589 - DNA, 20 bp, Artificial Sequence
  Description of Artificial Sequence: Synthetic oligonucleotide
  Target: ATXN1; (+) strand; PAM type: NRG; PAM sequence: GGG
aagagctgggtgtggcgggg

SEQ ID NO: 133590 - DNA, 20 bp, Artificial Sequence
  Description of Artificial Sequence: Synthetic oligonucleotide
  Target: ATXN1; (+) strand; PAM type: NRG; PAM sequence: TAG
taccttctctttcatttatt

SEQ ID NO: 133591 - DNA, 20 bp, Artificial Sequence
  Description of Artificial Sequence: Synthetic oligonucleotide
  Target: ATXN1; (+) strand; PAM type: NRG; PAM sequence: AAG
ttcatttatttagtgaaatg

SEQ ID NO: 133592 - DNA, 20 bp, Artificial Sequence
  Description of Artificial Sequence: Synthetic oligonucleotide
  Target: ATXN1; (+) strand; PAM type: NRG; PAM sequence: TAG
ttagtgaaatgaagcttatt

SEQ ID NO: 133593 - DNA, 20 bp, Artificial Sequence
  Description of Artificial Sequence: Synthetic oligonucleotide
  Target: ATXN1; (+) strand; PAM type: NRG; PAM sequence: CGG
tgaagcttatttagtaatga

SEQ ID NO: 133594 - DNA, 20 bp, Artificial Sequence
  Description of Artificial Sequence: Synthetic oligonucleotide
  Target: ATXN1; (+) strand; PAM type: NRG; PAM sequence: GGG
gaagcttatttagtaatgac

SEQ ID NO: 133595 - DNA, 20 bp, Artificial Sequence
  Description of Artificial Sequence: Synthetic oligonucleotide
  Target: ATXN1; (+) strand; PAM type: NRG; PAM sequence: AAG
gcttatttagtaatgacggg

SEQ ID NO: 133596 - DNA, 20 bp, Artificial Sequence
  Description of Artificial Sequence: Synthetic oligonucleotide
  Target: ATXN1; (+) strand; PAM type: NRG; PAM sequence: GAG
ttatttagtaatgacgggaa

SEQ ID NO: 133597 - DNA, 20 bp, Artificial Sequence
  Description of Artificial Sequence: Synthetic oligonucleotide
  Target: ATXN1; (+) strand; PAM type: NRG; PAM sequence: GAG
tagtaatgacgggaagagat

SEQ ID NO: 133598 - DNA, 20 bp, Artificial Sequence
  Description of Artificial Sequence: Synthetic oligonucleotide
  Target: ATXN1; (+) strand; PAM type: NRG; PAM sequence: TAG
acgggaagagatgagccaac

SEQ ID NO: 133599 - DNA, 20 bp, Artificial Sequence
  Description of Artificial Sequence: Synthetic oligonucleotide
  Target: ATXN1; (+) strand; PAM type: NRG; PAM sequence: AGG
cgggaagagatgagccaact

SEQ ID NO: 133600 - DNA, 20 bp, Artificial Sequence
  Description of Artificial Sequence: Synthetic oligonucleotide
  Target: ATXN1; (+) strand; PAM type: NRG; PAM sequence: GGG
gggaagagatgagccaacta

SEQ ID NO: 133601 - DNA, 20 bp, Artificial Sequence
  Description of Artificial Sequence: Synthetic oligonucleotide
  Target: ATXN1; (+) strand; PAM type: NRG; PAM sequence: CAG
aagagatgagccaactaggg

SEQ ID NO: 133602 - DNA, 20 bp, Artificial Sequence
  Description of Artificial Sequence: Synthetic oligonucleotide
  Target: ATXN1; (+) strand; PAM type: NRG; PAM sequence: TGG
caactagggcagctcacata

SEQ ID NO: 133603 - DNA, 20 bp, Artificial Sequence
  Description of Artificial Sequence: Synthetic oligonucleotide
  Target: ATXN1; (+) strand; PAM type: NRG; PAM sequence: CAG
gggcagctcacatatggtgc

SEQ ID NO: 133604 - DNA, 20 bp, Artificial Sequence
  Description of Artificial Sequence: Synthetic oligonucleotide
  Target: ATXN1; (+) strand; PAM type: NRG; PAM sequence: CGG
agctcacatatggtgccaga

SEQ ID NO: 133605 - DNA, 20 bp, Artificial Sequence
  Description of Artificial Sequence: Synthetic oligonucleotide
  Target: ATXN1; (+) strand; PAM type: NRG; PAM sequence: GAG
cacatatggtgccagacggt

SEQ ID NO: 133606 - DNA, 20 bp, Artificial Sequence
  Description of Artificial Sequence: Synthetic oligonucleotide
  Target: ATXN1; (+) strand; PAM type: NRG; PAM sequence: AGG
acatatggtgccagacggtg

SEQ ID NO: 133607 - DNA, 20 bp, Artificial Sequence
  Description of Artificial Sequence: Synthetic oligonucleotide
  Target: ATXN1; (+) strand; PAM type: NRG; PAM sequence: GGG
catatggtgccagacggtga

SEQ ID NO: 133608 - DNA, 20 bp, Artificial Sequence
  Description of Artificial Sequence: Synthetic oligonucleotide
  Target: ATXN1; (+) strand; PAM type: NRG; PAM sequence: AAG
cggtgagggactctgtgccc

SEQ ID NO: 133609 - DNA, 20 bp, Artificial Sequence
  Description of Artificial Sequence: Synthetic oligonucleotide
  Target: ATXN1; (+) strand; PAM type: NRG; PAM sequence: AGG
ggtgagggactctgtgccca

SEQ ID NO: 133610 - DNA, 20 bp, Artificial Sequence
  Description of Artificial Sequence: Synthetic oligonucleotide
  Target: ATXN1; (+) strand; PAM type: NRG; PAM sequence: CAG
ccaaggcacttgctgtacca

SEQ ID NO: 133611 - DNA, 20 bp, Artificial Sequence
  Description of Artificial Sequence: Synthetic oligonucleotide
  Target: ATXN1; (+) strand; PAM type: NRG; PAM sequence: AGG
caaggcacttgctgtaccac

SEQ ID NO: 133612 - DNA, 20 bp, Artificial Sequence
  Description of Artificial Sequence: Synthetic oligonucleotide
  Target: ATXN1; (+) strand; PAM type: NRG; PAM sequence: GAG
aggcacttgctgtaccacag

SEQ ID NO: 133613 - DNA, 20 bp, Artificial Sequence
  Description of Artificial Sequence: Synthetic oligonucleotide
  Target: ATXN1; (+) strand; PAM type: NRG; PAM sequence: TAG
acttgctgtaccacaggagc

SEQ ID NO: 133614 - DNA, 20 bp, Artificial Sequence
  Description of Artificial Sequence: Synthetic oligonucleotide
  Target: ATXN1; (+) strand; PAM type: NRG; PAM sequence: AGG
cttgctgtaccacaggagct

SEQ ID NO: 133615 - DNA, 20 bp, Artificial Sequence
  Description of Artificial Sequence: Synthetic oligonucleotide
  Target: ATXN1; (+) strand; PAM type: NRG; PAM sequence: CAG
gctgtaccacaggagctagg

SEQ ID NO: 133616 - DNA, 20 bp, Artificial Sequence
  Description of Artificial Sequence: Synthetic oligonucleotide
  Target: ATXN1; (+) strand; PAM type: NRG; PAM sequence: TGG
ccacaggagctaggcagccc

SEQ ID NO: 133617 - DNA, 20 bp, Artificial Sequence
  Description of Artificial Sequence: Synthetic oligonucleotide
  Target: ATXN1; (+) strand; PAM type: NRG; PAM sequence: TGG
aggagctaggcagccctggc

SEQ ID NO: 133618 - DNA, 20 bp, Artificial Sequence
  Description of Artificial Sequence: Synthetic oligonucleotide
  Target: ATXN1; (+) strand; PAM type: NRG; PAM sequence: GGG
ggagctaggcagccctggct

SEQ ID NO: 133619 - DNA, 20 bp, Artificial Sequence
  Description of Artificial Sequence: Synthetic oligonucleotide
  Target: ATXN1; (+) strand; PAM type: NRG; PAM sequence: AAG
gctaggcagccctggctggg

SEQ ID NO: 133620 - DNA, 20 bp, Artificial Sequence
  Description of Artificial Sequence: Synthetic oligonucleotide
  Target: ATXN1; (+) strand; PAM type: NRG; PAM sequence: AGG
ctaggcagccctggctggga

SEQ ID NO: 133621 - DNA, 20 bp, Artificial Sequence
  Description of Artificial Sequence: Synthetic oligonucleotide
  Target: ATXN1; (+) strand; PAM type: NRG; PAM sequence: AAG
ggcagccctggctgggaagg

SEQ ID NO: 133622 - DNA, 20 bp, Artificial Sequence
  Description of Artificial Sequence: Synthetic oligonucleotide
  Target: ATXN1; (+) strand; PAM type: NRG; PAM sequence: CGG
gaagctctgctctcacccaa

SEQ ID NO: 133623 - DNA, 20 bp, Artificial Sequence
  Description of Artificial Sequence: Synthetic oligonucleotide
  Target: ATXN1; (+) strand; PAM type: NRG; PAM sequence: AAG
tctcacccaacggctgctcc

SEQ ID NO: 133624 - DNA, 20 bp, Artificial Sequence
  Description of Artificial Sequence: Synthetic oligonucleotide
  Target: ATXN1; (+) strand; PAM type: NRG; PAM sequence: AGG
ctcacccaacggctgctcca

SEQ ID NO: 133625 - DNA, 20 bp, Artificial Sequence
  Description of Artificial Sequence: Synthetic oligonucleotide
  Target: ATXN1; (+) strand; PAM type: NRG; PAM sequence: GGG
tcacccaacggctgctccaa

SEQ ID NO: 133626 - DNA, 20 bp, Artificial Sequence
  Description of Artificial Sequence: Synthetic oligonucleotide
  Target: ATXN1; (+) strand; PAM type: NRG; PAM sequence: CAG
ggctgctccaagggtgcccc

SEQ ID NO: 133627 - DNA, 20 bp, Artificial Sequence
  Description of Artificial Sequence: Synthetic oligonucleotide
  Target: ATXN1; (+) strand; PAM type: NRG; PAM sequence: CAG
gctccaagggtgcccccagc

SEQ ID NO: 133628 - DNA, 20 bp, Artificial Sequence
  Description of Artificial Sequence: Synthetic oligonucleotide
  Target: ATXN1; (+) strand; PAM type: NRG; PAM sequence: AGG
ctccaagggtgcccccagcc

SEQ ID NO: 133629 - DNA, 20 bp, Artificial Sequence
  Description of Artificial Sequence: Synthetic oligonucleotide
  Target: ATXN1; (+) strand; PAM type: NRG; PAM sequence: CAG
gtgcccccagccaggtgatc

SEQ ID NO: 133630 - DNA, 20 bp, Artificial Sequence
  Description of Artificial Sequence: Synthetic oligonucleotide
  Target: ATXN1; (+) strand; PAM type: NRG; PAM sequence: CAG
ccccagccaggtgatccaga

SEQ ID NO: 133631 - DNA, 20 bp, Artificial Sequence
  Description of Artificial Sequence: Synthetic oligonucleotide
  Target: ATXN1; (+) strand; PAM type: NRG; PAM sequence: TGG
ccaggtgatccagacagcca

SEQ ID NO: 133632 - DNA, 20 bp, Artificial Sequence
  Description of Artificial Sequence: Synthetic oligonucleotide
  Target: ATXN1; (+) strand; PAM type: NRG; PAM sequence: AAG
tccagacagccatggtttca

SEQ ID NO: 133633 - DNA, 20 bp, Artificial Sequence
  Description of Artificial Sequence: Synthetic oligonucleotide
  Target: ATXN1; (+) strand; PAM type: NRG; PAM sequence: TGG
tttcaaagctctgtgaaaaa

SEQ ID NO: 133634 - DNA, 20 bp, Artificial Sequence
  Description of Artificial Sequence: Synthetic oligonucleotide
  Target: ATXN1; (+) strand; PAM type: NRG; PAM sequence: GGG
ttcaaagctctgtgaaaaat

SEQ ID NO: 133635 - DNA, 20 bp, Artificial Sequence
  Description of Artificial Sequence: Synthetic oligonucleotide
  Target: ATXN1; (+) strand; PAM type: NRG; PAM sequence: CAG
tctgacttgaaaacttgaat

SEQ ID NO: 133636 - DNA, 20 bp, Artificial Sequence
  Description of Artificial Sequence: Synthetic oligonucleotide
  Target: ATXN1; (+) strand; PAM type: NRG; PAM sequence: AGG
ctgacttgaaaacttgaatc

SEQ ID NO: 133637 - DNA, 20 bp, Artificial Sequence
  Description of Artificial Sequence: Synthetic oligonucleotide
  Target: ATXN1; (+) strand; PAM type: NRG; PAM sequence: AAG
acttgaaaacttgaatcagg

SEQ ID NO: 133638 - DNA, 20 bp, Artificial Sequence
  Description of Artificial Sequence: Synthetic oligonucleotide
  Target: ATXN1; (+) strand; PAM type: NRG; PAM sequence: CAG
cttgaatcaggaagtctctc

SEQ ID NO: 133639 - DNA, 20 bp, Artificial Sequence
  Description of Artificial Sequence: Synthetic oligonucleotide
  Target: ATXN1; (+) strand; PAM type: NRG; PAM sequence: AGG
ttgaatcaggaagtctctcc

SEQ ID NO: 133640 - DNA, 20 bp, Artificial Sequence
  Description of Artificial Sequence: Synthetic oligonucleotide
  Target: ATXN1; (+) strand; PAM type: NRG; PAM sequence: TGG
tcaggaagtctctccaggac

SEQ ID NO: 133641 - DNA, 20 bp, Artificial Sequence
  Description of Artificial Sequence: Synthetic oligonucleotide
  Target: ATXN1; (+) strand; PAM type: NRG; PAM sequence: GGG
caggaagtctctccaggact

SEQ ID NO: 133642 - DNA, 20 bp, Artificial Sequence
  Description of Artificial Sequence: Synthetic oligonucleotide
  Target: ATXN1; (+) strand; PAM type: NRG; PAM sequence: CAG
taatacaaattaaatccatt

SEQ ID NO: 133643 - DNA, 20 bp, Artificial Sequence
  Description of Artificial Sequence: Synthetic oligonucleotide
  Target: ATXN1; (+) strand; PAM type: NRG; PAM sequence: AAG
tacaaattaaatccattcag

SEQ ID NO: 133644 - DNA, 20 bp, Artificial Sequence
  Description of Artificial Sequence: Synthetic oligonucleotide
  Target: ATXN1; (+) strand; PAM type: NRG; PAM sequence: TAG
agtatgctaaaccctttttg

SEQ ID NO: 133645 - DNA, 20 bp, Artificial Sequence
  Description of Artificial Sequence: Synthetic oligonucleotide
  Target: ATXN1; (+) strand; PAM type: NRG; PAM sequence: TAG
taaaccctttttgtagatac

SEQ ID NO: 133646 - DNA, 20 bp, Artificial Sequence
  Description of Artificial Sequence: Synthetic oligonucleotide
  Target: ATXN1; (+) strand; PAM type: NRG; PAM sequence: GAG
aaccctttttgtagatacta

SEQ ID NO: 133647 - DNA, 20 bp, Artificial Sequence
  Description of Artificial Sequence: Synthetic oligonucleotide
  Target: ATXN1; (+) strand; PAM type: NRG; PAM sequence: AGG
accctttttgtagatactag

SEQ ID NO: 133648 - DNA, 20 bp, Artificial Sequence
  Description of Artificial Sequence: Synthetic oligonucleotide
  Target: ATXN1; (+) strand; PAM type: NRG; PAM sequence: GAG
cctttttgtagatactagag

SEQ ID NO: 133649 - DNA, 20 bp, Artificial Sequence
  Description of Artificial Sequence: Synthetic oligonucleotide
  Target: ATXN1; (+) strand; PAM type: NRG; PAM sequence: AGG
ctttttgtagatactagagg

SEQ ID NO: 133650 - DNA, 20 bp, Artificial Sequence
  Description of Artificial Sequence: Synthetic oligonucleotide
  Target: ATXN1; (+) strand; PAM type: NRG; PAM sequence: AAG
agatactagaggaggatgaa

SEQ ID NO: 133651 - DNA, 20 bp, Artificial Sequence
  Description of Artificial Sequence: Synthetic oligonucleotide
  Target: ATXN1; (+) strand; PAM type: NRG; PAM sequence: GAG
atactagaggaggatgaaaa

SEQ ID NO: 133652 - DNA, 20 bp, Artificial Sequence
  Description of Artificial Sequence: Synthetic oligonucleotide
  Target: ATXN1; (+) strand; PAM type: NRG; PAM sequence: AGG
tactagaggaggatgaaaag

SEQ ID NO: 133653 - DNA, 20 bp, Artificial Sequence
  Description of Artificial Sequence: Synthetic oligonucleotide
  Target: ATXN1; (+) strand; PAM type: NRG; PAM sequence: GGG
actagaggaggatgaaaaga

SEQ ID NO: 133654 - DNA, 20 bp, Artificial Sequence
  Description of Artificial Sequence: Synthetic oligonucleotide
  Target: ATXN1; (+) strand; PAM type: NRG; PAM sequence: GAG
tagaggaggatgaaaagagg

SEQ ID NO: 133655 - DNA, 20 bp, Artificial Sequence
  Description of Artificial Sequence: Synthetic oligonucleotide
  Target: ATXN1; (+) strand; PAM type: NRG; PAM sequence: AGG
agaggaggatgaaaagaggg

SEQ ID NO: 133656 - DNA, 20 bp, Artificial Sequence
  Description of Artificial Sequence: Synthetic oligonucleotide
  Target: ATXN1; (+) strand; PAM type: NRG; PAM sequence: AAG
gaggatgaaaagagggagga

SEQ ID NO: 133657 - DNA, 20 bp, Artificial Sequence
  Description of Artificial Sequence: Synthetic oligonucleotide
  Target: ATXN1; (+) strand; PAM type: NRG; PAM sequence: GAG
ggatgaaaagagggaggaaa

SEQ ID NO: 133658 - DNA, 20 bp, Artificial Sequence
  Description of Artificial Sequence: Synthetic oligonucleotide
  Target: ATXN1; (+) strand; PAM type: NRG; PAM sequence: GAG
atgaaaagagggaggaaaga

SEQ ID NO: 133659 - DNA, 20 bp, Artificial Sequence
  Description of Artificial Sequence: Synthetic oligonucleotide
  Target: ATXN1; (+) strand; PAM type: NRG; PAM sequence: AGG
tgaaaagagggaggaaagag

SEQ ID NO: 133660 - DNA, 20 bp, Artificial Sequence
  Description of Artificial Sequence: Synthetic oligonucleotide
  Target: ATXN1; (+) strand; PAM type: NRG; PAM sequence: AAG
agagggaggaaagagaggca

SEQ ID NO: 133661 - DNA, 20 bp, Artificial Sequence
  Description of Artificial Sequence: Synthetic oligonucleotide
  Target: ATXN1; (+) strand; PAM type: NRG; PAM sequence: TGG
aaagagaggcaaagtaattt

SEQ ID NO: 133662 - DNA, 20 bp, Artificial Sequence
  Description of Artificial Sequence: Synthetic oligonucleotide
  Target: ATXN1; (+) strand; PAM type: NRG; PAM sequence: AAG
gagaggcaaagtaattttgg

SEQ ID NO: 133663 - DNA, 20 bp, Artificial Sequence
  Description of Artificial Sequence: Synthetic oligonucleotide
  Target: ATXN1; (+) strand; PAM type: NRG; PAM sequence: TAG
gcaaagtaattttggaagat

SEQ ID NO: 133664 - DNA, 20 bp, Artificial Sequence
  Description of Artificial Sequence: Synthetic oligonucleotide
  Target: ATXN1; (+) strand; PAM type: NRG; PAM sequence: AGG
caaagtaattttggaagatt

SEQ ID NO: 133665 - DNA, 20 bp, Artificial Sequence
  Description of Artificial Sequence: Synthetic oligonucleotide
  Target: ATXN1; (+) strand; PAM type: NRG; PAM sequence: TGG
ggaagattaggattatacta

SEQ ID NO: 133666 - DNA, 20 bp, Artificial Sequence
  Description of Artificial Sequence: Synthetic oligonucleotide
  Target: ATXN1; (+) strand; PAM type: NRG; PAM sequence: TAG
atgattaaatactcctgaaa

SEQ ID NO: 133667 - DNA, 20 bp, Artificial Sequence
  Description of Artificial Sequence: Synthetic oligonucleotide
  Target: ATXN1; (+) strand; PAM type: NRG; PAM sequence: AGG
tgattaaatactcctgaaat

SEQ ID NO: 133668 - DNA, 20 bp, Artificial Sequence
  Description of Artificial Sequence: Synthetic oligonucleotide
  Target: ATXN1; (+) strand; PAM type: NRG; PAM sequence: GAG
attaaatactcctgaaatag

SEQ ID NO: 133669 - DNA, 20 bp, Artificial Sequence
  Description of Artificial Sequence: Synthetic oligonucleotide
  Target: ATXN1; (+) strand; PAM type: NRG; PAM sequence: CAG
catttcatatatattatttg

SEQ ID NO: 133670 - DNA, 20 bp, Artificial Sequence
  Description of Artificial Sequence: Synthetic oligonucleotide
  Target: ATXN1; (+) strand; PAM type: NRG; PAM sequence: AAG
tattatttgcagcaacaccc

SEQ ID NO: 133671 - DNA, 20 bp, Artificial Sequence
  Description of Artificial Sequence: Synthetic oligonucleotide
  Target: ATXN1; (+) strand; PAM type: NRG; PAM sequence: AGG
attatttgcagcaacaccca

SEQ ID NO: 133672 - DNA, 20 bp, Artificial Sequence
  Description of Artificial Sequence: Synthetic oligonucleotide
  Target: ATXN1; (+) strand; PAM type: NRG; PAM sequence: GGG
ttatttgcagcaacacccaa

SEQ ID NO: 133673 - DNA, 20 bp, Artificial Sequence
  Description of Artificial Sequence: Synthetic oligonucleotide
  Target: ATXN1; (+) strand; PAM type: NRG; PAM sequence: GAG
atttgcagcaacacccaagg

SEQ ID NO: 133674 - DNA, 20 bp, Artificial Sequence
  Description of Artificial Sequence: Synthetic oligonucleotide
  Target: ATXN1; (+) strand; PAM type: NRG; PAM sequence: AAG
tgcagcaacacccaagggag

SEQ ID NO: 133675 - DNA, 20 bp, Artificial Sequence
  Description of Artificial Sequence: Synthetic oligonucleotide
  Target: ATXN1; (+) strand; PAM type: NRG; PAM sequence: AGG
gcagcaacacccaagggaga

SEQ ID NO: 133676 - DNA, 20 bp, Artificial Sequence
  Description of Artificial Sequence: Synthetic oligonucleotide
  Target: ATXN1; (+) strand; PAM type: NRG; PAM sequence: GGG
cagcaacacccaagggagaa

SEQ ID NO: 133677 - DNA, 20 bp, Artificial Sequence
  Description of Artificial Sequence: Synthetic oligonucleotide
  Target: ATXN1; (+) strand; PAM type: NRG; PAM sequence: AAG
ttatccgaattttacatgca

SEQ ID NO: 133678 - DNA, 20 bp, Artificial Sequence
  Description of Artificial Sequence: Synthetic oligonucleotide
  Target: ATXN1; (+) strand; PAM type: NRG; PAM sequence: AAG
cttgcccaatgtcacacttc

SEQ ID NO: 133679 - DNA, 20 bp, Artificial Sequence
  Description of Artificial Sequence: Synthetic oligonucleotide
  Target: ATXN1; (+) strand; PAM type: NRG; PAM sequence: CAG
aatgtcacacttcaagaaaa

SEQ ID NO: 133680 - DNA, 20 bp, Artificial Sequence
  Description of Artificial Sequence: Synthetic oligonucleotide
  Target: ATXN1; (+) strand; PAM type: NRG; PAM sequence: CAG
gtcacacttcaagaaaacag

SEQ ID NO: 133681 - DNA, 20 bp, Artificial Sequence
  Description of Artificial Sequence: Synthetic oligonucleotide
  Target: ATXN1; (+) strand; PAM type: NRG; PAM sequence: GAG
cacacttcaagaaaacagca

SEQ ID NO: 133682 - DNA, 20 bp, Artificial Sequence
  Description of Artificial Sequence: Synthetic oligonucleotide
  Target: ATXN1; (+) strand; PAM type: NRG; PAM sequence: TGG
cttcaagaaaacagcagagc

SEQ ID NO: 133683 - DNA, 20 bp, Artificial Sequence
  Description of Artificial Sequence: Synthetic oligonucleotide
  Target: ATXN1; (+) strand; PAM type: NRG; PAM sequence: GAG
aaacagcagagctggaattt

SEQ ID NO: 133684 - DNA, 20 bp, Artificial Sequence
  Description of Artificial Sequence: Synthetic oligonucleotide
  Target: ATXN1; (+) strand; PAM type: NRG; PAM sequence: CAG
gcagagctggaatttgagcc

SEQ ID NO: 133685 - DNA, 20 bp, Artificial Sequence
  Description of Artificial Sequence: Synthetic oligonucleotide
  Target: ATXN1; (+) strand; PAM type: NRG; PAM sequence: AGG
cagagctggaatttgagccc

SEQ ID NO: 133686 - DNA, 20 bp, Artificial Sequence
  Description of Artificial Sequence: Synthetic oligonucleotide
  Target: ATXN1; (+) strand; PAM type: NRG; PAM sequence: CAG
agctggaatttgagcccagg

SEQ ID NO: 133687 - DNA, 20 bp, Artificial Sequence
  Description of Artificial Sequence: Synthetic oligonucleotide
  Target: ATXN1; (+) strand; PAM type: NRG; PAM sequence: AAG
atttgagcccaggcagcctg

SEQ ID NO: 133688 - DNA, 20 bp, Artificial Sequence
  Description of Artificial Sequence: Synthetic oligonucleotide
  Target: ATXN1; (+) strand; PAM type: NRG; PAM sequence: CAG
gaagcttgcaatcttatcta

SEQ ID NO: 133689 - DNA, 20 bp, Artificial Sequence
  Description of Artificial Sequence: Synthetic oligonucleotide
  Target: ATXN1; (+) strand; PAM type: NRG; PAM sequence: TGG
tctacagcttttccatcata

SEQ ID NO: 133690 - DNA, 20 bp, Artificial Sequence
  Description of Artificial Sequence: Synthetic oligonucleotide
  Target: ATXN1; (+) strand; PAM type: NRG; PAM sequence: TAG
tccatcatatggcactaaca

SEQ ID NO: 133691 - DNA, 20 bp, Artificial Sequence
  Description of Artificial Sequence: Synthetic oligonucleotide
  Target: ATXN1; (+) strand; PAM type: NRG; PAM sequence: TGG
tttaatcatgttcccgatat

SEQ ID NO: 133692 - DNA, 20 bp, Artificial Sequence
  Description of Artificial Sequence: Synthetic oligonucleotide
  Target: ATXN1; (+) strand; PAM type: NRG; PAM sequence: TAG
tacacacacacatacatata

SEQ ID NO: 133693 - DNA, 20 bp, Artificial Sequence
  Description of Artificial Sequence: Synthetic oligonucleotide
  Target: ATXN1; (+) strand; PAM type: NRG; PAM sequence: AGG
acacacacacatacatatat

SEQ ID NO: 133694 - DNA, 20 bp, Artificial Sequence
  Description of Artificial Sequence: Synthetic oligonucleotide
  Target: ATXN1; (+) strand; PAM type: NRG; PAM sequence: GAG
atacatatttttaaactaat

SEQ ID NO: 133695 - DNA, 20 bp, Artificial Sequence
  Description of Artificial Sequence: Synthetic oligonucleotide
  Target: ATXN1; (+) strand; PAM type: NRG; PAM sequence: CAG
catatttttaaactaatgag

SEQ ID NO: 133696 - DNA, 20 bp, Artificial Sequence
  Description of Artificial Sequence: Synthetic oligonucleotide
  Target: ATXN1; (+) strand; PAM type: NRG; PAM sequence: CAG
actaatgagcagtataactt

SEQ ID NO: 133697 - DNA, 20 bp, Artificial Sequence
  Description of Artificial Sequence: Synthetic oligonucleotide
  Target: ATXN1; (+) strand; PAM type: NRG; PAM sequence: AAG
aatacctttttgctcttttt

SEQ ID NO: 133698 - DNA, 20 bp, Artificial Sequence
  Description of Artificial Sequence: Synthetic oligonucleotide
  Target: ATXN1; (+) strand; PAM type: NRG; PAM sequence: TAG
cactgaaaaatgattgtatc

SEQ ID NO: 133699 - DNA, 20 bp, Artificial Sequence
  Description of Artificial Sequence: Synthetic oligonucleotide
  Target: ATXN1; (+) strand; PAM type: NRG; PAM sequence: TAG
gattgtatctagtgatttca

SEQ ID NO: 133700 - DNA, 20 bp, Artificial Sequence
  Description of Artificial Sequence: Synthetic oligonucleotide
  Target: ATXN1; (+) strand; PAM type: NRG; PAM sequence: TGG
catagttgtctaaaaatact

SEQ ID NO: 133701 - DNA, 20 bp, Artificial Sequence
  Description of Artificial Sequence: Synthetic oligonucleotide
  Target: ATXN1; (+) strand; PAM type: NRG; PAM sequence: CAG
gttgtctaaaaatacttggc

SEQ ID NO: 133702 - DNA, 20 bp, Artificial Sequence
  Description of Artificial Sequence: Synthetic oligonucleotide
  Target: ATXN1; (+) strand; PAM type: NRG; PAM sequence: AAG
tctaaaaatacttggccaga

SEQ ID NO: 133703 - DNA, 20 bp, Artificial Sequence
  Description of Artificial Sequence: Synthetic oligonucleotide
  Target: ATXN1; (+) strand; PAM type: NRG; PAM sequence: AGG
ctaaaaatacttggccagaa

SEQ ID NO: 133704 - DNA, 20 bp, Artificial Sequence
  Description of Artificial Sequence: Synthetic oligonucleotide
  Target: ATXN1; (+) strand; PAM type: NRG; PAM sequence: AAG
aaaatacttggccagaaagg

SEQ ID NO: 133705 - DNA, 20 bp, Artificial Sequence
  Description of Artificial Sequence: Synthetic oligonucleotide
  Target: ATXN1; (+) strand; PAM type: NRG; PAM sequence: TAG
aggaagaacttaaaattccc

SEQ ID NO: 133706 - DNA, 20 bp, Artificial Sequence
  Description of Artificial Sequence: Synthetic oligonucleotide
  Target: ATXN1; (+) strand; PAM type: NRG; PAM sequence: AGG
ggaagaacttaaaattccct

SEQ ID NO: 133707 - DNA, 20 bp, Artificial Sequence
  Description of Artificial Sequence: Synthetic oligonucleotide
  Target: ATXN1; (+) strand; PAM type: NRG; PAM sequence: TGG
taggacccttctactccttc

SEQ ID NO: 133708 - DNA, 20 bp, Artificial Sequence
  Description of Artificial Sequence: Synthetic oligonucleotide
  Target: ATXN1; (+) strand; PAM type: NRG; PAM sequence: TGG
atttctgaaatgtcgaaatc

SEQ ID NO: 133709 - DNA, 20 bp, Artificial Sequence
  Description of Artificial Sequence: Synthetic oligonucleotide
  Target: ATXN1; (+) strand; PAM type: NRG; PAM sequence: AAG
ctgaaatgtcgaaatctggt

SEQ ID NO: 133710 - DNA, 20 bp, Artificial Sequence
  Description of Artificial Sequence: Synthetic oligonucleotide
  Target: ATXN1; (+) strand; PAM type: NRG; PAM sequence: AAG
gtcgaaatctggtaagtttc

SEQ ID NO: 133711 - DNA, 20 bp, Artificial Sequence
  Description of Artificial Sequence: Synthetic oligonucleotide
  Target: ATXN1; (+) strand; PAM type: NRG; PAM sequence: AGG
tcgaaatctggtaagtttca

SEQ ID NO: 133712 - DNA, 20 bp, Artificial Sequence
  Description of Artificial Sequence: Synthetic oligonucleotide
  Target: ATXN1; (+) strand; PAM type: NRG; PAM sequence: TGG
tcaaggatgctgctgtctaa

SEQ ID NO: 133713 - DNA, 20 bp, Artificial Sequence
  Description of Artificial Sequence: Synthetic oligonucleotide
  Target: ATXN1; (+) strand; PAM type: NRG; PAM sequence: GAG
aaggatgctgctgtctaatg

SEQ ID NO: 133714 - DNA, 20 bp, Artificial Sequence
  Description of Artificial Sequence: Synthetic oligonucleotide
  Target: ATXN1; (+) strand; PAM type: NRG; PAM sequence: AGG
aggatgctgctgtctaatgg

SEQ ID NO: 133715 - DNA, 20 bp, Artificial Sequence
  Description of Artificial Sequence: Synthetic oligonucleotide
  Target: ATXN1; (+) strand; PAM type: NRG; PAM sequence: AAG
atgctgctgtctaatggagg

SEQ ID NO: 133716 - DNA, 20 bp, Artificial Sequence
  Description of Artificial Sequence: Synthetic oligonucleotide
  Target: ATXN1; (+) strand; PAM type: NRG; PAM sequence: AGG
tgctgctgtctaatggagga

SEQ ID NO: 133717 - DNA, 20 bp, Artificial Sequence
  Description of Artificial Sequence: Synthetic oligonucleotide
  Target: ATXN1; (+) strand; PAM type: NRG; PAM sequence: CAG
tggaggaaggttctacaaaa

SEQ ID NO: 133718 - DNA, 20 bp, Artificial Sequence
  Description of Artificial Sequence: Synthetic oligonucleotide
  Target: ATXN1; (+) strand; PAM type: NRG; PAM sequence: TGG
cccccaaaacccaaaataca

SEQ ID NO: 133719 - DNA, 20 bp, Artificial Sequence
  Description of Artificial Sequence: Synthetic oligonucleotide
  Target: ATXN1; (+) strand; PAM type: NRG; PAM sequence: CAG
gaaacaccattttgcataat

SEQ ID NO: 133720 - DNA, 20 bp, Artificial Sequence
  Description of Artificial Sequence: Synthetic oligonucleotide
  Target: ATXN1; (+) strand; PAM type: NRG; PAM sequence: CAG
caccattttgcataatcagt

SEQ ID NO: 133721 - DNA, 20 bp, Artificial Sequence
  Description of Artificial Sequence: Synthetic oligonucleotide
  Target: ATXN1; (+) strand; PAM type: NRG; PAM sequence: CAG
ctttttgttttcaaaattct

SEQ ID NO: 133722 - DNA, 20 bp, Artificial Sequence
  Description of Artificial Sequence: Synthetic oligonucleotide
  Target: ATXN1; (+) strand; PAM type: NRG; PAM sequence: TGG
gttttcaaaattctcagcat

SEQ ID NO: 133723 - DNA, 20 bp, Artificial Sequence
  Description of Artificial Sequence: Synthetic oligonucleotide
  Target: ATXN1; (+) strand; PAM type: NRG; PAM sequence: AAG
cagcattggaaaactgtatt

SEQ ID NO: 133724 - DNA, 20 bp, Artificial Sequence
  Description of Artificial Sequence: Synthetic oligonucleotide
  Target: ATXN1; (+) strand; PAM type: NRG; PAM sequence: TAG
cattggaaaactgtattaag

SEQ ID NO: 133725 - DNA, 20 bp, Artificial Sequence
  Description of Artificial Sequence: Synthetic oligonucleotide
  Target: ATXN1; (+) strand; PAM type: NRG; PAM sequence: TGG
acgctctcataaactgcctc

SEQ ID NO: 133726 - DNA, 20 bp, Artificial Sequence
  Description of Artificial Sequence: Synthetic oligonucleotide
  Target: ATXN1; (+) strand; PAM type: NRG; PAM sequence: TGG
ctgcctctggaaatacaaac

SEQ ID NO: 133727 - DNA, 20 bp, Artificial Sequence
  Description of Artificial Sequence: Synthetic oligonucleotide
  Target: ATXN1; (+) strand; PAM type: NRG; PAM sequence: AAG
aactggtatgactttactga

SEQ ID NO: 133728 - DNA, 20 bp, Artificial Sequence
  Description of Artificial Sequence: Synthetic oligonucleotide
  Target: ATXN1; (+) strand; PAM type: NRG; PAM sequence: TGG
tgactttactgaaagtaatt

SEQ ID NO: 133729 - DNA, 20 bp, Artificial Sequence
  Description of Artificial Sequence: Synthetic oligonucleotide
  Target: ATXN1; (+) strand; PAM type: NRG; PAM sequence: AAG
actgaaagtaatttggcaac

SEQ ID NO: 133730 - DNA, 20 bp, Artificial Sequence
  Description of Artificial Sequence: Synthetic oligonucleotide
  Target: ATXN1; (+) strand; PAM type: NRG; PAM sequence: AAG
atttggcaacaagttaccaa

SEQ ID NO: 133731 - DNA, 20 bp, Artificial Sequence
  Description of Artificial Sequence: Synthetic oligonucleotide
  Target: ATXN1; (+) strand; PAM type: NRG; PAM sequence: CAG
ttgaaaactcttacatttac

SEQ ID NO: 133732 - DNA, 20 bp, Artificial Sequence
  Description of Artificial Sequence: Synthetic oligonucleotide
  Target: ATXN1; (+) strand; PAM type: NRG; PAM sequence: AAG
acatttaccagtatgctgct

SEQ ID NO: 133733 - DNA, 20 bp, Artificial Sequence
  Description of Artificial Sequence: Synthetic oligonucleotide
  Target: ATXN1; (+) strand; PAM type: NRG; PAM sequence: TAG
ccagtatgctgctaagaaat

SEQ ID NO: 133734 - DNA, 20 bp, Artificial Sequence
  Description of Artificial Sequence: Synthetic oligonucleotide
  Target: ATXN1; (+) strand; PAM type: NRG; PAM sequence: AAG
tgctgctaagaaattagcct

SEQ ID NO: 133735 - DNA, 20 bp, Artificial Sequence
  Description of Artificial Sequence: Synthetic oligonucleotide
  Target: ATXN1; (+) strand; PAM type: NRG; PAM sequence: AGG
gctgctaagaaattagccta

SEQ ID NO: 133736 - DNA, 20 bp, Artificial Sequence
  Description of Artificial Sequence: Synthetic oligonucleotide
  Target: ATXN1; (+) strand; PAM type: NRG; PAM sequence: TGG
cctaaggaaataatttgtaa

SEQ ID NO: 133737 - DNA, 20 bp, Artificial Sequence
  Description of Artificial Sequence: Synthetic oligonucleotide
  Target: ATXN1; (+) strand; PAM type: NRG; PAM sequence: GGG
ctaaggaaataatttgtaat

SEQ ID NO: 133738 - DNA, 20 bp, Artificial Sequence
  Description of Artificial Sequence: Synthetic oligonucleotide
  Target: ATXN1; (+) strand; PAM type: NRG; PAM sequence: CAG
atttgtaatgggaactaata

SEQ ID NO: 133739 - DNA, 20 bp, Artificial Sequence
  Description of Artificial Sequence: Synthetic oligonucleotide
  Target: ATXN1; (+) strand; PAM type: NRG; PAM sequence: GAG
ttgtaatgggaactaataca

SEQ ID NO: 133740 - DNA, 20 bp, Artificial Sequence
  Description of Artificial Sequence: Synthetic oligonucleotide
  Target: ATXN1; (+) strand; PAM type: NRG; PAM sequence: AAG
gggaactaatacagagctat

SEQ ID NO: 133741 - DNA, 20 bp, Artificial Sequence
  Description of Artificial Sequence: Synthetic oligonucleotide
  Target: ATXN1; (+) strand; PAM type: NRG; PAM sequence: TGG
cagagctataagaatatttt

SEQ ID NO: 133742 - DNA, 20 bp, Artificial Sequence
  Description of Artificial Sequence: Synthetic oligonucleotide
  Target: ATXN1; (+) strand; PAM type: NRG; PAM sequence: AAG
gaatatttttggcatcatga

SEQ ID NO: 133743 - DNA, 20 bp, Artificial Sequence
  Description of Artificial Sequence: Synthetic oligonucleotide
  Target: ATXN1; (+) strand; PAM type: NRG; PAM sequence: TGG
catgaaagcaataaaatgtc

SEQ ID NO: 133744 - DNA, 20 bp, Artificial Sequence
  Description of Artificial Sequence: Synthetic oligonucleotide
  Target: ATXN1; (+) strand; PAM type: NRG; PAM sequence: GGG
atgaaagcaataaaatgtct

SEQ ID NO: 133745 - DNA, 20 bp, Artificial Sequence
  Description of Artificial Sequence: Synthetic oligonucleotide
  Target: ATXN1; (+) strand; PAM type: NRG; PAM sequence: TGG
agcaataaaatgtctgggtg

SEQ ID NO: 133746 - DNA, 20 bp, Artificial Sequence
  Description of Artificial Sequence: Synthetic oligonucleotide
  Target: ATXN1; (+) strand; PAM type: NRG; PAM sequence: TGG
aataaaatgtctgggtgtgg

SEQ ID NO: 133747 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccaacactt

SEQ ID NO: 133748 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccaacacttt

SEQ ID NO: 133749 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccaacactttgg

SEQ ID NO: 133750 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccaacactttggg

SEQ ID NO: 133751 - DNA, 20 bp, Artificial Sequence
  Description of Artificial Sequence: Synthetic oligonucleotide
  Target: ATXN1; (+) strand; PAM type: NRG; PAM sequence: GAG
tcccaacactttgggaggct

SEQ ID NO: 133752 - DNA, 20 bp, Artificial Sequence
  Description of Artificial Sequence: Synthetic oligonucleotide
  Target: ATXN1; (+) strand; PAM type: NRG; PAM sequence: AGG
cccaacactttgggaggctg

SEQ ID NO: 133753 - DNA, 20 bp, Artificial Sequence
  Description of Artificial Sequence: Synthetic oligonucleotide
  Target: ATXN1; (+) strand; PAM type: NRG; PAM sequence: TGG
aacactttgggaggctgagg

SEQ ID NO: 133754 - DNA, 20 bp, Artificial Sequence
  Description of Artificial Sequence: Synthetic oligonucleotide
  Target: ATXN1; (+) strand; PAM type: NRG; PAM sequence: GGG
acactttgggaggctgaggt

SEQ ID NO: 133755 - DNA, 20 bp, Artificial Sequence
  Description of Artificial Sequence: Synthetic oligonucleotide
  Target: ATXN1; (+) strand; PAM type: NRG; PAM sequence: AAG
ctttgggaggctgaggtggg

SEQ ID NO: 133756 - DNA, 20 bp, Artificial Sequence
  Description of Artificial Sequence: Synthetic oligonucleotide
  Target: ATXN1; (+) strand; PAM type: NRG; PAM sequence: GAG
ctgaggtgggaagactgctt

SEQ ID NO: 133757 - DNA, 20 bp, Artificial Sequence
  Description of Artificial Sequence: Synthetic oligonucleotide
  Target: ATXN1; (+) strand; PAM type: NRG; PAM sequence: AGG
tgaggtgggaagactgcttg

SEQ ID NO: 133758 - DNA, 20 bp, Artificial Sequence
  Description of Artificial Sequence: Synthetic oligonucleotide
  Target: ATXN1; (+) strand; PAM type: NRG; PAM sequence: GAG
ggaagactgcttgaggtcac

SEQ ID NO: 133759 - DNA, 20 bp, Artificial Sequence
  Description of Artificial Sequence: Synthetic oligonucleotide
  Target: ATXN1; (+) strand; PAM type: NRG; PAM sequence: GAG
ctgcttgaggtcacgagttt

SEQ ID NO: 133760 - DNA, 20 bp, Artificial Sequence
  Description of Artificial Sequence: Synthetic oligonucleotide
  Target: ATXN1; (+) strand; PAM type: NRG; PAM sequence: CAG
tgaggtcacgagtttgagac

SEQ ID NO: 133761 - DNA, 20 bp, Artificial Sequence
  Description of Artificial Sequence: Synthetic oligonucleotide
  Target: ATXN1; (+) strand; PAM type: NRG; PAM sequence: TGG
tcacgagtttgagaccagcc

SEQ ID NO: 133762 - DNA, 20 bp, Artificial Sequence
  Description of Artificial Sequence: Synthetic oligonucleotide
  Target: ATXN1; (+) strand; PAM type: NRG; PAM sequence: GGG
cacgagtttgagaccagcct

SEQ ID NO: 133763 - DNA, 20 bp, Artificial Sequence
  Description of Artificial Sequence: Synthetic oligonucleotide
  Target: ATXN1; (+) strand; PAM type: NRG; PAM sequence: TGG
tgagaccagcctgggcaaca

SEQ ID NO: 133764 - DNA, 20 bp, Artificial Sequence
  Description of Artificial Sequence: Synthetic oligonucleotide
  Target: ATXN1; (+) strand; PAM type: NRG; PAM sequence: AAG
tataaaaaaaaaaaatacaa

SEQ ID NO: 133765 - DNA, 20 bp, Artificial Sequence
  Description of Artificial Sequence: Synthetic oligonucleotide
  Target: ATXN1; (+) strand; PAM type: NRG; PAM sequence: TAG
aaaaaaaaaaatacaaaagt

SEQ ID NO: 133766 - DNA, 20 bp, Artificial Sequence
  Description of Artificial Sequence: Synthetic oligonucleotide
  Target: ATXN1; (+) strand; PAM type: NRG; PAM sequence: CAG
aaaaaaatacaaaagttagc

SEQ ID NO: 133767 - DNA, 20 bp, Artificial Sequence
  Description of Artificial Sequence: Synthetic oligonucleotide
  Target: ATXN1; (+) strand; PAM type: NRG; PAM sequence: AGG
aaaaaatacaaaagttagcc

SEQ ID NO: 133768 - DNA, 20 bp, Artificial Sequence
  Description of Artificial Sequence: Synthetic oligonucleotide
  Target: ATXN1; (+) strand; PAM type: NRG; PAM sequence: TGG
atacaaaagttagccaggca

SEQ ID NO: 133769 - DNA, 20 bp, Artificial Sequence
  Description of Artificial Sequence: Synthetic oligonucleotide
  Target: ATXN1; (+) strand; PAM type: NRG; PAM sequence: TAG
ggcatggtgatgtgcacctg

SEQ ID NO: 133770 - DNA, 20 bp, Artificial Sequence
  Description of Artificial Sequence: Synthetic oligonucleotide
  Target: ATXN1; (+) strand; PAM type: NRG; PAM sequence: CAG
gtgatgtgcacctgtagtcc

SEQ ID NO: 133771 - DNA, 20 bp, Artificial Sequence
  Description of Artificial Sequence: Synthetic oligonucleotide
  Target: ATXN1; (+) strand; PAM type: NRG; PAM sequence: TGG
tagtcccagctattaatact

SEQ ID NO: 133772 - DNA, 20 bp, Artificial Sequence
  Description of Artificial Sequence: Synthetic oligonucleotide
  Target: ATXN1; (+) strand; PAM type: NRG; PAM sequence: GGG
agtcccagctattaatactt

SEQ ID NO: 133773 - DNA, 20 bp, Artificial Sequence
  Description of Artificial Sequence: Synthetic oligonucleotide
  Target: ATXN1; (+) strand; PAM type: NRG; PAM sequence: GAG
tcccagctattaatacttgg

SEQ ID NO: 133774 - DNA, 20 bp, Artificial Sequence
  Description of Artificial Sequence: Synthetic oligonucleotide
  Target: ATXN1; (+) strand; PAM type: NRG; PAM sequence: AGG
cccagctattaatacttggg

SEQ ID NO: 133775 - DNA, 20 bp, Artificial Sequence
  Description of Artificial Sequence: Synthetic oligonucleotide
  Target: ATXN1; (+) strand; PAM type: NRG; PAM sequence: GAG
ctattaatacttgggaggct

SEQ ID NO: 133776 - DNA, 20 bp, Artificial Sequence
  Description of Artificial Sequence: Synthetic oligonucleotide
  Target: ATXN1; (+) strand; PAM type: NRG; PAM sequence: AGG
tattaatacttgggaggctg

SEQ ID NO: 133777 - DNA, 20 bp, Artificial Sequence
  Description of Artificial Sequence: Synthetic oligonucleotide
  Target: ATXN1; (+) strand; PAM type: NRG; PAM sequence: TGG
taatacttgggaggctgagg

SEQ ID NO: 133778 - DNA, 20 bp, Artificial Sequence
  Description of Artificial Sequence: Synthetic oligonucleotide
  Target: ATXN1; (+) strand; PAM type: NRG; PAM sequence: GGG
aatacttgggaggctgaggt

SEQ ID NO: 133779 - DNA, 20 bp, Artificial Sequence
  Description of Artificial Sequence: Synthetic oligonucleotide
  Target: ATXN1; (+) strand; PAM type: NRG; PAM sequence: GAG
tacttgggaggctgaggtgg

SEQ ID NO: 133780 - DNA, 20 bp, Artificial Sequence
  Description of Artificial Sequence: Synthetic oligonucleotide
  Target: ATXN1; (+) strand; PAM type: NRG; PAM sequence: AGG
acttgggaggctgaggtggg

SEQ ID NO: 133781 - DNA, 20 bp, Artificial Sequence
  Description of Artificial Sequence: Synthetic oligonucleotide
  Target: ATXN1; (+) strand; PAM type: NRG; PAM sequence: GAG
ctgaggtgggaggatcactt

SEQ ID NO: 133782 - DNA, 20 bp, Artificial Sequence
  Description of Artificial Sequence: Synthetic oligonucleotide
  Target: ATXN1; (+) strand; PAM type: NRG; PAM sequence: TGG
tgggaggatcacttgagcct

SEQ ID NO: 133783 - DNA, 20 bp, Artificial Sequence
  Description of Artificial Sequence: Synthetic oligonucleotide
  Target: ATXN1; (+) strand; PAM type: NRG; PAM sequence: GAG
ggaggatcacttgagccttg

SEQ ID NO: 133784 - DNA, 20 bp, Artificial Sequence
  Description of Artificial Sequence: Synthetic oligonucleotide
  Target: ATXN1; (+) strand; PAM type: NRG; PAM sequence: AGG
gaggatcacttgagccttgg

SEQ ID NO: 133785 - DNA, 20 bp, Artificial Sequence
  Description of Artificial Sequence: Synthetic oligonucleotide
  Target: ATXN1; (+) strand; PAM type: NRG; PAM sequence: TGG
gatcacttgagccttggagg

SEQ ID NO: 133786 - DNA, 20 bp, Artificial Sequence
  Description of Artificial Sequence: Synthetic oligonucleotide
  Target: ATXN1; (+) strand; PAM type: NRG; PAM sequence: AAG
cacttgagccttggaggtgg

SEQ ID NO: 133787 - DNA, 20 bp, Artificial Sequence
  Description of Artificial Sequence: Synthetic oligonucleotide
  Target: ATXN1; (+) strand; PAM type: NRG; PAM sequence: GAG
ttggaggtggaagctgcaat

SEQ ID NO: 133788 - DNA, 20 bp, Artificial Sequence
  Description of Artificial Sequence: Synthetic oligonucleotide
  Target: ATXN1; (+) strand; PAM type: NRG; PAM sequence: CAG
aaaatcatgccactgcactc

SEQ ID NO: 133789 - DNA, 20 bp, Artificial Sequence
  Description of Artificial Sequence: Synthetic oligonucleotide
  Target: ATXN1; (+) strand; PAM type: NRG; PAM sequence: TGG
catgccactgcactccagcc

SEQ ID NO: 133790 - DNA, 20 bp, Artificial Sequence
  Description of Artificial Sequence: Synthetic oligonucleotide
  Target: ATXN1; (+) strand; PAM type: NRG; PAM sequence: GGG
atgccactgcactccagcct

SEQ ID NO: 133791 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggtga

SEQ ID NO: 133792 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggtgaca

SEQ ID NO: 133793 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggtgacagagt

SEQ ID NO: 133794 - DNA, 20 bp, Artificial Sequence
  Description of Artificial Sequence: Synthetic oligonucleotide
  Target: ATXN1; (+) strand; PAM type: NRG; PAM sequence: AAG
acagagtgagaccctatctc

SEQ ID NO: 133795 - DNA, 20 bp, Artificial Sequence
  Description of Artificial Sequence: Synthetic oligonucleotide
  Target: ATXN1; (+) strand; PAM type: NRG; PAM sequence: AAG
ccctatctcaagaaaataaa

SEQ ID NO: 133796 - DNA, 20 bp, Artificial Sequence
  Description of Artificial Sequence: Synthetic oligonucleotide
  Target: ATXN1; (+) strand; PAM type: NRG; PAM sequence: AGG
cctatctcaagaaaataaaa

SEQ ID NO: 133797 - DNA, 20 bp, Artificial Sequence
  Description of Artificial Sequence: Synthetic oligonucleotide
  Target: ATXN1; (+) strand; PAM type: NRG; PAM sequence: TAG
aaataaaaaggcaaaaaaat

SEQ ID NO: 133798 - DNA, 20 bp, Artificial Sequence
  Description of Artificial Sequence: Synthetic oligonucleotide
  Target: ATXN1; (+) strand; PAM type: NRG; PAM sequence: CGG
aaaggcaaaaaaattagaaa

SEQ ID NO: 133799 - DNA, 20 bp, Artificial Sequence
  Description of Artificial Sequence: Synthetic oligonucleotide
  Target: ATXN1; (+) strand; PAM type: NRG; PAM sequence: CAG
attagaaacggctaactgtc

SEQ ID NO: 133800 - DNA, 20 bp, Artificial Sequence
  Description of Artificial Sequence: Synthetic oligonucleotide
  Target: ATXN1; (+) strand; PAM type: NRG; PAM sequence: TAG
gaaacggctaactgtccagt

SEQ ID NO: 133801 - DNA, 20 bp, Artificial Sequence
  Description of Artificial Sequence: Synthetic oligonucleotide
  Target: ATXN1; (+) strand; PAM type: NRG; PAM sequence: AAG
acggctaactgtccagttag

SEQ ID NO: 133802 - DNA, 20 bp, Artificial Sequence
  Description of Artificial Sequence: Synthetic oligonucleotide
  Target: ATXN1; (+) strand; PAM type: NRG; PAM sequence: AGG
cggctaactgtccagttaga

SEQ ID NO: 133803 - DNA, 20 bp, Artificial Sequence
  Description of Artificial Sequence: Synthetic oligonucleotide
  Target: ATXN1; (+) strand; PAM type: NRG; PAM sequence: GGG
ggctaactgtccagttagaa

SEQ ID NO: 133804 - DNA, 20 bp, Artificial Sequence
  Description of Artificial Sequence: Synthetic oligonucleotide
  Target: ATXN1; (+) strand; PAM type: NRG; PAM sequence: TAG
gatataaattaaataaattt

SEQ ID NO: 133805 - DNA, 20 bp, Artificial Sequence
  Description of Artificial Sequence: Synthetic oligonucleotide
  Target: ATXN1; (+) strand; PAM type: NRG; PAM sequence: TGG
attttagaatgtttactcaa

SEQ ID NO: 133806 - DNA, 20 bp, Artificial Sequence
  Description of Artificial Sequence: Synthetic oligonucleotide
  Target: ATXN1; (+) strand; PAM type: NRG; PAM sequence: CGG
actaatcattaataactata

SEQ ID NO: 133807 - DNA, 20 bp, Artificial Sequence
  Description of Artificial Sequence: Synthetic oligonucleotide
  Target: ATXN1; (+) strand; PAM type: NRG; PAM sequence: TAG
aatcattaataactatacgg

SEQ ID NO: 133808 - DNA, 20 bp, Artificial Sequence
  Description of Artificial Sequence: Synthetic oligonucleotide
  Target: ATXN1; (+) strand; PAM type: NRG; PAM sequence: AAG
aaaaatatctgttgctatga

SEQ ID NO: 133809 - DNA, 20 bp, Artificial Sequence
  Description of Artificial Sequence: Synthetic oligonucleotide
  Target: ATXN1; (+) strand; PAM type: NRG; PAM sequence: CAG
ctgttgctatgaaagatgtt

SEQ ID NO: 133810 - DNA, 20 bp, Artificial Sequence
  Description of Artificial Sequence: Synthetic oligonucleotide
  Target: ATXN1; (+) strand; PAM type: NRG; PAM sequence: AAG
atgttcagaattatattgtt

SEQ ID NO: 133811 - DNA, 20 bp, Artificial Sequence
  Description of Artificial Sequence: Synthetic oligonucleotide
  Target: ATXN1; (+) strand; PAM type: NRG; PAM sequence: GAG
gttcagaattatattgttaa

SEQ ID NO: 133812 - DNA, 20 bp, Artificial Sequence
  Description of Artificial Sequence: Synthetic oligonucleotide
  Target: ATXN1; (+) strand; PAM type: NRG; PAM sequence: AGG
ttcagaattatattgttaag

SEQ ID NO: 133813 - DNA, 20 bp, Artificial Sequence
  Description of Artificial Sequence: Synthetic oligonucleotide
  Target: ATXN1; (+) strand; PAM type: NRG; PAM sequence: AAG
catttgatgtttgtctctct

SEQ ID NO: 133814 - DNA, 20 bp, Artificial Sequence
  Description of Artificial Sequence: Synthetic oligonucleotide
  Target: ATXN1; (+) strand; PAM type: NRG; PAM sequence: CAG
tataaatttataaatgcctt

SEQ ID NO: 133815 - DNA, 20 bp, Artificial Sequence
  Description of Artificial Sequence: Synthetic oligonucleotide
  Target: ATXN1; (+) strand; PAM type: NRG; PAM sequence: CAG
ataaatgccttcagaattat

SEQ ID NO: 133816 - DNA, 20 bp, Artificial Sequence
  Description of Artificial Sequence: Synthetic oligonucleotide
  Target: ATXN1; (+) strand; PAM type: NRG; PAM sequence: TAG
gccttgtcatctatcctaac

SEQ ID NO: 133817 - DNA, 20 bp, Artificial Sequence
  Description of Artificial Sequence: Synthetic oligonucleotide
  Target: ATXN1; (+) strand; PAM type: NRG; PAM sequence: AAG
ctaactagtgacctcaaaat

SEQ ID NO: 133818 - DNA, 20 bp, Artificial Sequence
  Description of Artificial Sequence: Synthetic oligonucleotide
  Target: ATXN1; (+) strand; PAM type: NRG; PAM sequence: TAG
actagtgacctcaaaataag

SEQ ID NO: 133819 - DNA, 20 bp, Artificial Sequence
  Description of Artificial Sequence: Synthetic oligonucleotide
  Target: ATXN1; (+) strand; PAM type: NRG; PAM sequence: AAG
agtgacctcaaaataagtag

SEQ ID NO: 133820 - DNA, 20 bp, Artificial Sequence
  Description of Artificial Sequence: Synthetic oligonucleotide
  Target: ATXN1; (+) strand; PAM type: NRG; PAM sequence: AAG
ttatttcctttcccataaaa

SEQ ID NO: 133821 - DNA, 20 bp, Artificial Sequence
  Description of Artificial Sequence: Synthetic oligonucleotide
  Target: ATXN1; (+) strand; PAM type: NRG; PAM sequence: AAG
ttcctttcccataaaaaagc

SEQ ID NO: 133822 - DNA, 20 bp, Artificial Sequence
  Description of Artificial Sequence: Synthetic oligonucleotide
  Target: ATXN1; (+) strand; PAM type: NRG; PAM sequence: AGG
tcctttcccataaaaaagca

SEQ ID NO: 133823 - DNA, 20 bp, Artificial Sequence
  Description of Artificial Sequence: Synthetic oligonucleotide
  Target: ATXN1; (+) strand; PAM type: NRG; PAM sequence: GGG
cctttcccataaaaaagcaa

SEQ ID NO: 133824 - DNA, 20 bp, Artificial Sequence
  Description of Artificial Sequence: Synthetic oligonucleotide
  Target: ATXN1; (+) strand; PAM type: NRG; PAM sequence: AAG
caagggttccatttttataa

SEQ ID NO: 133825 - DNA, 20 bp, Artificial Sequence
  Description of Artificial Sequence: Synthetic oligonucleotide
  Target: ATXN1; (+) strand; PAM type: NRG; PAM sequence: GAG
agggttccatttttataaaa

SEQ ID NO: 133826 - DNA, 20 bp, Artificial Sequence
  Description of Artificial Sequence: Synthetic oligonucleotide
  Target: ATXN1; (+) strand; PAM type: NRG; PAM sequence: CAG
ttccatttttataaaagaga

SEQ ID NO: 133827 - DNA, 20 bp, Artificial Sequence
  Description of Artificial Sequence: Synthetic oligonucleotide
  Target: ATXN1; (+) strand; PAM type: NRG; PAM sequence: TAG
catttttataaaagagacag

SEQ ID NO: 133828 - DNA, 20 bp, Artificial Sequence
  Description of Artificial Sequence: Synthetic oligonucleotide
  Target: ATXN1; (+) strand; PAM type: NRG; PAM sequence: AGG
atttttataaaagagacagt

SEQ ID NO: 133829 - DNA, 20 bp, Artificial Sequence
  Description of Artificial Sequence: Synthetic oligonucleotide
  Target: ATXN1; (+) strand; PAM type: NRG; PAM sequence: TGG
aaagagacagtaggaaaaaa

SEQ ID NO: 133830 - DNA, 20 bp, Artificial Sequence
  Description of Artificial Sequence: Synthetic oligonucleotide
  Target: ATXN1; (+) strand; PAM type: NRG; PAM sequence: GAG
agagacagtaggaaaaaatg

SEQ ID NO: 133831 - DNA, 20 bp, Artificial Sequence
  Description of Artificial Sequence: Synthetic oligonucleotide
  Target: ATXN1; (+) strand; PAM type: NRG; PAM sequence: TAG
aaaaatggagtctacatgaa

SEQ ID NO: 133832 - DNA, 20 bp, Artificial Sequence
  Description of Artificial Sequence: Synthetic oligonucleotide
  Target: ATXN1; (+) strand; PAM type: NRG; PAM sequence: CAG
tgtgtgtatgtttgtgtgac

SEQ ID NO: 133833 - DNA, 20 bp, Artificial Sequence
  Description of Artificial Sequence: Synthetic oligonucleotide
  Target: ATXN1; (+) strand; PAM type: NRG; PAM sequence: TGG
atacacccccaccactatct

SEQ ID NO: 133834 - DNA, 20 bp, Artificial Sequence
  Description of Artificial Sequence: Synthetic oligonucleotide
  Target: ATXN1; (+) strand; PAM type: NRG; PAM sequence: GGG
tacacccccaccactatctt

SEQ ID NO: 133835 - DNA, 20 bp, Artificial Sequence
  Description of Artificial Sequence: Synthetic oligonucleotide
  Target: ATXN1; (+) strand; PAM type: NRG; PAM sequence: GGG
acacccccaccactatcttg

SEQ ID NO: 133836 - DNA, 20 bp, Artificial Sequence
  Description of Artificial Sequence: Synthetic oligonucleotide
  Target: ATXN1; (+) strand; PAM type: NRG; PAM sequence: AAG
atgataattattttccttta

SEQ ID NO: 133837 - DNA, 20 bp, Artificial Sequence
  Description of Artificial Sequence: Synthetic oligonucleotide
  Target: ATXN1; (+) strand; PAM type: NRG; PAM sequence: TGG
ttattttcctttaaagcttt

SEQ ID NO: 133838 - DNA, 20 bp, Artificial Sequence
  Description of Artificial Sequence: Synthetic oligonucleotide
  Target: ATXN1; (+) strand; PAM type: NRG; PAM sequence: GAG
attttcctttaaagcttttg

SEQ ID NO: 133839 - DNA, 20 bp, Artificial Sequence
  Description of Artificial Sequence: Synthetic oligonucleotide
  Target: ATXN1; (+) strand; PAM type: NRG; PAM sequence: TGG
accatgtgctttcatcacaa

SEQ ID NO: 133840 - DNA, 20 bp, Artificial Sequence
  Description of Artificial Sequence: Synthetic oligonucleotide
  Target: ATXN1; (+) strand; PAM type: NRG; PAM sequence: GAG
catgtgctttcatcacaatg

SEQ ID NO: 133841 - DNA, 20 bp, Artificial Sequence
  Description of Artificial Sequence: Synthetic oligonucleotide
  Target: ATXN1; (+) strand; PAM type: NRG; PAM sequence: AAG
tcatcacaatggagaaccat

SEQ ID NO: 133842 - DNA, 20 bp, Artificial Sequence
  Description of Artificial Sequence: Synthetic oligonucleotide
  Target: ATXN1; (+) strand; PAM type: NRG; PAM sequence: CAG
aatggagaaccataagctat

SEQ ID NO: 133843 - DNA, 20 bp, Artificial Sequence
  Description of Artificial Sequence: Synthetic oligonucleotide
  Target: ATXN1; (+) strand; PAM type: NRG; PAM sequence: CAG
cataagctatcagttccttg

SEQ ID NO: 133844 - DNA, 20 bp, Artificial Sequence
  Description of Artificial Sequence: Synthetic oligonucleotide
  Target: ATXN1; (+) strand; PAM type: NRG; PAM sequence: CAG
aagctatcagttccttgcag

SEQ ID NO: 133845 - DNA, 20 bp, Artificial Sequence
  Description of Artificial Sequence: Synthetic oligonucleotide
  Target: ATXN1; (+) strand; PAM type: NRG; PAM sequence: AAG
ttgcagcagatcttttcacg

SEQ ID NO: 133846 - DNA, 20 bp, Artificial Sequence
  Description of Artificial Sequence: Synthetic oligonucleotide
  Target: ATXN1; (+) strand; PAM type: NRG; PAM sequence: GAG
ttttcacgaagattttgctt

SEQ ID NO: 133847 - DNA, 20 bp, Artificial Sequence
  Description of Artificial Sequence: Synthetic oligonucleotide
  Target: ATXN1; (+) strand; PAM type: NRG; PAM sequence: TAG
tcacgaagattttgcttgag

SEQ ID NO: 133848 - DNA, 20 bp, Artificial Sequence
  Description of Artificial Sequence: Synthetic oligonucleotide
  Target: ATXN1; (+) strand; PAM type: NRG; PAM sequence: AAG
gaagattttgcttgagtaga

SEQ ID NO: 133849 - DNA, 20 bp, Artificial Sequence
  Description of Artificial Sequence: Synthetic oligonucleotide
  Target: ATXN1; (+) strand; PAM type: NRG; PAM sequence: AGG
aagattttgcttgagtagaa

SEQ ID NO: 133850 - DNA, 20 bp, Artificial Sequence
  Description of Artificial Sequence: Synthetic oligonucleotide
  Target: ATXN1; (+) strand; PAM type: NRG; PAM sequence: GGG
agattttgcttgagtagaaa

SEQ ID NO: 133851 - DNA, 20 bp, Artificial Sequence
  Description of Artificial Sequence: Synthetic oligonucleotide
  Target: ATXN1; (+) strand; PAM type: NRG; PAM sequence: TGG
ttttgcttgagtagaaaggg

SEQ ID NO: 133852 - DNA, 20 bp, Artificial Sequence
  Description of Artificial Sequence: Synthetic oligonucleotide
  Target: ATXN1; (+) strand; PAM type: NRG; PAM sequence: CAG
tgcttgagtagaaagggtgg

SEQ ID NO: 133853 - DNA, 20 bp, Artificial Sequence
  Description of Artificial Sequence: Synthetic oligonucleotide
  Target: ATXN1; (+) strand; PAM type: NRG; PAM sequence: TGG
ttgagtagaaagggtggcag

SEQ ID NO: 133854 - DNA, 20 bp, Artificial Sequence
  Description of Artificial Sequence: Synthetic oligonucleotide
  Target: ATXN1; (+) strand; PAM type: NRG; PAM sequence: GAG
gagtagaaagggtggcagtg

SEQ ID NO: 133855 - DNA, 20 bp, Artificial Sequence
  Description of Artificial Sequence: Synthetic oligonucleotide
  Target: ATXN1; (+) strand; PAM type: NRG; PAM sequence: CAG
agggtggcagtggagaatct

SEQ ID NO: 133856 - DNA, 20 bp, Artificial Sequence
  Description of Artificial Sequence: Synthetic oligonucleotide
  Target: ATXN1; (+) strand; PAM type: NRG; PAM sequence: TAG
gaatctcagtgtaaaacgcc

SEQ ID NO: 133857 - DNA, 20 bp, Artificial Sequence
  Description of Artificial Sequence: Synthetic oligonucleotide
  Target: ATXN1; (+) strand; PAM type: NRG; PAM sequence: GAG
ataaaaacaatattctcact

SEQ ID NO: 133858 - DNA, 20 bp, Artificial Sequence
  Description of Artificial Sequence: Synthetic oligonucleotide
  Target: ATXN1; (+) strand; PAM type: NRG; PAM sequence: TAG
aaacaatattctcactgagt

SEQ ID NO: 133859 - DNA, 20 bp, Artificial Sequence
  Description of Artificial Sequence: Synthetic oligonucleotide
  Target: ATXN1; (+) strand; PAM type: NRG; PAM sequence: AGG
aacaatattctcactgagtt

SEQ ID NO: 133860 - DNA, 20 bp, Artificial Sequence
  Description of Artificial Sequence: Synthetic oligonucleotide
  Target: ATXN1; (+) strand; PAM type: NRG; PAM sequence: TGG
actgagttaggctgcttctg

SEQ ID NO: 133861 - DNA, 20 bp, Artificial Sequence
  Description of Artificial Sequence: Synthetic oligonucleotide
  Target: ATXN1; (+) strand; PAM type: NRG; PAM sequence: AAG
gtcttcattcacattcgctg

SEQ ID NO: 133862 - DNA, 20 bp, Artificial Sequence
  Description of Artificial Sequence: Synthetic oligonucleotide
  Target: ATXN1; (+) strand; PAM type: NRG; PAM sequence: CAG
attcacattcgctgaagtca

SEQ ID NO: 133863 - DNA, 20 bp, Artificial Sequence
  Description of Artificial Sequence: Synthetic oligonucleotide
  Target: ATXN1; (+) strand; PAM type: NRG; PAM sequence: CGG
attcgctgaagtcacagaaa

SEQ ID NO: 133864 - DNA, 20 bp, Artificial Sequence
  Description of Artificial Sequence: Synthetic oligonucleotide
  Target: ATXN1; (+) strand; PAM type: NRG; PAM sequence: GGG
ttcgctgaagtcacagaaac

SEQ ID NO: 133865 - DNA, 20 bp, Artificial Sequence
  Description of Artificial Sequence: Synthetic oligonucleotide
  Target: ATXN1; (+) strand; PAM type: NRG; PAM sequence: AAG
acacacacatgcacacacgc

SEQ ID NO: 133866 - DNA, 20 bp, Artificial Sequence
  Description of Artificial Sequence: Synthetic oligonucleotide
  Target: ATXN1; (+) strand; PAM type: NRG; PAM sequence: AAG
acacacacacacacacacac

SEQ ID NO: 133867 - DNA, 20 bp, Artificial Sequence
  Description of Artificial Sequence: Synthetic oligonucleotide
  Target: ATXN1; (+) strand; PAM type: NRG; PAM sequence: AGG
cacacacacacacacacaca

SEQ ID NO: 133868 - DNA, 20 bp, Artificial Sequence
  Description of Artificial Sequence: Synthetic oligonucleotide
  Target: ATXN1; (+) strand; PAM type: NRG; PAM sequence: CAG
cacacacaaggtttttaaat

SEQ ID NO: 133869 - DNA, 20 bp, Artificial Sequence
  Description of Artificial Sequence: Synthetic oligonucleotide
  Target: ATXN1; (+) strand; PAM type: NRG; PAM sequence: CAG
aaatcagaatgtcaaaaact

SEQ ID NO: 133870 - DNA, 20 bp, Artificial Sequence
  Description of Artificial Sequence: Synthetic oligonucleotide
  Target: ATXN1; (+) strand; PAM type: NRG; PAM sequence: CAG
tcagaatgtcaaaaactcag

SEQ ID NO: 133871 - DNA, 20 bp, Artificial Sequence
  Description of Artificial Sequence: Synthetic oligonucleotide
  Target: ATXN1; (+) strand; PAM type: NRG; PAM sequence: AGG
cagaatgtcaaaaactcagc

SEQ ID NO: 133872 - DNA, 20 bp, Artificial Sequence
  Description of Artificial Sequence: Synthetic oligonucleotide
  Target: ATXN1; (+) strand; PAM type: NRG; PAM sequence: CAG
aatgtcaaaaactcagcagg

SEQ ID NO: 133873 - DNA, 20 bp, Artificial Sequence
  Description of Artificial Sequence: Synthetic oligonucleotide
  Target: ATXN1; (+) strand; PAM type: NRG; PAM sequence: GAG
tgtcaaaaactcagcaggca

SEQ ID NO: 133874 - DNA, 20 bp, Artificial Sequence
  Description of Artificial Sequence: Synthetic oligonucleotide
  Target: ATXN1; (+) strand; PAM type: NRG; PAM sequence: CAG
aaactcagcaggcagagaca

SEQ ID NO: 133875 - DNA, 20 bp, Artificial Sequence
  Description of Artificial Sequence: Synthetic oligonucleotide
  Target: ATXN1; (+) strand; PAM type: NRG; PAM sequence: CAG
ctcagcaggcagagacacag

SEQ ID NO: 133876 - DNA, 20 bp, Artificial Sequence
  Description of Artificial Sequence: Synthetic oligonucleotide
  Target: ATXN1; (+) strand; PAM type: NRG; PAM sequence: AGG
tcagcaggcagagacacagc

SEQ ID NO: 133877 - DNA, 20 bp, Artificial Sequence
  Description of Artificial Sequence: Synthetic oligonucleotide
  Target: ATXN1; (+) strand; PAM type: NRG; PAM sequence: CAG
acacagcaggtccctatccc

SEQ ID NO: 133878 - DNA, 20 bp, Artificial Sequence
  Description of Artificial Sequence: Synthetic oligonucleotide
  Target: ATXN1; (+) strand; PAM type: NRG; PAM sequence: AGG
cacagcaggtccctatcccc

SEQ ID NO: 133879 - DNA, 20 bp, Artificial Sequence
  Description of Artificial Sequence: Synthetic oligonucleotide
  Target: ATXN1; (+) strand; PAM type: NRG; PAM sequence: GGG
acagcaggtccctatcccca

SEQ ID NO: 133880 - DNA, 20 bp, Artificial Sequence
  Description of Artificial Sequence: Synthetic oligonucleotide
  Target: ATXN1; (+) strand; PAM type: NRG; PAM sequence: GAG
aggtccctatccccagggat

SEQ ID NO: 133881 - DNA, 20 bp, Artificial Sequence
  Description of Artificial Sequence: Synthetic oligonucleotide
  Target: ATXN1; (+) strand; PAM type: NRG; PAM sequence: TGG
tccctatccccagggatgag

SEQ ID NO: 133882 - DNA, 20 bp, Artificial Sequence
  Description of Artificial Sequence: Synthetic oligonucleotide
  Target: ATXN1; (+) strand; PAM type: NRG; PAM sequence: GGG
ccctatccccagggatgagt

SEQ ID NO: 133883 - DNA, 20 bp, Artificial Sequence
  Description of Artificial Sequence: Synthetic oligonucleotide
  Target: ATXN1; (+) strand; PAM type: NRG; PAM sequence: TGG
ccccagggatgagtgggttc

SEQ ID NO: 133884 - DNA, 20 bp, Artificial Sequence
  Description of Artificial Sequence: Synthetic oligonucleotide
  Target: ATXN1; (+) strand; PAM type: NRG; PAM sequence: CAG
agggatgagtgggttctggc

SEQ ID NO: 133885 - DNA, 20 bp, Artificial Sequence
  Description of Artificial Sequence: Synthetic oligonucleotide
  Target: ATXN1; (+) strand; PAM type: NRG; PAM sequence: AGG
gggatgagtgggttctggcc

SEQ ID NO: 133886 - DNA, 20 bp, Artificial Sequence
  Description of Artificial Sequence: Synthetic oligonucleotide
  Target: ATXN1; (+) strand; PAM type: NRG; PAM sequence: GGG
ggatgagtgggttctggcca

SEQ ID NO: 133887 - DNA, 20 bp, Artificial Sequence
  Description of Artificial Sequence: Synthetic oligonucleotide
  Target: ATXN1; (+) strand; PAM type: NRG; PAM sequence: GGG
gatgagtgggttctggccag

SEQ ID NO: 133888 - DNA, 20 bp, Artificial Sequence
  Description of Artificial Sequence: Synthetic oligonucleotide
  Target: ATXN1; (+) strand; PAM type: NRG; PAM sequence: GAG
ccaccccatctcctcccctt

SEQ ID NO: 133889 - DNA, 20 bp, Artificial Sequence
  Description of Artificial Sequence: Synthetic oligonucleotide
  Target: ATXN1; (+) strand; PAM type: NRG; PAM sequence: AGG
caccccatctcctccccttg

SEQ ID NO: 133890 - DNA, 20 bp, Artificial Sequence
  Description of Artificial Sequence: Synthetic oligonucleotide
  Target: ATXN1; (+) strand; PAM type: NRG; PAM sequence: AAG
cttccctgctcaatgattct

SEQ ID NO: 133891 - DNA, 20 bp, Artificial Sequence
  Description of Artificial Sequence: Synthetic oligonucleotide
  Target: ATXN1; (+) strand; PAM type: NRG; PAM sequence: AAG
tcaatgattctaagatttct

SEQ ID NO: 133892 - DNA, 20 bp, Artificial Sequence
  Description of Artificial Sequence: Synthetic oligonucleotide
  Target: ATXN1; (+) strand; PAM type: NRG; PAM sequence: AAG
taagatttctaagaaataac

SEQ ID NO: 133893 - DNA, 20 bp, Artificial Sequence
  Description of Artificial Sequence: Synthetic oligonucleotide
  Target: ATXN1; (+) strand; PAM type: NRG; PAM sequence: CAG
gatttctaagaaataacaag

SEQ ID NO: 133894 - DNA, 20 bp, Artificial Sequence
  Description of Artificial Sequence: Synthetic oligonucleotide
  Target: ATXN1; (+) strand; PAM type: NRG; PAM sequence: CAG
tctaagaaataacaagcagt

SEQ ID NO: 133895 - DNA, 20 bp, Artificial Sequence
  Description of Artificial Sequence: Synthetic oligonucleotide
  Target: ATXN1; (+) strand; PAM type: NRG; PAM sequence: TAG
aacaagcagtcagttcttca

SEQ ID NO: 133896 - DNA, 20 bp, Artificial Sequence
  Description of Artificial Sequence: Synthetic oligonucleotide
  Target: ATXN1; (+) strand; PAM type: NRG; PAM sequence: CAG
cagttcttcatagaaaatgt

SEQ ID NO: 133897 - DNA, 20 bp, Artificial Sequence
  Description of Artificial Sequence: Synthetic oligonucleotide
  Target: ATXN1; (+) strand; PAM type: NRG; PAM sequence: AAG
atttgatgctctctttctct

SEQ ID NO: 133898 - DNA, 20 bp, Artificial Sequence
  Description of Artificial Sequence: Synthetic oligonucleotide
  Target: ATXN1; (+) strand; PAM type: NRG; PAM sequence: TAG
tctttctctaagactccttc

SEQ ID NO: 133899 - DNA, 20 bp, Artificial Sequence
  Description of Artificial Sequence: Synthetic oligonucleotide
  Target: ATXN1; (+) strand; PAM type: NRG; PAM sequence: CAG
gccacaaaattatgcaaatt

SEQ ID NO: 133900 - DNA, 20 bp, Artificial Sequence
  Description of Artificial Sequence: Synthetic oligonucleotide
  Target: ATXN1; (+) strand; PAM type: NRG; PAM sequence: CGG
agtgcatgtatttaccattc

SEQ ID NO: 133901 - DNA, 20 bp, Artificial Sequence
  Description of Artificial Sequence: Synthetic oligonucleotide
  Target: ATXN1; (+) strand; PAM type: NRG; PAM sequence: CAG
atgcctctttgttaataact

SEQ ID NO: 133902 - DNA, 20 bp, Artificial Sequence
  Description of Artificial Sequence: Synthetic oligonucleotide
  Target: ATXN1; (+) strand; PAM type: NRG; PAM sequence: AAG
tctttgttaataactcagtt

SEQ ID NO: 133903 - DNA, 20 bp, Artificial Sequence
  Description of Artificial Sequence: Synthetic oligonucleotide
  Target: ATXN1; (+) strand; PAM type: NRG; PAM sequence: CAG
actcagttaagacatgatgt

SEQ ID NO: 133904 - DNA, 20 bp, Artificial Sequence
  Description of Artificial Sequence: Synthetic oligonucleotide
  Target: ATXN1; (+) strand; PAM type: NRG; PAM sequence: TGG
ttaagacatgatgtcagtga

SEQ ID NO: 133905 - DNA, 20 bp, Artificial Sequence
  Description of Artificial Sequence: Synthetic oligonucleotide
  Target: ATXN1; (+) strand; PAM type: NRG; PAM sequence: AAG
acatgatgtcagtgatggcc

SEQ ID NO: 133906 - DNA, 20 bp, Artificial Sequence
  Description of Artificial Sequence: Synthetic oligonucleotide
  Target: ATXN1; (+) strand; PAM type: NRG; PAM sequence: AGG
catgatgtcagtgatggcca

SEQ ID NO: 133907 - DNA, 20 bp, Artificial Sequence
  Description of Artificial Sequence: Synthetic oligonucleotide
  Target: ATXN1; (+) strand; PAM type: NRG; PAM sequence: TGG
attaaacatttactatgttc

SEQ ID NO: 133908 - DNA, 20 bp, Artificial Sequence
  Description of Artificial Sequence: Synthetic oligonucleotide
  Target: ATXN1; (+) strand; PAM type: NRG; PAM sequence: GGG
ttaaacatttactatgttct

SEQ ID NO: 133909 - DNA, 20 bp, Artificial Sequence
  Description of Artificial Sequence: Synthetic oligonucleotide
  Target: ATXN1; (+) strand; PAM type: NRG; PAM sequence: AAG
tatgttctgggccatgtgct

SEQ ID NO: 133910 - DNA, 20 bp, Artificial Sequence
  Description of Artificial Sequence: Synthetic oligonucleotide
  Target: ATXN1; (+) strand; PAM type: NRG; PAM sequence: AGG
atgttctgggccatgtgcta

SEQ ID NO: 133911 - DNA, 20 bp, Artificial Sequence
  Description of Artificial Sequence: Synthetic oligonucleotide
  Target: ATXN1; (+) strand; PAM type: NRG; PAM sequence: GGG
tgttctgggccatgtgctaa

SEQ ID NO: 133912 - DNA, 20 bp, Artificial Sequence
  Description of Artificial Sequence: Synthetic oligonucleotide
  Target: ATXN1; (+) strand; PAM type: NRG; PAM sequence: CAG
cacattgccccactccactg

SEQ ID NO: 133913 - DNA, 20 bp, Artificial Sequence
  Description of Artificial Sequence: Synthetic oligonucleotide
  Target: ATXN1; (+) strand; PAM type: NRG; PAM sequence: GAG
cccactccactgcagtctgt

SEQ ID NO: 133914 - DNA, 20 bp, Artificial Sequence
  Description of Artificial Sequence: Synthetic oligonucleotide
  Target: ATXN1; (+) strand; PAM type: NRG; PAM sequence: AGG
ccactccactgcagtctgtg

SEQ ID NO: 133915 - DNA, 20 bp, Artificial Sequence
  Description of Artificial Sequence: Synthetic oligonucleotide
  Target: ATXN1; (+) strand; PAM type: NRG; PAM sequence: TGG
ctccactgcagtctgtgagg

SEQ ID NO: 133916 - DNA, 20 bp, Artificial Sequence
  Description of Artificial Sequence: Synthetic oligonucleotide
  Target: ATXN1; (+) strand; PAM type: NRG; PAM sequence: CAG
actgcagtctgtgaggtggc

SEQ ID NO: 133917 - DNA, 20 bp, Artificial Sequence
  Description of Artificial Sequence: Synthetic oligonucleotide
  Target: ATXN1; (+) strand; PAM type: NRG; PAM sequence: AGG
ctgcagtctgtgaggtggcc

SEQ ID NO: 133918 - DNA, 20 bp, Artificial Sequence
  Description of Artificial Sequence: Synthetic oligonucleotide
  Target: ATXN1; (+) strand; PAM type: NRG; PAM sequence: AAG
tttacctctgcattattgac

SEQ ID NO: 133919 - DNA, 20 bp, Artificial Sequence
  Description of Artificial Sequence: Synthetic oligonucleotide
  Target: ATXN1; (+) strand; PAM type: NRG; PAM sequence: CAG
attattgacaagaaaactga

SEQ ID NO: 133920 - DNA, 20 bp, Artificial Sequence
  Description of Artificial Sequence: Synthetic oligonucleotide
  Target: ATXN1; (+) strand; PAM type: NRG; PAM sequence: CAG
aagaaaactgacagtaaata

SEQ ID NO: 133921 - DNA, 20 bp, Artificial Sequence
  Description of Artificial Sequence: Synthetic oligonucleotide
  Target: ATXN1; (+) strand; PAM type: NRG; PAM sequence: CGG
ctgacagtaaatacagccaa

SEQ ID NO: 133922 - DNA, 20 bp, Artificial Sequence
  Description of Artificial Sequence: Synthetic oligonucleotide
  Target: ATXN1; (+) strand; PAM type: NRG; PAM sequence: AAG
aatacagccaacggatgtta

SEQ ID NO: 133923 - DNA, 20 bp, Artificial Sequence
  Description of Artificial Sequence: Synthetic oligonucleotide
  Target: ATXN1; (+) strand; PAM type: NRG; PAM sequence: CAG
cagccaacggatgttaaagc

SEQ ID NO: 133924 - DNA, 20 bp, Artificial Sequence
  Description of Artificial Sequence: Synthetic oligonucleotide
  Target: ATXN1; (+) strand; PAM type: NRG; PAM sequence: AAG
ggatgttaaagccagtactt

SEQ ID NO: 133925 - DNA, 20 bp, Artificial Sequence
  Description of Artificial Sequence: Synthetic oligonucleotide
  Target: ATXN1; (+) strand; PAM type: NRG; PAM sequence: CAG
aaagccagtacttaagccaa

SEQ ID NO: 133926 - DNA, 20 bp, Artificial Sequence
  Description of Artificial Sequence: Synthetic oligonucleotide
  Target: ATXN1; (+) strand; PAM type: NRG; PAM sequence: CAG
gtacttaagccaacagttca

SEQ ID NO: 133927 - DNA, 20 bp, Artificial Sequence
  Description of Artificial Sequence: Synthetic oligonucleotide
  Target: ATXN1; (+) strand; PAM type: NRG; PAM sequence: GAG
acttaagccaacagttcaca

SEQ ID NO: 133928 - DNA, 20 bp, Artificial Sequence
  Description of Artificial Sequence: Synthetic oligonucleotide
  Target: ATXN1; (+) strand; PAM type: NRG; PAM sequence: AGG
cttaagccaacagttcacag

SEQ ID NO: 133929 - DNA, 20 bp, Artificial Sequence
  Description of Artificial Sequence: Synthetic oligonucleotide
  Target: ATXN1; (+) strand; PAM type: NRG; PAM sequence: TAG
cagttcacagaggtcatgct

SEQ ID NO: 133930 - DNA, 20 bp, Artificial Sequence
  Description of Artificial Sequence: Synthetic oligonucleotide
  Target: ATXN1; (+) strand; PAM type: NRG; PAM sequence: AGG
agttcacagaggtcatgctt

SEQ ID NO: 133931 - DNA, 20 bp, Artificial Sequence
  Description of Artificial Sequence: Synthetic oligonucleotide
  Target: ATXN1; (+) strand; PAM type: NRG; PAM sequence: TAG
agaggtcatgcttaggattc

SEQ ID NO: 133932 - DNA, 20 bp, Artificial Sequence
  Description of Artificial Sequence: Synthetic oligonucleotide
  Target: ATXN1; (+) strand; PAM type: NRG; PAM sequence: AAG
tagtactataccatctcttc

SEQ ID NO: 133933 - DNA, 20 bp, Artificial Sequence
  Description of Artificial Sequence: Synthetic oligonucleotide
  Target: ATXN1; (+) strand; PAM type: NRG; PAM sequence: AGG
agtactataccatctcttca

SEQ ID NO: 133934 - DNA, 20 bp, Artificial Sequence
  Description of Artificial Sequence: Synthetic oligonucleotide
  Target: ATXN1; (+) strand; PAM type: NRG; PAM sequence: TAG
tctttctaccaacacttctg

SEQ ID NO: 133935 - DNA, 20 bp, Artificial Sequence
  Description of Artificial Sequence: Synthetic oligonucleotide
  Target: ATXN1; (+) strand; PAM type: NRG; PAM sequence: TAG
tctaccaacacttctgtagt

SEQ ID NO: 133936 - DNA, 20 bp, Artificial Sequence
  Description of Artificial Sequence: Synthetic oligonucleotide
  Target: ATXN1; (+) strand; PAM type: NRG; PAM sequence: CGG
tagttagtattaaaacatat

SEQ ID NO: 133937 - DNA, 20 bp, Artificial Sequence
  Description of Artificial Sequence: Synthetic oligonucleotide
  Target: ATXN1; (+) strand; PAM type: NRG; PAM sequence: GGG
agttagtattaaaacatatc

SEQ ID NO: 133938 - DNA, 20 bp, Artificial Sequence
  Description of Artificial Sequence: Synthetic oligonucleotide
  Target: ATXN1; (+) strand; PAM type: NRG; PAM sequence: GGG
gttagtattaaaacatatcg

SEQ ID NO: 133939 - DNA, 20 bp, Artificial Sequence
  Description of Artificial Sequence: Synthetic oligonucleotide
  Target: ATXN1; (+) strand; PAM type: NRG; PAM sequence: TGG
gtattaaaacatatcggggc

SEQ ID NO: 133940 - DNA, 20 bp, Artificial Sequence
  Description of Artificial Sequence: Synthetic oligonucleotide
  Target: ATXN1; (+) strand; PAM type: NRG; PAM sequence: GGG
tattaaaacatatcggggct

SEQ ID NO: 133941 - DNA, 20 bp, Artificial Sequence
  Description of Artificial Sequence: Synthetic oligonucleotide
  Target: ATXN1; (+) strand; PAM type: NRG; PAM sequence: GGG
attaaaacatatcggggctg

SEQ ID NO: 133942 - DNA, 20 bp, Artificial Sequence
  Description of Artificial Sequence: Synthetic oligonucleotide
  Target: ATXN1; (+) strand; PAM type: NRG; PAM sequence: TGG
aacatatcggggctggggca

SEQ ID NO: 133943 - DNA, 20 bp, Artificial Sequence
  Description of Artificial Sequence: Synthetic oligonucleotide
  Target: ATXN1; (+) strand; PAM type: NRG; PAM sequence: TGG
atatcggggctggggcatgg

SEQ ID NO: 133944 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgtaatcc

SEQ ID NO: 133945 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagcactt

SEQ ID NO: 133946 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 133947 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 133948 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 133949 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggct

SEQ ID NO: 133950 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggctg

SEQ ID NO: 133951 - DNA, 20 bp, Artificial Sequence
  Description of Artificial Sequence: Synthetic oligonucleotide
  Target: ATXN1; (+) strand; PAM type: NRG; PAM sequence: TGG
agcactttgggaggctgagg

SEQ ID NO: 133952 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggctgaggt

SEQ ID NO: 133953 - DNA, 20 bp, Artificial Sequence
  Description of Artificial Sequence: Synthetic oligonucleotide
  Target: ATXN1; (+) strand; PAM type: NRG; PAM sequence: CGG
ctttgggaggctgaggtggg

SEQ ID NO: 133954 - DNA, 20 bp, Artificial Sequence
  Description of Artificial Sequence: Synthetic oligonucleotide
  Target: ATXN1; (+) strand; PAM type: NRG; PAM sequence: GAG
ggctgaggtgggcggatcat

SEQ ID NO: 133955 - DNA, 20 bp, Artificial Sequence
  Description of Artificial Sequence: Synthetic oligonucleotide
  Target: ATXN1; (+) strand; PAM type: NRG; PAM sequence: AGG
gctgaggtgggcggatcatg

SEQ ID NO: 133956 - DNA, 20 bp, Artificial Sequence
  Description of Artificial Sequence: Synthetic oligonucleotide
  Target: ATXN1; (+) strand; PAM type: NRG; PAM sequence: CAG
aggtgggcggatcatgaggt

SEQ ID NO: 133957 - DNA, 20 bp, Artificial Sequence
  Description of Artificial Sequence: Synthetic oligonucleotide
  Target: ATXN1; (+) strand; PAM type: NRG; PAM sequence: AGG
ggtgggcggatcatgaggtc

SEQ ID NO: 133958 - DNA, 20 bp, Artificial Sequence
  Description of Artificial Sequence: Synthetic oligonucleotide
  Target: ATXN1; (+) strand; PAM type: NRG; PAM sequence: GAG
tgggcggatcatgaggtcag

SEQ ID NO: 133959 - DNA, 20 bp, Artificial Sequence
  Description of Artificial Sequence: Synthetic oligonucleotide
  Target: ATXN1; (+) strand; PAM type: NRG; PAM sequence: GAG
gatcatgaggtcaggagatc

SEQ ID NO: 133960 - DNA, 20 bp, Artificial Sequence
  Description of Artificial Sequence: Synthetic oligonucleotide
  Target: ATXN1; (+) strand; PAM type: NRG; PAM sequence: TGG
tcaggagatcgagaccatcc

SEQ ID NO: 133961 - DNA, 20 bp, Artificial Sequence
  Description of Artificial Sequence: Synthetic oligonucleotide
  Target: ATXN1; (+) strand; PAM type: NRG; PAM sequence: TGG
cgagaccatcctggccaaca

SEQ ID NO: 133962 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 133963 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagccacgca

SEQ ID NO: 133964 - DNA, 20 bp, Artificial Sequence
  Description of Artificial Sequence: Synthetic oligonucleotide
  Target: ATXN1; (+) strand; PAM type: NRG; PAM sequence: TGG
caaaaattagccacgcatgg

SEQ ID NO: 133965 - DNA, 20 bp, Artificial Sequence
  Description of Artificial Sequence: Synthetic oligonucleotide
  Target: ATXN1; (+) strand; PAM type: NRG; PAM sequence: CAG
gtggtgcgtgcccgtaatcc

SEQ ID NO: 133966 - DNA, 20 bp, Artificial Sequence
  Description of Artificial Sequence: Synthetic oligonucleotide
  Target: ATXN1; (+) strand; PAM type: NRG; PAM sequence: CAG
tgcccgtaatcccagctact

SEQ ID NO: 133967 - DNA, 20 bp, Artificial Sequence
  Description of Artificial Sequence: Synthetic oligonucleotide
  Target: ATXN1; (+) strand; PAM type: NRG; PAM sequence: AGG
gcccgtaatcccagctactc

SEQ ID NO: 133968 - DNA, 20 bp, Artificial Sequence
  Description of Artificial Sequence: Synthetic oligonucleotide
  Target: ATXN1; (+) strand; PAM type: NRG; PAM sequence: AAG
cgtaatcccagctactcagg

SEQ ID NO: 133969 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcaggaagct

SEQ ID NO: 133970 - DNA, 20 bp, Artificial Sequence
  Description of Artificial Sequence: Synthetic oligonucleotide
  Target: ATXN1; (+) strand; PAM type: NRG; PAM sequence: AGG
cccagctactcaggaagctg

SEQ ID NO: 133971 - DNA, 20 bp, Artificial Sequence
  Description of Artificial Sequence: Synthetic oligonucleotide
  Target: ATXN1; (+) strand; PAM type: NRG; PAM sequence: CAG
agctactcaggaagctgagg

SEQ ID NO: 133972 - DNA, 20 bp, Artificial Sequence
  Description of Artificial Sequence: Synthetic oligonucleotide
  Target: ATXN1; (+) strand; PAM type: NRG; PAM sequence: AGG
gctactcaggaagctgaggc

SEQ ID NO: 133973 - DNA, 20 bp, Artificial Sequence
  Description of Artificial Sequence: Synthetic oligonucleotide
  Target: ATXN1; (+) strand; PAM type: NRG; PAM sequence: GAG
tactcaggaagctgaggcag

SEQ ID NO: 133974 - DNA, 20 bp, Artificial Sequence
  Description of Artificial Sequence: Synthetic oligonucleotide
  Target: ATXN1; (+) strand; PAM type: NRG; PAM sequence: CGG
ggcaggagaatcacttgaac

SEQ ID NO: 133975 - DNA, 20 bp, Artificial Sequence
  Description of Artificial Sequence: Synthetic oligonucleotide
  Target: ATXN1; (+) strand; PAM type: NRG; PAM sequence: AAG
aggagaatcacttgaaccgg

SEQ ID NO: 133976 - DNA, 20 bp, Artificial Sequence
  Description of Artificial Sequence: Synthetic oligonucleotide
  Target: ATXN1; (+) strand; PAM type: NRG; PAM sequence: AGG
ggagaatcacttgaaccgga

SEQ ID NO: 133977 - DNA, 20 bp, Artificial Sequence
  Description of Artificial Sequence: Synthetic oligonucleotide
  Target: ATXN1; (+) strand; PAM type: NRG; PAM sequence: CAG
gaatcacttgaaccggaagg

SEQ ID NO: 133978 - DNA, 20 bp, Artificial Sequence
  Description of Artificial Sequence: Synthetic oligonucleotide
  Target: ATXN1; (+) strand; PAM type: NRG; PAM sequence: GAG
atcacttgaaccggaaggca

SEQ ID NO: 133979 - DNA, 20 bp, Artificial Sequence
  Description of Artificial Sequence: Synthetic oligonucleotide
  Target: ATXN1; (+) strand; PAM type: NRG; PAM sequence: CAG
gaaccggaaggcagagtttg

SEQ ID NO: 133980 - DNA, 20 bp, Artificial Sequence
  Description of Artificial Sequence: Synthetic oligonucleotide
  Target: ATXN1; (+) strand; PAM type: NRG; PAM sequence: GAG
cggaaggcagagtttgcagt

SEQ ID NO: 133981 - DNA, 20 bp, Artificial Sequence
  Description of Artificial Sequence: Synthetic oligonucleotide
  Target: ATXN1; (+) strand; PAM type: NRG; PAM sequence: GAG
ggcagagtttgcagtgagct

SEQ ID NO: 133982 - DNA, 20 bp, Artificial Sequence
  Description of Artificial Sequence: Synthetic oligonucleotide
  Target: ATXN1; (+) strand; PAM type: NRG; PAM sequence: CAG
gagatcatgccactgcactc

SEQ ID NO: 133983 - DNA, 20 bp, Artificial Sequence
  Description of Artificial Sequence: Synthetic oligonucleotide
  Target: ATXN1; (+) strand; PAM type: NRG; PAM sequence: TGG
catgccactgcactccagcc

SEQ ID NO: 133984 - DNA, 20 bp, Artificial Sequence
  Description of Artificial Sequence: Synthetic oligonucleotide
  Target: ATXN1; (+) strand; PAM type: NRG; PAM sequence: AAG
tgcactccagcctggtgaca

SEQ ID NO: 133985 - DNA, 20 bp, Artificial Sequence
  Description of Artificial Sequence: Synthetic oligonucleotide
  Target: ATXN1; (+) strand; PAM type: NRG; PAM sequence: AAG
ctccagcctggtgacaaagc

SEQ ID NO: 133986 - DNA, 20 bp, Artificial Sequence
  Description of Artificial Sequence: Synthetic oligonucleotide
  Target: ATXN1; (+) strand; PAM type: NRG; PAM sequence: AAG
ctctgtctcaaaaaaaaaaa

SEQ ID NO: 133987 - DNA, 20 bp, Artificial Sequence
  Description of Artificial Sequence: Synthetic oligonucleotide
  Target: ATXN1; (+) strand; PAM type: NRG; PAM sequence: CAG
cactatcacctcatttttcc

SEQ ID NO: 133988 - DNA, 20 bp, Artificial Sequence
  Description of Artificial Sequence: Synthetic oligonucleotide
  Target: ATXN1; (+) strand; PAM type: NRG; PAM sequence: GAG
ctatcacctcatttttccca

SEQ ID NO: 133989 - DNA, 20 bp, Artificial Sequence
  Description of Artificial Sequence: Synthetic oligonucleotide
  Target: ATXN1; (+) strand; PAM type: NRG; PAM sequence: AGG
tatcacctcatttttcccag

SEQ ID NO: 133990 - DNA, 20 bp, Artificial Sequence
  Description of Artificial Sequence: Synthetic oligonucleotide
  Target: ATXN1; (+) strand; PAM type: NRG; PAM sequence: GGG
atcacctcatttttcccaga

SEQ ID NO: 133991 - DNA, 20 bp, Artificial Sequence
  Description of Artificial Sequence: Synthetic oligonucleotide
  Target: ATXN1; (+) strand; PAM type: NRG; PAM sequence: TAG
tcccagagggttatgtcacc

SEQ ID NO: 133992 - DNA, 20 bp, Artificial Sequence
  Description of Artificial Sequence: Synthetic oligonucleotide
  Target: ATXN1; (+) strand; PAM type: NRG; PAM sequence: TGG
aaaattactattatttgttt

SEQ ID NO: 133993 - DNA, 20 bp, Artificial Sequence
  Description of Artificial Sequence: Synthetic oligonucleotide
  Target: ATXN1; (+) strand; PAM type: NRG; PAM sequence: AAG
gtactttgattttaattccc

SEQ ID NO: 133994 - DNA, 20 bp, Artificial Sequence
  Description of Artificial Sequence: Synthetic oligonucleotide
  Target: ATXN1; (+) strand; PAM type: NRG; PAM sequence: AAG
tgattttaattcccaagctc

SEQ ID NO: 133995 - DNA, 20 bp, Artificial Sequence
  Description of Artificial Sequence: Synthetic oligonucleotide
  Target: ATXN1; (+) strand; PAM type: NRG; PAM sequence: GAG
gacatgttcatatttcaact

SEQ ID NO: 133996 - DNA, 20 bp, Artificial Sequence
  Description of Artificial Sequence: Synthetic oligonucleotide
  Target: ATXN1; (+) strand; PAM type: NRG; PAM sequence: AAG
ttcatatttcaactgagtgt

SEQ ID NO: 133997 - DNA, 20 bp, Artificial Sequence
  Description of Artificial Sequence: Synthetic oligonucleotide
  Target: ATXN1; (+) strand; PAM type: NRG; PAM sequence: TGG
tatttcaactgagtgtaagt

SEQ ID NO: 133998 - DNA, 20 bp, Artificial Sequence
  Description of Artificial Sequence: Synthetic oligonucleotide
  Target: ATXN1; (+) strand; PAM type: NRG; PAM sequence: TGG
ttcaactgagtgtaagttgg

SEQ ID NO: 133999 - DNA, 20 bp, Artificial Sequence
  Description of Artificial Sequence: Synthetic oligonucleotide
  Target: ATXN1; (+) strand; PAM type: NRG; PAM sequence: TAG
gtgtaagttggtggttattt

SEQ ID NO: 134000 - DNA, 20 bp, Artificial Sequence
  Description of Artificial Sequence: Synthetic oligonucleotide
  Target: ATXN1; (+) strand; PAM type: NRG; PAM sequence: AAG
tttagtaaattaaaaatgct

SEQ ID NO: 134001 - DNA, 20 bp, Artificial Sequence
  Description of Artificial Sequence: Synthetic oligonucleotide
  Target: ATXN1; (+) strand; PAM type: NRG; PAM sequence: CAG
atgctaagtaatcccaaatc

SEQ ID NO: 134002 - DNA, 20 bp, Artificial Sequence
  Description of Artificial Sequence: Synthetic oligonucleotide
  Target: ATXN1; (+) strand; PAM type: NRG; PAM sequence: AAG
aatccagatgccaaaacact

SEQ ID NO: 134003 - DNA, 20 bp, Artificial Sequence
  Description of Artificial Sequence: Synthetic oligonucleotide
  Target: ATXN1; (+) strand; PAM type: NRG; PAM sequence: CAG
ccagatgccaaaacactaag

SEQ ID NO: 134004 - DNA, 20 bp, Artificial Sequence
  Description of Artificial Sequence: Synthetic oligonucleotide
  Target: ATXN1; (+) strand; PAM type: NRG; PAM sequence: AAG
ctaaaatccacgtcctgcct

SEQ ID NO: 134005 - DNA, 20 bp, Artificial Sequence
  Description of Artificial Sequence: Synthetic oligonucleotide
  Target: ATXN1; (+) strand; PAM type: NRG; PAM sequence: CGG
aaatccacgtcctgcctaag

SEQ ID NO: 134006 - DNA, 20 bp, Artificial Sequence
  Description of Artificial Sequence: Synthetic oligonucleotide
  Target: ATXN1; (+) strand; PAM type: NRG; PAM sequence: TAG
cctaagcggctaaatttcat

SEQ ID NO: 134007 - DNA, 20 bp, Artificial Sequence
  Description of Artificial Sequence: Synthetic oligonucleotide
  Target: ATXN1; (+) strand; PAM type: NRG; PAM sequence: AAG
ggctaaatttcattagaaac

SEQ ID NO: 134008 - DNA, 20 bp, Artificial Sequence
  Description of Artificial Sequence: Synthetic oligonucleotide
  Target: ATXN1; (+) strand; PAM type: NRG; PAM sequence: CAG
aaatttcattagaaacaagt

SEQ ID NO: 134009 - DNA, 20 bp, Artificial Sequence
  Description of Artificial Sequence: Synthetic oligonucleotide
  Target: ATXN1; (+) strand; PAM type: NRG; PAM sequence: AAG
aagtcagatgataacatcaa

SEQ ID NO: 134010 - DNA, 20 bp, Artificial Sequence
  Description of Artificial Sequence: Synthetic oligonucleotide
  Target: ATXN1; (+) strand; PAM type: NRG; PAM sequence: AGG
agtcagatgataacatcaaa

SEQ ID NO: 134011 - DNA, 20 bp, Artificial Sequence
  Description of Artificial Sequence: Synthetic oligonucleotide
  Target: ATXN1; (+) strand; PAM type: NRG; PAM sequence: AAG
aaaggcatatatgaattcca

SEQ ID NO: 134012 - DNA, 20 bp, Artificial Sequence
  Description of Artificial Sequence: Synthetic oligonucleotide
  Target: ATXN1; (+) strand; PAM type: NRG; PAM sequence: AAG
catatatgaattccaaagta

SEQ ID NO: 134013 - DNA, 20 bp, Artificial Sequence
  Description of Artificial Sequence: Synthetic oligonucleotide
  Target: ATXN1; (+) strand; PAM type: NRG; PAM sequence: AAG
aaagtaaagatatgaaaatg

SEQ ID NO: 134014 - DNA, 20 bp, Artificial Sequence
  Description of Artificial Sequence: Synthetic oligonucleotide
  Target: ATXN1; (+) strand; PAM type: NRG; PAM sequence: GAG
agtaaagatatgaaaatgaa

SEQ ID NO: 134015 - DNA, 20 bp, Artificial Sequence
  Description of Artificial Sequence: Synthetic oligonucleotide
  Target: ATXN1; (+) strand; PAM type: NRG; PAM sequence: GAG
taaagatatgaaaatgaaga

SEQ ID NO: 134016 - DNA, 20 bp, Artificial Sequence
  Description of Artificial Sequence: Synthetic oligonucleotide
  Target: ATXN1; (+) strand; PAM type: NRG; PAM sequence: AGG
aaagatatgaaaatgaagag

SEQ ID NO: 134017 - DNA, 20 bp, Artificial Sequence
  Description of Artificial Sequence: Synthetic oligonucleotide
  Target: ATXN1; (+) strand; PAM type: NRG; PAM sequence: CAG
aggaatttcgatatctaata

SEQ ID NO: 134018 - DNA, 20 bp, Artificial Sequence
  Description of Artificial Sequence: Synthetic oligonucleotide
  Target: ATXN1; (+) strand; PAM type: NRG; PAM sequence: AAG
aacatgtttacctgttcaca

SEQ ID NO: 134019 - DNA, 20 bp, Artificial Sequence
  Description of Artificial Sequence: Synthetic oligonucleotide
  Target: ATXN1; (+) strand; PAM type: NRG; PAM sequence: CAG
acaaagtctacatactaata

SEQ ID NO: 134020 - DNA, 20 bp, Artificial Sequence
  Description of Artificial Sequence: Synthetic oligonucleotide
  Target: ATXN1; (+) strand; PAM type: NRG; PAM sequence: TAG
ctacatactaatacagatct

SEQ ID NO: 134021 - DNA, 20 bp, Artificial Sequence
  Description of Artificial Sequence: Synthetic oligonucleotide
  Target: ATXN1; (+) strand; PAM type: NRG; PAM sequence: TGG
agaatcactgcaacacaaaa

SEQ ID NO: 134022 - DNA, 20 bp, Artificial Sequence
  Description of Artificial Sequence: Synthetic oligonucleotide
  Target: ATXN1; (+) strand; PAM type: NRG; PAM sequence: GAG
ctgcaacacaaaatggatat

SEQ ID NO: 134023 - DNA, 20 bp, Artificial Sequence
  Description of Artificial Sequence: Synthetic oligonucleotide
  Target: ATXN1; (+) strand; PAM type: NRG; PAM sequence: AAG
aaaatggatatgagcatatc

SEQ ID NO: 134024 - DNA, 20 bp, Artificial Sequence
  Description of Artificial Sequence: Synthetic oligonucleotide
  Target: ATXN1; (+) strand; PAM type: NRG; PAM sequence: TGG
gaaatcaacaaaattatgta

SEQ ID NO: 134025 - DNA, 20 bp, Artificial Sequence
  Description of Artificial Sequence: Synthetic oligonucleotide
  Target: ATXN1; (+) strand; PAM type: NRG; PAM sequence: GGG
aaatcaacaaaattatgtat

SEQ ID NO: 134026 - DNA, 20 bp, Artificial Sequence
  Description of Artificial Sequence: Synthetic oligonucleotide
  Target: ATXN1; (+) strand; PAM type: NRG; PAM sequence: TAG
actctccttttgtatatgtg

SEQ ID NO: 134027 - DNA, 20 bp, Artificial Sequence
  Description of Artificial Sequence: Synthetic oligonucleotide
  Target: ATXN1; (+) strand; PAM type: NRG; PAM sequence: AGG
ctctccttttgtatatgtgt

SEQ ID NO: 134028 - DNA, 20 bp, Artificial Sequence
  Description of Artificial Sequence: Synthetic oligonucleotide
  Target: ATXN1; (+) strand; PAM type: NRG; PAM sequence: TAG
ctttgcctctccttgccatt

SEQ ID NO: 134029 - DNA, 20 bp, Artificial Sequence
  Description of Artificial Sequence: Synthetic oligonucleotide
  Target: ATXN1; (+) strand; PAM type: NRG; PAM sequence: CAG
gaaaattcctactcattttt

SEQ ID NO: 134030 - DNA, 20 bp, Artificial Sequence
  Description of Artificial Sequence: Synthetic oligonucleotide
  Target: ATXN1; (+) strand; PAM type: NRG; PAM sequence: TGG
attcctactcatttttcagc

SEQ ID NO: 134031 - DNA, 20 bp, Artificial Sequence
  Description of Artificial Sequence: Synthetic oligonucleotide
  Target: ATXN1; (+) strand; PAM type: NRG; PAM sequence: CAG
actcatttttcagctggaca

SEQ ID NO: 134032 - DNA, 20 bp, Artificial Sequence
  Description of Artificial Sequence: Synthetic oligonucleotide
  Target: ATXN1; (+) strand; PAM type: NRG; PAM sequence: TGG
catttttcagctggacacag

SEQ ID NO: 134033 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgtaaatc

SEQ ID NO: 134034 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaaatccagcactt

SEQ ID NO: 134035 - DNA, 20 bp, Artificial Sequence
  Description of Artificial Sequence: Synthetic oligonucleotide
  Target: ATXN1; (+) strand; PAM type: NRG; PAM sequence: GGG
gcctgtaaatccagcacttt

SEQ ID NO: 134036 - DNA, 20 bp, Artificial Sequence
  Description of Artificial Sequence: Synthetic oligonucleotide
  Target: ATXN1; (+) strand; PAM type: NRG; PAM sequence: GGG
cctgtaaatccagcactttg

SEQ ID NO: 134037 - DNA, 20 bp, Artificial Sequence
  Description of Artificial Sequence: Synthetic oligonucleotide
  Target: ATXN1; (+) strand; PAM type: NRG; PAM sequence: GGG
ctgtaaatccagcactttgg

SEQ ID NO: 134038 - DNA, 20 bp, Artificial Sequence
  Description of Artificial Sequence: Synthetic oligonucleotide
  Target: ATXN1; (+) strand; PAM type: NRG; PAM sequence: GGG
tgtaaatccagcactttggg

SEQ ID NO: 134039 - DNA, 20 bp, Artificial Sequence
  Description of Artificial Sequence: Synthetic oligonucleotide
  Target: ATXN1; (+) strand; PAM type: NRG; PAM sequence: AAG
atccagcactttggggggcc

SEQ ID NO: 134040 - DNA, 20 bp, Artificial Sequence
  Description of Artificial Sequence: Synthetic oligonucleotide
  Target: ATXN1; (+) strand; PAM type: NRG; PAM sequence: AGG
tccagcactttggggggcca

SEQ ID NO: 134041 - DNA, 20 bp, Artificial Sequence
  Description of Artificial Sequence: Synthetic oligonucleotide
  Target: ATXN1; (+) strand; PAM type: NRG; PAM sequence: CGG
agcactttggggggccaagg

SEQ ID NO: 134042 - DNA, 20 bp, Artificial Sequence
  Description of Artificial Sequence: Synthetic oligonucleotide
  Target: ATXN1; (+) strand; PAM type: NRG; PAM sequence: GGG
gcactttggggggccaaggc

SEQ ID NO: 134043 - DNA, 20 bp, Artificial Sequence
  Description of Artificial Sequence: Synthetic oligonucleotide
  Target: ATXN1; (+) strand; PAM type: NRG; PAM sequence: GAG
actttggggggccaaggcgg

SEQ ID NO: 134044 - DNA, 20 bp, Artificial Sequence
  Description of Artificial Sequence: Synthetic oligonucleotide
  Target: ATXN1; (+) strand; PAM type: NRG; PAM sequence: AGG
ctttggggggccaaggcggg

SEQ ID NO: 134045 - DNA, 20 bp, Artificial Sequence
  Description of Artificial Sequence: Synthetic oligonucleotide
  Target: ATXN1; (+) strand; PAM type: NRG; PAM sequence: GAG
ccaaggcgggaggatcacct

SEQ ID NO: 134046 - DNA, 20 bp, Artificial Sequence
  Description of Artificial Sequence: Synthetic oligonucleotide
  Target: ATXN1; (+) strand; PAM type: NRG; PAM sequence: AGG
caaggcgggaggatcacctg

SEQ ID NO: 134047 - DNA, 20 bp, Artificial Sequence
  Description of Artificial Sequence: Synthetic oligonucleotide
  Target: ATXN1; (+) strand; PAM type: NRG; PAM sequence: CAG
gcgggaggatcacctgaggt

SEQ ID NO: 134048 - DNA, 20 bp, Artificial Sequence
  Description of Artificial Sequence: Synthetic oligonucleotide
  Target: ATXN1; (+) strand; PAM type: NRG; PAM sequence: AGG
cgggaggatcacctgaggtc

SEQ ID NO: 134049 - DNA, 20 bp, Artificial Sequence
  Description of Artificial Sequence: Synthetic oligonucleotide
  Target: ATXN1; (+) strand; PAM type: NRG; PAM sequence: GAG
ggaggatcacctgaggtcag

SEQ ID NO: 134050 - DNA, 20 bp, Artificial Sequence
  Description of Artificial Sequence: Synthetic oligonucleotide
  Target: ATXN1; (+) strand; PAM type: NRG; PAM sequence: GAG
tcacctgaggtcaggagttc

SEQ ID NO: 134051 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagttcgagac

SEQ ID NO: 134052 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcgagaccagcc

SEQ ID NO: 134053 - DNA, 20 bp, Artificial Sequence
  Description of Artificial Sequence: Synthetic oligonucleotide
  Target: ATXN1; (+) strand; PAM type: NRG; PAM sequence: TGG
cgagaccagcctggccaaca

SEQ ID NO: 134054 - DNA, 20 bp, Artificial Sequence
  Description of Artificial Sequence: Synthetic oligonucleotide
  Target: ATXN1; (+) strand; PAM type: NRG; PAM sequence: TAG
tctatactaaaaaaaaaaac

SEQ ID NO: 134055 - DNA, 20 bp, Artificial Sequence
  Description of Artificial Sequence: Synthetic oligonucleotide
  Target: ATXN1; (+) strand; PAM type: NRG; PAM sequence: CAG
tactaaaaaaaaaaactagc

SEQ ID NO: 134056 - DNA, 20 bp, Artificial Sequence
  Description of Artificial Sequence: Synthetic oligonucleotide
  Target: ATXN1; (+) strand; PAM type: NRG; PAM sequence: AGG
actaaaaaaaaaaactagcc

SEQ ID NO: 134057 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaaactagccaggca

SEQ ID NO: 134058 - DNA, 20 bp, Artificial Sequence
  Description of Artificial Sequence: Synthetic oligonucleotide
  Target: ATXN1; (+) strand; PAM type: NRG; PAM sequence: TGG
aaaaaactagccaggcatgg

SEQ ID NO: 134059 - DNA, 20 bp, Artificial Sequence
  Description of Artificial Sequence: Synthetic oligonucleotide
  Target: ATXN1; (+) strand; PAM type: NRG; PAM sequence: TGG
aaactagccaggcatggtgg

SEQ ID NO: 134060 - DNA, 20 bp, Artificial Sequence
  Description of Artificial Sequence: Synthetic oligonucleotide
  Target: ATXN1; (+) strand; PAM type: NRG; PAM sequence: GGG
aactagccaggcatggtggt

SEQ ID NO: 134061 - DNA, 20 bp, Artificial Sequence
  Description of Artificial Sequence: Synthetic oligonucleotide
  Target: ATXN1; (+) strand; PAM type: NRG; PAM sequence: CAG
gtggtgggcgcctgtaatcc

SEQ ID NO: 134062 - DNA, 20 bp, Artificial Sequence
  Description of Artificial Sequence: Synthetic oligonucleotide
  Target: ATXN1; (+) strand; PAM type: NRG; PAM sequence: CGG
cgcctgtaatcccagtgacc

SEQ ID NO: 134063 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagtgaccc

SEQ ID NO: 134064 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagtgacccgg

SEQ ID NO: 134065 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagtgacccggg

SEQ ID NO: 134066 - DNA, 20 bp, Artificial Sequence
  Description of Artificial Sequence: Synthetic oligonucleotide
  Target: ATXN1; (+) strand; PAM type: NRG; PAM sequence: GAG
tcccagtgacccgggaggct

SEQ ID NO: 134067 - DNA, 20 bp, Artificial Sequence
  Description of Artificial Sequence: Synthetic oligonucleotide
  Target: ATXN1; (+) strand; PAM type: NRG; PAM sequence: AGG
cccagtgacccgggaggctg

SEQ ID NO: 134068 - DNA, 20 bp, Artificial Sequence
  Description of Artificial Sequence: Synthetic oligonucleotide
  Target: ATXN1; (+) strand; PAM type: NRG; PAM sequence: CAG
agtgacccgggaggctgagg

SEQ ID NO: 134069 - DNA, 20 bp, Artificial Sequence
  Description of Artificial Sequence: Synthetic oligonucleotide
  Target: ATXN1; (+) strand; PAM type: NRG; PAM sequence: AGG
gtgacccgggaggctgaggc

SEQ ID NO: 134070 - DNA, 20 bp, Artificial Sequence
  Description of Artificial Sequence: Synthetic oligonucleotide
  Target: ATXN1; (+) strand; PAM type: NRG; PAM sequence: GAG
gacccgggaggctgaggcag

SEQ ID NO: 134071 - DNA, 20 bp, Artificial Sequence
  Description of Artificial Sequence: Synthetic oligonucleotide
  Target: ATXN1; (+) strand; PAM type: NRG; PAM sequence: TGG
gcaggagaatcgcttgaacc

SEQ ID NO: 134072 - DNA, 20 bp, Artificial Sequence
  Description of Artificial Sequence: Synthetic oligonucleotide
  Target: ATXN1; (+) strand; PAM type: NRG; PAM sequence: GGG
caggagaatcgcttgaacct

SEQ ID NO: 134073 - DNA, 20 bp, Artificial Sequence
  Description of Artificial Sequence: Synthetic oligonucleotide
  Target: ATXN1; (+) strand; PAM type: NRG; PAM sequence: GAG
ggagaatcgcttgaacctgg

SEQ ID NO: 134074 - DNA, 20 bp, Artificial Sequence
  Description of Artificial Sequence: Synthetic oligonucleotide
  Target: ATXN1; (+) strand; PAM type: NRG; PAM sequence: AGG
gagaatcgcttgaacctggg

SEQ ID NO: 134075 - DNA, 20 bp, Artificial Sequence
  Description of Artificial Sequence: Synthetic oligonucleotide
  Target: ATXN1; (+) strand; PAM type: NRG; PAM sequence: CAG
aatcgcttgaacctgggagg

SEQ ID NO: 134076 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaacctgggaggca

SEQ ID NO: 134077 - DNA, 20 bp, Artificial Sequence
  Description of Artificial Sequence: Synthetic oligonucleotide
  Target: ATXN1; (+) strand; PAM type: NRG; PAM sequence: AGG
cgcttgaacctgggaggcag

SEQ ID NO: 134078 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggcagaggttg

SEQ ID NO: 134079 - DNA, 20 bp, Artificial Sequence
  Description of Artificial Sequence: Synthetic oligonucleotide
  Target: ATXN1; (+) strand; PAM type: NRG; PAM sequence: AAG
tgggaggcagaggttgcagt

SEQ ID NO: 134080 - DNA, 20 bp, Artificial Sequence
  Description of Artificial Sequence: Synthetic oligonucleotide
  Target: ATXN1; (+) strand; PAM type: NRG; PAM sequence: GAG
ggcagaggttgcagtaagct

SEQ ID NO: 134081 - DNA, 20 bp, Artificial Sequence
  Description of Artificial Sequence: Synthetic oligonucleotide
  Target: ATXN1; (+) strand; PAM type: NRG; PAM sequence: CAG
gagatcgtgccattgcacta

SEQ ID NO: 134082 - DNA, 20 bp, Artificial Sequence
  Description of Artificial Sequence: Synthetic oligonucleotide
  Target: ATXN1; (+) strand; PAM type: NRG; PAM sequence: TGG
cgtgccattgcactacagcc

SEQ ID NO: 134083 - DNA, 20 bp, Artificial Sequence
  Description of Artificial Sequence: Synthetic oligonucleotide
  Target: ATXN1; (+) strand; PAM type: NRG; PAM sequence: GGG
gtgccattgcactacagcct

SEQ ID NO: 134084 - DNA, 20 bp, Artificial Sequence
  Description of Artificial Sequence: Synthetic oligonucleotide
  Target: ATXN1; (+) strand; PAM type: NRG; PAM sequence: CAG
cactacagcctgggcatcaa

SEQ ID NO: 134085 - DNA, 20 bp, Artificial Sequence
  Description of Artificial Sequence: Synthetic oligonucleotide
  Target: ATXN1; (+) strand; PAM type: NRG; PAM sequence: CGG
tacagcctgggcatcaacag

SEQ ID NO: 134086 - DNA, 20 bp, Artificial Sequence
  Description of Artificial Sequence: Synthetic oligonucleotide
  Target: ATXN1; (+) strand; PAM type: NRG; PAM sequence: AAG
tctgtctaaaaaaaaaaaaa

SEQ ID NO: 134087 - DNA, 20 bp, Artificial Sequence
  Description of Artificial Sequence: Synthetic oligonucleotide
  Target: ATXN1; (+) strand; PAM type: NRG; PAM sequence: AAG
aaaattcctactcatttttc

SEQ ID NO: 134088 - DNA, 20 bp, Artificial Sequence
  Description of Artificial Sequence: Synthetic oligonucleotide
  Target: ATXN1; (+) strand; PAM type: NRG; PAM sequence: AGG
aaattcctactcatttttca

SEQ ID NO: 134089 - DNA, 20 bp, Artificial Sequence
  Description of Artificial Sequence: Synthetic oligonucleotide
  Target: ATXN1; (+) strand; PAM type: NRG; PAM sequence: GAG
catttttcaaggccaacctt

SEQ ID NO: 134090 - DNA, 20 bp, Artificial Sequence
  Description of Artificial Sequence: Synthetic oligonucleotide
  Target: ATXN1; (+) strand; PAM type: NRG; PAM sequence: TAG
aggccaaccttgagcttaaa

SEQ ID NO: 134091 - DNA, 20 bp, Artificial Sequence
  Description of Artificial Sequence: Synthetic oligonucleotide
  Target: ATXN1; (+) strand; PAM type: NRG; PAM sequence: TGG
atctatcccctaatgttttc

SEQ ID NO: 134092 - DNA, 20 bp, Artificial Sequence
  Description of Artificial Sequence: Synthetic oligonucleotide
  Target: ATXN1; (+) strand; PAM type: NRG; PAM sequence: AAG
ctaatgttttctggaaatct

SEQ ID NO: 134093 - DNA, 20 bp, Artificial Sequence
  Description of Artificial Sequence: Synthetic oligonucleotide
  Target: ATXN1; (+) strand; PAM type: NRG; PAM sequence: CAG
atgttttctggaaatctaag

SEQ ID NO: 134094 - DNA, 20 bp, Artificial Sequence
  Description of Artificial Sequence: Synthetic oligonucleotide
  Target: ATXN1; (+) strand; PAM type: NRG; PAM sequence: TAG
ttctggaaatctaagcagaa

SEQ ID NO: 134095 - DNA, 20 bp, Artificial Sequence
  Description of Artificial Sequence: Synthetic oligonucleotide
  Target: ATXN1; (+) strand; PAM type: NRG; PAM sequence: TAG
tctgcctcacctacgtttcc

SEQ ID NO: 134096 - DNA, 20 bp, Artificial Sequence
  Description of Artificial Sequence: Synthetic oligonucleotide
  Target: ATXN1; (+) strand; PAM type: NRG; PAM sequence: CAG
ctcacctacgtttcctagct

SEQ ID NO: 134097 - DNA, 20 bp, Artificial Sequence
  Description of Artificial Sequence: Synthetic oligonucleotide
  Target: ATXN1; (+) strand; PAM type: NRG; PAM sequence: TGG
tacgtttcctagctcagtga

SEQ ID NO: 134098 - DNA, 20 bp, Artificial Sequence
  Description of Artificial Sequence: Synthetic oligonucleotide
  Target: ATXN1; (+) strand; PAM type: NRG; PAM sequence: CAG
atgccccatattcaaccatg

SEQ ID NO: 134099 - DNA, 20 bp, Artificial Sequence
  Description of Artificial Sequence: Synthetic oligonucleotide
  Target: ATXN1; (+) strand; PAM type: NRG; PAM sequence: CGG
caactccctccgctcctctc

SEQ ID NO: 134100 - DNA, 20 bp, Artificial Sequence
  Description of Artificial Sequence: Synthetic oligonucleotide
  Target: ATXN1; (+) strand; PAM type: NRG; PAM sequence: TGG
gctcctctccggcaccaccc

SEQ ID NO: 134101 - DNA, 20 bp, Artificial Sequence
  Description of Artificial Sequence: Synthetic oligonucleotide
  Target: ATXN1; (+) strand; PAM type: NRG; PAM sequence: TGG
cggcaccaccctggctcatc

SEQ ID NO: 134102 - DNA, 20 bp, Artificial Sequence
  Description of Artificial Sequence: Synthetic oligonucleotide
  Target: ATXN1; (+) strand; PAM type: NRG; PAM sequence: TGG
gctcatctggactctttccc

SEQ ID NO: 134103 - DNA, 20 bp, Artificial Sequence
  Description of Artificial Sequence: Synthetic oligonucleotide
  Target: ATXN1; (+) strand; PAM type: NRG; PAM sequence: TGG
tgccaccctactaccttcct

SEQ ID NO: 134104 - DNA, 20 bp, Artificial Sequence
  Description of Artificial Sequence: Synthetic oligonucleotide
  Target: ATXN1; (+) strand; PAM type: NRG; PAM sequence: AAG
accttccttggctcctgcct

SEQ ID NO: 134105 - DNA, 20 bp, Artificial Sequence
  Description of Artificial Sequence: Synthetic oligonucleotide
  Target: ATXN1; (+) strand; PAM type: NRG; PAM sequence: AGG
ccttccttggctcctgccta

SEQ ID NO: 134106 - DNA, 20 bp, Artificial Sequence
  Description of Artificial Sequence: Synthetic oligonucleotide
  Target: ATXN1; (+) strand; PAM type: NRG; PAM sequence: CAG
ggctcctgcctaaggcattg

SEQ ID NO: 134107 - DNA, 20 bp, Artificial Sequence
  Description of Artificial Sequence: Synthetic oligonucleotide
  Target: ATXN1; (+) strand; PAM type: NRG; PAM sequence: TGG
tcctgcctaaggcattgcag

SEQ ID NO: 134108 - DNA, 20 bp, Artificial Sequence
  Description of Artificial Sequence: Synthetic oligonucleotide
  Target: ATXN1; (+) strand; PAM type: NRG; PAM sequence: TGG
tggctttccatttctaaaca

SEQ ID NO: 134109 - DNA, 20 bp, Artificial Sequence
  Description of Artificial Sequence: Synthetic oligonucleotide
  Target: ATXN1; (+) strand; PAM type: NRG; PAM sequence: CAG
ttctcttccaacttgcacta

SEQ ID NO: 134110 - DNA, 20 bp, Artificial Sequence
  Description of Artificial Sequence: Synthetic oligonucleotide
  Target: ATXN1; (+) strand; PAM type: NRG; PAM sequence: TGG
ttccaacttgcactacagca

SEQ ID NO: 134111 - DNA, 20 bp, Artificial Sequence
  Description of Artificial Sequence: Synthetic oligonucleotide
  Target: ATXN1; (+) strand; PAM type: NRG; PAM sequence: TGG
aacttgcactacagcatggc

SEQ ID NO: 134112 - DNA, 20 bp, Artificial Sequence
  Description of Artificial Sequence: Synthetic oligonucleotide
  Target: ATXN1; (+) strand; PAM type: NRG; PAM sequence: AAG
gcttactttcaattccttaa

SEQ ID NO: 134113 - DNA, 20 bp, Artificial Sequence
  Description of Artificial Sequence: Synthetic oligonucleotide
  Target: ATXN1; (+) strand; PAM type: NRG; PAM sequence: AGG
cttactttcaattccttaaa

SEQ ID NO: 134114 - DNA, 20 bp, Artificial Sequence
  Description of Artificial Sequence: Synthetic oligonucleotide
  Target: ATXN1; (+) strand; PAM type: NRG; PAM sequence: CAG
ttaaaaggaccttgctttcc

SEQ ID NO: 134115 - DNA, 20 bp, Artificial Sequence
  Description of Artificial Sequence: Synthetic oligonucleotide
  Target: ATXN1; (+) strand; PAM type: NRG; PAM sequence: AGG
taaaaggaccttgctttccc

SEQ ID NO: 134116 - DNA, 20 bp, Artificial Sequence
  Description of Artificial Sequence: Synthetic oligonucleotide
  Target: ATXN1; (+) strand; PAM type: NRG; PAM sequence: AAG
ccttgctttcccaggcctta

SEQ ID NO: 134117 - DNA, 20 bp, Artificial Sequence
  Description of Artificial Sequence: Synthetic oligonucleotide
  Target: ATXN1; (+) strand; PAM type: NRG; PAM sequence: AAG
cacatgacttcctccttgct

SEQ ID NO: 134118 - DNA, 20 bp, Artificial Sequence
  Description of Artificial Sequence: Synthetic oligonucleotide
  Target: ATXN1; (+) strand; PAM type: NRG; PAM sequence: CAG
ccttgtattcttttctcctt

SEQ ID NO: 134119 - DNA, 20 bp, Artificial Sequence
  Description of Artificial Sequence: Synthetic oligonucleotide
  Target: ATXN1; (+) strand; PAM type: NRG; PAM sequence: CAG
ttcttttctccttcagctct

SEQ ID NO: 134120 - DNA, 20 bp, Artificial Sequence
  Description of Artificial Sequence: Synthetic oligonucleotide
  Target: ATXN1; (+) strand; PAM type: NRG; PAM sequence: CAG
ttctccttcagctctcagct

SEQ ID NO: 134121 - DNA, 20 bp, Artificial Sequence
  Description of Artificial Sequence: Synthetic oligonucleotide
  Target: ATXN1; (+) strand; PAM type: NRG; PAM sequence: AAG
ctcagctcagtcctcttctc

SEQ ID NO: 134122 - DNA, 20 bp, Artificial Sequence
  Description of Artificial Sequence: Synthetic oligonucleotide
  Target: ATXN1; (+) strand; PAM type: NRG; PAM sequence: AGG
tcagctcagtcctcttctca

SEQ ID NO: 134123 - DNA, 20 bp, Artificial Sequence
  Description of Artificial Sequence: Synthetic oligonucleotide
  Target: ATXN1; (+) strand; PAM type: NRG; PAM sequence: GGG
cagctcagtcctcttctcaa

SEQ ID NO: 134124 - DNA, 20 bp, Artificial Sequence
  Description of Artificial Sequence: Synthetic oligonucleotide
  Target: ATXN1; (+) strand; PAM type: NRG; PAM sequence: GAG
gctcagtcctcttctcaagg

SEQ ID NO: 134125 - DNA, 20 bp, Artificial Sequence
  Description of Artificial Sequence: Synthetic oligonucleotide
  Target: ATXN1; (+) strand; PAM type: NRG; PAM sequence: CAG
cttctcaagggagacttcct

SEQ ID NO: 134126 - DNA, 20 bp, Artificial Sequence
  Description of Artificial Sequence: Synthetic oligonucleotide
  Target: ATXN1; (+) strand; PAM type: NRG; PAM sequence: CAG
tcaagggagacttcctcagc

SEQ ID NO: 134127 - DNA, 20 bp, Artificial Sequence
  Description of Artificial Sequence: Synthetic oligonucleotide
  Target: ATXN1; (+) strand; PAM type: NRG; PAM sequence: AGG
caagggagacttcctcagcc

SEQ ID NO: 134128 - DNA, 20 bp, Artificial Sequence
  Description of Artificial Sequence: Synthetic oligonucleotide
  Target: ATXN1; (+) strand; PAM type: NRG; PAM sequence: TAG
tcagccaggtcaccacctcc

SEQ ID NO: 134129 - DNA, 20 bp, Artificial Sequence
  Description of Artificial Sequence: Synthetic oligonucleotide
  Target: ATXN1; (+) strand; PAM type: NRG; PAM sequence: AGG
cagccaggtcaccacctcct

SEQ ID NO: 134130 - DNA, 20 bp, Artificial Sequence
  Description of Artificial Sequence: Synthetic oligonucleotide
  Target: ATXN1; (+) strand; PAM type: NRG; PAM sequence: TAG
cctcctaggacacacttgta

SEQ ID NO: 134131 - DNA, 20 bp, Artificial Sequence
  Description of Artificial Sequence: Synthetic oligonucleotide
  Target: ATXN1; (+) strand; PAM type: NRG; PAM sequence: TGG
ttgtatagaatgaccctccc

SEQ ID NO: 134132 - DNA, 20 bp, Artificial Sequence
  Description of Artificial Sequence: Synthetic oligonucleotide
  Target: ATXN1; (+) strand; PAM type: NRG; PAM sequence: TAG
agaatgaccctccctggtta

SEQ ID NO: 134133 - DNA, 20 bp, Artificial Sequence
  Description of Artificial Sequence: Synthetic oligonucleotide
  Target: ATXN1; (+) strand; PAM type: NRG; PAM sequence: TAG
atgaccctccctggttatag

SEQ ID NO: 134134 - DNA, 20 bp, Artificial Sequence
  Description of Artificial Sequence: Synthetic oligonucleotide
  Target: ATXN1; (+) strand; PAM type: NRG; PAM sequence: TGG
tttgtaacttttacattttt

SEQ ID NO: 134135 - DNA, 20 bp, Artificial Sequence
  Description of Artificial Sequence: Synthetic oligonucleotide
  Target: ATXN1; (+) strand; PAM type: NRG; PAM sequence: CAG
ccccacgaatcaataaactc

SEQ ID NO: 134136 - DNA, 20 bp, Artificial Sequence
  Description of Artificial Sequence: Synthetic oligonucleotide
  Target: ATXN1; (+) strand; PAM type: NRG; PAM sequence: AAG
acgaatcaataaactccaga

SEQ ID NO: 134137 - DNA, 20 bp, Artificial Sequence
  Description of Artificial Sequence: Synthetic oligonucleotide
  Target: ATXN1; (+) strand; PAM type: NRG; PAM sequence: AGG
cgaatcaataaactccagaa

SEQ ID NO: 134138 - DNA, 20 bp, Artificial Sequence
  Description of Artificial Sequence: Synthetic oligonucleotide
  Target: ATXN1; (+) strand; PAM type: NRG; PAM sequence: GGG
gaatcaataaactccagaaa

SEQ ID NO: 134139 - DNA, 20 bp, Artificial Sequence
  Description of Artificial Sequence: Synthetic oligonucleotide
  Target: ATXN1; (+) strand; PAM type: NRG; PAM sequence: GAG
atcaataaactccagaaagg

SEQ ID NO: 134140 - DNA, 20 bp, Artificial Sequence
  Description of Artificial Sequence: Synthetic oligonucleotide
  Target: ATXN1; (+) strand; PAM type: NRG; PAM sequence: TGG
ctcacccctcctttcatctt

SEQ ID NO: 134141 - DNA, 20 bp, Artificial Sequence
  Description of Artificial Sequence: Synthetic oligonucleotide
  Target: ATXN1; (+) strand; PAM type: NRG; PAM sequence: GGG
tcacccctcctttcatcttt

SEQ ID NO: 134142 - DNA, 20 bp, Artificial Sequence
  Description of Artificial Sequence: Synthetic oligonucleotide
  Target: ATXN1; (+) strand; PAM type: NRG; PAM sequence: TGG
ctttcatctttgggattcaa

SEQ ID NO: 134143 - DNA, 20 bp, Artificial Sequence
  Description of Artificial Sequence: Synthetic oligonucleotide
  Target: ATXN1; (+) strand; PAM type: NRG; PAM sequence: AAG
catctttgggattcaatgga

SEQ ID NO: 134144 - DNA, 20 bp, Artificial Sequence
  Description of Artificial Sequence: Synthetic oligonucleotide
  Target: ATXN1; (+) strand; PAM type: NRG; PAM sequence: TGG
atggaaagctttgcacatta

SEQ ID NO: 134145 - DNA, 20 bp, Artificial Sequence
  Description of Artificial Sequence: Synthetic oligonucleotide
  Target: ATXN1; (+) strand; PAM type: NRG; PAM sequence: GGG
tggaaagctttgcacattat

SEQ ID NO: 134146 - DNA, 20 bp, Artificial Sequence
  Description of Artificial Sequence: Synthetic oligonucleotide
  Target: ATXN1; (+) strand; PAM type: NRG; PAM sequence: GAG
ggcactcaataaaatcttct

SEQ ID NO: 134147 - DNA, 20 bp, Artificial Sequence
  Description of Artificial Sequence: Synthetic oligonucleotide
  Target: ATXN1; (+) strand; PAM type: NRG; PAM sequence: GAG
aatcttctgagtgaataaat

SEQ ID NO: 134148 - DNA, 20 bp, Artificial Sequence
  Description of Artificial Sequence: Synthetic oligonucleotide
  Target: ATXN1; (+) strand; PAM type: NRG; PAM sequence: AAG
ctgagtgaataaatgagcca

SEQ ID NO: 134149 - DNA, 20 bp, Artificial Sequence
  Description of Artificial Sequence: Synthetic oligonucleotide
  Target: ATXN1; (+) strand; PAM type: NRG; PAM sequence: AAG
agtgaataaatgagccaaag

SEQ ID NO: 134150 - DNA, 20 bp, Artificial Sequence
  Description of Artificial Sequence: Synthetic oligonucleotide
  Target: ATXN1; (+) strand; PAM type: NRG; PAM sequence: AGG
gtgaataaatgagccaaaga

SEQ ID NO: 134151 - DNA, 20 bp, Artificial Sequence
  Description of Artificial Sequence: Synthetic oligonucleotide
  Target: ATXN1; (+) strand; PAM type: NRG; PAM sequence: GAG
gaataaatgagccaaagaag

SEQ ID NO: 134152 - DNA, 20 bp, Artificial Sequence
  Description of Artificial Sequence: Synthetic oligonucleotide
  Target: ATXN1; (+) strand; PAM type: NRG; PAM sequence: AGG
aataaatgagccaaagaagg

SEQ ID NO: 134153 - DNA, 20 bp, Artificial Sequence
  Description of Artificial Sequence: Synthetic oligonucleotide
  Target: ATXN1; (+) strand; PAM type: NRG; PAM sequence: GGG
ataaatgagccaaagaagga

SEQ ID NO: 134154 - DNA, 20 bp, Artificial Sequence
  Description of Artificial Sequence: Synthetic oligonucleotide
  Target: ATXN1; (+) strand; PAM type: NRG; PAM sequence: AAG
aatgagccaaagaaggaggg

SEQ ID NO: 134155 - DNA, 20 bp, Artificial Sequence
  Description of Artificial Sequence: Synthetic oligonucleotide
  Target: ATXN1; (+) strand; PAM type: NRG; PAM sequence: AGG
atgagccaaagaaggaggga

SEQ ID NO: 134156 - DNA, 20 bp, Artificial Sequence
  Description of Artificial Sequence: Synthetic oligonucleotide
  Target: ATXN1; (+) strand; PAM type: NRG; PAM sequence: GAG
gagccaaagaaggagggaag

SEQ ID NO: 134157 - DNA, 20 bp, Artificial Sequence
  Description of Artificial Sequence: Synthetic oligonucleotide
  Target: ATXN1; (+) strand; PAM type: NRG; PAM sequence: AGG
agccaaagaaggagggaagg

SEQ ID NO: 134158 - DNA, 20 bp, Artificial Sequence
  Description of Artificial Sequence: Synthetic oligonucleotide
  Target: ATXN1; (+) strand; PAM type: NRG; PAM sequence: AAG
caaagaaggagggaaggagg

SEQ ID NO: 134159 - DNA, 20 bp, Artificial Sequence
  Description of Artificial Sequence: Synthetic oligonucleotide
  Target: ATXN1; (+) strand; PAM type: NRG; PAM sequence: AGG
aaagaaggagggaaggagga

SEQ ID NO: 134160 - DNA, 20 bp, Artificial Sequence
  Description of Artificial Sequence: Synthetic oligonucleotide
  Target: ATXN1; (+) strand; PAM type: NRG; PAM sequence: GGG
aagaaggagggaaggaggaa

SEQ ID NO: 134161 - DNA, 20 bp, Artificial Sequence
  Description of Artificial Sequence: Synthetic oligonucleotide
  Target: ATXN1; (+) strand; PAM type: NRG; PAM sequence: GAG
gaaggagggaaggaggaagg

SEQ ID NO: 134162 - DNA, 20 bp, Artificial Sequence
  Description of Artificial Sequence: Synthetic oligonucleotide
  Target: ATXN1; (+) strand; PAM type: NRG; PAM sequence: AGG
aaggagggaaggaggaaggg

SEQ ID NO: 134163 - DNA, 20 bp, Artificial Sequence
  Description of Artificial Sequence: Synthetic oligonucleotide
  Target: ATXN1; (+) strand; PAM type: NRG; PAM sequence: GGG
aggagggaaggaggaaggga

SEQ ID NO: 134164 - DNA, 20 bp, Artificial Sequence
  Description of Artificial Sequence: Synthetic oligonucleotide
  Target: ATXN1; (+) strand; PAM type: NRG; PAM sequence: GAG
gagggaaggaggaagggagg

SEQ ID NO: 134165 - DNA, 20 bp, Artificial Sequence
  Description of Artificial Sequence: Synthetic oligonucleotide
  Target: ATXN1; (+) strand; PAM type: NRG; PAM sequence: AGG
agggaaggaggaagggaggg

SEQ ID NO: 134166 - DNA, 20 bp, Artificial Sequence
  Description of Artificial Sequence: Synthetic oligonucleotide
  Target: ATXN1; (+) strand; PAM type: NRG; PAM sequence: AAG
gaaggaggaagggagggagg

SEQ ID NO: 134167 - DNA, 20 bp, Artificial Sequence
  Description of Artificial Sequence: Synthetic oligonucleotide
  Target: ATXN1; (+) strand; PAM type: NRG; PAM sequence: AGG
aaggaggaagggagggagga

SEQ ID NO: 134168 - DNA, 20 bp, Artificial Sequence
  Description of Artificial Sequence: Synthetic oligonucleotide
  Target: ATXN1; (+) strand; PAM type: NRG; PAM sequence: TAG
gaggaagggagggaggaagg

SEQ ID NO: 134169 - DNA, 20 bp, Artificial Sequence
  Description of Artificial Sequence: Synthetic oligonucleotide
  Target: ATXN1; (+) strand; PAM type: NRG; PAM sequence: AGG
aggaagggagggaggaaggt

SEQ ID NO: 134170 - DNA, 20 bp, Artificial Sequence
  Description of Artificial Sequence: Synthetic oligonucleotide
  Target: ATXN1; (+) strand; PAM type: NRG; PAM sequence: AAG
aagggagggaggaaggtagg

SEQ ID NO: 134171 - DNA, 20 bp, Artificial Sequence
  Description of Artificial Sequence: Synthetic oligonucleotide
  Target: ATXN1; (+) strand; PAM type: NRG; PAM sequence: AAG
gagggaggaaggtaggaaga

SEQ ID NO: 134172 - DNA, 20 bp, Artificial Sequence
  Description of Artificial Sequence: Synthetic oligonucleotide
  Target: ATXN1; (+) strand; PAM type: NRG; PAM sequence: AGG
agggaggaaggtaggaagaa

SEQ ID NO: 134173 - DNA, 20 bp, Artificial Sequence
  Description of Artificial Sequence: Synthetic oligonucleotide
  Target: ATXN1; (+) strand; PAM type: NRG; PAM sequence: AAG
gaggaaggtaggaagaaagg

SEQ ID NO: 134174 - DNA, 20 bp, Artificial Sequence
  Description of Artificial Sequence: Synthetic oligonucleotide
  Target: ATXN1; (+) strand; PAM type: NRG; PAM sequence: AGG
aggaaggtaggaagaaagga

SEQ ID NO: 134175 - DNA, 20 bp, Artificial Sequence
  Description of Artificial Sequence: Synthetic oligonucleotide
  Target: ATXN1; (+) strand; PAM type: NRG; PAM sequence: TAG
cttaatcatactgatttaat

SEQ ID NO: 134176 - DNA, 20 bp, Artificial Sequence
  Description of Artificial Sequence: Synthetic oligonucleotide
  Target: ATXN1; (+) strand; PAM type: NRG; PAM sequence: TGG
ctgatttaattagtgttgat

SEQ ID NO: 134177 - DNA, 20 bp, Artificial Sequence
  Description of Artificial Sequence: Synthetic oligonucleotide
  Target: ATXN1; (+) strand; PAM type: NRG; PAM sequence: CAG
ttcatctgtaaatcgttttc

SEQ ID NO: 134178 - DNA, 20 bp, Artificial Sequence
  Description of Artificial Sequence: Synthetic oligonucleotide
  Target: ATXN1; (+) strand; PAM type: NRG; PAM sequence: CAG
gtaaatcgttttccagcaca

SEQ ID NO: 134179 - DNA, 20 bp, Artificial Sequence
  Description of Artificial Sequence: Synthetic oligonucleotide
  Target: ATXN1; (+) strand; PAM type: NRG; PAM sequence: GAG
aaatcgttttccagcacaca

SEQ ID NO: 134180 - DNA, 20 bp, Artificial Sequence
  Description of Artificial Sequence: Synthetic oligonucleotide
  Target: ATXN1; (+) strand; PAM type: NRG; PAM sequence: TGG
gtatgacatctacattcctt

SEQ ID NO: 134181 - DNA, 20 bp, Artificial Sequence
  Description of Artificial Sequence: Synthetic oligonucleotide
  Target: ATXN1; (+) strand; PAM type: NRG; PAM sequence: GGG
tatgacatctacattccttt

SEQ ID NO: 134182 - DNA, 20 bp, Artificial Sequence
  Description of Artificial Sequence: Synthetic oligonucleotide
  Target: ATXN1; (+) strand; PAM type: NRG; PAM sequence: AAG
cattcctttgggtaacatgc

SEQ ID NO: 134183 - DNA, 20 bp, Artificial Sequence
  Description of Artificial Sequence: Synthetic oligonucleotide
  Target: ATXN1; (+) strand; PAM type: NRG; PAM sequence: AGG
attcctttgggtaacatgca

SEQ ID NO: 134184 - DNA, 20 bp, Artificial Sequence
  Description of Artificial Sequence: Synthetic oligonucleotide
  Target: ATXN1; (+) strand; PAM type: NRG; PAM sequence: GAG
ggtaacatgcaaggctcctt

SEQ ID NO: 134185 - DNA, 20 bp, Artificial Sequence
  Description of Artificial Sequence: Synthetic oligonucleotide
  Target: ATXN1; (+) strand; PAM type: NRG; PAM sequence: CAG
ggctccttgagctctgaccc

SEQ ID NO: 134186 - DNA, 20 bp, Artificial Sequence
  Description of Artificial Sequence: Synthetic oligonucleotide
  Target: ATXN1; (+) strand; PAM type: NRG; PAM sequence: CAG
ccttgagctctgaccccagc

SEQ ID NO: 134187 - DNA, 20 bp, Artificial Sequence
  Description of Artificial Sequence: Synthetic oligonucleotide
  Target: ATXN1; (+) strand; PAM type: NRG; PAM sequence: CGG
gagctctgaccccagccagc

SEQ ID NO: 134188 - DNA, 20 bp, Artificial Sequence
  Description of Artificial Sequence: Synthetic oligonucleotide
  Target: ATXN1; (+) strand; PAM type: NRG; PAM sequence: GGG
agctctgaccccagccagcc

SEQ ID NO: 134189 - DNA, 20 bp, Artificial Sequence
  Description of Artificial Sequence: Synthetic oligonucleotide
  Target: ATXN1; (+) strand; PAM type: NRG; PAM sequence: CAG
ctcctgctgcacttgaccct

SEQ ID NO: 134190 - DNA, 20 bp, Artificial Sequence
  Description of Artificial Sequence: Synthetic oligonucleotide
  Target: ATXN1; (+) strand; PAM type: NRG; PAM sequence: AAG
acttgaccctcagcacctcc

SEQ ID NO: 134191 - DNA, 20 bp, Artificial Sequence
  Description of Artificial Sequence: Synthetic oligonucleotide
  Target: ATXN1; (+) strand; PAM type: NRG; PAM sequence: TAG
cacctccaagtccctccctg

SEQ ID NO: 134192 - DNA, 20 bp, Artificial Sequence
  Description of Artificial Sequence: Synthetic oligonucleotide
  Target: ATXN1; (+) strand; PAM type: NRG; PAM sequence: CAG
atcatcttttcaaactcact

SEQ ID NO: 134193 - DNA, 20 bp, Artificial Sequence
  Description of Artificial Sequence: Synthetic oligonucleotide
  Target: ATXN1; (+) strand; PAM type: NRG; PAM sequence: AAG
ttcaaactcactcagtcttc

SEQ ID NO: 134194 - DNA, 20 bp, Artificial Sequence
  Description of Artificial Sequence: Synthetic oligonucleotide
  Target: ATXN1; (+) strand; PAM type: NRG; PAM sequence: CAG
ctcactcagtcttcaagtct

SEQ ID NO: 134195 - DNA, 20 bp, Artificial Sequence
  Description of Artificial Sequence: Synthetic oligonucleotide
  Target: ATXN1; (+) strand; PAM type: NRG; PAM sequence: AGG
tcactcagtcttcaagtctc

SEQ ID NO: 134196 - DNA, 20 bp, Artificial Sequence
  Description of Artificial Sequence: Synthetic oligonucleotide
  Target: ATXN1; (+) strand; PAM type: NRG; PAM sequence: GGG
cactcagtcttcaagtctca

SEQ ID NO: 134197 - DNA, 20 bp, Artificial Sequence
  Description of Artificial Sequence: Synthetic oligonucleotide
  Target: ATXN1; (+) strand; PAM type: NRG; PAM sequence: TGG
cagtcttcaagtctcagggc

SEQ ID NO: 134198 - DNA, 20 bp, Artificial Sequence
  Description of Artificial Sequence: Synthetic oligonucleotide
  Target: ATXN1; (+) strand; PAM type: NRG; PAM sequence: GGG
agtcttcaagtctcagggct

SEQ ID NO: 134199 - DNA, 20 bp, Artificial Sequence
  Description of Artificial Sequence: Synthetic oligonucleotide
  Target: ATXN1; (+) strand; PAM type: NRG; PAM sequence: GGG
gtcttcaagtctcagggctg

SEQ ID NO: 134200 - DNA, 20 bp, Artificial Sequence
  Description of Artificial Sequence: Synthetic oligonucleotide
  Target: ATXN1; (+) strand; PAM type: NRG; PAM sequence: TGG
aaaaactccctgacaccttc

SEQ ID NO: 134201 - DNA, 20 bp, Artificial Sequence
  Description of Artificial Sequence: Synthetic oligonucleotide
  Target: ATXN1; (+) strand; PAM type: NRG; PAM sequence: GGG
aaaactccctgacaccttct

SEQ ID NO: 134202 - DNA, 20 bp, Artificial Sequence
  Description of Artificial Sequence: Synthetic oligonucleotide
  Target: ATXN1; (+) strand; PAM type: NRG; PAM sequence: AAG
actccctgacaccttctggg

SEQ ID NO: 134203 - DNA, 20 bp, Artificial Sequence
  Description of Artificial Sequence: Synthetic oligonucleotide
  Target: ATXN1; (+) strand; PAM type: NRG; PAM sequence: TGG
ccctgacaccttctgggaag

SEQ ID NO: 134204 - DNA, 20 bp, Artificial Sequence
  Description of Artificial Sequence: Synthetic oligonucleotide
  Target: ATXN1; (+) strand; PAM type: NRG; PAM sequence: GGG
cctgacaccttctgggaagt

SEQ ID NO: 134205 - DNA, 20 bp, Artificial Sequence
  Description of Artificial Sequence: Synthetic oligonucleotide
  Target: ATXN1; (+) strand; PAM type: NRG; PAM sequence: GGG
ctgacaccttctgggaagtg

SEQ ID NO: 134206 - DNA, 20 bp, Artificial Sequence
  Description of Artificial Sequence: Synthetic oligonucleotide
  Target: ATXN1; (+) strand; PAM type: NRG; PAM sequence: GGG
tgacaccttctgggaagtgg

SEQ ID NO: 134207 - DNA, 20 bp, Artificial Sequence
  Description of Artificial Sequence: Synthetic oligonucleotide
  Target: ATXN1; (+) strand; PAM type: NRG; PAM sequence: AAG
ccctgtacctatccctatta

SEQ ID NO: 134208 - DNA, 20 bp, Artificial Sequence
  Description of Artificial Sequence: Synthetic oligonucleotide
  Target: ATXN1; (+) strand; PAM type: NRG; PAM sequence: AAG
cctgtacttgttccttaacc

SEQ ID NO: 134209 - DNA, 20 bp, Artificial Sequence
  Description of Artificial Sequence: Synthetic oligonucleotide
  Target: ATXN1; (+) strand; PAM type: NRG; PAM sequence: AAG
catctctcccaccacaacct

SEQ ID NO: 134210 - DNA, 20 bp, Artificial Sequence
  Description of Artificial Sequence: Synthetic oligonucleotide
  Target: ATXN1; (+) strand; PAM type: NRG; PAM sequence: AAG
accacaacctaagtccctta

SEQ ID NO: 134211 - DNA, 20 bp, Artificial Sequence
  Description of Artificial Sequence: Synthetic oligonucleotide
  Target: ATXN1; (+) strand; PAM type: NRG; PAM sequence: AGG
ccacaacctaagtcccttaa

SEQ ID NO: 134212 - DNA, 20 bp, Artificial Sequence
  Description of Artificial Sequence: Synthetic oligonucleotide
  Target: ATXN1; (+) strand; PAM type: NRG; PAM sequence: AAG
aacctaagtcccttaaaggc

SEQ ID NO: 134213 - DNA, 20 bp, Artificial Sequence
  Description of Artificial Sequence: Synthetic oligonucleotide
  Target: ATXN1; (+) strand; PAM type: NRG; PAM sequence: AAG
taagtcccttaaaggcaaga

SEQ ID NO: 134214 - DNA, 20 bp, Artificial Sequence
  Description of Artificial Sequence: Synthetic oligonucleotide
  Target: ATXN1; (+) strand; PAM type: NRG; PAM sequence: GAG
agtcccttaaaggcaagaaa

SEQ ID NO: 134215 - DNA, 20 bp, Artificial Sequence
  Description of Artificial Sequence: Synthetic oligonucleotide
  Target: ATXN1; (+) strand; PAM type: NRG; PAM sequence: AGG
gtcccttaaaggcaagaaag

SEQ ID NO: 134216 - DNA, 20 bp, Artificial Sequence
  Description of Artificial Sequence: Synthetic oligonucleotide
  Target: ATXN1; (+) strand; PAM type: NRG; PAM sequence: TAG
aaagaggtatcccctcatca

SEQ ID NO: 134217 - DNA, 20 bp, Artificial Sequence
  Description of Artificial Sequence: Synthetic oligonucleotide
  Target: ATXN1; (+) strand; PAM type: NRG; PAM sequence: CAG
atcccctcatcatagtaccc

SEQ ID NO: 134218 - DNA, 20 bp, Artificial Sequence
  Description of Artificial Sequence: Synthetic oligonucleotide
  Target: ATXN1; (+) strand; PAM type: NRG; PAM sequence: GAG
cccctcatcatagtacccca

SEQ ID NO: 134219 - DNA, 20 bp, Artificial Sequence
  Description of Artificial Sequence: Synthetic oligonucleotide
  Target: ATXN1; (+) strand; PAM type: NRG; PAM sequence: CAG
tagtaccccagagtttcgta

SEQ ID NO: 134220 - DNA, 20 bp, Artificial Sequence
  Description of Artificial Sequence: Synthetic oligonucleotide
  Target: ATXN1; (+) strand; PAM type: NRG; PAM sequence: CAG
taccccagagtttcgtacag

SEQ ID NO: 134221 - DNA, 20 bp, Artificial Sequence
  Description of Artificial Sequence: Synthetic oligonucleotide
  Target: ATXN1; (+) strand; PAM type: NRG; PAM sequence: TGG
cagagtttcgtacagcagcg

SEQ ID NO: 134222 - DNA, 20 bp, Artificial Sequence
  Description of Artificial Sequence: Synthetic oligonucleotide
  Target: ATXN1; (+) strand; PAM type: NRG; PAM sequence: AAG
aaattaacaacaacaaaaaa

SEQ ID NO: 134223 - DNA, 20 bp, Artificial Sequence
  Description of Artificial Sequence: Synthetic oligonucleotide
  Target: ATXN1; (+) strand; PAM type: NRG; PAM sequence: AAG
cacacacgtttcatactgca

SEQ ID NO: 134224 - DNA, 20 bp, Artificial Sequence
  Description of Artificial Sequence: Synthetic oligonucleotide
  Target: ATXN1; (+) strand; PAM type: NRG; PAM sequence: CAG
cgtttcatactgcaaagttc

SEQ ID NO: 134225 - DNA, 20 bp, Artificial Sequence
  Description of Artificial Sequence: Synthetic oligonucleotide
  Target: ATXN1; (+) strand; PAM type: NRG; PAM sequence: GAG
tttcatactgcaaagttcca

SEQ ID NO: 134226 - DNA, 20 bp, Artificial Sequence
  Description of Artificial Sequence: Synthetic oligonucleotide
  Target: ATXN1; (+) strand; PAM type: NRG; PAM sequence: TGG
atactgcaaagttccagagc

SEQ ID NO: 134227 - DNA, 20 bp, Artificial Sequence
  Description of Artificial Sequence: Synthetic oligonucleotide
  Target: ATXN1; (+) strand; PAM type: NRG; PAM sequence: GGG
tactgcaaagttccagagct

SEQ ID NO: 134228 - DNA, 20 bp, Artificial Sequence
  Description of Artificial Sequence: Synthetic oligonucleotide
  Target: ATXN1; (+) strand; PAM type: NRG; PAM sequence: TAG
catctgaaatatacgattaa

SEQ ID NO: 134229 - DNA, 20 bp, Artificial Sequence
  Description of Artificial Sequence: Synthetic oligonucleotide
  Target: ATXN1; (+) strand; PAM type: NRG; PAM sequence: GAG
tctgaaatatacgattaata

SEQ ID NO: 134230 - DNA, 20 bp, Artificial Sequence
  Description of Artificial Sequence: Synthetic oligonucleotide
  Target: ATXN1; (+) strand; PAM type: NRG; PAM sequence: TGG
gagaatgttattattaaatg

SEQ ID NO: 134231 - DNA, 20 bp, Artificial Sequence
  Description of Artificial Sequence: Synthetic oligonucleotide
  Target: ATXN1; (+) strand; PAM type: NRG; PAM sequence: AAG
atgttattattaaatgtggt

SEQ ID NO: 134232 - DNA, 20 bp, Artificial Sequence
  Description of Artificial Sequence: Synthetic oligonucleotide
  Target: ATXN1; (+) strand; PAM type: NRG; PAM sequence: AGG
tgttattattaaatgtggta

SEQ ID NO: 134233 - DNA, 20 bp, Artificial Sequence
  Description of Artificial Sequence: Synthetic oligonucleotide
  Target: ATXN1; (+) strand; PAM type: NRG; PAM sequence: CGG
ttacaaattcatctgtgaaa

SEQ ID NO: 134234 - DNA, 20 bp, Artificial Sequence
  Description of Artificial Sequence: Synthetic oligonucleotide
  Target: ATXN1; (+) strand; PAM type: NRG; PAM sequence: GGG
tacaaattcatctgtgaaac

SEQ ID NO: 134235 - DNA, 20 bp, Artificial Sequence
  Description of Artificial Sequence: Synthetic oligonucleotide
  Target: ATXN1; (+) strand; PAM type: NRG; PAM sequence: CAG
ggctaataacacctacctca

SEQ ID NO: 134236 - DNA, 20 bp, Artificial Sequence
  Description of Artificial Sequence: Synthetic oligonucleotide
  Target: ATXN1; (+) strand; PAM type: NRG; PAM sequence: AGG
gctaataacacctacctcac

SEQ ID NO: 134237 - DNA, 20 bp, Artificial Sequence
  Description of Artificial Sequence: Synthetic oligonucleotide
  Target: ATXN1; (+) strand; PAM type: NRG; PAM sequence: GGG
ctaataacacctacctcaca

SEQ ID NO: 134238 - DNA, 20 bp, Artificial Sequence
  Description of Artificial Sequence: Synthetic oligonucleotide
  Target: ATXN1; (+) strand; PAM type: NRG; PAM sequence: GAG
ctacctcacagggttgttac

SEQ ID NO: 134239 - DNA, 20 bp, Artificial Sequence
  Description of Artificial Sequence: Synthetic oligonucleotide
  Target: ATXN1; (+) strand; PAM type: NRG; PAM sequence: GAG
acctcacagggttgttacga

SEQ ID NO: 134240 - DNA, 20 bp, Artificial Sequence
  Description of Artificial Sequence: Synthetic oligonucleotide
  Target: ATXN1; (+) strand; PAM type: NRG; PAM sequence: AAG
ggttgttacgagagttaact

SEQ ID NO: 134241 - DNA, 20 bp, Artificial Sequence
  Description of Artificial Sequence: Synthetic oligonucleotide
  Target: ATXN1; (+) strand; PAM type: NRG; PAM sequence: AAG
gagagttaactaagctacat

SEQ ID NO: 134242 - DNA, 20 bp, Artificial Sequence
  Description of Artificial Sequence: Synthetic oligonucleotide
  Target: ATXN1; (+) strand; PAM type: NRG; PAM sequence: TAG
agctacataagtaaaatgtt

SEQ ID NO: 134243 - DNA, 20 bp, Artificial Sequence
  Description of Artificial Sequence: Synthetic oligonucleotide
  Target: ATXN1; (+) strand; PAM type: NRG; PAM sequence: CAG
cataagtaaaatgtttagca

SEQ ID NO: 134244 - DNA, 20 bp, Artificial Sequence
  Description of Artificial Sequence: Synthetic oligonucleotide
  Target: ATXN1; (+) strand; PAM type: NRG; PAM sequence: GAG
taagtaaaatgtttagcaca

SEQ ID NO: 134245 - DNA, 20 bp, Artificial Sequence
  Description of Artificial Sequence: Synthetic oligonucleotide
  Target: ATXN1; (+) strand; PAM type: NRG; PAM sequence: CAG
aaaatgtttagcacagagct

SEQ ID NO: 134246 - DNA, 20 bp, Artificial Sequence
  Description of Artificial Sequence: Synthetic oligonucleotide
  Target: ATXN1; (+) strand; PAM type: NRG; PAM sequence: TGG
tagcacagagctcagtatac

SEQ ID NO: 134247 - DNA, 20 bp, Artificial Sequence
  Description of Artificial Sequence: Synthetic oligonucleotide
  Target: ATXN1; (+) strand; PAM type: NRG; PAM sequence: AAG
cacagagctcagtatactgg

SEQ ID NO: 134248 - DNA, 20 bp, Artificial Sequence
  Description of Artificial Sequence: Synthetic oligonucleotide
  Target: ATXN1; (+) strand; PAM type: NRG; PAM sequence: CAG
ctccataaatattaattgta

SEQ ID NO: 134249 - DNA, 20 bp, Artificial Sequence
  Description of Artificial Sequence: Synthetic oligonucleotide
  Target: ATXN1; (+) strand; PAM type: NRG; PAM sequence: CAG
tgtacagccattatcactat

SEQ ID NO: 134250 - DNA, 20 bp, Artificial Sequence
  Description of Artificial Sequence: Synthetic oligonucleotide
  Target: ATXN1; (+) strand; PAM type: NRG; PAM sequence: TAG
attatcactatcagtattgt

SEQ ID NO: 134251 - DNA, 20 bp, Artificial Sequence
  Description of Artificial Sequence: Synthetic oligonucleotide
  Target: ATXN1; (+) strand; PAM type: NRG; PAM sequence: AGG
ttatcactatcagtattgtt

SEQ ID NO: 134252 - DNA, 20 bp, Artificial Sequence
  Description of Artificial Sequence: Synthetic oligonucleotide
  Target: ATXN1; (+) strand; PAM type: NRG; PAM sequence: GGG
tatcactatcagtattgtta

SEQ ID NO: 134253 - DNA, 20 bp, Artificial Sequence
  Description of Artificial Sequence: Synthetic oligonucleotide
  Target: ATXN1; (+) strand; PAM type: NRG; PAM sequence: AAG
tcagtattgttagggcaact

SEQ ID NO: 134254 - DNA, 20 bp, Artificial Sequence
  Description of Artificial Sequence: Synthetic oligonucleotide
  Target: ATXN1; (+) strand; PAM type: NRG; PAM sequence: TGG
taagctgaatttacaactta

SEQ ID NO: 134255 - DNA, 20 bp, Artificial Sequence
  Description of Artificial Sequence: Synthetic oligonucleotide
  Target: ATXN1; (+) strand; PAM type: NRG; PAM sequence: GGG
aagctgaatttacaacttat

SEQ ID NO: 134256 - DNA, 20 bp, Artificial Sequence
  Description of Artificial Sequence: Synthetic oligonucleotide
  Target: ATXN1; (+) strand; PAM type: NRG; PAM sequence: CAG
aacttatgggtaaaatgtaa

SEQ ID NO: 134257 - DNA, 20 bp, Artificial Sequence
  Description of Artificial Sequence: Synthetic oligonucleotide
  Target: ATXN1; (+) strand; PAM type: NRG; PAM sequence: CAG
aatgtaacagttttatttgc

SEQ ID NO: 134258 - DNA, 20 bp, Artificial Sequence
  Description of Artificial Sequence: Synthetic oligonucleotide
  Target: ATXN1; (+) strand; PAM type: NRG; PAM sequence: AAG
tgccagtatctttcatatta

SEQ ID NO: 134259 - DNA, 20 bp, Artificial Sequence
  Description of Artificial Sequence: Synthetic oligonucleotide
  Target: ATXN1; (+) strand; PAM type: NRG; PAM sequence: TAG
tttcatattaaagcattaat

SEQ ID NO: 134260 - DNA, 20 bp, Artificial Sequence
  Description of Artificial Sequence: Synthetic oligonucleotide
  Target: ATXN1; (+) strand; PAM type: NRG; PAM sequence: TAG
attaaagcattaattagcat

SEQ ID NO: 134261 - DNA, 20 bp, Artificial Sequence
  Description of Artificial Sequence: Synthetic oligonucleotide
  Target: ATXN1; (+) strand; PAM type: NRG; PAM sequence: AAG
attagcattagcatctgtgt

SEQ ID NO: 134262 - DNA, 20 bp, Artificial Sequence
  Description of Artificial Sequence: Synthetic oligonucleotide
  Target: ATXN1; (+) strand; PAM type: NRG; PAM sequence: TAG
gtgtaagaacataaaatgcc

SEQ ID NO: 134263 - DNA, 20 bp, Artificial Sequence
  Description of Artificial Sequence: Synthetic oligonucleotide
  Target: ATXN1; (+) strand; PAM type: NRG; PAM sequence: AAG
aagaacataaaatgcctaga

SEQ ID NO: 134264 - DNA, 20 bp, Artificial Sequence
  Description of Artificial Sequence: Synthetic oligonucleotide
  Target: ATXN1; (+) strand; PAM type: NRG; PAM sequence: AGG
agaacataaaatgcctagaa

SEQ ID NO: 134265 - DNA, 20 bp, Artificial Sequence
  Description of Artificial Sequence: Synthetic oligonucleotide
  Target: ATXN1; (+) strand; PAM type: NRG; PAM sequence: GAG
aacataaaatgcctagaaag

SEQ ID NO: 134266 - DNA, 20 bp, Artificial Sequence
  Description of Artificial Sequence: Synthetic oligonucleotide
  Target: ATXN1; (+) strand; PAM type: NRG; PAM sequence: CAG
aaaatgcctagaaaggagct

SEQ ID NO: 134267 - DNA, 20 bp, Artificial Sequence
  Description of Artificial Sequence: Synthetic oligonucleotide
  Target: ATXN1; (+) strand; PAM type: NRG; PAM sequence: AAG
agaaaggagctcagaaaatt

SEQ ID NO: 134268 - DNA, 20 bp, Artificial Sequence
  Description of Artificial Sequence: Synthetic oligonucleotide
  Target: ATXN1; (+) strand; PAM type: NRG; PAM sequence: AGG
gaaaggagctcagaaaatta

SEQ ID NO: 134269 - DNA, 20 bp, Artificial Sequence
  Description of Artificial Sequence: Synthetic oligonucleotide
  Target: ATXN1; (+) strand; PAM type: NRG; PAM sequence: AAG
agctcagaaaattaaggata

SEQ ID NO: 134270 - DNA, 20 bp, Artificial Sequence
  Description of Artificial Sequence: Synthetic oligonucleotide
  Target: ATXN1; (+) strand; PAM type: NRG; PAM sequence: AAG
tcagaaaattaaggataaag

SEQ ID NO: 134271 - DNA, 20 bp, Artificial Sequence
  Description of Artificial Sequence: Synthetic oligonucleotide
  Target: ATXN1; (+) strand; PAM type: NRG; PAM sequence: GAG
agaaaattaaggataaagaa

SEQ ID NO: 134272 - DNA, 20 bp, Artificial Sequence
  Description of Artificial Sequence: Synthetic oligonucleotide
  Target: ATXN1; (+) strand; PAM type: NRG; PAM sequence: AAG
agtcttatccgttgcaactg

SEQ ID NO: 134273 - DNA, 20 bp, Artificial Sequence
  Description of Artificial Sequence: Synthetic oligonucleotide
  Target: ATXN1; (+) strand; PAM type: NRG; PAM sequence: AGG
gtcttatccgttgcaactga

SEQ ID NO: 134274 - DNA, 20 bp, Artificial Sequence
  Description of Artificial Sequence: Synthetic oligonucleotide
  Target: ATXN1; (+) strand; PAM type: NRG; PAM sequence: CGG
tgaaggactaatgattgttt

SEQ ID NO: 134275 - DNA, 20 bp, Artificial Sequence
  Description of Artificial Sequence: Synthetic oligonucleotide
  Target: ATXN1; (+) strand; PAM type: NRG; PAM sequence: AAG
taatctgtgatatatgtgtg

SEQ ID NO: 134276 - DNA, 20 bp, Artificial Sequence
  Description of Artificial Sequence: Synthetic oligonucleotide
  Target: ATXN1; (+) strand; PAM type: NRG; PAM sequence: AGG
aatctgtgatatatgtgtga

SEQ ID NO: 134277 - DNA, 20 bp, Artificial Sequence
  Description of Artificial Sequence: Synthetic oligonucleotide
  Target: ATXN1; (+) strand; PAM type: NRG; PAM sequence: AAG
ctgtgatatatgtgtgaagg

SEQ ID NO: 134278 - DNA, 20 bp, Artificial Sequence
  Description of Artificial Sequence: Synthetic oligonucleotide
  Target: ATXN1; (+) strand; PAM type: NRG; PAM sequence: AAG
atatatgtgtgaaggaagca

SEQ ID NO: 134279 - DNA, 20 bp, Artificial Sequence
  Description of Artificial Sequence: Synthetic oligonucleotide
  Target: ATXN1; (+) strand; PAM type: NRG; PAM sequence: AAG
gaagcaaagcatcaacaaca

SEQ ID NO: 134280 - DNA, 20 bp, Artificial Sequence
  Description of Artificial Sequence: Synthetic oligonucleotide
  Target: ATXN1; (+) strand; PAM type: NRG; PAM sequence: AAG
ctgtacaaaaattatctatg

SEQ ID NO: 134281 - DNA, 20 bp, Artificial Sequence
  Description of Artificial Sequence: Synthetic oligonucleotide
  Target: ATXN1; (+) strand; PAM type: NRG; PAM sequence: CAG
tatctatgaagtctaaatga

SEQ ID NO: 134282 - DNA, 20 bp, Artificial Sequence
  Description of Artificial Sequence: Synthetic oligonucleotide
  Target: ATXN1; (+) strand; PAM type: NRG; PAM sequence: AAG
aactacacatatcgccattc

SEQ ID NO: 134283 - DNA, 20 bp, Artificial Sequence
  Description of Artificial Sequence: Synthetic oligonucleotide
  Target: ATXN1; (+) strand; PAM type: NRG; PAM sequence: GAG
attcaagtgctgtaaacatt

SEQ ID NO: 134284 - DNA, 20 bp, Artificial Sequence
  Description of Artificial Sequence: Synthetic oligonucleotide
  Target: ATXN1; (+) strand; PAM type: NRG; PAM sequence: AAG
taattataaatacttactgt

SEQ ID NO: 134285 - DNA, 20 bp, Artificial Sequence
  Description of Artificial Sequence: Synthetic oligonucleotide
  Target: ATXN1; (+) strand; PAM type: NRG; PAM sequence: TAG
tcttttgctaaaaaaaaaat

SEQ ID NO: 134286 - DNA, 20 bp, Artificial Sequence
  Description of Artificial Sequence: Synthetic oligonucleotide
  Target: ATXN1; (+) strand; PAM type: NRG; PAM sequence: GAG
ttttgctaaaaaaaaaatta

SEQ ID NO: 134287 - DNA, 20 bp, Artificial Sequence
  Description of Artificial Sequence: Synthetic oligonucleotide
  Target: ATXN1; (+) strand; PAM type: NRG; PAM sequence: TGG
catccacttctgttaattac

SEQ ID NO: 134288 - DNA, 20 bp, Artificial Sequence
  Description of Artificial Sequence: Synthetic oligonucleotide
  Target: ATXN1; (+) strand; PAM type: NRG; PAM sequence: CAG
cacttctgttaattactgga

SEQ ID NO: 134289 - DNA, 20 bp, Artificial Sequence
  Description of Artificial Sequence: Synthetic oligonucleotide
  Target: ATXN1; (+) strand; PAM type: NRG; PAM sequence: GAG
cttctgttaattactggaca

SEQ ID NO: 134290 - DNA, 20 bp, Artificial Sequence
  Description of Artificial Sequence: Synthetic oligonucleotide
  Target: ATXN1; (+) strand; PAM type: NRG; PAM sequence: AAG
tgacttcataaataaatact

SEQ ID NO: 134291 - DNA, 20 bp, Artificial Sequence
  Description of Artificial Sequence: Synthetic oligonucleotide
  Target: ATXN1; (+) strand; PAM type: NRG; PAM sequence: AGG
gacttcataaataaatacta

SEQ ID NO: 134292 - DNA, 20 bp, Artificial Sequence
  Description of Artificial Sequence: Synthetic oligonucleotide
  Target: ATXN1; (+) strand; PAM type: NRG; PAM sequence: TAG
ccataaaatgtctgaattaa

SEQ ID NO: 134293 - DNA, 20 bp, Artificial Sequence
  Description of Artificial Sequence: Synthetic oligonucleotide
  Target: ATXN1; (+) strand; PAM type: NRG; PAM sequence: AAG
aaaatgtctgaattaatagc

SEQ ID NO: 134294 - DNA, 20 bp, Artificial Sequence
  Description of Artificial Sequence: Synthetic oligonucleotide
  Target: ATXN1; (+) strand; PAM type: NRG; PAM sequence: TGG
tagcaagcacatttcatatg

SEQ ID NO: 134295 - DNA, 20 bp, Artificial Sequence
  Description of Artificial Sequence: Synthetic oligonucleotide
  Target: ATXN1; (+) strand; PAM type: NRG; PAM sequence: TAG
acatttcatatgtggtctat

SEQ ID NO: 134296 - DNA, 20 bp, Artificial Sequence
  Description of Artificial Sequence: Synthetic oligonucleotide
  Target: ATXN1; (+) strand; PAM type: NRG; PAM sequence: TAG
tattagatgctattctaatt

SEQ ID NO: 134297 - DNA, 20 bp, Artificial Sequence
  Description of Artificial Sequence: Synthetic oligonucleotide
  Target: ATXN1; (+) strand; PAM type: NRG; PAM sequence: CAG
gctattctaatttagaattg

SEQ ID NO: 134298 - DNA, 20 bp, Artificial Sequence
  Description of Artificial Sequence: Synthetic oligonucleotide
  Target: ATXN1; (+) strand; PAM type: NRG; PAM sequence: TAG
attgcagaaatttaatgaaa

SEQ ID NO: 134299 - DNA, 20 bp, Artificial Sequence
  Description of Artificial Sequence: Synthetic oligonucleotide
  Target: ATXN1; (+) strand; PAM type: NRG; PAM sequence: CAG
ttaatgaaatagactgcaaa

SEQ ID NO: 134300 - DNA, 20 bp, Artificial Sequence
  Description of Artificial Sequence: Synthetic oligonucleotide
  Target: ATXN1; (+) strand; PAM type: NRG; PAM sequence: AGG
taatgaaatagactgcaaac

SEQ ID NO: 134301 - DNA, 20 bp, Artificial Sequence
  Description of Artificial Sequence: Synthetic oligonucleotide
  Target: ATXN1; (+) strand; PAM type: NRG; PAM sequence: CAG
agactgcaaacaggaaaata

SEQ ID NO: 134302 - DNA, 20 bp, Artificial Sequence
  Description of Artificial Sequence: Synthetic oligonucleotide
  Target: ATXN1; (+) strand; PAM type: NRG; PAM sequence: AGG
gactgcaaacaggaaaatac

SEQ ID NO: 134303 - DNA, 20 bp, Artificial Sequence
  Description of Artificial Sequence: Synthetic oligonucleotide
  Target: ATXN1; (+) strand; PAM type: NRG; PAM sequence: AAG
gcaaacaggaaaatacaggc

SEQ ID NO: 134304 - DNA, 20 bp, Artificial Sequence
  Description of Artificial Sequence: Synthetic oligonucleotide
  Target: ATXN1; (+) strand; PAM type: NRG; PAM sequence: TGG
gactattttgcaatgcactt

SEQ ID NO: 134305 - DNA, 20 bp, Artificial Sequence
  Description of Artificial Sequence: Synthetic oligonucleotide
  Target: ATXN1; (+) strand; PAM type: NRG; PAM sequence: AAG
atgcactttggaaaaaaaat

SEQ ID NO: 134306 - DNA, 20 bp, Artificial Sequence
  Description of Artificial Sequence: Synthetic oligonucleotide
  Target: ATXN1; (+) strand; PAM type: NRG; PAM sequence: CAG
gaattgtttacaaatgctac

SEQ ID NO: 134307 - DNA, 20 bp, Artificial Sequence
  Description of Artificial Sequence: Synthetic oligonucleotide
  Target: ATXN1; (+) strand; PAM type: NRG; PAM sequence: TAG
ttacaaatgctaccagtaca

SEQ ID NO: 134308 - DNA, 20 bp, Artificial Sequence
  Description of Artificial Sequence: Synthetic oligonucleotide
  Target: ATXN1; (+) strand; PAM type: NRG; PAM sequence: CAG
gctaccagtacatagttgaa

SEQ ID NO: 134309 - DNA, 20 bp, Artificial Sequence
  Description of Artificial Sequence: Synthetic oligonucleotide
  Target: ATXN1; (+) strand; PAM type: NRG; PAM sequence: TGG
catagttgaacagaatgaac

SEQ ID NO: 134310 - DNA, 20 bp, Artificial Sequence
  Description of Artificial Sequence: Synthetic oligonucleotide
  Target: ATXN1; (+) strand; PAM type: NRG; PAM sequence: TAG
tgaacagaatgaactggtaa

SEQ ID NO: 134311 - DNA, 20 bp, Artificial Sequence
  Description of Artificial Sequence: Synthetic oligonucleotide
  Target: ATXN1; (+) strand; PAM type: NRG; PAM sequence: AAG
ctggtaatagttattttacg

SEQ ID NO: 134312 - DNA, 20 bp, Artificial Sequence
  Description of Artificial Sequence: Synthetic oligonucleotide
  Target: ATXN1; (+) strand; PAM type: NRG; PAM sequence: TGG
gttgcttttctcttgcatat

SEQ ID NO: 134313 - DNA, 20 bp, Artificial Sequence
  Description of Artificial Sequence: Synthetic oligonucleotide
  Target: ATXN1; (+) strand; PAM type: NRG; PAM sequence: TAG
caaatttaaataatgcatat

SEQ ID NO: 134314 - DNA, 20 bp, Artificial Sequence
  Description of Artificial Sequence: Synthetic oligonucleotide
  Target: ATXN1; (+) strand; PAM type: NRG; PAM sequence: GAG
aatttaaataatgcatatta

SEQ ID NO: 134315 - DNA, 20 bp, Artificial Sequence
  Description of Artificial Sequence: Synthetic oligonucleotide
  Target: ATXN1; (+) strand; PAM type: NRG; PAM sequence: AAG
atattagagttttatatatt

SEQ ID NO: 134316 - DNA, 20 bp, Artificial Sequence
  Description of Artificial Sequence: Synthetic oligonucleotide
  Target: ATXN1; (+) strand; PAM type: NRG; PAM sequence: AAG
ttaagtcctactgaaatata

SEQ ID NO: 134317 - DNA, 20 bp, Artificial Sequence
  Description of Artificial Sequence: Synthetic oligonucleotide
  Target: ATXN1; (+) strand; PAM type: NRG; PAM sequence: GAG
tactatcattattgcatttt

SEQ ID NO: 134318 - DNA, 20 bp, Artificial Sequence
  Description of Artificial Sequence: Synthetic oligonucleotide
  Target: ATXN1; (+) strand; PAM type: NRG; PAM sequence: AAG
ttcacatttatcactgataa

SEQ ID NO: 134319 - DNA, 20 bp, Artificial Sequence
  Description of Artificial Sequence: Synthetic oligonucleotide
  Target: ATXN1; (+) strand; PAM type: NRG; PAM sequence: AAG
tgataaaagataaaacccca

SEQ ID NO: 134320 - DNA, 20 bp, Artificial Sequence
  Description of Artificial Sequence: Synthetic oligonucleotide
  Target: ATXN1; (+) strand; PAM type: NRG; PAM sequence: GAG
agcaaatcatttttctgatt

SEQ ID NO: 134321 - DNA, 20 bp, Artificial Sequence
  Description of Artificial Sequence: Synthetic oligonucleotide
  Target: ATXN1; (+) strand; PAM type: NRG; PAM sequence: AGG
gcaaatcatttttctgattg

SEQ ID NO: 134322 - DNA, 20 bp, Artificial Sequence
  Description of Artificial Sequence: Synthetic oligonucleotide
  Target: ATXN1; (+) strand; PAM type: NRG; PAM sequence: CAG
ttctgattgaggcttttcct

SEQ ID NO: 134323 - DNA, 20 bp, Artificial Sequence
  Description of Artificial Sequence: Synthetic oligonucleotide
  Target: ATXN1; (+) strand; PAM type: NRG; PAM sequence: GAG
ctgattgaggcttttcctca

SEQ ID NO: 134324 - DNA, 20 bp, Artificial Sequence
  Description of Artificial Sequence: Synthetic oligonucleotide
  Target: ATXN1; (+) strand; PAM type: NRG; PAM sequence: TAG
aggcttttcctcagagatac

SEQ ID NO: 134325 - DNA, 20 bp, Artificial Sequence
  Description of Artificial Sequence: Synthetic oligonucleotide
  Target: ATXN1; (+) strand; PAM type: NRG; PAM sequence: GAG
gcttttcctcagagatacta

SEQ ID NO: 134326 - DNA, 20 bp, Artificial Sequence
  Description of Artificial Sequence: Synthetic oligonucleotide
  Target: ATXN1; (+) strand; PAM type: NRG; PAM sequence: TAG
cctcagagatactagagttg

SEQ ID NO: 134327 - DNA, 20 bp, Artificial Sequence
  Description of Artificial Sequence: Synthetic oligonucleotide
  Target: ATXN1; (+) strand; PAM type: NRG; PAM sequence: AGG
ctcagagatactagagttgt

SEQ ID NO: 134328 - DNA, 20 bp, Artificial Sequence
  Description of Artificial Sequence: Synthetic oligonucleotide
  Target: ATXN1; (+) strand; PAM type: NRG; PAM sequence: GGG
tcagagatactagagttgta

SEQ ID NO: 134329 - DNA, 20 bp, Artificial Sequence
  Description of Artificial Sequence: Synthetic oligonucleotide
  Target: ATXN1; (+) strand; PAM type: NRG; PAM sequence: GGG
cagagatactagagttgtag

SEQ ID NO: 134330 - DNA, 20 bp, Artificial Sequence
  Description of Artificial Sequence: Synthetic oligonucleotide
  Target: ATXN1; (+) strand; PAM type: NRG; PAM sequence: AAG
agatactagagttgtagggg

SEQ ID NO: 134331 - DNA, 20 bp, Artificial Sequence
  Description of Artificial Sequence: Synthetic oligonucleotide
  Target: ATXN1; (+) strand; PAM type: NRG; PAM sequence: GAG
attcttttttttttttcttt

SEQ ID NO: 134332 - DNA, 20 bp, Artificial Sequence
  Description of Artificial Sequence: Synthetic oligonucleotide
  Target: ATXN1; (+) strand; PAM type: NRG; PAM sequence: AAG
tttttttttttctttgagac

SEQ ID NO: 134333 - DNA, 20 bp, Artificial Sequence
  Description of Artificial Sequence: Synthetic oligonucleotide
  Target: ATXN1; (+) strand; PAM type: NRG; PAM sequence: CAG
caagttctcactctgtttcc

SEQ ID NO: 134334 - DNA, 20 bp, Artificial Sequence
  Description of Artificial Sequence: Synthetic oligonucleotide
  Target: ATXN1; (+) strand; PAM type: NRG; PAM sequence: AGG
aagttctcactctgtttccc

SEQ ID NO: 134335 - DNA, 20 bp, Artificial Sequence
  Description of Artificial Sequence: Synthetic oligonucleotide
  Target: ATXN1; (+) strand; PAM type: NRG; PAM sequence: TGG
tctcactctgtttcccaggt

SEQ ID NO: 134336 - DNA, 20 bp, Artificial Sequence
  Description of Artificial Sequence: Synthetic oligonucleotide
  Target: ATXN1; (+) strand; PAM type: NRG; PAM sequence: GAG
tcactctgtttcccaggttg

SEQ ID NO: 134337 - DNA, 20 bp, Artificial Sequence
  Description of Artificial Sequence: Synthetic oligonucleotide
  Target: ATXN1; (+) strand; PAM type: NRG; PAM sequence: CAG
ctgtttcccaggttggagtg

SEQ ID NO: 134338 - DNA, 20 bp, Artificial Sequence
  Description of Artificial Sequence: Synthetic oligonucleotide
  Target: ATXN1; (+) strand; PAM type: NRG; PAM sequence: TGG
tttcccaggttggagtgcag

SEQ ID NO: 134339 - DNA, 20 bp, Artificial Sequence
  Description of Artificial Sequence: Synthetic oligonucleotide
  Target: ATXN1; (+) strand; PAM type: NRG; PAM sequence: CAG
ggagtgcagtggtgtgatga

SEQ ID NO: 134340 - DNA, 20 bp, Artificial Sequence
  Description of Artificial Sequence: Synthetic oligonucleotide
  Target: ATXN1; (+) strand; PAM type: NRG; PAM sequence: CAG
ggtgtgatgacagctcactt

SEQ ID NO: 134341 - DNA, 20 bp, Artificial Sequence
  Description of Artificial Sequence: Synthetic oligonucleotide
  Target: ATXN1; (+) strand; PAM type: NRG; PAM sequence: CGG
tcacttcagcctcaacctct

SEQ ID NO: 134342 - DNA, 20 bp, Artificial Sequence
  Description of Artificial Sequence: Synthetic oligonucleotide
  Target: ATXN1; (+) strand; PAM type: NRG; PAM sequence: GGG
cacttcagcctcaacctctc

SEQ ID NO: 134343 - DNA, 20 bp, Artificial Sequence
  Description of Artificial Sequence: Synthetic oligonucleotide
  Target: ATXN1; (+) strand; PAM type: NRG; PAM sequence: CAG
cagcctcaacctctcgggct

SEQ ID NO: 134344 - DNA, 20 bp, Artificial Sequence
  Description of Artificial Sequence: Synthetic oligonucleotide
  Target: ATXN1; (+) strand; PAM type: NRG; PAM sequence: AGG
agcctcaacctctcgggctc

SEQ ID NO: 134345 - DNA, 20 bp, Artificial Sequence
  Description of Artificial Sequence: Synthetic oligonucleotide
  Target: ATXN1; (+) strand; PAM type: NRG; PAM sequence: TGG
ctcaacctctcgggctcagg

SEQ ID NO: 134346 - DNA, 20 bp, Artificial Sequence
  Description of Artificial Sequence: Synthetic oligonucleotide
  Target: ATXN1; (+) strand; PAM type: NRG; PAM sequence: CAG
ctcaggtggtcctctcacct

SEQ ID NO: 134347 - DNA, 20 bp, Artificial Sequence
  Description of Artificial Sequence: Synthetic oligonucleotide
  Target: ATXN1; (+) strand; PAM type: NRG; PAM sequence: TGG
gtcctctcacctcagcctcc

SEQ ID NO: 134348 - DNA, 20 bp, Artificial Sequence
  Description of Artificial Sequence: Synthetic oligonucleotide
  Target: ATXN1; (+) strand; PAM type: NRG; PAM sequence: GGG
tcctctcacctcagcctcct

SEQ ID NO: 134349 - DNA, 20 bp, Artificial Sequence
  Description of Artificial Sequence: Synthetic oligonucleotide
  Target: ATXN1; (+) strand; PAM type: NRG; PAM sequence: TAG
tctcacctcagcctcctggg

SEQ ID NO: 134350 - DNA, 20 bp, Artificial Sequence
  Description of Artificial Sequence: Synthetic oligonucleotide
  Target: ATXN1; (+) strand; PAM type: NRG; PAM sequence: TGG
acctcagcctcctgggtagc

SEQ ID NO: 134351 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcctgggtagct

SEQ ID NO: 134352 - DNA, 20 bp, Artificial Sequence
  Description of Artificial Sequence: Synthetic oligonucleotide
  Target: ATXN1; (+) strand; PAM type: NRG; PAM sequence: CAG
ctcctgggtagctgggacta

SEQ ID NO: 134353 - DNA, 20 bp, Artificial Sequence
  Description of Artificial Sequence: Synthetic oligonucleotide
  Target: ATXN1; (+) strand; PAM type: NRG; PAM sequence: AGG
tcctgggtagctgggactac

SEQ ID NO: 134354 - DNA, 20 bp, Artificial Sequence
  Description of Artificial Sequence: Synthetic oligonucleotide
  Target: ATXN1; (+) strand; PAM type: NRG; PAM sequence: TGG
caggcacacgccaccatgcc

SEQ ID NO: 134355 - DNA, 20 bp, Artificial Sequence
  Description of Artificial Sequence: Synthetic oligonucleotide
  Target: ATXN1; (+) strand; PAM type: NRG; PAM sequence: TAG
ttttttttttttttgaaaca

SEQ ID NO: 134356 - DNA, 20 bp, Artificial Sequence
  Description of Artificial Sequence: Synthetic oligonucleotide
  Target: ATXN1; (+) strand; PAM type: NRG; PAM sequence: CAG
atagtttcactcctgttgcc

SEQ ID NO: 134357 - DNA, 20 bp, Artificial Sequence
  Description of Artificial Sequence: Synthetic oligonucleotide
  Target: ATXN1; (+) strand; PAM type: NRG; PAM sequence: AGG
tagtttcactcctgttgccc

SEQ ID NO: 134358 - DNA, 20 bp, Artificial Sequence
  Description of Artificial Sequence: Synthetic oligonucleotide
  Target: ATXN1; (+) strand; PAM type: NRG; PAM sequence: TGG
ttcactcctgttgcccaggc

SEQ ID NO: 134359 - DNA, 20 bp, Artificial Sequence
  Description of Artificial Sequence: Synthetic oligonucleotide
  Target: ATXN1; (+) strand; PAM type: NRG; PAM sequence: GAG
cactcctgttgcccaggctg

SEQ ID NO: 134360 - DNA, 20 bp, Artificial Sequence
  Description of Artificial Sequence: Synthetic oligonucleotide
  Target: ATXN1; (+) strand; PAM type: NRG; PAM sequence: TGG
ttgcccaggctggagtgcaa

SEQ ID NO: 134361 - DNA, 20 bp, Artificial Sequence
  Description of Artificial Sequence: Synthetic oligonucleotide
  Target: ATXN1; (+) strand; PAM type: NRG; PAM sequence: CAG
tcaccataacctccgccttc

SEQ ID NO: 134362 - DNA, 20 bp, Artificial Sequence
  Description of Artificial Sequence: Synthetic oligonucleotide
  Target: ATXN1; (+) strand; PAM type: NRG; PAM sequence: AGG
caccataacctccgccttcc

SEQ ID NO: 134363 - DNA, 20 bp, Artificial Sequence
  Description of Artificial Sequence: Synthetic oligonucleotide
  Target: ATXN1; (+) strand; PAM type: NRG; PAM sequence: AAG
aacctccgccttccaggttc

SEQ ID NO: 134364 - DNA, 20 bp, Artificial Sequence
  Description of Artificial Sequence: Synthetic oligonucleotide
  Target: ATXN1; (+) strand; PAM type: NRG; PAM sequence: CAG
ttcaagcaattatcctgcct

SEQ ID NO: 134365 - DNA, 20 bp, Artificial Sequence
  Description of Artificial Sequence: Synthetic oligonucleotide
  Target: ATXN1; (+) strand; PAM type: NRG; PAM sequence: GAG
ttatcctgcctcagcctcct

SEQ ID NO: 134366 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcctgag

SEQ ID NO: 134367 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcctgagtagc

SEQ ID NO: 134368 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcctgagtagct

SEQ ID NO: 134369 - DNA, 20 bp, Artificial Sequence
  Description of Artificial Sequence: Synthetic oligonucleotide
  Target: ATXN1; (+) strand; PAM type: NRG; PAM sequence: CAG
ctcctgagtagctgggatta

SEQ ID NO: 134370 - DNA, 20 bp, Artificial Sequence
  Description of Artificial Sequence: Synthetic oligonucleotide
  Target: ATXN1; (+) strand; PAM type: NRG; PAM sequence: AGG
tcctgagtagctgggattac

SEQ ID NO: 134371 - DNA, 20 bp, Artificial Sequence
  Description of Artificial Sequence: Synthetic oligonucleotide
  Target: ATXN1; (+) strand; PAM type: NRG; PAM sequence: CAG
caggcatgcaccaccacgtc

SEQ ID NO: 134372 - DNA, 20 bp, Artificial Sequence
  Description of Artificial Sequence: Synthetic oligonucleotide
  Target: ATXN1; (+) strand; PAM type: NRG; PAM sequence: TAG
tccagctaattttgtatttt

SEQ ID NO: 134373 - DNA, 20 bp, Artificial Sequence
  Description of Artificial Sequence: Synthetic oligonucleotide
  Target: ATXN1; (+) strand; PAM type: NRG; PAM sequence: TAG
agctaattttgtatttttag

SEQ ID NO: 134374 - DNA, 20 bp, Artificial Sequence
  Description of Artificial Sequence: Synthetic oligonucleotide
  Target: ATXN1; (+) strand; PAM type: NRG; PAM sequence: GAG
ctaattttgtatttttagta

SEQ ID NO: 134375 - DNA, 20 bp, Artificial Sequence
  Description of Artificial Sequence: Synthetic oligonucleotide
  Target: ATXN1; (+) strand; PAM type: NRG; PAM sequence: TGG
ttttgtatttttagtagaga

SEQ ID NO: 134376 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtagagat

SEQ ID NO: 134377 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagatg

SEQ ID NO: 134378 - DNA, 20 bp, Artificial Sequence
  Description of Artificial Sequence: Synthetic oligonucleotide
  Target: ATXN1; (+) strand; PAM type: NRG; PAM sequence: TGG
gagatggggtttctccatgt

SEQ ID NO: 134379 - DNA, 20 bp, Artificial Sequence
  Description of Artificial Sequence: Synthetic oligonucleotide
  Target: ATXN1; (+) strand; PAM type: NRG; PAM sequence: CAG
tggggtttctccatgttggc

SEQ ID NO: 134380 - DNA, 20 bp, Artificial Sequence
  Description of Artificial Sequence: Synthetic oligonucleotide
  Target: ATXN1; (+) strand; PAM type: NRG; PAM sequence: AGG
ggggtttctccatgttggcc

SEQ ID NO: 134381 - DNA, 20 bp, Artificial Sequence
  Description of Artificial Sequence: Synthetic oligonucleotide
  Target: ATXN1; (+) strand; PAM type: NRG; PAM sequence: TGG
tttctccatgttggccagga

SEQ ID NO: 134382 - DNA, 20 bp, Artificial Sequence
  Description of Artificial Sequence: Synthetic oligonucleotide
  Target: ATXN1; (+) strand; PAM type: NRG; PAM sequence: CAG
ttggccaggatggtctcgac

SEQ ID NO: 134383 - DNA, 20 bp, Artificial Sequence
  Description of Artificial Sequence: Synthetic oligonucleotide
  Target: ATXN1; (+) strand; PAM type: NRG; PAM sequence: TGG
ggatggtctcgaccagcatg

SEQ ID NO: 134384 - DNA, 20 bp, Artificial Sequence
  Description of Artificial Sequence: Synthetic oligonucleotide
  Target: ATXN1; (+) strand; PAM type: NRG; PAM sequence: AAG
gaccagcatgtggtctccca

SEQ ID NO: 134385 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgtgatta

SEQ ID NO: 134386 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgtgattac

SEQ ID NO: 134387 - DNA, 20 bp, Artificial Sequence
  Description of Artificial Sequence: Synthetic oligonucleotide
  Target: ATXN1; (+) strand; PAM type: NRG; PAM sequence: GAG
agtgctgtgattacaggcgt

SEQ ID NO: 134388 - DNA, 20 bp, Artificial Sequence
  Description of Artificial Sequence: Synthetic oligonucleotide
  Target: ATXN1; (+) strand; PAM type: NRG; PAM sequence: TAG
caactatttttttaattttt

SEQ ID NO: 134389 - DNA, 20 bp, Artificial Sequence
  Description of Artificial Sequence: Synthetic oligonucleotide
  Target: ATXN1; (+) strand; PAM type: NRG; PAM sequence: TAG
ctatttttttaattttttag

SEQ ID NO: 134390 - DNA, 20 bp, Artificial Sequence
  Description of Artificial Sequence: Synthetic oligonucleotide
  Target: ATXN1; (+) strand; PAM type: NRG; PAM sequence: GAG
atttttttaattttttagta

SEQ ID NO: 134391 - DNA, 20 bp, Artificial Sequence
  Description of Artificial Sequence: Synthetic oligonucleotide
  Target: ATXN1; (+) strand; PAM type: NRG; PAM sequence: CAG
ttttaattttttagtagaga

SEQ ID NO: 134392 - DNA, 20 bp, Artificial Sequence
  Description of Artificial Sequence: Synthetic oligonucleotide
  Target: ATXN1; (+) strand; PAM type: NRG; PAM sequence: AGG
tttaattttttagtagagac

SEQ ID NO: 134393 - DNA, 20 bp, Artificial Sequence
  Description of Artificial Sequence: Synthetic oligonucleotide
  Target: ATXN1; (+) strand; PAM type: NRG; PAM sequence: GGG
ttaattttttagtagagaca

SEQ ID NO: 134394 - DNA, 20 bp, Artificial Sequence
  Description of Artificial Sequence: Synthetic oligonucleotide
  Target: ATXN1; (+) strand; PAM type: NRG; PAM sequence: CAG
cagggtcttgctatgtcgcc

SEQ ID NO: 134395 - DNA, 20 bp, Artificial Sequence
  Description of Artificial Sequence: Synthetic oligonucleotide
  Target: ATXN1; (+) strand; PAM type: NRG; PAM sequence: AGG
agggtcttgctatgtcgccc

SEQ ID NO: 134396 - DNA, 20 bp, Artificial Sequence
  Description of Artificial Sequence: Synthetic oligonucleotide
  Target: ATXN1; (+) strand; PAM type: NRG; PAM sequence: TGG
tcttgctatgtcgcccaggc

SEQ ID NO: 134397 - DNA, 20 bp, Artificial Sequence
  Description of Artificial Sequence: Synthetic oligonucleotide
  Target: ATXN1; (+) strand; PAM type: NRG; PAM sequence: TGG
ccaggctggactcaaactac

SEQ ID NO: 134398 - DNA, 20 bp, Artificial Sequence
  Description of Artificial Sequence: Synthetic oligonucleotide
  Target: ATXN1; (+) strand; PAM type: NRG; PAM sequence: CAG
ggactcaaactactggtctc

SEQ ID NO: 134399 - DNA, 20 bp, Artificial Sequence
  Description of Artificial Sequence: Synthetic oligonucleotide
  Target: ATXN1; (+) strand; PAM type: NRG; PAM sequence: TAG
tctccagcaatcttcccacc

SEQ ID NO: 134400 - DNA, 20 bp, Artificial Sequence
  Description of Artificial Sequence: Synthetic oligonucleotide
  Target: ATXN1; (+) strand; PAM type: NRG; PAM sequence: AGG
ctccagcaatcttcccacct

SEQ ID NO: 134401 - DNA, 20 bp, Artificial Sequence
  Description of Artificial Sequence: Synthetic oligonucleotide
  Target: ATXN1; (+) strand; PAM type: NRG; PAM sequence: AAG
cttcccacctaggcctccca

SEQ ID NO: 134402 - DNA, 20 bp, Artificial Sequence
  Description of Artificial Sequence: Synthetic oligonucleotide
  Target: ATXN1; (+) strand; PAM type: NRG; PAM sequence: TGG
acctaggcctcccaaagaac

SEQ ID NO: 134403 - DNA, 20 bp, Artificial Sequence
  Description of Artificial Sequence: Synthetic oligonucleotide
  Target: ATXN1; (+) strand; PAM type: NRG; PAM sequence: GGG
cctaggcctcccaaagaact

SEQ ID NO: 134404 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagaactgggacta

SEQ ID NO: 134405 - DNA, 20 bp, Artificial Sequence
  Description of Artificial Sequence: Synthetic oligonucleotide
  Target: ATXN1; (+) strand; PAM type: NRG; PAM sequence: AGG
tcccaaagaactgggactac

SEQ ID NO: 134406 - DNA, 20 bp, Artificial Sequence
  Description of Artificial Sequence: Synthetic oligonucleotide
  Target: ATXN1; (+) strand; PAM type: NRG; PAM sequence: GAG
agaactgggactacaggtgt

SEQ ID NO: 134407 - DNA, 20 bp, Artificial Sequence
  Description of Artificial Sequence: Synthetic oligonucleotide
  Target: ATXN1; (+) strand; PAM type: NRG; PAM sequence: CAG
gggactacaggtgtgagcca

SEQ ID NO: 134408 - DNA, 20 bp, Artificial Sequence
  Description of Artificial Sequence: Synthetic oligonucleotide
  Target: ATXN1; (+) strand; PAM type: NRG; PAM sequence: CAG
caggtgtgagccacagtgcc

SEQ ID NO: 134409 - DNA, 20 bp, Artificial Sequence
  Description of Artificial Sequence: Synthetic oligonucleotide
  Target: ATXN1; (+) strand; PAM type: NRG; PAM sequence: GAG
gtaacctattcatttaccat

SEQ ID NO: 134410 - DNA, 20 bp, Artificial Sequence
  Description of Artificial Sequence: Synthetic oligonucleotide
  Target: ATXN1; (+) strand; PAM type: NRG; PAM sequence: TGG
tgaattataattctattcca

SEQ ID NO: 134411 - DNA, 20 bp, Artificial Sequence
  Description of Artificial Sequence: Synthetic oligonucleotide
  Target: ATXN1; (+) strand; PAM type: NRG; PAM sequence: CAG
ataattctattccatggcca

SEQ ID NO: 134412 - DNA, 20 bp, Artificial Sequence
  Description of Artificial Sequence: Synthetic oligonucleotide
  Target: ATXN1; (+) strand; PAM type: NRG; PAM sequence: CAG
ccatggccacagctattgac

SEQ ID NO: 134413 - DNA, 20 bp, Artificial Sequence
  Description of Artificial Sequence: Synthetic oligonucleotide
  Target: ATXN1; (+) strand; PAM type: NRG; PAM sequence: AAG
gctattgaccagtttaccct

SEQ ID NO: 134414 - DNA, 20 bp, Artificial Sequence
  Description of Artificial Sequence: Synthetic oligonucleotide
  Target: ATXN1; (+) strand; PAM type: NRG; PAM sequence: TGG
accagtttaccctaagtata

SEQ ID NO: 134415 - DNA, 20 bp, Artificial Sequence
  Description of Artificial Sequence: Synthetic oligonucleotide
  Target: ATXN1; (+) strand; PAM type: NRG; PAM sequence: GAG
ctttgcaacataattaaaat

SEQ ID NO: 134416 - DNA, 20 bp, Artificial Sequence
  Description of Artificial Sequence: Synthetic oligonucleotide
  Target: ATXN1; (+) strand; PAM type: NRG; PAM sequence: AAG
tgcaacataattaaaatgag

SEQ ID NO: 134417 - DNA, 20 bp, Artificial Sequence
  Description of Artificial Sequence: Synthetic oligonucleotide
  Target: ATXN1; (+) strand; PAM type: NRG; PAM sequence: AGG
gcaacataattaaaatgaga

SEQ ID NO: 134418 - DNA, 20 bp, Artificial Sequence
  Description of Artificial Sequence: Synthetic oligonucleotide
  Target: ATXN1; (+) strand; PAM type: NRG; PAM sequence: TAG
acataattaaaatgagaagg

SEQ ID NO: 134419 - DNA, 20 bp, Artificial Sequence
  Description of Artificial Sequence: Synthetic oligonucleotide
  Target: ATXN1; (+) strand; PAM type: NRG; PAM sequence: TAG
attaaaatgagaaggtagaa

SEQ ID NO: 134420 - DNA, 20 bp, Artificial Sequence
  Description of Artificial Sequence: Synthetic oligonucleotide
  Target: ATXN1; (+) strand; PAM type: NRG; PAM sequence: AAG
tagaatagacaaaaccaaaa

SEQ ID NO: 134421 - DNA, 20 bp, Artificial Sequence
  Description of Artificial Sequence: Synthetic oligonucleotide
  Target: ATXN1; (+) strand; PAM type: NRG; PAM sequence: TGG
gtttgcgtcataacatctga

SEQ ID NO: 134422 - DNA, 20 bp, Artificial Sequence
  Description of Artificial Sequence: Synthetic oligonucleotide
  Target: ATXN1; (+) strand; PAM type: NRG; PAM sequence: TAG
cataacatctgatggaatct

SEQ ID NO: 134423 - DNA, 20 bp, Artificial Sequence
  Description of Artificial Sequence: Synthetic oligonucleotide
  Target: ATXN1; (+) strand; PAM type: NRG; PAM sequence: AAG
tgatggaatcttagtaatat

SEQ ID NO: 134424 - DNA, 20 bp, Artificial Sequence
  Description of Artificial Sequence: Synthetic oligonucleotide
  Target: ATXN1; (+) strand; PAM type: NRG; PAM sequence: AGG
gatggaatcttagtaatata

SEQ ID NO: 134425 - DNA, 20 bp, Artificial Sequence
  Description of Artificial Sequence: Synthetic oligonucleotide
  Target: ATXN1; (+) strand; PAM type: NRG; PAM sequence: TGG
aaattctttgttcattatgc

SEQ ID NO: 134426 - DNA, 20 bp, Artificial Sequence
  Description of Artificial Sequence: Synthetic oligonucleotide
  Target: ATXN1; (+) strand; PAM type: NRG; PAM sequence: CAG
cattatgctggtccttcaat

SEQ ID NO: 134427 - DNA, 20 bp, Artificial Sequence
  Description of Artificial Sequence: Synthetic oligonucleotide
  Target: ATXN1; (+) strand; PAM type: NRG; PAM sequence: AGG
attatgctggtccttcaatc

SEQ ID NO: 134428 - DNA, 20 bp, Artificial Sequence
  Description of Artificial Sequence: Synthetic oligonucleotide
  Target: ATXN1; (+) strand; PAM type: NRG; PAM sequence: GGG
ttatgctggtccttcaatca

SEQ ID NO: 134429 - DNA, 20 bp, Artificial Sequence
  Description of Artificial Sequence: Synthetic oligonucleotide
  Target: ATXN1; (+) strand; PAM type: NRG; PAM sequence: AAG
agggatgtcctcattcattc

SEQ ID NO: 134430 - DNA, 20 bp, Artificial Sequence
  Description of Artificial Sequence: Synthetic oligonucleotide
  Target: ATXN1; (+) strand; PAM type: NRG; PAM sequence: AAG
tcaagcattgctcttccttt

SEQ ID NO: 134431 - DNA, 20 bp, Artificial Sequence
  Description of Artificial Sequence: Synthetic oligonucleotide
  Target: ATXN1; (+) strand; PAM type: NRG; PAM sequence: CAG
attgctcttcctttaagatt

SEQ ID NO: 134432 - DNA, 20 bp, Artificial Sequence
  Description of Artificial Sequence: Synthetic oligonucleotide
  Target: ATXN1; (+) strand; PAM type: NRG; PAM sequence: TAG
taatgatctgtctccctttc

SEQ ID NO: 134433 - DNA, 20 bp, Artificial Sequence
  Description of Artificial Sequence: Synthetic oligonucleotide
  Target: ATXN1; (+) strand; PAM type: NRG; PAM sequence: GAG
tgtctccctttctagactat

SEQ ID NO: 134434 - DNA, 20 bp, Artificial Sequence
  Description of Artificial Sequence: Synthetic oligonucleotide
  Target: ATXN1; (+) strand; PAM type: NRG; PAM sequence: TAG
tttctagactatgagctcct

SEQ ID NO: 134435 - DNA, 20 bp, Artificial Sequence
  Description of Artificial Sequence: Synthetic oligonucleotide
  Target: ATXN1; (+) strand; PAM type: NRG; PAM sequence: AGG
ttctagactatgagctcctt

SEQ ID NO: 134436 - DNA, 20 bp, Artificial Sequence
  Description of Artificial Sequence: Synthetic oligonucleotide
  Target: ATXN1; (+) strand; PAM type: NRG; PAM sequence: GGG
tctagactatgagctcctta

SEQ ID NO: 134437 - DNA, 20 bp, Artificial Sequence
  Description of Artificial Sequence: Synthetic oligonucleotide
  Target: ATXN1; (+) strand; PAM type: NRG; PAM sequence: GGG
ctagactatgagctccttag

SEQ ID NO: 134438 - DNA, 20 bp, Artificial Sequence
  Description of Artificial Sequence: Synthetic oligonucleotide
  Target: ATXN1; (+) strand; PAM type: NRG; PAM sequence: CAG
tatgagctccttaggggccc

SEQ ID NO: 134439 - DNA, 20 bp, Artificial Sequence
  Description of Artificial Sequence: Synthetic oligonucleotide
  Target: ATXN1; (+) strand; PAM type: NRG; PAM sequence: GAG
agctccttaggggccccagc

SEQ ID NO: 134440 - DNA, 20 bp, Artificial Sequence
  Description of Artificial Sequence: Synthetic oligonucleotide
  Target: ATXN1; (+) strand; PAM type: NRG; PAM sequence: AGG
gctccttaggggccccagcg

SEQ ID NO: 134441 - DNA, 20 bp, Artificial Sequence
  Description of Artificial Sequence: Synthetic oligonucleotide
  Target: ATXN1; (+) strand; PAM type: NRG; PAM sequence: CAG
aaactgcacaattctttgca

SEQ ID NO: 134442 - DNA, 20 bp, Artificial Sequence
  Description of Artificial Sequence: Synthetic oligonucleotide
  Target: ATXN1; (+) strand; PAM type: NRG; PAM sequence: CAG
ctttgcacagaatatactct

SEQ ID NO: 134443 - DNA, 20 bp, Artificial Sequence
  Description of Artificial Sequence: Synthetic oligonucleotide
  Target: ATXN1; (+) strand; PAM type: NRG; PAM sequence: TGG
aatatactctcagtaaacac

SEQ ID NO: 134444 - DNA, 20 bp, Artificial Sequence
  Description of Artificial Sequence: Synthetic oligonucleotide
  Target: ATXN1; (+) strand; PAM type: NRG; PAM sequence: TGG
gtaaacactggtttgatgtg

SEQ ID NO: 134445 - DNA, 20 bp, Artificial Sequence
  Description of Artificial Sequence: Synthetic oligonucleotide
  Target: ATXN1; (+) strand; PAM type: NRG; PAM sequence: GGG
taaacactggtttgatgtgt

SEQ ID NO: 134446 - DNA, 20 bp, Artificial Sequence
  Description of Artificial Sequence: Synthetic oligonucleotide
  Target: ATXN1; (+) strand; PAM type: NRG; PAM sequence: TGG
ctttgatactcttatgacta

SEQ ID NO: 134447 - DNA, 20 bp, Artificial Sequence
  Description of Artificial Sequence: Synthetic oligonucleotide
  Target: ATXN1; (+) strand; PAM type: NRG; PAM sequence: AAG
actcttatgactatggtgaa

SEQ ID NO: 134448 - DNA, 20 bp, Artificial Sequence
  Description of Artificial Sequence: Synthetic oligonucleotide
  Target: ATXN1; (+) strand; PAM type: NRG; PAM sequence: AGG
ctcttatgactatggtgaaa

SEQ ID NO: 134449 - DNA, 20 bp, Artificial Sequence
  Description of Artificial Sequence: Synthetic oligonucleotide
  Target: ATXN1; (+) strand; PAM type: NRG; PAM sequence: AAG
ctaattgtgatttcaactta

SEQ ID NO: 134450 - DNA, 20 bp, Artificial Sequence
  Description of Artificial Sequence: Synthetic oligonucleotide
  Target: ATXN1; (+) strand; PAM type: NRG; PAM sequence: AGG
taattgtgatttcaacttaa

SEQ ID NO: 134451 - DNA, 20 bp, Artificial Sequence
  Description of Artificial Sequence: Synthetic oligonucleotide
  Target: ATXN1; (+) strand; PAM type: NRG; PAM sequence: AAG
tgatttcaacttaaaggtta

SEQ ID NO: 134452 - DNA, 20 bp, Artificial Sequence
  Description of Artificial Sequence: Synthetic oligonucleotide
  Target: ATXN1; (+) strand; PAM type: NRG; PAM sequence: TAG
gccaaaaaaaatccattttt

SEQ ID NO: 134453 - DNA, 20 bp, Artificial Sequence
  Description of Artificial Sequence: Synthetic oligonucleotide
  Target: ATXN1; (+) strand; PAM type: NRG; PAM sequence: TAG
ttttagtgaaatgaaactct

SEQ ID NO: 134454 - DNA, 20 bp, Artificial Sequence
  Description of Artificial Sequence: Synthetic oligonucleotide
  Target: ATXN1; (+) strand; PAM type: NRG; PAM sequence: CAG
actcttagcgttttcacttc

SEQ ID NO: 134455 - DNA, 20 bp, Artificial Sequence
  Description of Artificial Sequence: Synthetic oligonucleotide
  Target: ATXN1; (+) strand; PAM type: NRG; PAM sequence: CAG
gttttcacttccagatgcat

SEQ ID NO: 134456 - DNA, 20 bp, Artificial Sequence
  Description of Artificial Sequence: Synthetic oligonucleotide
  Target: ATXN1; (+) strand; PAM type: NRG; PAM sequence: AAG
gatgcatcagcattacataa

SEQ ID NO: 134457 - DNA, 20 bp, Artificial Sequence
  Description of Artificial Sequence: Synthetic oligonucleotide
  Target: ATXN1; (+) strand; PAM type: NRG; PAM sequence: TAG
gttgaaactattttaaaaaa

SEQ ID NO: 134458 - DNA, 20 bp, Artificial Sequence
  Description of Artificial Sequence: Synthetic oligonucleotide
  Target: ATXN1; (+) strand; PAM type: NRG; PAM sequence: GAG
tgctgcgcattttcctgtct

SEQ ID NO: 134459 - DNA, 20 bp, Artificial Sequence
  Description of Artificial Sequence: Synthetic oligonucleotide
  Target: ATXN1; (+) strand; PAM type: NRG; PAM sequence: TAG
gcattttcctgtctgagaat

SEQ ID NO: 134460 - DNA, 20 bp, Artificial Sequence
  Description of Artificial Sequence: Synthetic oligonucleotide
  Target: ATXN1; (+) strand; PAM type: NRG; PAM sequence: CAG
actgaaaataccaaattccc

SEQ ID NO: 134461 - DNA, 20 bp, Artificial Sequence
  Description of Artificial Sequence: Synthetic oligonucleotide
  Target: ATXN1; (+) strand; PAM type: NRG; PAM sequence: AGG
ctgaaaataccaaattcccc

SEQ ID NO: 134462 - DNA, 20 bp, Artificial Sequence
  Description of Artificial Sequence: Synthetic oligonucleotide
  Target: ATXN1; (+) strand; PAM type: NRG; PAM sequence: GGG
tgaaaataccaaattcccca

SEQ ID NO: 134463 - DNA, 20 bp, Artificial Sequence
  Description of Artificial Sequence: Synthetic oligonucleotide
  Target: ATXN1; (+) strand; PAM type: NRG; PAM sequence: GGG
gaaaataccaaattccccag

SEQ ID NO: 134464 - DNA, 20 bp, Artificial Sequence
  Description of Artificial Sequence: Synthetic oligonucleotide
  Target: ATXN1; (+) strand; PAM type: NRG; PAM sequence: TGG
ccaaattccccaggggcccc

SEQ ID NO: 134465 - DNA, 20 bp, Artificial Sequence
  Description of Artificial Sequence: Synthetic oligonucleotide
  Target: ATXN1; (+) strand; PAM type: NRG; PAM sequence: GGG
caaattccccaggggcccct

SEQ ID NO: 134466 - DNA, 20 bp, Artificial Sequence
  Description of Artificial Sequence: Synthetic oligonucleotide
  Target: ATXN1; (+) strand; PAM type: NRG; PAM sequence: AAG
aggggcccctgggtgttcta

SEQ ID NO: 134467 - DNA, 20 bp, Artificial Sequence
  Description of Artificial Sequence: Synthetic oligonucleotide
  Target: ATXN1; (+) strand; PAM type: NRG; PAM sequence: CAG
gtgttctaaagacaaatgtt

SEQ ID NO: 134468 - DNA, 20 bp, Artificial Sequence
  Description of Artificial Sequence: Synthetic oligonucleotide
  Target: ATXN1; (+) strand; PAM type: NRG; PAM sequence: TAG
tctaaagacaaatgttcagt

SEQ ID NO: 134469 - DNA, 20 bp, Artificial Sequence
  Description of Artificial Sequence: Synthetic oligonucleotide
  Target: ATXN1; (+) strand; PAM type: NRG; PAM sequence: TGG
gattccatgcactcatttaa

SEQ ID NO: 134470 - DNA, 20 bp, Artificial Sequence
  Description of Artificial Sequence: Synthetic oligonucleotide
  Target: ATXN1; (+) strand; PAM type: NRG; PAM sequence: CGG
gcactcatttaatggaaatc

SEQ ID NO: 134471 - DNA, 20 bp, Artificial Sequence
  Description of Artificial Sequence: Synthetic oligonucleotide
  Target: ATXN1; (+) strand; PAM type: NRG; PAM sequence: GAG
actcatttaatggaaatccg

SEQ ID NO: 134472 - DNA, 20 bp, Artificial Sequence
  Description of Artificial Sequence: Synthetic oligonucleotide
  Target: ATXN1; (+) strand; PAM type: NRG; PAM sequence: AAG
atttaatggaaatccggagt

SEQ ID NO: 134473 - DNA, 20 bp, Artificial Sequence
  Description of Artificial Sequence: Synthetic oligonucleotide
  Target: ATXN1; (+) strand; PAM type: NRG; PAM sequence: CAG
agactcaacctccccaccac

SEQ ID NO: 134474 - DNA, 20 bp, Artificial Sequence
  Description of Artificial Sequence: Synthetic oligonucleotide
  Target: ATXN1; (+) strand; PAM type: NRG; PAM sequence: CAG
ctgtcactcattattctgct

SEQ ID NO: 134475 - DNA, 20 bp, Artificial Sequence
  Description of Artificial Sequence: Synthetic oligonucleotide
  Target: ATXN1; (+) strand; PAM type: NRG; PAM sequence: CAG
attattctgctcagctgttt

SEQ ID NO: 134476 - DNA, 20 bp, Artificial Sequence
  Description of Artificial Sequence: Synthetic oligonucleotide
  Target: ATXN1; (+) strand; PAM type: NRG; PAM sequence: AAG
ctgctcagctgtttcagaat

SEQ ID NO: 134477 - DNA, 20 bp, Artificial Sequence
  Description of Artificial Sequence: Synthetic oligonucleotide
  Target: ATXN1; (+) strand; PAM type: NRG; PAM sequence: CGG
tcagaataagcgacgactcc

SEQ ID NO: 134478 - DNA, 20 bp, Artificial Sequence
  Description of Artificial Sequence: Synthetic oligonucleotide
  Target: ATXN1; (+) strand; PAM type: NRG; PAM sequence: GGG
cagaataagcgacgactccc

SEQ ID NO: 134479 - DNA, 20 bp, Artificial Sequence
  Description of Artificial Sequence: Synthetic oligonucleotide
  Target: ATXN1; (+) strand; PAM type: NRG; PAM sequence: GAG
gaataagcgacgactcccgg

SEQ ID NO: 134480 - DNA, 20 bp, Artificial Sequence
  Description of Artificial Sequence: Synthetic oligonucleotide
  Target: ATXN1; (+) strand; PAM type: NRG; PAM sequence: GAG
ataagcgacgactcccggga

SEQ ID NO: 134481 - DNA, 20 bp, Artificial Sequence
  Description of Artificial Sequence: Synthetic oligonucleotide
  Target: ATXN1; (+) strand; PAM type: NRG; PAM sequence: CAG
ggagagctctgcccccctcc

SEQ ID NO: 134482 - DNA, 20 bp, Artificial Sequence
  Description of Artificial Sequence: Synthetic oligonucleotide
  Target: ATXN1; (+) strand; PAM type: NRG; PAM sequence: TGG
ctctgcccccctcccagtac

SEQ ID NO: 134483 - DNA, 20 bp, Artificial Sequence
  Description of Artificial Sequence: Synthetic oligonucleotide
  Target: ATXN1; (+) strand; PAM type: NRG; PAM sequence: CAG
gcccccctcccagtactggc

SEQ ID NO: 134484 - DNA, 20 bp, Artificial Sequence
  Description of Artificial Sequence: Synthetic oligonucleotide
  Target: ATXN1; (+) strand; PAM type: NRG; PAM sequence: CAG
cccagtactggccagcactt

SEQ ID NO: 134485 - DNA, 20 bp, Artificial Sequence
  Description of Artificial Sequence: Synthetic oligonucleotide
  Target: ATXN1; (+) strand; PAM type: NRG; PAM sequence: GAG
acttcagtgatgatgaatcc

SEQ ID NO: 134486 - DNA, 20 bp, Artificial Sequence
  Description of Artificial Sequence: Synthetic oligonucleotide
  Target: ATXN1; (+) strand; PAM type: NRG; PAM sequence: CAG
tcagtgatgatgaatccgag

SEQ ID NO: 134487 - DNA, 20 bp, Artificial Sequence
  Description of Artificial Sequence: Synthetic oligonucleotide
  Target: ATXN1; (+) strand; PAM type: NRG; PAM sequence: CAG
gtgatgatgaatccgagcag

SEQ ID NO: 134488 - DNA, 20 bp, Artificial Sequence
  Description of Artificial Sequence: Synthetic oligonucleotide
  Target: ATXN1; (+) strand; PAM type: NRG; PAM sequence: GAG
gatgatgaatccgagcagca

SEQ ID NO: 134489 - DNA, 20 bp, Artificial Sequence
  Description of Artificial Sequence: Synthetic oligonucleotide
  Target: ATXN1; (+) strand; PAM type: NRG; PAM sequence: CAG
atccgagcagcagagaattt

SEQ ID NO: 134490 - DNA, 20 bp, Artificial Sequence
  Description of Artificial Sequence: Synthetic oligonucleotide
  Target: ATXN1; (+) strand; PAM type: NRG; PAM sequence: AAG
gcagagaatttcagtactca

SEQ ID NO: 134491 - DNA, 20 bp, Artificial Sequence
  Description of Artificial Sequence: Synthetic oligonucleotide
  Target: ATXN1; (+) strand; PAM type: NRG; PAM sequence: CAG
gagaatttcagtactcaaag

SEQ ID NO: 134492 - DNA, 20 bp, Artificial Sequence
  Description of Artificial Sequence: Synthetic oligonucleotide
  Target: ATXN1; (+) strand; PAM type: NRG; PAM sequence: CAG
aatttcagtactcaaagcag

SEQ ID NO: 134493 - DNA, 20 bp, Artificial Sequence
  Description of Artificial Sequence: Synthetic oligonucleotide
  Target: ATXN1; (+) strand; PAM type: NRG; PAM sequence: CAG
tactcaaagcagcagaacat

SEQ ID NO: 134494 - DNA, 20 bp, Artificial Sequence
  Description of Artificial Sequence: Synthetic oligonucleotide
  Target: ATXN1; (+) strand; PAM type: NRG; PAM sequence: TGG
ttgtcattcttattcctata

SEQ ID NO: 134495 - DNA, 20 bp, Artificial Sequence
  Description of Artificial Sequence: Synthetic oligonucleotide
  Target: ATXN1; (+) strand; PAM type: NRG; PAM sequence: GGG
tgtcattcttattcctatat

SEQ ID NO: 134496 - DNA, 20 bp, Artificial Sequence
  Description of Artificial Sequence: Synthetic oligonucleotide
  Target: ATXN1; (+) strand; PAM type: NRG; PAM sequence: AAG
atatccacctttgatttttc

SEQ ID NO: 134497 - DNA, 20 bp, Artificial Sequence
  Description of Artificial Sequence: Synthetic oligonucleotide
  Target: ATXN1; (+) strand; PAM type: NRG; PAM sequence: AAG
ttcaagatcgaacctttgaa

SEQ ID NO: 134498 - DNA, 20 bp, Artificial Sequence
  Description of Artificial Sequence: Synthetic oligonucleotide
  Target: ATXN1; (+) strand; PAM type: NRG; PAM sequence: AGG
tcaagatcgaacctttgaaa

SEQ ID NO: 134499 - DNA, 20 bp, Artificial Sequence
  Description of Artificial Sequence: Synthetic oligonucleotide
  Target: ATXN1; (+) strand; PAM type: NRG; PAM sequence: GAG
gatcgaacctttgaaaaggt

SEQ ID NO: 134500 - DNA, 20 bp, Artificial Sequence
  Description of Artificial Sequence: Synthetic oligonucleotide
  Target: ATXN1; (+) strand; PAM type: NRG; PAM sequence: AGG
atcgaacctttgaaaaggtg

SEQ ID NO: 134501 - DNA, 20 bp, Artificial Sequence
  Description of Artificial Sequence: Synthetic oligonucleotide
  Target: ATXN1; (+) strand; PAM type: NRG; PAM sequence: GGG
tcgaacctttgaaaaggtga

SEQ ID NO: 134502 - DNA, 20 bp, Artificial Sequence
  Description of Artificial Sequence: Synthetic oligonucleotide
  Target: ATXN1; (+) strand; PAM type: NRG; PAM sequence: TGG
cctttgaaaaggtgagggcc

SEQ ID NO: 134503 - DNA, 20 bp, Artificial Sequence
  Description of Artificial Sequence: Synthetic oligonucleotide
  Target: ATXN1; (+) strand; PAM type: NRG; PAM sequence: CGG
ttacatcatcacgcatatgc

SEQ ID NO: 134504 - DNA, 20 bp, Artificial Sequence
  Description of Artificial Sequence: Synthetic oligonucleotide
  Target: ATXN1; (+) strand; PAM type: NRG; PAM sequence: CAG
tgccggactcctgcctcact

SEQ ID NO: 134505 - DNA, 20 bp, Artificial Sequence
  Description of Artificial Sequence: Synthetic oligonucleotide
  Target: ATXN1; (+) strand; PAM type: NRG; PAM sequence: AAG
cggactcctgcctcactcag

SEQ ID NO: 134506 - DNA, 20 bp, Artificial Sequence
  Description of Artificial Sequence: Synthetic oligonucleotide
  Target: ATXN1; (+) strand; PAM type: NRG; PAM sequence: CAG
tcagaagaccacgtgttgct

SEQ ID NO: 134507 - DNA, 20 bp, Artificial Sequence
  Description of Artificial Sequence: Synthetic oligonucleotide
  Target: ATXN1; (+) strand; PAM type: NRG; PAM sequence: AAG
agaccacgtgttgctcagaa

SEQ ID NO: 134508 - DNA, 20 bp, Artificial Sequence
  Description of Artificial Sequence: Synthetic oligonucleotide
  Target: ATXN1; (+) strand; PAM type: NRG; PAM sequence: AAG
cacgtgttgctcagaaaaga

SEQ ID NO: 134509 - DNA, 20 bp, Artificial Sequence
  Description of Artificial Sequence: Synthetic oligonucleotide
  Target: ATXN1; (+) strand; PAM type: NRG; PAM sequence: AGG
acgtgttgctcagaaaagaa

SEQ ID NO: 134510 - DNA, 20 bp, Artificial Sequence
  Description of Artificial Sequence: Synthetic oligonucleotide
  Target: ATXN1; (+) strand; PAM type: NRG; PAM sequence: TGG
tgttgctcagaaaagaaagg

SEQ ID NO: 134511 - DNA, 20 bp, Artificial Sequence
  Description of Artificial Sequence: Synthetic oligonucleotide
  Target: ATXN1; (+) strand; PAM type: NRG; PAM sequence: GGG
gttgctcagaaaagaaaggt

SEQ ID NO: 134512 - DNA, 20 bp, Artificial Sequence
  Description of Artificial Sequence: Synthetic oligonucleotide
  Target: ATXN1; (+) strand; PAM type: NRG; PAM sequence: AAG
aaaagaaaggtgggcaccaa

SEQ ID NO: 134513 - DNA, 20 bp, Artificial Sequence
  Description of Artificial Sequence: Synthetic oligonucleotide
  Target: ATXN1; (+) strand; PAM type: NRG; PAM sequence: CAG
aaaggtgggcaccaaaagaa

SEQ ID NO: 134514 - DNA, 20 bp, Artificial Sequence
  Description of Artificial Sequence: Synthetic oligonucleotide
  Target: ATXN1; (+) strand; PAM type: NRG; PAM sequence: AGG
aaggtgggcaccaaaagaac

SEQ ID NO: 134515 - DNA, 20 bp, Artificial Sequence
  Description of Artificial Sequence: Synthetic oligonucleotide
  Target: ATXN1; (+) strand; PAM type: NRG; PAM sequence: CAG
gtttctcataatatcctacc

SEQ ID NO: 134516 - DNA, 20 bp, Artificial Sequence
  Description of Artificial Sequence: Synthetic oligonucleotide
  Target: ATXN1; (+) strand; PAM type: NRG; PAM sequence: AGG
tttctcataatatcctaccc

SEQ ID NO: 134517 - DNA, 20 bp, Artificial Sequence
  Description of Artificial Sequence: Synthetic oligonucleotide
  Target: ATXN1; (+) strand; PAM type: NRG; PAM sequence: CAG
taatatcctacccaggccca

SEQ ID NO: 134518 - DNA, 20 bp, Artificial Sequence
  Description of Artificial Sequence: Synthetic oligonucleotide
  Target: ATXN1; (+) strand; PAM type: NRG; PAM sequence: TAG
atcctacccaggcccacagt

SEQ ID NO: 134519 - DNA, 20 bp, Artificial Sequence
  Description of Artificial Sequence: Synthetic oligonucleotide
  Target: ATXN1; (+) strand; PAM type: NRG; PAM sequence: TAG
aggcccacagttagacgtat

SEQ ID NO: 134520 - DNA, 20 bp, Artificial Sequence
  Description of Artificial Sequence: Synthetic oligonucleotide
  Target: ATXN1; (+) strand; PAM type: NRG; PAM sequence: TGG
ttagacgtattagtcactgt

SEQ ID NO: 134521 - DNA, 20 bp, Artificial Sequence
  Description of Artificial Sequence: Synthetic oligonucleotide
  Target: ATXN1; (+) strand; PAM type: NRG; PAM sequence: GGG
tagacgtattagtcactgtt

SEQ ID NO: 134522 - DNA, 20 bp, Artificial Sequence
  Description of Artificial Sequence: Synthetic oligonucleotide
  Target: ATXN1; (+) strand; PAM type: NRG; PAM sequence: TGG
cactgttgggacaatgaata

SEQ ID NO: 134523 - DNA, 20 bp, Artificial Sequence
  Description of Artificial Sequence: Synthetic oligonucleotide
  Target: ATXN1; (+) strand; PAM type: NRG; PAM sequence: GGG
actgttgggacaatgaatat

SEQ ID NO: 134524 - DNA, 20 bp, Artificial Sequence
  Description of Artificial Sequence: Synthetic oligonucleotide
  Target: ATXN1; (+) strand; PAM type: NRG; PAM sequence: AAG
acaatgaatatgggttttcc

SEQ ID NO: 134525 - DNA, 20 bp, Artificial Sequence
  Description of Artificial Sequence: Synthetic oligonucleotide
  Target: ATXN1; (+) strand; PAM type: NRG; PAM sequence: GAG
aatgaatatgggttttccaa

SEQ ID NO: 134526 - DNA, 20 bp, Artificial Sequence
  Description of Artificial Sequence: Synthetic oligonucleotide
  Target: ATXN1; (+) strand; PAM type: NRG; PAM sequence: AGG
atgaatatgggttttccaag

SEQ ID NO: 134527 - DNA, 20 bp, Artificial Sequence
  Description of Artificial Sequence: Synthetic oligonucleotide
  Target: ATXN1; (+) strand; PAM type: NRG; PAM sequence: AAG
gggttttccaagaggtgatc

SEQ ID NO: 134528 - DNA, 20 bp, Artificial Sequence
  Description of Artificial Sequence: Synthetic oligonucleotide
  Target: ATXN1; (+) strand; PAM type: NRG; PAM sequence: TGG
gtgatcaagcctttacttga

SEQ ID NO: 134529 - DNA, 20 bp, Artificial Sequence
  Description of Artificial Sequence: Synthetic oligonucleotide
  Target: ATXN1; (+) strand; PAM type: NRG; PAM sequence: AAG
ttttcttttctccacgcccc

SEQ ID NO: 134530 - DNA, 20 bp, Artificial Sequence
  Description of Artificial Sequence: Synthetic oligonucleotide
  Target: ATXN1; (+) strand; PAM type: NRG; PAM sequence: TAG
ctccacgccccaagattttc

SEQ ID NO: 134531 - DNA, 20 bp, Artificial Sequence
  Description of Artificial Sequence: Synthetic oligonucleotide
  Target: ATXN1; (+) strand; PAM type: NRG; PAM sequence: AGG
tccacgccccaagattttct

SEQ ID NO: 134532 - DNA, 20 bp, Artificial Sequence
  Description of Artificial Sequence: Synthetic oligonucleotide
  Target: ATXN1; (+) strand; PAM type: NRG; PAM sequence: TGG
cccaagattttctaggcttt

SEQ ID NO: 134533 - DNA, 20 bp, Artificial Sequence
  Description of Artificial Sequence: Synthetic oligonucleotide
  Target: ATXN1; (+) strand; PAM type: NRG; PAM sequence: TAG
aagattttctaggcttttgg

SEQ ID NO: 134534 - DNA, 20 bp, Artificial Sequence
  Description of Artificial Sequence: Synthetic oligonucleotide
  Target: ATXN1; (+) strand; PAM type: NRG; PAM sequence: AGG
agattttctaggcttttggt

SEQ ID NO: 134535 - DNA, 20 bp, Artificial Sequence
  Description of Artificial Sequence: Synthetic oligonucleotide
  Target: ATXN1; (+) strand; PAM type: NRG; PAM sequence: AAG
ttttctaggcttttggtagg

SEQ ID NO: 134536 - DNA, 20 bp, Artificial Sequence
  Description of Artificial Sequence: Synthetic oligonucleotide
  Target: ATXN1; (+) strand; PAM type: NRG; PAM sequence: CAG
ttttggtaggaagcactata

SEQ ID NO: 134537 - DNA, 20 bp, Artificial Sequence
  Description of Artificial Sequence: Synthetic oligonucleotide
  Target: ATXN1; (+) strand; PAM type: NRG; PAM sequence: AAG
ggtaggaagcactatacaga

SEQ ID NO: 134538 - DNA, 20 bp, Artificial Sequence
  Description of Artificial Sequence: Synthetic oligonucleotide
  Target: ATXN1; (+) strand; PAM type: NRG; PAM sequence: TAG
cagaaagcacccacgtctcc

SEQ ID NO: 134539 - DNA, 20 bp, Artificial Sequence
  Description of Artificial Sequence: Synthetic oligonucleotide
  Target: ATXN1; (+) strand; PAM type: NRG; PAM sequence: TGG
ctcctagctgattctgtgtc

SEQ ID NO: 134540 - DNA, 20 bp, Artificial Sequence
  Description of Artificial Sequence: Synthetic oligonucleotide
  Target: ATXN1; (+) strand; PAM type: NRG; PAM sequence: GAG
cctagctgattctgtgtctg

SEQ ID NO: 134541 - DNA, 20 bp, Artificial Sequence
  Description of Artificial Sequence: Synthetic oligonucleotide
  Target: ATXN1; (+) strand; PAM type: NRG; PAM sequence: TGG
gctgattctgtgtctggagt

SEQ ID NO: 134542 - DNA, 20 bp, Artificial Sequence
  Description of Artificial Sequence: Synthetic oligonucleotide
  Target: ATXN1; (+) strand; PAM type: NRG; PAM sequence: TGG
tgtctggagttggttccttc

SEQ ID NO: 134543 - DNA, 20 bp, Artificial Sequence
  Description of Artificial Sequence: Synthetic oligonucleotide
  Target: ATXN1; (+) strand; PAM type: NRG; PAM sequence: TGG
ctggagttggttccttctgg

SEQ ID NO: 134544 - DNA, 20 bp, Artificial Sequence
  Description of Artificial Sequence: Synthetic oligonucleotide
  Target: ATXN1; (+) strand; PAM type: NRG; PAM sequence: GGG
tggagttggttccttctggt

SEQ ID NO: 134545 - DNA, 20 bp, Artificial Sequence
  Description of Artificial Sequence: Synthetic oligonucleotide
  Target: ATXN1; (+) strand; PAM type: NRG; PAM sequence: TGG
ggttccttctggtgggttcg

SEQ ID NO: 134546 - DNA, 20 bp, Artificial Sequence
  Description of Artificial Sequence: Synthetic oligonucleotide
  Target: ATXN1; (+) strand; PAM type: NRG; PAM sequence: AAG
ttcgtggtctcgctgacttc

SEQ ID NO: 134547 - DNA, 20 bp, Artificial Sequence
  Description of Artificial Sequence: Synthetic oligonucleotide
  Target: ATXN1; (+) strand; PAM type: NRG; PAM sequence: TGG
ggtctcgctgacttcaagaa

SEQ ID NO: 134548 - DNA, 20 bp, Artificial Sequence
  Description of Artificial Sequence: Synthetic oligonucleotide
  Target: ATXN1; (+) strand; PAM type: NRG; PAM sequence: GAG
tctcgctgacttcaagaatg

SEQ ID NO: 134549 - DNA, 20 bp, Artificial Sequence
  Description of Artificial Sequence: Synthetic oligonucleotide
  Target: ATXN1; (+) strand; PAM type: NRG; PAM sequence: CGG
aatggagccgctaacctttg

SEQ ID NO: 134550 - DNA, 20 bp, Artificial Sequence
  Description of Artificial Sequence: Synthetic oligonucleotide
  Target: ATXN1; (+) strand; PAM type: NRG; PAM sequence: CAG
aacctttgcggtgactgtta

SEQ ID NO: 134551 - DNA, 20 bp, Artificial Sequence
  Description of Artificial Sequence: Synthetic oligonucleotide
  Target: ATXN1; (+) strand; PAM type: NRG; PAM sequence: AAG
ggtgactgttacagctctta

SEQ ID NO: 134552 - DNA, 20 bp, Artificial Sequence
  Description of Artificial Sequence: Synthetic oligonucleotide
  Target: ATXN1; (+) strand; PAM type: NRG; PAM sequence: TGG
actgttacagctcttaaaga

SEQ ID NO: 134553 - DNA, 20 bp, Artificial Sequence
  Description of Artificial Sequence: Synthetic oligonucleotide
  Target: ATXN1; (+) strand; PAM type: NRG; PAM sequence: CAG
tacagctcttaaagatggca

SEQ ID NO: 134554 - DNA, 20 bp, Artificial Sequence
  Description of Artificial Sequence: Synthetic oligonucleotide
  Target: ATXN1; (+) strand; PAM type: NRG; PAM sequence: AAG
taaagatggcacagacccaa

SEQ ID NO: 134555 - DNA, 20 bp, Artificial Sequence
  Description of Artificial Sequence: Synthetic oligonucleotide
  Target: ATXN1; (+) strand; PAM type: NRG; PAM sequence: CAG
cacagacccaaaagactgaa

SEQ ID NO: 134556 - DNA, 20 bp, Artificial Sequence
  Description of Artificial Sequence: Synthetic oligonucleotide
  Target: ATXN1; (+) strand; PAM type: NRG; PAM sequence: CAG
agacccaaaagactgaacag

SEQ ID NO: 134557 - DNA, 20 bp, Artificial Sequence
  Description of Artificial Sequence: Synthetic oligonucleotide
  Target: ATXN1; (+) strand; PAM type: NRG; PAM sequence: AAG
ccaaaagactgaacagcagc

SEQ ID NO: 134558 - DNA, 20 bp, Artificial Sequence
  Description of Artificial Sequence: Synthetic oligonucleotide
  Target: ATXN1; (+) strand; PAM type: NRG; PAM sequence: AAG
cagcagcaagatttatcata

SEQ ID NO: 134559 - DNA, 20 bp, Artificial Sequence
  Description of Artificial Sequence: Synthetic oligonucleotide
  Target: ATXN1; (+) strand; PAM type: NRG; PAM sequence: GAG
gcagcaagatttatcataaa

SEQ ID NO: 134560 - DNA, 20 bp, Artificial Sequence
  Description of Artificial Sequence: Synthetic oligonucleotide
  Target: ATXN1; (+) strand; PAM type: NRG; PAM sequence: AAG
agatttatcataaagagtga

SEQ ID NO: 134561 - DNA, 20 bp, Artificial Sequence
  Description of Artificial Sequence: Synthetic oligonucleotide
  Target: ATXN1; (+) strand; PAM type: NRG; PAM sequence: AAG
tcataaagagtgaaagaaca

SEQ ID NO: 134562 - DNA, 20 bp, Artificial Sequence
  Description of Artificial Sequence: Synthetic oligonucleotide
  Target: ATXN1; (+) strand; PAM type: NRG; PAM sequence: CAG
gtgaaagaacaaagcttcca

SEQ ID NO: 134563 - DNA, 20 bp, Artificial Sequence
  Description of Artificial Sequence: Synthetic oligonucleotide
  Target: ATXN1; (+) strand; PAM type: NRG; PAM sequence: TGG
aagaacaaagcttccacagc

SEQ ID NO: 134564 - DNA, 20 bp, Artificial Sequence
  Description of Artificial Sequence: Synthetic oligonucleotide
  Target: ATXN1; (+) strand; PAM type: NRG; PAM sequence: AAG
caaagcttccacagctggaa

SEQ ID NO: 134565 - DNA, 20 bp, Artificial Sequence
  Description of Artificial Sequence: Synthetic oligonucleotide
  Target: ATXN1; (+) strand; PAM type: NRG; PAM sequence: GAG
ccacagctggaaaagaatct

SEQ ID NO: 134566 - DNA, 20 bp, Artificial Sequence
  Description of Artificial Sequence: Synthetic oligonucleotide
  Target: ATXN1; (+) strand; PAM type: NRG; PAM sequence: CAG
cagctggaaaagaatctgag

SEQ ID NO: 134567 - DNA, 20 bp, Artificial Sequence
  Description of Artificial Sequence: Synthetic oligonucleotide
  Target: ATXN1; (+) strand; PAM type: NRG; PAM sequence: AGG
agctggaaaagaatctgagc

SEQ ID NO: 134568 - DNA, 20 bp, Artificial Sequence
  Description of Artificial Sequence: Synthetic oligonucleotide
  Target: ATXN1; (+) strand; PAM type: NRG; PAM sequence: TGG
agaatctgagcaggttgcac

SEQ ID NO: 134569 - DNA, 20 bp, Artificial Sequence
  Description of Artificial Sequence: Synthetic oligonucleotide
  Target: ATXN1; (+) strand; PAM type: NRG; PAM sequence: TGG
atctgagcaggttgcactgg

SEQ ID NO: 134570 - DNA, 20 bp, Artificial Sequence
  Description of Artificial Sequence: Synthetic oligonucleotide
  Target: ATXN1; (+) strand; PAM type: NRG; PAM sequence: TGG
gagcaggttgcactggtggc

SEQ ID NO: 134571 - DNA, 20 bp, Artificial Sequence
  Description of Artificial Sequence: Synthetic oligonucleotide
  Target: ATXN1; (+) strand; PAM type: NRG; PAM sequence: CGG
ggttgcactggtggctggtg

SEQ ID NO: 134572 - DNA, 20 bp, Artificial Sequence
  Description of Artificial Sequence: Synthetic oligonucleotide
  Target: ATXN1; (+) strand; PAM type: NRG; PAM sequence: GGG
gttgcactggtggctggtgc

SEQ ID NO: 134573 - DNA, 20 bp, Artificial Sequence
  Description of Artificial Sequence: Synthetic oligonucleotide
  Target: ATXN1; (+) strand; PAM type: NRG; PAM sequence: TGG
gcactggtggctggtgcggg

SEQ ID NO: 134574 - DNA, 20 bp, Artificial Sequence
  Description of Artificial Sequence: Synthetic oligonucleotide
  Target: ATXN1; (+) strand; PAM type: NRG; PAM sequence: GGG
cactggtggctggtgcgggt

SEQ ID NO: 134575 - DNA, 20 bp, Artificial Sequence
  Description of Artificial Sequence: Synthetic oligonucleotide
  Target: ATXN1; (+) strand; PAM type: NRG; PAM sequence: GGG
actggtggctggtgcgggtg

SEQ ID NO: 134576 - DNA, 20 bp, Artificial Sequence
  Description of Artificial Sequence: Synthetic oligonucleotide
  Target: ATXN1; (+) strand; PAM type: NRG; PAM sequence: GGG
ctggtggctggtgcgggtgg

SEQ ID NO: 134577 - DNA, 20 bp, Artificial Sequence
  Description of Artificial Sequence: Synthetic oligonucleotide
  Target: ATXN1; (+) strand; PAM type: NRG; PAM sequence: TGG
gtggctggtgcgggtggggg

SEQ ID NO: 134578 - DNA, 20 bp, Artificial Sequence
  Description of Artificial Sequence: Synthetic oligonucleotide
  Target: ATXN1; (+) strand; PAM type: NRG; PAM sequence: GGG
tggctggtgcgggtgggggt

SEQ ID NO: 134579 - DNA, 20 bp, Artificial Sequence
  Description of Artificial Sequence: Synthetic oligonucleotide
  Target: ATXN1; (+) strand; PAM type: NRG; PAM sequence: GGG
ggctggtgcgggtgggggtg

SEQ ID NO: 134580 - DNA, 20 bp, Artificial Sequence
  Description of Artificial Sequence: Synthetic oligonucleotide
  Target: ATXN1; (+) strand; PAM type: NRG; PAM sequence: GGG
gctggtgcgggtgggggtgg

SEQ ID NO: 134581 - DNA, 20 bp, Artificial Sequence
  Description of Artificial Sequence: Synthetic oligonucleotide
  Target: ATXN1; (+) strand; PAM type: NRG; PAM sequence: GGG
ctggtgcgggtgggggtggg

SEQ ID NO: 134582 - DNA, 20 bp, Artificial Sequence
  Description of Artificial Sequence: Synthetic oligonucleotide
  Target: ATXN1; (+) strand; PAM type: NRG; PAM sequence: TGG
tgcgggtgggggtggggggt

SEQ ID NO: 134583 - DNA, 20 bp, Artificial Sequence
  Description of Artificial Sequence: Synthetic oligonucleotide
  Target: ATXN1; (+) strand; PAM type: NRG; PAM sequence: GGG
gcgggtgggggtggggggtt

SEQ ID NO: 134584 - DNA, 20 bp, Artificial Sequence
  Description of Artificial Sequence: Synthetic oligonucleotide
  Target: ATXN1; (+) strand; PAM type: NRG; PAM sequence: GGG
cgggtgggggtggggggttg

SEQ ID NO: 134585 - DNA, 20 bp, Artificial Sequence
  Description of Artificial Sequence: Synthetic oligonucleotide
  Target: ATXN1; (+) strand; PAM type: NRG; PAM sequence: GGG
gggtgggggtggggggttgg

SEQ ID NO: 134586 - DNA, 20 bp, Artificial Sequence
  Description of Artificial Sequence: Synthetic oligonucleotide
  Target: ATXN1; (+) strand; PAM type: NRG; PAM sequence: GGG
ggtgggggtggggggttggg

SEQ ID NO: 134587 - DNA, 20 bp, Artificial Sequence
  Description of Artificial Sequence: Synthetic oligonucleotide
  Target: ATXN1; (+) strand; PAM type: NRG; PAM sequence: GGG
gtgggggtggggggttgggg

SEQ ID NO: 134588 - DNA, 20 bp, Artificial Sequence
  Description of Artificial Sequence: Synthetic oligonucleotide
  Target: ATXN1; (+) strand; PAM type: NRG; PAM sequence: GGG
tgggggtggggggttggggg

SEQ ID NO: 134589 - DNA, 20 bp, Artificial Sequence
  Description of Artificial Sequence: Synthetic oligonucleotide
  Target: ATXN1; (+) strand; PAM type: NRG; PAM sequence: CAG
gggtggggggttgggggggg

SEQ ID NO: 134590 - DNA, 20 bp, Artificial Sequence
  Description of Artificial Sequence: Synthetic oligonucleotide
  Target: ATXN1; (+) strand; PAM type: NRG; PAM sequence: CAG
atgtcctgtttctgtcctat

SEQ ID NO: 134591 - DNA, 20 bp, Artificial Sequence
  Description of Artificial Sequence: Synthetic oligonucleotide
  Target: ATXN1; (+) strand; PAM type: NRG; PAM sequence: TGG
ttctcaatcctccccatgat

SEQ ID NO: 134592 - DNA, 20 bp, Artificial Sequence
  Description of Artificial Sequence: Synthetic oligonucleotide
  Target: ATXN1; (+) strand; PAM type: NRG; PAM sequence: TAG
tccccatgattggttacttt

SEQ ID NO: 134593 - DNA, 20 bp, Artificial Sequence
  Description of Artificial Sequence: Synthetic oligonucleotide
  Target: ATXN1; (+) strand; PAM type: NRG; PAM sequence: TGG
acttttagaaccctgctgat

SEQ ID NO: 134594 - DNA, 20 bp, Artificial Sequence
  Description of Artificial Sequence: Synthetic oligonucleotide
  Target: ATXN1; (+) strand; PAM type: NRG; PAM sequence: AAG
gctgattggtccattttaca

SEQ ID NO: 134595 - DNA, 20 bp, Artificial Sequence
  Description of Artificial Sequence: Synthetic oligonucleotide
  Target: ATXN1; (+) strand; PAM type: NRG; PAM sequence: TGG
ccattttacaaagtactgat

SEQ ID NO: 134596 - DNA, 20 bp, Artificial Sequence
  Description of Artificial Sequence: Synthetic oligonucleotide
  Target: ATXN1; (+) strand; PAM type: NRG; PAM sequence: TAG
gcattttacaaatctcttgc

SEQ ID NO: 134597 - DNA, 20 bp, Artificial Sequence
  Description of Artificial Sequence: Synthetic oligonucleotide
  Target: ATXN1; (+) strand; PAM type: NRG; PAM sequence: CAG
tacaaatctcttgctagcta

SEQ ID NO: 134598 - DNA, 20 bp, Artificial Sequence
  Description of Artificial Sequence: Synthetic oligonucleotide
  Target: ATXN1; (+) strand; PAM type: NRG; PAM sequence: GAG
caaatctcttgctagctaca

SEQ ID NO: 134599 - DNA, 20 bp, Artificial Sequence
  Description of Artificial Sequence: Synthetic oligonucleotide
  Target: ATXN1; (+) strand; PAM type: NRG; PAM sequence: TGG
gctagctacagagcactgac

SEQ ID NO: 134600 - DNA, 20 bp, Artificial Sequence
  Description of Artificial Sequence: Synthetic oligonucleotide
  Target: ATXN1; (+) strand; PAM type: NRG; PAM sequence: CAG
cactgactggtgcattttta

SEQ ID NO: 134601 - DNA, 20 bp, Artificial Sequence
  Description of Artificial Sequence: Synthetic oligonucleotide
  Target: ATXN1; (+) strand; PAM type: NRG; PAM sequence: GAG
ctgactggtgcatttttaca

SEQ ID NO: 134602 - DNA, 20 bp, Artificial Sequence
  Description of Artificial Sequence: Synthetic oligonucleotide
  Target: ATXN1; (+) strand; PAM type: NRG; PAM sequence: TGG
catttttacagagcactgat

SEQ ID NO: 134603 - DNA, 20 bp, Artificial Sequence
  Description of Artificial Sequence: Synthetic oligonucleotide
  Target: ATXN1; (+) strand; PAM type: NRG; PAM sequence: TAG
gcattttacaaacctcttgc

SEQ ID NO: 134604 - DNA, 20 bp, Artificial Sequence
  Description of Artificial Sequence: Synthetic oligonucleotide
  Target: ATXN1; (+) strand; PAM type: NRG; PAM sequence: CAG
tacaaacctcttgctagcta

SEQ ID NO: 134605 - DNA, 20 bp, Artificial Sequence
  Description of Artificial Sequence: Synthetic oligonucleotide
  Target: ATXN1; (+) strand; PAM type: NRG; PAM sequence: GAG
caaacctcttgctagctaca

SEQ ID NO: 134606 - DNA, 20 bp, Artificial Sequence
  Description of Artificial Sequence: Synthetic oligonucleotide
  Target: ATXN1; (+) strand; PAM type: NRG; PAM sequence: TGG
gctgcattttataataccct

SEQ ID NO: 134607 - DNA, 20 bp, Artificial Sequence
  Description of Artificial Sequence: Synthetic oligonucleotide
  Target: ATXN1; (+) strand; PAM type: NRG; PAM sequence: AAG
gcattttataatacccttgg

SEQ ID NO: 134608 - DNA, 20 bp, Artificial Sequence
  Description of Artificial Sequence: Synthetic oligonucleotide
  Target: ATXN1; (+) strand; PAM type: NRG; PAM sequence: CAG
tttataatacccttggaaga

SEQ ID NO: 134609 - DNA, 20 bp, Artificial Sequence
  Description of Artificial Sequence: Synthetic oligonucleotide
  Target: ATXN1; (+) strand; PAM type: NRG; PAM sequence: AAG
aatacccttggaagacagaa

SEQ ID NO: 134610 - DNA, 20 bp, Artificial Sequence
  Description of Artificial Sequence: Synthetic oligonucleotide
  Target: ATXN1; (+) strand; PAM type: NRG; PAM sequence: AAG
ggaagacagaaaagttctcc

SEQ ID NO: 134611 - DNA, 20 bp, Artificial Sequence
  Description of Artificial Sequence: Synthetic oligonucleotide
  Target: ATXN1; (+) strand; PAM type: NRG; PAM sequence: CAG
ctccaagtccccactcgacc

SEQ ID NO: 134612 - DNA, 20 bp, Artificial Sequence
  Description of Artificial Sequence: Synthetic oligonucleotide
  Target: ATXN1; (+) strand; PAM type: NRG; PAM sequence: AGG
tccaagtccccactcgaccc

SEQ ID NO: 134613 - DNA, 20 bp, Artificial Sequence
  Description of Artificial Sequence: Synthetic oligonucleotide
  Target: ATXN1; (+) strand; PAM type: NRG; PAM sequence: AAG
aagtccccactcgacccagg

SEQ ID NO: 134614 - DNA, 20 bp, Artificial Sequence
  Description of Artificial Sequence: Synthetic oligonucleotide
  Target: ATXN1; (+) strand; PAM type: NRG; PAM sequence: CAG
cccactcgacccaggaagtc

SEQ ID NO: 134615 - DNA, 20 bp, Artificial Sequence
  Description of Artificial Sequence: Synthetic oligonucleotide
  Target: ATXN1; (+) strand; PAM type: NRG; PAM sequence: TGG
ctcgacccaggaagtccagc

SEQ ID NO: 134616 - DNA, 20 bp, Artificial Sequence
  Description of Artificial Sequence: Synthetic oligonucleotide
  Target: ATXN1; (+) strand; PAM type: NRG; PAM sequence: CAG
cttcacctctcaattccact

SEQ ID NO: 134617 - DNA, 20 bp, Artificial Sequence
  Description of Artificial Sequence: Synthetic oligonucleotide
  Target: ATXN1; (+) strand; PAM type: NRG; PAM sequence: TAG
cacctctcaattccactcag

SEQ ID NO: 134618 - DNA, 20 bp, Artificial Sequence
  Description of Artificial Sequence: Synthetic oligonucleotide
  Target: ATXN1; (+) strand; PAM type: NRG; PAM sequence: CAG
ttccactcagtagttactgt

SEQ ID NO: 134619 - DNA, 20 bp, Artificial Sequence
  Description of Artificial Sequence: Synthetic oligonucleotide
  Target: ATXN1; (+) strand; PAM type: NRG; PAM sequence: AAG
ccctaaaacctccaccactc

SEQ ID NO: 134620 - DNA, 20 bp, Artificial Sequence
  Description of Artificial Sequence: Synthetic oligonucleotide
  Target: ATXN1; (+) strand; PAM type: NRG; PAM sequence: AGG
cctaaaacctccaccactca

SEQ ID NO: 134621 - DNA, 20 bp, Artificial Sequence
  Description of Artificial Sequence: Synthetic oligonucleotide
  Target: ATXN1; (+) strand; PAM type: NRG; PAM sequence: GAG
taaaacctccaccactcaag

SEQ ID NO: 134622 - DNA, 20 bp, Artificial Sequence
  Description of Artificial Sequence: Synthetic oligonucleotide
  Target: ATXN1; (+) strand; PAM type: NRG; PAM sequence: CAG
cactcaaggagcgacactgt

SEQ ID NO: 134623 - DNA, 20 bp, Artificial Sequence
  Description of Artificial Sequence: Synthetic oligonucleotide
  Target: ATXN1; (+) strand; PAM type: NRG; PAM sequence: AAG
tcaaggagcgacactgtcag

SEQ ID NO: 134624 - DNA, 20 bp, Artificial Sequence
  Description of Artificial Sequence: Synthetic oligonucleotide
  Target: ATXN1; (+) strand; PAM type: NRG; PAM sequence: CAG
aggagcgacactgtcagaag

SEQ ID NO: 134625 - DNA, 20 bp, Artificial Sequence
  Description of Artificial Sequence: Synthetic oligonucleotide
  Target: ATXN1; (+) strand; PAM type: NRG; PAM sequence: AAG
aattactcctgtgtgatctc

SEQ ID NO: 134626 - DNA, 20 bp, Artificial Sequence
  Description of Artificial Sequence: Synthetic oligonucleotide
  Target: ATXN1; (+) strand; PAM type: NRG; PAM sequence: TGG
gtgatctcaagccccctccc

SEQ ID NO: 134627 - DNA, 20 bp, Artificial Sequence
  Description of Artificial Sequence: Synthetic oligonucleotide
  Target: ATXN1; (+) strand; PAM type: NRG; PAM sequence: GGG
tgatctcaagccccctccct

SEQ ID NO: 134628 - DNA, 20 bp, Artificial Sequence
  Description of Artificial Sequence: Synthetic oligonucleotide
  Target: ATXN1; (+) strand; PAM type: NRG; PAM sequence: GGG
gatctcaagccccctccctg

SEQ ID NO: 134629 - DNA, 20 bp, Artificial Sequence
  Description of Artificial Sequence: Synthetic oligonucleotide
  Target: ATXN1; (+) strand; PAM type: NRG; PAM sequence: TGG
agccccctccctggggacta

SEQ ID NO: 134630 - DNA, 20 bp, Artificial Sequence
  Description of Artificial Sequence: Synthetic oligonucleotide
  Target: ATXN1; (+) strand; PAM type: NRG; PAM sequence: AAG
ccctccctggggactatgga

SEQ ID NO: 134631 - DNA, 20 bp, Artificial Sequence
  Description of Artificial Sequence: Synthetic oligonucleotide
  Target: ATXN1; (+) strand; PAM type: NRG; PAM sequence: GAG
ctccctggggactatggaaa

SEQ ID NO: 134632 - DNA, 20 bp, Artificial Sequence
  Description of Artificial Sequence: Synthetic oligonucleotide
  Target: ATXN1; (+) strand; PAM type: NRG; PAM sequence: TAG
ggactatggaaagagaatgt

SEQ ID NO: 134633 - DNA, 20 bp, Artificial Sequence
  Description of Artificial Sequence: Synthetic oligonucleotide
  Target: ATXN1; (+) strand; PAM type: NRG; PAM sequence: AGG
gactatggaaagagaatgtt

SEQ ID NO: 134634 - DNA, 20 bp, Artificial Sequence
  Description of Artificial Sequence: Synthetic oligonucleotide
  Target: ATXN1; (+) strand; PAM type: NRG; PAM sequence: TAG
ggaaagagaatgttaggaaa

SEQ ID NO: 134635 - DNA, 20 bp, Artificial Sequence
  Description of Artificial Sequence: Synthetic oligonucleotide
  Target: ATXN1; (+) strand; PAM type: NRG; PAM sequence: GAG
aaagagaatgttaggaaata

SEQ ID NO: 134636 - DNA, 20 bp, Artificial Sequence
  Description of Artificial Sequence: Synthetic oligonucleotide
  Target: ATXN1; (+) strand; PAM type: NRG; PAM sequence: TGG
agaatgttaggaaatagaga

SEQ ID NO: 134637 - DNA, 20 bp, Artificial Sequence
  Description of Artificial Sequence: Synthetic oligonucleotide
  Target: ATXN1; (+) strand; PAM type: NRG; PAM sequence: AAG
gaaatagagatggaaaaaac

SEQ ID NO: 134638 - DNA, 20 bp, Artificial Sequence
  Description of Artificial Sequence: Synthetic oligonucleotide
  Target: ATXN1; (+) strand; PAM type: NRG; PAM sequence: AAG
gcaatgtttgtaacccacaa

SEQ ID NO: 134639 - DNA, 20 bp, Artificial Sequence
  Description of Artificial Sequence: Synthetic oligonucleotide
  Target: ATXN1; (+) strand; PAM type: NRG; PAM sequence: AAG
taacatgtacgtaacctgtg

SEQ ID NO: 134640 - DNA, 20 bp, Artificial Sequence
  Description of Artificial Sequence: Synthetic oligonucleotide
  Target: ATXN1; (+) strand; PAM type: NRG; PAM sequence: AAG
gtacgtaacctgtgaagcat

SEQ ID NO: 134641 - DNA, 20 bp, Artificial Sequence
  Description of Artificial Sequence: Synthetic oligonucleotide
  Target: ATXN1; (+) strand; PAM type: NRG; PAM sequence: CAG
aagcataagaataaaatgaa

SEQ ID NO: 134642 - DNA, 20 bp, Artificial Sequence
  Description of Artificial Sequence: Synthetic oligonucleotide
  Target: ATXN1; (+) strand; PAM type: NRG; PAM sequence: AGG
agcataagaataaaatgaac

SEQ ID NO: 134643 - DNA, 20 bp, Artificial Sequence
  Description of Artificial Sequence: Synthetic oligonucleotide
  Target: ATXN1; (+) strand; PAM type: NRG; PAM sequence: GAG
atacaccgaccaccctattt

SEQ ID NO: 134644 - DNA, 20 bp, Artificial Sequence
  Description of Artificial Sequence: Synthetic oligonucleotide
  Target: ATXN1; (+) strand; PAM type: NRG; PAM sequence: TAG
cgaccaccctatttgagaac

SEQ ID NO: 134645 - DNA, 20 bp, Artificial Sequence
  Description of Artificial Sequence: Synthetic oligonucleotide
  Target: ATXN1; (+) strand; PAM type: NRG; PAM sequence: TAG
ctatttgagaactagacatt

SEQ ID NO: 134646 - DNA, 20 bp, Artificial Sequence
  Description of Artificial Sequence: Synthetic oligonucleotide
  Target: ATXN1; (+) strand; PAM type: NRG; PAM sequence: AGG
tatttgagaactagacattt

SEQ ID NO: 134647 - DNA, 20 bp, Artificial Sequence
  Description of Artificial Sequence: Synthetic oligonucleotide
  Target: ATXN1; (+) strand; PAM type: NRG; PAM sequence: GGG
atttgagaactagacattta

SEQ ID NO: 134648 - DNA, 20 bp, Artificial Sequence
  Description of Artificial Sequence: Synthetic oligonucleotide
  Target: ATXN1; (+) strand; PAM type: NRG; PAM sequence: GGG
tttgagaactagacatttag

SEQ ID NO: 134649 - DNA, 20 bp, Artificial Sequence
  Description of Artificial Sequence: Synthetic oligonucleotide
  Target: ATXN1; (+) strand; PAM type: NRG; PAM sequence: AAG
tacctatttgctatttccct

SEQ ID NO: 134650 - DNA, 20 bp, Artificial Sequence
  Description of Artificial Sequence: Synthetic oligonucleotide
  Target: ATXN1; (+) strand; PAM type: NRG; PAM sequence: CAG
ccatcctcctgccttctctc

SEQ ID NO: 134651 - DNA, 20 bp, Artificial Sequence
  Description of Artificial Sequence: Synthetic oligonucleotide
  Target: ATXN1; (+) strand; PAM type: NRG; PAM sequence: AGG
catcctcctgccttctctcc

SEQ ID NO: 134652 - DNA, 20 bp, Artificial Sequence
  Description of Artificial Sequence: Synthetic oligonucleotide
  Target: ATXN1; (+) strand; PAM type: NRG; PAM sequence: GGG
atcctcctgccttctctcca

SEQ ID NO: 134653 - DNA, 20 bp, Artificial Sequence
  Description of Artificial Sequence: Synthetic oligonucleotide
  Target: ATXN1; (+) strand; PAM type: NRG; PAM sequence: GGG
tcctcctgccttctctccag

SEQ ID NO: 134654 - DNA, 20 bp, Artificial Sequence
  Description of Artificial Sequence: Synthetic oligonucleotide
  Target: ATXN1; (+) strand; PAM type: NRG; PAM sequence: TAG
ctatcactctctaaaataca

SEQ ID NO: 134655 - DNA, 20 bp, Artificial Sequence
  Description of Artificial Sequence: Synthetic oligonucleotide
  Target: ATXN1; (+) strand; PAM type: NRG; PAM sequence: TAG
taatactatcatactgtata

SEQ ID NO: 134656 - DNA, 20 bp, Artificial Sequence
  Description of Artificial Sequence: Synthetic oligonucleotide
  Target: ATXN1; (+) strand; PAM type: NRG; PAM sequence: TAG
tgtatatagtcttttgtgac

SEQ ID NO: 134657 - DNA, 20 bp, Artificial Sequence
  Description of Artificial Sequence: Synthetic oligonucleotide
  Target: ATXN1; (+) strand; PAM type: NRG; PAM sequence: AAG
tttcacacaatattgtttct

SEQ ID NO: 134658 - DNA, 20 bp, Artificial Sequence
  Description of Artificial Sequence: Synthetic oligonucleotide
  Target: ATXN1; (+) strand; PAM type: NRG; PAM sequence: TAG
acaatattgtttctaagatt

SEQ ID NO: 134659 - DNA, 20 bp, Artificial Sequence
  Description of Artificial Sequence: Synthetic oligonucleotide
  Target: ATXN1; (+) strand; PAM type: NRG; PAM sequence: CAG
aagatttagccatgttgtta

SEQ ID NO: 134660 - DNA, 20 bp, Artificial Sequence
  Description of Artificial Sequence: Synthetic oligonucleotide
  Target: ATXN1; (+) strand; PAM type: NRG; PAM sequence: AGG
agatttagccatgttgttac

SEQ ID NO: 134661 - DNA, 20 bp, Artificial Sequence
  Description of Artificial Sequence: Synthetic oligonucleotide
  Target: ATXN1; (+) strand; PAM type: NRG; PAM sequence: TAG
tttagccatgttgttacagg

SEQ ID NO: 134662 - DNA, 20 bp, Artificial Sequence
  Description of Artificial Sequence: Synthetic oligonucleotide
  Target: ATXN1; (+) strand; PAM type: NRG; PAM sequence: TAG
gttgttacaggtagctacta

SEQ ID NO: 134663 - DNA, 20 bp, Artificial Sequence
  Description of Artificial Sequence: Synthetic oligonucleotide
  Target: ATXN1; (+) strand; PAM type: NRG; PAM sequence: AAG
gtataatattccattctgtg

SEQ ID NO: 134664 - DNA, 20 bp, Artificial Sequence
  Description of Artificial Sequence: Synthetic oligonucleotide
  Target: ATXN1; (+) strand; PAM type: NRG; PAM sequence: AAG
tatatatatatatatatata

SEQ ID NO: 134665 - DNA, 20 bp, Artificial Sequence
  Description of Artificial Sequence: Synthetic oligonucleotide
  Target: ATXN1; (+) strand; PAM type: NRG; PAM sequence: AGG
atatatatatatatatataa

SEQ ID NO: 134666 - DNA, 20 bp, Artificial Sequence
  Description of Artificial Sequence: Synthetic oligonucleotide
  Target: ATXN1; (+) strand; PAM type: NRG; PAM sequence: TAG
atatatataaaggttctcaa

SEQ ID NO: 134667 - DNA, 20 bp, Artificial Sequence
  Description of Artificial Sequence: Synthetic oligonucleotide
  Target: ATXN1; (+) strand; PAM type: NRG; PAM sequence: TAG
agactaatatatatatatat

SEQ ID NO: 134668 - DNA, 20 bp, Artificial Sequence
  Description of Artificial Sequence: Synthetic oligonucleotide
  Target: ATXN1; (+) strand; PAM type: NRG; PAM sequence: TGG
aatatatatatatattagtc

SEQ ID NO: 134669 - DNA, 20 bp, Artificial Sequence
  Description of Artificial Sequence: Synthetic oligonucleotide
  Target: ATXN1; (+) strand; PAM type: NRG; PAM sequence: GAG
tatatatatatattagtctg

SEQ ID NO: 134670 - DNA, 20 bp, Artificial Sequence
  Description of Artificial Sequence: Synthetic oligonucleotide
  Target: ATXN1; (+) strand; PAM type: NRG; PAM sequence: GAG
tatatatatattagtctgga

SEQ ID NO: 134671 - DNA, 20 bp, Artificial Sequence
  Description of Artificial Sequence: Synthetic oligonucleotide
  Target: ATXN1; (+) strand; PAM type: NRG; PAM sequence: TAG
tatatattagtctggagaga

SEQ ID NO: 134672 - DNA, 20 bp, Artificial Sequence
  Description of Artificial Sequence: Synthetic oligonucleotide
  Target: ATXN1; (+) strand; PAM type: NRG; PAM sequence: AAG
atattagtctggagagatag

SEQ ID NO: 134673 - DNA, 20 bp, Artificial Sequence
  Description of Artificial Sequence: Synthetic oligonucleotide
  Target: ATXN1; (+) strand; PAM type: NRG; PAM sequence: TAG
atagaagctaatacatatat

SEQ ID NO: 134674 - DNA, 20 bp, Artificial Sequence
  Description of Artificial Sequence: Synthetic oligonucleotide
  Target: ATXN1; (+) strand; PAM type: NRG; PAM sequence: TAG
agtccaattattatacatat

SEQ ID NO: 134675 - DNA, 20 bp, Artificial Sequence
  Description of Artificial Sequence: Synthetic oligonucleotide
  Target: ATXN1; (+) strand; PAM type: NRG; PAM sequence: TAG
ttagtctaattattatatat

SEQ ID NO: 134676 - DNA, 20 bp, Artificial Sequence
  Description of Artificial Sequence: Synthetic oligonucleotide
  Target: ATXN1; (+) strand; PAM type: NRG; PAM sequence: TAG
attagactaatatatgtcta

SEQ ID NO: 134677 - DNA, 20 bp, Artificial Sequence
  Description of Artificial Sequence: Synthetic oligonucleotide
  Target: ATXN1; (+) strand; PAM type: NRG; PAM sequence: GAG
tagactaatatatgtctata

SEQ ID NO: 134678 - DNA, 20 bp, Artificial Sequence
  Description of Artificial Sequence: Synthetic oligonucleotide
  Target: ATXN1; (+) strand; PAM type: NRG; PAM sequence: TAG
ctaatatatgtctatagaga

SEQ ID NO: 134679 - DNA, 20 bp, Artificial Sequence
  Description of Artificial Sequence: Synthetic oligonucleotide
  Target: ATXN1; (+) strand; PAM type: NRG; PAM sequence: AAG
atatatgtctatagagatag

SEQ ID NO: 134680 - DNA, 20 bp, Artificial Sequence
  Description of Artificial Sequence: Synthetic oligonucleotide
  Target: ATXN1; (+) strand; PAM type: NRG; PAM sequence: TAG
atagaagctaatatacatat

SEQ ID NO: 134681 - DNA, 20 bp, Artificial Sequence
  Description of Artificial Sequence: Synthetic oligonucleotide
  Target: ATXN1; (+) strand; PAM type: NRG; PAM sequence: TAG
attagtcaaattatacatat

SEQ ID NO: 134682 - DNA, 20 bp, Artificial Sequence
  Description of Artificial Sequence: Synthetic oligonucleotide
  Target: ATXN1; (+) strand; PAM type: NRG; PAM sequence: TAG
ttagttcaattattatatat

SEQ ID NO: 134683 - DNA, 20 bp, Artificial Sequence
  Description of Artificial Sequence: Synthetic oligonucleotide
  Target: ATXN1; (+) strand; PAM type: NRG; PAM sequence: TAG
tatattagactaatatatat

SEQ ID NO: 134684 - DNA, 20 bp, Artificial Sequence
  Description of Artificial Sequence: Synthetic oligonucleotide
  Target: ATXN1; (+) strand; PAM type: NRG; PAM sequence: CAG
gactaatatatattagtcta

SEQ ID NO: 134685 - DNA, 20 bp, Artificial Sequence
  Description of Artificial Sequence: Synthetic oligonucleotide
  Target: ATXN1; (+) strand; PAM type: NRG; PAM sequence: AGG
actaatatatattagtctac

SEQ ID NO: 134686 - DNA, 20 bp, Artificial Sequence
  Description of Artificial Sequence: Synthetic oligonucleotide
  Target: ATXN1; (+) strand; PAM type: NRG; PAM sequence: GGG
ctaatatatattagtctaca

SEQ ID NO: 134687 - DNA, 20 bp, Artificial Sequence
  Description of Artificial Sequence: Synthetic oligonucleotide
  Target: ATXN1; (+) strand; PAM type: NRG; PAM sequence: TAG
tatatattagtctacaggga

SEQ ID NO: 134688 - DNA, 20 bp, Artificial Sequence
  Description of Artificial Sequence: Synthetic oligonucleotide
  Target: ATXN1; (+) strand; PAM type: NRG; PAM sequence: AAG
atattagtctacagggatag

SEQ ID NO: 134689 - DNA, 20 bp, Artificial Sequence
  Description of Artificial Sequence: Synthetic oligonucleotide
  Target: ATXN1; (+) strand; PAM type: NRG; PAM sequence: TAG
ggatagaagctaatatatat

SEQ ID NO: 134690 - DNA, 20 bp, Artificial Sequence
  Description of Artificial Sequence: Synthetic oligonucleotide
  Target: ATXN1; (+) strand; PAM type: NRG; PAM sequence: TAG
agtctaattaatatatatat

SEQ ID NO: 134691 - DNA, 20 bp, Artificial Sequence
  Description of Artificial Sequence: Synthetic oligonucleotide
  Target: ATXN1; (+) strand; PAM type: NRG; PAM sequence: TAG
ttagtctaattgtcatatat

SEQ ID NO: 134692 - DNA, 20 bp, Artificial Sequence
  Description of Artificial Sequence: Synthetic oligonucleotide
  Target: ATXN1; (+) strand; PAM type: NRG; PAM sequence: CAG
gacgacctttaaaatttttt

SEQ ID NO: 134693 - DNA, 20 bp, Artificial Sequence
  Description of Artificial Sequence: Synthetic oligonucleotide
  Target: ATXN1; (+) strand; PAM type: NRG; PAM sequence: TAG
agcttcgtttttttttctat

SEQ ID NO: 134694 - DNA, 20 bp, Artificial Sequence
  Description of Artificial Sequence: Synthetic oligonucleotide
  Target: ATXN1; (+) strand; PAM type: NRG; PAM sequence: TAG
agaaacaatgctgtgtccat

SEQ ID NO: 134695 - DNA, 20 bp, Artificial Sequence
  Description of Artificial Sequence: Synthetic oligonucleotide
  Target: ATXN1; (+) strand; PAM type: NRG; PAM sequence: AGG
gaaacaatgctgtgtccatt

SEQ ID NO: 134696 - DNA, 20 bp, Artificial Sequence
  Description of Artificial Sequence: Synthetic oligonucleotide
  Target: ATXN1; (+) strand; PAM type: NRG; PAM sequence: CAG
ccattaggaacaatacccat

SEQ ID NO: 134697 - DNA, 20 bp, Artificial Sequence
  Description of Artificial Sequence: Synthetic oligonucleotide
  Target: ATXN1; (+) strand; PAM type: NRG; PAM sequence: AAG
ggaacaatacccatcagcat

SEQ ID NO: 134698 - DNA, 20 bp, Artificial Sequence
  Description of Artificial Sequence: Synthetic oligonucleotide
  Target: ATXN1; (+) strand; PAM type: NRG; PAM sequence: TGG
cccatcagcataagtttccc

SEQ ID NO: 134699 - DNA, 20 bp, Artificial Sequence
  Description of Artificial Sequence: Synthetic oligonucleotide
  Target: ATXN1; (+) strand; PAM type: NRG; PAM sequence: GGG
ccatcagcataagtttccct

SEQ ID NO: 134700 - DNA, 20 bp, Artificial Sequence
  Description of Artificial Sequence: Synthetic oligonucleotide
  Target: ATXN1; (+) strand; PAM type: NRG; PAM sequence: TAG
agtttccctgggttattgcc

SEQ ID NO: 134701 - DNA, 20 bp, Artificial Sequence
  Description of Artificial Sequence: Synthetic oligonucleotide
  Target: ATXN1; (+) strand; PAM type: NRG; PAM sequence: AGG
gtttccctgggttattgcct

SEQ ID NO: 134702 - DNA, 20 bp, Artificial Sequence
  Description of Artificial Sequence: Synthetic oligonucleotide
  Target: ATXN1; (+) strand; PAM type: NRG; PAM sequence: TGG
cctgggttattgcctaggaa

SEQ ID NO: 134703 - DNA, 20 bp, Artificial Sequence
  Description of Artificial Sequence: Synthetic oligonucleotide
  Target: ATXN1; (+) strand; PAM type: NRG; PAM sequence: GGG
ctgggttattgcctaggaat

SEQ ID NO: 134704 - DNA, 20 bp, Artificial Sequence
  Description of Artificial Sequence: Synthetic oligonucleotide
  Target: ATXN1; (+) strand; PAM type: NRG; PAM sequence: TAG
gaatattcactgttaaacaa

SEQ ID NO: 134705 - DNA, 20 bp, Artificial Sequence
  Description of Artificial Sequence: Synthetic oligonucleotide
  Target: ATXN1; (+) strand; PAM type: NRG; PAM sequence: CAG
atatcaacctacactcccac

SEQ ID NO: 134706 - DNA, 20 bp, Artificial Sequence
  Description of Artificial Sequence: Synthetic oligonucleotide
  Target: ATXN1; (+) strand; PAM type: NRG; PAM sequence: CAG
tcaacctacactcccaccag

SEQ ID NO: 134707 - DNA, 20 bp, Artificial Sequence
  Description of Artificial Sequence: Synthetic oligonucleotide
  Target: ATXN1; (+) strand; PAM type: NRG; PAM sequence: CAG
ttaaaactgataaatcattt

SEQ ID NO: 134708 - DNA, 20 bp, Artificial Sequence
  Description of Artificial Sequence: Synthetic oligonucleotide
  Target: ATXN1; (+) strand; PAM type: NRG; PAM sequence: AAG
tgataaatcatttcagaatc

SEQ ID NO: 134709 - DNA, 20 bp, Artificial Sequence
  Description of Artificial Sequence: Synthetic oligonucleotide
  Target: ATXN1; (+) strand; PAM type: NRG; PAM sequence: AAG
aaatcatttcagaatcaaga

SEQ ID NO: 134710 - DNA, 20 bp, Artificial Sequence
  Description of Artificial Sequence: Synthetic oligonucleotide
  Target: ATXN1; (+) strand; PAM type: NRG; PAM sequence: GAG
atcatttcagaatcaagaaa

SEQ ID NO: 134711 - DNA, 20 bp, Artificial Sequence
  Description of Artificial Sequence: Synthetic oligonucleotide
  Target: ATXN1; (+) strand; PAM type: NRG; PAM sequence: AAG
aaagagatctatttgtgctg

SEQ ID NO: 134712 - DNA, 20 bp, Artificial Sequence
  Description of Artificial Sequence: Synthetic oligonucleotide
  Target: ATXN1; (+) strand; PAM type: NRG; PAM sequence: TGG
agatctatttgtgctgaagt

SEQ ID NO: 134713 - DNA, 20 bp, Artificial Sequence
  Description of Artificial Sequence: Synthetic oligonucleotide
  Target: ATXN1; (+) strand; PAM type: NRG; PAM sequence: CAG
ttgtgctgaagttggtgtta

SEQ ID NO: 134714 - DNA, 20 bp, Artificial Sequence
  Description of Artificial Sequence: Synthetic oligonucleotide
  Target: ATXN1; (+) strand; PAM type: NRG; PAM sequence: AGG
tgtgctgaagttggtgttac

SEQ ID NO: 134715 - DNA, 20 bp, Artificial Sequence
  Description of Artificial Sequence: Synthetic oligonucleotide
  Target: ATXN1; (+) strand; PAM type: NRG; PAM sequence: GAG
tttttatttatttatttttt

SEQ ID NO: 134716 - DNA, 20 bp, Artificial Sequence
  Description of Artificial Sequence: Synthetic oligonucleotide
  Target: ATXN1; (+) strand; PAM type: NRG; PAM sequence: CGG
tatttatttattttttgaga

SEQ ID NO: 134717 - DNA, 20 bp, Artificial Sequence
  Description of Artificial Sequence: Synthetic oligonucleotide
  Target: ATXN1; (+) strand; PAM type: NRG; PAM sequence: GAG
tttatttattttttgagacg

SEQ ID NO: 134718 - DNA, 20 bp, Artificial Sequence
  Description of Artificial Sequence: Synthetic oligonucleotide
  Target: ATXN1; (+) strand; PAM type: NRG; PAM sequence: CAG
acggagtctcattctgtcgc

SEQ ID NO: 134719 - DNA, 20 bp, Artificial Sequence
  Description of Artificial Sequence: Synthetic oligonucleotide
  Target: ATXN1; (+) strand; PAM type: NRG; PAM sequence: AGG
cggagtctcattctgtcgcc

SEQ ID NO: 134720 - DNA, 20 bp, Artificial Sequence
  Description of Artificial Sequence: Synthetic oligonucleotide
  Target: ATXN1; (+) strand; PAM type: NRG; PAM sequence: TGG
gtctcattctgtcgccaggc

SEQ ID NO: 134721 - DNA, 20 bp, Artificial Sequence
  Description of Artificial Sequence: Synthetic oligonucleotide
  Target: ATXN1; (+) strand; PAM type: NRG; PAM sequence: GAG
ctcattctgtcgccaggctg

SEQ ID NO: 134722 - DNA, 20 bp, Artificial Sequence
  Description of Artificial Sequence: Synthetic oligonucleotide
  Target: ATXN1; (+) strand; PAM type: NRG; PAM sequence: CAG
tctgtcgccaggctggagtg

SEQ ID NO: 134723 - DNA, 20 bp, Artificial Sequence
  Description of Artificial Sequence: Synthetic oligonucleotide
  Target: ATXN1; (+) strand; PAM type: NRG; PAM sequence: TGG
gtcgccaggctggagtgcag

SEQ ID NO: 134724 - DNA, 20 bp, Artificial Sequence
  Description of Artificial Sequence: Synthetic oligonucleotide
  Target: ATXN1; (+) strand; PAM type: NRG; PAM sequence: CGG
ggagtgcagtggcacgatct

SEQ ID NO: 134725 - DNA, 20 bp, Artificial Sequence
  Description of Artificial Sequence: Synthetic oligonucleotide
  Target: ATXN1; (+) strand; PAM type: NRG; PAM sequence: CAG
ggcacgatctcggctcacta

SEQ ID NO: 134726 - DNA, 20 bp, Artificial Sequence
  Description of Artificial Sequence: Synthetic oligonucleotide
  Target: ATXN1; (+) strand; PAM type: NRG; PAM sequence: TGG
tcactacagcctccacctcc

SEQ ID NO: 134727 - DNA, 20 bp, Artificial Sequence
  Description of Artificial Sequence: Synthetic oligonucleotide
  Target: ATXN1; (+) strand; PAM type: NRG; PAM sequence: GGG
cactacagcctccacctcct

SEQ ID NO: 134728 - DNA, 20 bp, Artificial Sequence
  Description of Artificial Sequence: Synthetic oligonucleotide
  Target: ATXN1; (+) strand; PAM type: NRG; PAM sequence: AAG
agcctccacctcctgggttc

SEQ ID NO: 134729 - DNA, 20 bp, Artificial Sequence
  Description of Artificial Sequence: Synthetic oligonucleotide
  Target: ATXN1; (+) strand; PAM type: NRG; PAM sequence: CAG
ttcaagtgattctcctgcct

SEQ ID NO: 134730 - DNA, 20 bp, Artificial Sequence
  Description of Artificial Sequence: Synthetic oligonucleotide
  Target: ATXN1; (+) strand; PAM type: NRG; PAM sequence: GAG
ttctcctgcctcagcctccc

SEQ ID NO: 134731 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccgagtatc

SEQ ID NO: 134732 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccgagtatct

SEQ ID NO: 134733 - DNA, 20 bp, Artificial Sequence
  Description of Artificial Sequence: Synthetic oligonucleotide
  Target: ATXN1; (+) strand; PAM type: NRG; PAM sequence: CAG
ctcccgagtatctgggacta

SEQ ID NO: 134734 - DNA, 20 bp, Artificial Sequence
  Description of Artificial Sequence: Synthetic oligonucleotide
  Target: ATXN1; (+) strand; PAM type: NRG; PAM sequence: AGG
tcccgagtatctgggactac

SEQ ID NO: 134735 - DNA, 20 bp, Artificial Sequence
  Description of Artificial Sequence: Synthetic oligonucleotide
  Target: ATXN1; (+) strand; PAM type: NRG; PAM sequence: TAG
ccacctaatttttgtatttt

SEQ ID NO: 134736 - DNA, 20 bp, Artificial Sequence
  Description of Artificial Sequence: Synthetic oligonucleotide
  Target: ATXN1; (+) strand; PAM type: NRG; PAM sequence: AAG
cctaatttttgtatttttag

SEQ ID NO: 134737 - DNA, 20 bp, Artificial Sequence
  Description of Artificial Sequence: Synthetic oligonucleotide
  Target: ATXN1; (+) strand; PAM type: NRG; PAM sequence: GAG
taatttttgtatttttagaa

SEQ ID NO: 134738 - DNA, 20 bp, Artificial Sequence
  Description of Artificial Sequence: Synthetic oligonucleotide
  Target: ATXN1; (+) strand; PAM type: NRG; PAM sequence: GAG
tttgtatttttagaagagac

SEQ ID NO: 134739 - DNA, 20 bp, Artificial Sequence
  Description of Artificial Sequence: Synthetic oligonucleotide
  Target: ATXN1; (+) strand; PAM type: NRG; PAM sequence: AGG
ttgtatttttagaagagacg

SEQ ID NO: 134740 - DNA, 20 bp, Artificial Sequence
  Description of Artificial Sequence: Synthetic oligonucleotide
  Target: ATXN1; (+) strand; PAM type: NRG; PAM sequence: TGG
gagacgaggtttcactatgt

SEQ ID NO: 134741 - DNA, 20 bp, Artificial Sequence
  Description of Artificial Sequence: Synthetic oligonucleotide
  Target: ATXN1; (+) strand; PAM type: NRG; PAM sequence: CAG
cgaggtttcactatgttggc

SEQ ID NO: 134742 - DNA, 20 bp, Artificial Sequence
  Description of Artificial Sequence: Synthetic oligonucleotide
  Target: ATXN1; (+) strand; PAM type: NRG; PAM sequence: AGG
gaggtttcactatgttggcc

SEQ ID NO: 134743 - DNA, 20 bp, Artificial Sequence
  Description of Artificial Sequence: Synthetic oligonucleotide
  Target: ATXN1; (+) strand; PAM type: NRG; PAM sequence: CGG
tttcactatgttggccagga

SEQ ID NO: 134744 - DNA, 20 bp, Artificial Sequence
  Description of Artificial Sequence: Synthetic oligonucleotide
  Target: ATXN1; (+) strand; PAM type: NRG; PAM sequence: TGG
ctatgttggccaggacggtc

SEQ ID NO: 134745 - DNA, 20 bp, Artificial Sequence
  Description of Artificial Sequence: Synthetic oligonucleotide
  Target: ATXN1; (+) strand; PAM type: NRG; PAM sequence: CGG
acctcgtgatccgcctgcct

SEQ ID NO: 134746 - DNA, 20 bp, Artificial Sequence
  Description of Artificial Sequence: Synthetic oligonucleotide
  Target: ATXN1; (+) strand; PAM type: NRG; PAM sequence: AAG
ccgcctgcctcggcctccca

SEQ ID NO: 134747 - DNA, 20 bp, Artificial Sequence
  Description of Artificial Sequence: Synthetic oligonucleotide
  Target: ATXN1; (+) strand; PAM type: NRG; PAM sequence: TGG
gcctcggcctcccaaagtgc

SEQ ID NO: 134748 - DNA, 20 bp, Artificial Sequence
  Description of Artificial Sequence: Synthetic oligonucleotide
  Target: ATXN1; (+) strand; PAM type: NRG; PAM sequence: GGG
cctcggcctcccaaagtgct

SEQ ID NO: 134749 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 134750 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 134751 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggcgt

SEQ ID NO: 134752 - DNA, 20 bp, Artificial Sequence
  Description of Artificial Sequence: Synthetic oligonucleotide
  Target: ATXN1; (+) strand; PAM type: NRG; PAM sequence: CAG
caggcgtgagccaccgtgcc

SEQ ID NO: 134753 - DNA, 20 bp, Artificial Sequence
  Description of Artificial Sequence: Synthetic oligonucleotide
  Target: ATXN1; (+) strand; PAM type: NRG; PAM sequence: CAG
gagccaccgtgcccagccta

SEQ ID NO: 134754 - DNA, 20 bp, Artificial Sequence
  Description of Artificial Sequence: Synthetic oligonucleotide
  Target: ATXN1; (+) strand; PAM type: NRG; PAM sequence: AGG
agccaccgtgcccagcctac

SEQ ID NO: 134755 - DNA, 20 bp, Artificial Sequence
  Description of Artificial Sequence: Synthetic oligonucleotide
  Target: ATXN1; (+) strand; PAM type: NRG; PAM sequence: AAG
tcaaattctaaatatccata

SEQ ID NO: 134756 - DNA, 20 bp, Artificial Sequence
  Description of Artificial Sequence: Synthetic oligonucleotide
  Target: ATXN1; (+) strand; PAM type: NRG; PAM sequence: AAG
ctaaatatccataaagaaat

SEQ ID NO: 134757 - DNA, 20 bp, Artificial Sequence
  Description of Artificial Sequence: Synthetic oligonucleotide
  Target: ATXN1; (+) strand; PAM type: NRG; PAM sequence: TGG
cctgtccctgtctctcacat

SEQ ID NO: 134758 - DNA, 20 bp, Artificial Sequence
  Description of Artificial Sequence: Synthetic oligonucleotide
  Target: ATXN1; (+) strand; PAM type: NRG; PAM sequence: GAG
tccctgtctctcacattggt

SEQ ID NO: 134759 - DNA, 20 bp, Artificial Sequence
  Description of Artificial Sequence: Synthetic oligonucleotide
  Target: ATXN1; (+) strand; PAM type: NRG; PAM sequence: CAG
tggtgagtttatactttgtt

SEQ ID NO: 134760 - DNA, 20 bp, Artificial Sequence
  Description of Artificial Sequence: Synthetic oligonucleotide
  Target: ATXN1; (+) strand; PAM type: NRG; PAM sequence: AAG
tttatactttgttcagcact

SEQ ID NO: 134761 - DNA, 20 bp, Artificial Sequence
  Description of Artificial Sequence: Synthetic oligonucleotide
  Target: ATXN1; (+) strand; PAM type: NRG; PAM sequence: GAG
cagcactaagcataacaaac

SEQ ID NO: 134762 - DNA, 20 bp, Artificial Sequence
  Description of Artificial Sequence: Synthetic oligonucleotide
  Target: ATXN1; (+) strand; PAM type: NRG; PAM sequence: GAG
gcactaagcataacaaacga

SEQ ID NO: 134763 - DNA, 20 bp, Artificial Sequence
  Description of Artificial Sequence: Synthetic oligonucleotide
  Target: ATXN1; (+) strand; PAM type: NRG; PAM sequence: AAG
acaaacgagagttacttcgt

SEQ ID NO: 134764 - DNA, 20 bp, Artificial Sequence
  Description of Artificial Sequence: Synthetic oligonucleotide
  Target: ATXN1; (+) strand; PAM type: NRG; PAM sequence: CGG
agagttacttcgtaagatga

SEQ ID NO: 134765 - DNA, 20 bp, Artificial Sequence
  Description of Artificial Sequence: Synthetic oligonucleotide
  Target: ATXN1; (+) strand; PAM type: NRG; PAM sequence: TGG
tactttaccaccttcaaaca

SEQ ID NO: 134766 - DNA, 20 bp, Artificial Sequence
  Description of Artificial Sequence: Synthetic oligonucleotide
  Target: ATXN1; (+) strand; PAM type: NRG; PAM sequence: TAG
catggcattaactaatgact

SEQ ID NO: 134767 - DNA, 20 bp, Artificial Sequence
  Description of Artificial Sequence: Synthetic oligonucleotide
  Target: ATXN1; (+) strand; PAM type: NRG; PAM sequence: TGG
cattaactaatgacttagat

SEQ ID NO: 134768 - DNA, 20 bp, Artificial Sequence
  Description of Artificial Sequence: Synthetic oligonucleotide
  Target: ATXN1; (+) strand; PAM type: NRG; PAM sequence: GAG
ctaatgacttagattggact

SEQ ID NO: 134769 - DNA, 20 bp, Artificial Sequence
  Description of Artificial Sequence: Synthetic oligonucleotide
  Target: ATXN1; (+) strand; PAM type: NRG; PAM sequence: AGG
taatgacttagattggactg

SEQ ID NO: 134770 - DNA, 20 bp, Artificial Sequence
  Description of Artificial Sequence: Synthetic oligonucleotide
  Target: ATXN1; (+) strand; PAM type: NRG; PAM sequence: GGG
aatgacttagattggactga

SEQ ID NO: 134771 - DNA, 20 bp, Artificial Sequence
  Description of Artificial Sequence: Synthetic oligonucleotide
  Target: ATXN1; (+) strand; PAM type: NRG; PAM sequence: AAG
gactgagggttaataatttg

SEQ ID NO: 134772 - DNA, 20 bp, Artificial Sequence
  Description of Artificial Sequence: Synthetic oligonucleotide
  Target: ATXN1; (+) strand; PAM type: NRG; PAM sequence: TAG
ctccccatgaccttctttcc

SEQ ID NO: 134773 - DNA, 20 bp, Artificial Sequence
  Description of Artificial Sequence: Synthetic oligonucleotide
  Target: ATXN1; (+) strand; PAM type: NRG; PAM sequence: AAG
ttcctagtcattcaattctt

SEQ ID NO: 134774 - DNA, 20 bp, Artificial Sequence
  Description of Artificial Sequence: Synthetic oligonucleotide
  Target: ATXN1; (+) strand; PAM type: NRG; PAM sequence: AAG
tagtcattcaattcttaagc

SEQ ID NO: 134775 - DNA, 20 bp, Artificial Sequence
  Description of Artificial Sequence: Synthetic oligonucleotide
  Target: ATXN1; (+) strand; PAM type: NRG; PAM sequence: AGG
agtcattcaattcttaagca

SEQ ID NO: 134776 - DNA, 20 bp, Artificial Sequence
  Description of Artificial Sequence: Synthetic oligonucleotide
  Target: ATXN1; (+) strand; PAM type: NRG; PAM sequence: TGG
cattcaattcttaagcaagg

SEQ ID NO: 134777 - DNA, 20 bp, Artificial Sequence
  Description of Artificial Sequence: Synthetic oligonucleotide
  Target: ATXN1; (+) strand; PAM type: NRG; PAM sequence: AAG
ttaagcaaggtggataccaa

SEQ ID NO: 134778 - DNA, 20 bp, Artificial Sequence
  Description of Artificial Sequence: Synthetic oligonucleotide
  Target: ATXN1; (+) strand; PAM type: NRG; PAM sequence: TAG
aaaagtgtccaaaaatgccc

SEQ ID NO: 134779 - DNA, 20 bp, Artificial Sequence
  Description of Artificial Sequence: Synthetic oligonucleotide
  Target: ATXN1; (+) strand; PAM type: NRG; PAM sequence: AAG
aaaatgccctagcgtacatg

SEQ ID NO: 134780 - DNA, 20 bp, Artificial Sequence
  Description of Artificial Sequence: Synthetic oligonucleotide
  Target: ATXN1; (+) strand; PAM type: NRG; PAM sequence: CAG
ccctagcgtacatgaagtgc

SEQ ID NO: 134781 - DNA, 20 bp, Artificial Sequence
  Description of Artificial Sequence: Synthetic oligonucleotide
  Target: ATXN1; (+) strand; PAM type: NRG; PAM sequence: AGG
cctagcgtacatgaagtgcc

SEQ ID NO: 134782 - DNA, 20 bp, Artificial Sequence
  Description of Artificial Sequence: Synthetic oligonucleotide
  Target: ATXN1; (+) strand; PAM type: NRG; PAM sequence: GGG
ctagcgtacatgaagtgcca

SEQ ID NO: 134783 - DNA, 20 bp, Artificial Sequence
  Description of Artificial Sequence: Synthetic oligonucleotide
  Target: ATXN1; (+) strand; PAM type: NRG; PAM sequence: GGG
tagcgtacatgaagtgccag

SEQ ID NO: 134784 - DNA, 20 bp, Artificial Sequence
  Description of Artificial Sequence: Synthetic oligonucleotide
  Target: ATXN1; (+) strand; PAM type: NRG; PAM sequence: TAG
aggggccaaaaccacccact

SEQ ID NO: 134785 - DNA, 20 bp, Artificial Sequence
  Description of Artificial Sequence: Synthetic oligonucleotide
  Target: ATXN1; (+) strand; PAM type: NRG; PAM sequence: CAG
ccaaaaccacccacttagaa

SEQ ID NO: 134786 - DNA, 20 bp, Artificial Sequence
  Description of Artificial Sequence: Synthetic oligonucleotide
  Target: ATXN1; (+) strand; PAM type: NRG; PAM sequence: AGG
caaaaccacccacttagaac

SEQ ID NO: 134787 - DNA, 20 bp, Artificial Sequence
  Description of Artificial Sequence: Synthetic oligonucleotide
  Target: ATXN1; (+) strand; PAM type: NRG; PAM sequence: AAG
aggaaatcatgtacaaatat

SEQ ID NO: 134788 - DNA, 20 bp, Artificial Sequence
  Description of Artificial Sequence: Synthetic oligonucleotide
  Target: ATXN1; (+) strand; PAM type: NRG; PAM sequence: AAG
tgtacaaatataagtacctc

SEQ ID NO: 134789 - DNA, 20 bp, Artificial Sequence
  Description of Artificial Sequence: Synthetic oligonucleotide
  Target: ATXN1; (+) strand; PAM type: NRG; PAM sequence: GAG
tacctcaagcttgtgaaatt

SEQ ID NO: 134790 - DNA, 20 bp, Artificial Sequence
  Description of Artificial Sequence: Synthetic oligonucleotide
  Target: ATXN1; (+) strand; PAM type: NRG; PAM sequence: GAG
cctcaagcttgtgaaattga

SEQ ID NO: 134791 - DNA, 20 bp, Artificial Sequence
  Description of Artificial Sequence: Synthetic oligonucleotide
  Target: ATXN1; (+) strand; PAM type: NRG; PAM sequence: TAG
ttctttatttccttcactat

SEQ ID NO: 134792 - DNA, 20 bp, Artificial Sequence
  Description of Artificial Sequence: Synthetic oligonucleotide
  Target: ATXN1; (+) strand; PAM type: NRG; PAM sequence: AAG
tttatttccttcactattag

SEQ ID NO: 134793 - DNA, 20 bp, Artificial Sequence
  Description of Artificial Sequence: Synthetic oligonucleotide
  Target: ATXN1; (+) strand; PAM type: NRG; PAM sequence: CAG
atttccttcactattagaag

SEQ ID NO: 134794 - DNA, 20 bp, Artificial Sequence
  Description of Artificial Sequence: Synthetic oligonucleotide
  Target: ATXN1; (+) strand; PAM type: NRG; PAM sequence: GAG
ttccttcactattagaagca

SEQ ID NO: 134795 - DNA, 20 bp, Artificial Sequence
  Description of Artificial Sequence: Synthetic oligonucleotide
  Target: ATXN1; (+) strand; PAM type: NRG; PAM sequence: AGG
tccttcactattagaagcag

SEQ ID NO: 134796 - DNA, 20 bp, Artificial Sequence
  Description of Artificial Sequence: Synthetic oligonucleotide
  Target: ATXN1; (+) strand; PAM type: NRG; PAM sequence: AAG
ttcactattagaagcagagg

SEQ ID NO: 134797 - DNA, 20 bp, Artificial Sequence
  Description of Artificial Sequence: Synthetic oligonucleotide
  Target: ATXN1; (+) strand; PAM type: NRG; PAM sequence: GAG
cactattagaagcagaggaa

SEQ ID NO: 134798 - DNA, 20 bp, Artificial Sequence
  Description of Artificial Sequence: Synthetic oligonucleotide
  Target: ATXN1; (+) strand; PAM type: NRG; PAM sequence: GAG
ctattagaagcagaggaaga

SEQ ID NO: 134799 - DNA, 20 bp, Artificial Sequence
  Description of Artificial Sequence: Synthetic oligonucleotide
  Target: ATXN1; (+) strand; PAM type: NRG; PAM sequence: AGG
tattagaagcagaggaagag

SEQ ID NO: 134800 - DNA, 20 bp, Artificial Sequence
  Description of Artificial Sequence: Synthetic oligonucleotide
  Target: ATXN1; (+) strand; PAM type: NRG; PAM sequence: GGG
attagaagcagaggaagaga

SEQ ID NO: 134801 - DNA, 20 bp, Artificial Sequence
  Description of Artificial Sequence: Synthetic oligonucleotide
  Target: ATXN1; (+) strand; PAM type: NRG; PAM sequence: TAG
cagaggaagagagggctgat

SEQ ID NO: 134802 - DNA, 20 bp, Artificial Sequence
  Description of Artificial Sequence: Synthetic oligonucleotide
  Target: ATXN1; (+) strand; PAM type: NRG; PAM sequence: TGG
ggaagagagggctgattaga

SEQ ID NO: 134803 - DNA, 20 bp, Artificial Sequence
  Description of Artificial Sequence: Synthetic oligonucleotide
  Target: ATXN1; (+) strand; PAM type: NRG; PAM sequence: GGG
gaagagagggctgattagat

SEQ ID NO: 134804 - DNA, 20 bp, Artificial Sequence
  Description of Artificial Sequence: Synthetic oligonucleotide
  Target: ATXN1; (+) strand; PAM type: NRG; PAM sequence: GGG
aagagagggctgattagatg

SEQ ID NO: 134805 - DNA, 20 bp, Artificial Sequence
  Description of Artificial Sequence: Synthetic oligonucleotide
  Target: ATXN1; (+) strand; PAM type: NRG; PAM sequence: GGG
agagagggctgattagatgg

SEQ ID NO: 134806 - DNA, 20 bp, Artificial Sequence
  Description of Artificial Sequence: Synthetic oligonucleotide
  Target: ATXN1; (+) strand; PAM type: NRG; PAM sequence: GGG
gagagggctgattagatggg

SEQ ID NO: 134807 - DNA, 20 bp, Artificial Sequence
  Description of Artificial Sequence: Synthetic oligonucleotide
  Target: ATXN1; (+) strand; PAM type: NRG; PAM sequence: AAG
agggctgattagatgggggg

SEQ ID NO: 134808 - DNA, 20 bp, Artificial Sequence
  Description of Artificial Sequence: Synthetic oligonucleotide
  Target: ATXN1; (+) strand; PAM type: NRG; PAM sequence: AGG
gggctgattagatgggggga

SEQ ID NO: 134809 - DNA, 20 bp, Artificial Sequence
  Description of Artificial Sequence: Synthetic oligonucleotide
  Target: ATXN1; (+) strand; PAM type: NRG; PAM sequence: TAG
gattagatggggggaaggct

SEQ ID NO: 134810 - DNA, 20 bp, Artificial Sequence
  Description of Artificial Sequence: Synthetic oligonucleotide
  Target: ATXN1; (+) strand; PAM type: NRG; PAM sequence: TAG
gcttagcttttattttaaaa

SEQ ID NO: 134811 - DNA, 20 bp, Artificial Sequence
  Description of Artificial Sequence: Synthetic oligonucleotide
  Target: ATXN1; (+) strand; PAM type: NRG; PAM sequence: TAG
aaatcgaaaaactttgtaat

SEQ ID NO: 134812 - DNA, 20 bp, Artificial Sequence
  Description of Artificial Sequence: Synthetic oligonucleotide
  Target: ATXN1; (+) strand; PAM type: NRG; PAM sequence: CAG
actttgtaattagattttgc

SEQ ID NO: 134813 - DNA, 20 bp, Artificial Sequence
  Description of Artificial Sequence: Synthetic oligonucleotide
  Target: ATXN1; (+) strand; PAM type: NRG; PAM sequence: TAG
taattagattttgccagact

SEQ ID NO: 134814 - DNA, 20 bp, Artificial Sequence
  Description of Artificial Sequence: Synthetic oligonucleotide
  Target: ATXN1; (+) strand; PAM type: NRG; PAM sequence: AGG
aattagattttgccagactt

SEQ ID NO: 134815 - DNA, 20 bp, Artificial Sequence
  Description of Artificial Sequence: Synthetic oligonucleotide
  Target: ATXN1; (+) strand; PAM type: NRG; PAM sequence: AAG
ttttgccagacttaggctta

SEQ ID NO: 134816 - DNA, 20 bp, Artificial Sequence
  Description of Artificial Sequence: Synthetic oligonucleotide
  Target: ATXN1; (+) strand; PAM type: NRG; PAM sequence: AGG
tttgccagacttaggcttaa

SEQ ID NO: 134817 - DNA, 20 bp, Artificial Sequence
  Description of Artificial Sequence: Synthetic oligonucleotide
  Target: ATXN1; (+) strand; PAM type: NRG; PAM sequence: AAG
aatgattctttcctctccaa

SEQ ID NO: 134818 - DNA, 20 bp, Artificial Sequence
  Description of Artificial Sequence: Synthetic oligonucleotide
  Target: ATXN1; (+) strand; PAM type: NRG; PAM sequence: AAG
tctttcctctccaaaagaat

SEQ ID NO: 134819 - DNA, 20 bp, Artificial Sequence
  Description of Artificial Sequence: Synthetic oligonucleotide
  Target: ATXN1; (+) strand; PAM type: NRG; PAM sequence: AGG
ctttcctctccaaaagaata

SEQ ID NO: 134820 - DNA, 20 bp, Artificial Sequence
  Description of Artificial Sequence: Synthetic oligonucleotide
  Target: ATXN1; (+) strand; PAM type: NRG; PAM sequence: CAG
cctctccaaaagaataaggt

SEQ ID NO: 134821 - DNA, 20 bp, Artificial Sequence
  Description of Artificial Sequence: Synthetic oligonucleotide
  Target: ATXN1; (+) strand; PAM type: NRG; PAM sequence: GAG
tctccaaaagaataaggtca

SEQ ID NO: 134822 - DNA, 20 bp, Artificial Sequence
  Description of Artificial Sequence: Synthetic oligonucleotide
  Target: ATXN1; (+) strand; PAM type: NRG; PAM sequence: AAG
aaagaataaggtcagagcct

SEQ ID NO: 134823 - DNA, 20 bp, Artificial Sequence
  Description of Artificial Sequence: Synthetic oligonucleotide
  Target: ATXN1; (+) strand; PAM type: NRG; PAM sequence: TGG
gcctaagactcccaaacctt

SEQ ID NO: 134824 - DNA, 20 bp, Artificial Sequence
  Description of Artificial Sequence: Synthetic oligonucleotide
  Target: ATXN1; (+) strand; PAM type: NRG; PAM sequence: TGG
gactcccaaacctttggtcc

SEQ ID NO: 134825 - DNA, 20 bp, Artificial Sequence
  Description of Artificial Sequence: Synthetic oligonucleotide
  Target: ATXN1; (+) strand; PAM type: NRG; PAM sequence: AAG
aaacctttggtcctggctca

SEQ ID NO: 134826 - DNA, 20 bp, Artificial Sequence
  Description of Artificial Sequence: Synthetic oligonucleotide
  Target: ATXN1; (+) strand; PAM type: NRG; PAM sequence: AGG
aacctttggtcctggctcaa

SEQ ID NO: 134827 - DNA, 20 bp, Artificial Sequence
  Description of Artificial Sequence: Synthetic oligonucleotide
  Target: ATXN1; (+) strand; PAM type: NRG; PAM sequence: GGG
acctttggtcctggctcaaa

SEQ ID NO: 134828 - DNA, 20 bp, Artificial Sequence
  Description of Artificial Sequence: Synthetic oligonucleotide
  Target: ATXN1; (+) strand; PAM type: NRG; PAM sequence: GAG
ttggtcctggctcaaagggt

SEQ ID NO: 134829 - DNA, 20 bp, Artificial Sequence
  Description of Artificial Sequence: Synthetic oligonucleotide
  Target: ATXN1; (+) strand; PAM type: NRG; PAM sequence: CGG
tcaaagggtgagctacgaat

SEQ ID NO: 134830 - DNA, 20 bp, Artificial Sequence
  Description of Artificial Sequence: Synthetic oligonucleotide
  Target: ATXN1; (+) strand; PAM type: NRG; PAM sequence: TAG
catcctcctacatataccta

SEQ ID NO: 134831 - DNA, 20 bp, Artificial Sequence
  Description of Artificial Sequence: Synthetic oligonucleotide
  Target: ATXN1; (+) strand; PAM type: NRG; PAM sequence: TGG
catatacctatagatctgtc

SEQ ID NO: 134832 - DNA, 20 bp, Artificial Sequence
  Description of Artificial Sequence: Synthetic oligonucleotide
  Target: ATXN1; (+) strand; PAM type: NRG; PAM sequence: GGG
atatacctatagatctgtct

SEQ ID NO: 134833 - DNA, 20 bp, Artificial Sequence
  Description of Artificial Sequence: Synthetic oligonucleotide
  Target: ATXN1; (+) strand; PAM type: NRG; PAM sequence: GAG
ctatagatctgtctgggcat

SEQ ID NO: 134834 - DNA, 20 bp, Artificial Sequence
  Description of Artificial Sequence: Synthetic oligonucleotide
  Target: ATXN1; (+) strand; PAM type: NRG; PAM sequence: CAG
gatctgtctgggcatgagta

SEQ ID NO: 134835 - DNA, 20 bp, Artificial Sequence
  Description of Artificial Sequence: Synthetic oligonucleotide
  Target: ATXN1; (+) strand; PAM type: NRG; PAM sequence: TGG
tctgggcatgagtacagaat

SEQ ID NO: 134836 - DNA, 20 bp, Artificial Sequence
  Description of Artificial Sequence: Synthetic oligonucleotide
  Target: ATXN1; (+) strand; PAM type: NRG; PAM sequence: CAG
gagtacagaattggcaaata

SEQ ID NO: 134837 - DNA, 20 bp, Artificial Sequence
  Description of Artificial Sequence: Synthetic oligonucleotide
  Target: ATXN1; (+) strand; PAM type: NRG; PAM sequence: AGG
agtacagaattggcaaatac

SEQ ID NO: 134838 - DNA, 20 bp, Artificial Sequence
  Description of Artificial Sequence: Synthetic oligonucleotide
  Target: ATXN1; (+) strand; PAM type: NRG; PAM sequence: GGG
gtacagaattggcaaataca

SEQ ID NO: 134839 - DNA, 20 bp, Artificial Sequence
  Description of Artificial Sequence: Synthetic oligonucleotide
  Target: ATXN1; (+) strand; PAM type: NRG; PAM sequence: GAG
aattggcaaatacagggtat

SEQ ID NO: 134840 - DNA, 20 bp, Artificial Sequence
  Description of Artificial Sequence: Synthetic oligonucleotide
  Target: ATXN1; (+) strand; PAM type: NRG; PAM sequence: AAG
tggcaaatacagggtatgag

SEQ ID NO: 134841 - DNA, 20 bp, Artificial Sequence
  Description of Artificial Sequence: Synthetic oligonucleotide
  Target: ATXN1; (+) strand; PAM type: NRG; PAM sequence: GAG
gcaaatacagggtatgagaa

SEQ ID NO: 134842 - DNA, 20 bp, Artificial Sequence
  Description of Artificial Sequence: Synthetic oligonucleotide
  Target: ATXN1; (+) strand; PAM type: NRG; PAM sequence: CGG
gagaagagacaacgataaaa

SEQ ID NO: 134843 - DNA, 20 bp, Artificial Sequence
  Description of Artificial Sequence: Synthetic oligonucleotide
  Target: ATXN1; (+) strand; PAM type: NRG; PAM sequence: CAG
agagacaacgataaaacgga

SEQ ID NO: 134844 - DNA, 20 bp, Artificial Sequence
  Description of Artificial Sequence: Synthetic oligonucleotide
  Target: ATXN1; (+) strand; PAM type: NRG; PAM sequence: TGG
acgataaaacggacagaatg

SEQ ID NO: 134845 - DNA, 20 bp, Artificial Sequence
  Description of Artificial Sequence: Synthetic oligonucleotide
  Target: ATXN1; (+) strand; PAM type: NRG; PAM sequence: AAG
tgtggtactgttcaaatgtt

SEQ ID NO: 134846 - DNA, 20 bp, Artificial Sequence
  Description of Artificial Sequence: Synthetic oligonucleotide
  Target: ATXN1; (+) strand; PAM type: NRG; PAM sequence: AAG
ggtactgttcaaatgttaag

SEQ ID NO: 134847 - DNA, 20 bp, Artificial Sequence
  Description of Artificial Sequence: Synthetic oligonucleotide
  Target: ATXN1; (+) strand; PAM type: NRG; PAM sequence: CAG
gttcaaatgttaagaagtgt

SEQ ID NO: 134848 - DNA, 20 bp, Artificial Sequence
  Description of Artificial Sequence: Synthetic oligonucleotide
  Target: ATXN1; (+) strand; PAM type: NRG; PAM sequence: AGG
ttcaaatgttaagaagtgtc

SEQ ID NO: 134849 - DNA, 20 bp, Artificial Sequence
  Description of Artificial Sequence: Synthetic oligonucleotide
  Target: ATXN1; (+) strand; PAM type: NRG; PAM sequence: AAG
aatgttaagaagtgtcagga

SEQ ID NO: 134850 - DNA, 20 bp, Artificial Sequence
  Description of Artificial Sequence: Synthetic oligonucleotide
  Target: ATXN1; (+) strand; PAM type: NRG; PAM sequence: CAG
gaagtgtcaggaaagcacca

SEQ ID NO: 134851 - DNA, 20 bp, Artificial Sequence
  Description of Artificial Sequence: Synthetic oligonucleotide
  Target: ATXN1; (+) strand; PAM type: NRG; PAM sequence: AAG
aagcaccacagctgacgctg

SEQ ID NO: 134852 - DNA, 20 bp, Artificial Sequence
  Description of Artificial Sequence: Synthetic oligonucleotide
  Target: ATXN1; (+) strand; PAM type: NRG; PAM sequence: TGG
agctgacgctgaagttaatc

SEQ ID NO: 134853 - DNA, 20 bp, Artificial Sequence
  Description of Artificial Sequence: Synthetic oligonucleotide
  Target: ATXN1; (+) strand; PAM type: NRG; PAM sequence: GAG
ctgacgctgaagttaatctg

SEQ ID NO: 134854 - DNA, 20 bp, Artificial Sequence
  Description of Artificial Sequence: Synthetic oligonucleotide
  Target: ATXN1; (+) strand; PAM type: NRG; PAM sequence: AGG
tgacgctgaagttaatctgg

SEQ ID NO: 134855 - DNA, 20 bp, Artificial Sequence
  Description of Artificial Sequence: Synthetic oligonucleotide
  Target: ATXN1; (+) strand; PAM type: NRG; PAM sequence: GGG
gacgctgaagttaatctgga

SEQ ID NO: 134856 - DNA, 20 bp, Artificial Sequence
  Description of Artificial Sequence: Synthetic oligonucleotide
  Target: ATXN1; (+) strand; PAM type: NRG; PAM sequence: GGG
acgctgaagttaatctggag

SEQ ID NO: 134857 - DNA, 20 bp, Artificial Sequence
  Description of Artificial Sequence: Synthetic oligonucleotide
  Target: ATXN1; (+) strand; PAM type: NRG; PAM sequence: AAG
taatttaccttctttaacac

SEQ ID NO: 134858 - DNA, 20 bp, Artificial Sequence
  Description of Artificial Sequence: Synthetic oligonucleotide
  Target: ATXN1; (+) strand; PAM type: NRG; PAM sequence: TGG
tttaccttctttaacacaag

SEQ ID NO: 134859 - DNA, 20 bp, Artificial Sequence
  Description of Artificial Sequence: Synthetic oligonucleotide
  Target: ATXN1; (+) strand; PAM type: NRG; PAM sequence: GAG
taccttctttaacacaagtg

SEQ ID NO: 134860 - DNA, 20 bp, Artificial Sequence
  Description of Artificial Sequence: Synthetic oligonucleotide
  Target: ATXN1; (+) strand; PAM type: NRG; PAM sequence: GAG
tctttaacacaagtggagat

SEQ ID NO: 134861 - DNA, 20 bp, Artificial Sequence
  Description of Artificial Sequence: Synthetic oligonucleotide
  Target: ATXN1; (+) strand; PAM type: NRG; PAM sequence: AGG
ctttaacacaagtggagatg

SEQ ID NO: 134862 - DNA, 20 bp, Artificial Sequence
  Description of Artificial Sequence: Synthetic oligonucleotide
  Target: ATXN1; (+) strand; PAM type: NRG; PAM sequence: GGG
tttaacacaagtggagatga

SEQ ID NO: 134863 - DNA, 20 bp, Artificial Sequence
  Description of Artificial Sequence: Synthetic oligonucleotide
  Target: ATXN1; (+) strand; PAM type: NRG; PAM sequence: CAG
acaagtggagatgagggcaa

SEQ ID NO: 134864 - DNA, 20 bp, Artificial Sequence
  Description of Artificial Sequence: Synthetic oligonucleotide
  Target: ATXN1; (+) strand; PAM type: NRG; PAM sequence: CAG
gggcaacagtctgtgaaaca

SEQ ID NO: 134865 - DNA, 20 bp, Artificial Sequence
  Description of Artificial Sequence: Synthetic oligonucleotide
  Target: ATXN1; (+) strand; PAM type: NRG; PAM sequence: CAG
aacagtctgtgaaacacagt

SEQ ID NO: 134866 - DNA, 20 bp, Artificial Sequence
  Description of Artificial Sequence: Synthetic oligonucleotide
  Target: ATXN1; (+) strand; PAM type: NRG; PAM sequence: TGG
agtgtgttctttctccatta

SEQ ID NO: 134867 - DNA, 20 bp, Artificial Sequence
  Description of Artificial Sequence: Synthetic oligonucleotide
  Target: ATXN1; (+) strand; PAM type: NRG; PAM sequence: TGG
cattatggtctctttcttac

SEQ ID NO: 134868 - DNA, 20 bp, Artificial Sequence
  Description of Artificial Sequence: Synthetic oligonucleotide
  Target: ATXN1; (+) strand; PAM type: NRG; PAM sequence: AAG
tcttactggttaactacaaa

SEQ ID NO: 134869 - DNA, 20 bp, Artificial Sequence
  Description of Artificial Sequence: Synthetic oligonucleotide
  Target: ATXN1; (+) strand; PAM type: NRG; PAM sequence: AAG
actggttaactacaaaaagc

SEQ ID NO: 134870 - DNA, 20 bp, Artificial Sequence
  Description of Artificial Sequence: Synthetic oligonucleotide
  Target: ATXN1; (+) strand; PAM type: NRG; PAM sequence: AGG
ctggttaactacaaaaagca

SEQ ID NO: 134871 - DNA, 20 bp, Artificial Sequence
  Description of Artificial Sequence: Synthetic oligonucleotide
  Target: ATXN1; (+) strand; PAM type: NRG; PAM sequence: TGG
aactacaaaaagcaaggaaa

SEQ ID NO: 134872 - DNA, 20 bp, Artificial Sequence
  Description of Artificial Sequence: Synthetic oligonucleotide
  Target: ATXN1; (+) strand; PAM type: NRG; PAM sequence: AAG
aaaagcaaggaaatggctga

SEQ ID NO: 134873 - DNA, 20 bp, Artificial Sequence
  Description of Artificial Sequence: Synthetic oligonucleotide
  Target: ATXN1; (+) strand; PAM type: NRG; PAM sequence: AGG
aaagcaaggaaatggctgaa

SEQ ID NO: 134874 - DNA, 20 bp, Artificial Sequence
  Description of Artificial Sequence: Synthetic oligonucleotide
  Target: ATXN1; (+) strand; PAM type: NRG; PAM sequence: CAG
gcaaggaaatggctgaaagg

SEQ ID NO: 134875 - DNA, 20 bp, Artificial Sequence
  Description of Artificial Sequence: Synthetic oligonucleotide
  Target: ATXN1; (+) strand; PAM type: NRG; PAM sequence: AGG
caaggaaatggctgaaaggc

SEQ ID NO: 134876 - DNA, 20 bp, Artificial Sequence
  Description of Artificial Sequence: Synthetic oligonucleotide
  Target: ATXN1; (+) strand; PAM type: NRG; PAM sequence: CAG
ggaaatggctgaaaggcagg

SEQ ID NO: 134877 - DNA, 20 bp, Artificial Sequence
  Description of Artificial Sequence: Synthetic oligonucleotide
  Target: ATXN1; (+) strand; PAM type: NRG; PAM sequence: GAG
atggctgaaaggcaggcagt

SEQ ID NO: 134878 - DNA, 20 bp, Artificial Sequence
  Description of Artificial Sequence: Synthetic oligonucleotide
  Target: ATXN1; (+) strand; PAM type: NRG; PAM sequence: AGG
tggctgaaaggcaggcagtg

SEQ ID NO: 134879 - DNA, 20 bp, Artificial Sequence
  Description of Artificial Sequence: Synthetic oligonucleotide
  Target: ATXN1; (+) strand; PAM type: NRG; PAM sequence: GGG
ggctgaaaggcaggcagtga

SEQ ID NO: 134880 - DNA, 20 bp, Artificial Sequence
  Description of Artificial Sequence: Synthetic oligonucleotide
  Target: ATXN1; (+) strand; PAM type: NRG; PAM sequence: GGG
gctgaaaggcaggcagtgag

SEQ ID NO: 134881 - DNA, 20 bp, Artificial Sequence
  Description of Artificial Sequence: Synthetic oligonucleotide
  Target: ATXN1; (+) strand; PAM type: NRG; PAM sequence: GAG
tgaaaggcaggcagtgaggg

SEQ ID NO: 134882 - DNA, 20 bp, Artificial Sequence
  Description of Artificial Sequence: Synthetic oligonucleotide
  Target: ATXN1; (+) strand; PAM type: NRG; PAM sequence: GAG
aaaggcaggcagtgagggga

SEQ ID NO: 134883 - DNA, 20 bp, Artificial Sequence
  Description of Artificial Sequence: Synthetic oligonucleotide
  Target: ATXN1; (+) strand; PAM type: NRG; PAM sequence: AGG
aaggcaggcagtgaggggag

SEQ ID NO: 134884 - DNA, 20 bp, Artificial Sequence
  Description of Artificial Sequence: Synthetic oligonucleotide
  Target: ATXN1; (+) strand; PAM type: NRG; PAM sequence: GGG
aggcaggcagtgaggggaga

SEQ ID NO: 134885 - DNA, 20 bp, Artificial Sequence
  Description of Artificial Sequence: Synthetic oligonucleotide
  Target: ATXN1; (+) strand; PAM type: NRG; PAM sequence: GAG
gcaggcagtgaggggagagg

SEQ ID NO: 134886 - DNA, 20 bp, Artificial Sequence
  Description of Artificial Sequence: Synthetic oligonucleotide
  Target: ATXN1; (+) strand; PAM type: NRG; PAM sequence: AGG
caggcagtgaggggagaggg

SEQ ID NO: 134887 - DNA, 20 bp, Artificial Sequence
  Description of Artificial Sequence: Synthetic oligonucleotide
  Target: ATXN1; (+) strand; PAM type: NRG; PAM sequence: GAG
gtgaggggagagggaggaat

SEQ ID NO: 134888 - DNA, 20 bp, Artificial Sequence
  Description of Artificial Sequence: Synthetic oligonucleotide
  Target: ATXN1; (+) strand; PAM type: NRG; PAM sequence: GAG
gaggggagagggaggaatga

SEQ ID NO: 134889 - DNA, 20 bp, Artificial Sequence
  Description of Artificial Sequence: Synthetic oligonucleotide
  Target: ATXN1; (+) strand; PAM type: NRG; PAM sequence: AAG
gagagactttcacctgtacg

SEQ ID NO: 134890 - DNA, 20 bp, Artificial Sequence
  Description of Artificial Sequence: Synthetic oligonucleotide
  Target: ATXN1; (+) strand; PAM type: NRG; PAM sequence: AGG
agagactttcacctgtacga

SEQ ID NO: 134891 - DNA, 20 bp, Artificial Sequence
  Description of Artificial Sequence: Synthetic oligonucleotide
  Target: ATXN1; (+) strand; PAM type: NRG; PAM sequence: TGG
acctgtacgaaggatgtctc

SEQ ID NO: 134892 - DNA, 20 bp, Artificial Sequence
  Description of Artificial Sequence: Synthetic oligonucleotide
  Target: ATXN1; (+) strand; PAM type: NRG; PAM sequence: CGG
cgaaggatgtctctggaaaa

SEQ ID NO: 134893 - DNA, 20 bp, Artificial Sequence
  Description of Artificial Sequence: Synthetic oligonucleotide
  Target: ATXN1; (+) strand; PAM type: NRG; PAM sequence: CAG
tctggaaaacggaatgttga

SEQ ID NO: 134894 - DNA, 20 bp, Artificial Sequence
  Description of Artificial Sequence: Synthetic oligonucleotide
  Target: ATXN1; (+) strand; PAM type: NRG; PAM sequence: GAG
tggaaaacggaatgttgaca

SEQ ID NO: 134895 - DNA, 20 bp, Artificial Sequence
  Description of Artificial Sequence: Synthetic oligonucleotide
  Target: ATXN1; (+) strand; PAM type: NRG; PAM sequence: GAG
gaaaacggaatgttgacaga

SEQ ID NO: 134896 - DNA, 20 bp, Artificial Sequence
  Description of Artificial Sequence: Synthetic oligonucleotide
  Target: ATXN1; (+) strand; PAM type: NRG; PAM sequence: AAG
aatgttgacagagagtaaac

SEQ ID NO: 134897 - DNA, 20 bp, Artificial Sequence
  Description of Artificial Sequence: Synthetic oligonucleotide
  Target: ATXN1; (+) strand; PAM type: NRG; PAM sequence: AAG
atatgctattaatgcctgtt

SEQ ID NO: 134898 - DNA, 20 bp, Artificial Sequence
  Description of Artificial Sequence: Synthetic oligonucleotide
  Target: ATXN1; (+) strand; PAM type: NRG; PAM sequence: GAG
gcctgttaagtcaccttttt

SEQ ID NO: 134899 - DNA, 20 bp, Artificial Sequence
  Description of Artificial Sequence: Synthetic oligonucleotide
  Target: ATXN1; (+) strand; PAM type: NRG; PAM sequence: TGG
gtcacctttttgagattttt

SEQ ID NO: 134900 - DNA, 20 bp, Artificial Sequence
  Description of Artificial Sequence: Synthetic oligonucleotide
  Target: ATXN1; (+) strand; PAM type: NRG; PAM sequence: CAG
tgagattttttggtgactat

SEQ ID NO: 134901 - DNA, 20 bp, Artificial Sequence
  Description of Artificial Sequence: Synthetic oligonucleotide
  Target: ATXN1; (+) strand; PAM type: NRG; PAM sequence: AAG
ttttttggtgactatcagtg

SEQ ID NO: 134902 - DNA, 20 bp, Artificial Sequence
  Description of Artificial Sequence: Synthetic oligonucleotide
  Target: ATXN1; (+) strand; PAM type: NRG; PAM sequence: AAG
attctcacactgttttaatt

SEQ ID NO: 134903 - DNA, 20 bp, Artificial Sequence
  Description of Artificial Sequence: Synthetic oligonucleotide
  Target: ATXN1; (+) strand; PAM type: NRG; PAM sequence: TAG
ctcacactgttttaattaag

SEQ ID NO: 134904 - DNA, 20 bp, Artificial Sequence
  Description of Artificial Sequence: Synthetic oligonucleotide
  Target: ATXN1; (+) strand; PAM type: NRG; PAM sequence: AGG
tcacactgttttaattaagt

SEQ ID NO: 134905 - DNA, 20 bp, Artificial Sequence
  Description of Artificial Sequence: Synthetic oligonucleotide
  Target: ATXN1; (+) strand; PAM type: NRG; PAM sequence: GGG
cacactgttttaattaagta

SEQ ID NO: 134906 - DNA, 20 bp, Artificial Sequence
  Description of Artificial Sequence: Synthetic oligonucleotide
  Target: ATXN1; (+) strand; PAM type: NRG; PAM sequence: CAG
gtagggccttattttaatca

SEQ ID NO: 134907 - DNA, 20 bp, Artificial Sequence
  Description of Artificial Sequence: Synthetic oligonucleotide
  Target: ATXN1; (+) strand; PAM type: NRG; PAM sequence: TGG
gggccttattttaatcacag

SEQ ID NO: 134908 - DNA, 20 bp, Artificial Sequence
  Description of Artificial Sequence: Synthetic oligonucleotide
  Target: ATXN1; (+) strand; PAM type: NRG; PAM sequence: TGG
ccttattttaatcacagtgg

SEQ ID NO: 134909 - DNA, 20 bp, Artificial Sequence
  Description of Artificial Sequence: Synthetic oligonucleotide
  Target: ATXN1; (+) strand; PAM type: NRG; PAM sequence: AAG
tggtggtgccttctcgtttt

SEQ ID NO: 134910 - DNA, 20 bp, Artificial Sequence
  Description of Artificial Sequence: Synthetic oligonucleotide
  Target: ATXN1; (+) strand; PAM type: NRG; PAM sequence: TAG
ggtgccttctcgttttaagc

SEQ ID NO: 134911 - DNA, 20 bp, Artificial Sequence
  Description of Artificial Sequence: Synthetic oligonucleotide
  Target: ATXN1; (+) strand; PAM type: NRG; PAM sequence: GAG
ccttctcgttttaagctagt

SEQ ID NO: 134912 - DNA, 20 bp, Artificial Sequence
  Description of Artificial Sequence: Synthetic oligonucleotide
  Target: ATXN1; (+) strand; PAM type: NRG; PAM sequence: TGG
ctcgttttaagctagtgagc

SEQ ID NO: 134913 - DNA, 20 bp, Artificial Sequence
  Description of Artificial Sequence: Synthetic oligonucleotide
  Target: ATXN1; (+) strand; PAM type: NRG; PAM sequence: CAG
taagctagtgagctggaacc

SEQ ID NO: 134914 - DNA, 20 bp, Artificial Sequence
  Description of Artificial Sequence: Synthetic oligonucleotide
  Target: ATXN1; (+) strand; PAM type: NRG; PAM sequence: CAG
ctagtgagctggaacccagc

SEQ ID NO: 134915 - DNA, 20 bp, Artificial Sequence
  Description of Artificial Sequence: Synthetic oligonucleotide
  Target: ATXN1; (+) strand; PAM type: NRG; PAM sequence: AGG
tagtgagctggaacccagcc

SEQ ID NO: 134916 - DNA, 20 bp, Artificial Sequence
  Description of Artificial Sequence: Synthetic oligonucleotide
  Target: ATXN1; (+) strand; PAM type: NRG; PAM sequence: CAG
tgagctggaacccagccagg

SEQ ID NO: 134917 - DNA, 20 bp, Artificial Sequence
  Description of Artificial Sequence: Synthetic oligonucleotide
  Target: ATXN1; (+) strand; PAM type: NRG; PAM sequence: CAG
cccagccaggcagtgttaaa

SEQ ID NO: 134918 - DNA, 20 bp, Artificial Sequence
  Description of Artificial Sequence: Synthetic oligonucleotide
  Target: ATXN1; (+) strand; PAM type: NRG; PAM sequence: AGG
ccagccaggcagtgttaaac

SEQ ID NO: 134919 - DNA, 20 bp, Artificial Sequence
  Description of Artificial Sequence: Synthetic oligonucleotide
  Target: ATXN1; (+) strand; PAM type: NRG; PAM sequence: GAG
agccaggcagtgttaaacag

SEQ ID NO: 134920 - DNA, 20 bp, Artificial Sequence
  Description of Artificial Sequence: Synthetic oligonucleotide
  Target: ATXN1; (+) strand; PAM type: NRG; PAM sequence: GAG
aggcagtgttaaacaggagc

SEQ ID NO: 134921 - DNA, 20 bp, Artificial Sequence
  Description of Artificial Sequence: Synthetic oligonucleotide
  Target: ATXN1; (+) strand; PAM type: NRG; PAM sequence: GAG
gcagtgttaaacaggagcga

SEQ ID NO: 134922 - DNA, 20 bp, Artificial Sequence
  Description of Artificial Sequence: Synthetic oligonucleotide
  Target: ATXN1; (+) strand; PAM type: NRG; PAM sequence: AAG
agagactttccttcttcgtc

SEQ ID NO: 134923 - DNA, 20 bp, Artificial Sequence
  Description of Artificial Sequence: Synthetic oligonucleotide
  Target: ATXN1; (+) strand; PAM type: NRG; PAM sequence: AGG
gagactttccttcttcgtca

SEQ ID NO: 134924 - DNA, 20 bp, Artificial Sequence
  Description of Artificial Sequence: Synthetic oligonucleotide
  Target: ATXN1; (+) strand; PAM type: NRG; PAM sequence: AAG
actttccttcttcgtcaagg

SEQ ID NO: 134925 - DNA, 20 bp, Artificial Sequence
  Description of Artificial Sequence: Synthetic oligonucleotide
  Target: ATXN1; (+) strand; PAM type: NRG; PAM sequence: CAG
cttcgtcaaggaagcttttg

SEQ ID NO: 134926 - DNA, 20 bp, Artificial Sequence
  Description of Artificial Sequence: Synthetic oligonucleotide
  Target: ATXN1; (+) strand; PAM type: NRG; PAM sequence: CAG
tattttgtttttttattttt

SEQ ID NO: 134927 - DNA, 20 bp, Artificial Sequence
  Description of Artificial Sequence: Synthetic oligonucleotide
  Target: ATXN1; (+) strand; PAM type: NRG; PAM sequence: GAG
ttttgtttttttatttttca

SEQ ID NO: 134928 - DNA, 20 bp, Artificial Sequence
  Description of Artificial Sequence: Synthetic oligonucleotide
  Target: ATXN1; (+) strand; PAM type: NRG; PAM sequence: TAG
tatttttcagagactgaatc

SEQ ID NO: 134929 - DNA, 20 bp, Artificial Sequence
  Description of Artificial Sequence: Synthetic oligonucleotide
  Target: ATXN1; (+) strand; PAM type: NRG; PAM sequence: CAG
ctgaatctagctctgtcacc

SEQ ID NO: 134930 - DNA, 20 bp, Artificial Sequence
  Description of Artificial Sequence: Synthetic oligonucleotide
  Target: ATXN1; (+) strand; PAM type: NRG; PAM sequence: AGG
tgaatctagctctgtcaccc

SEQ ID NO: 134931 - DNA, 20 bp, Artificial Sequence
  Description of Artificial Sequence: Synthetic oligonucleotide
  Target: ATXN1; (+) strand; PAM type: NRG; PAM sequence: TGG
ctgtcacccaggctgtgcaa

SEQ ID NO: 134932 - DNA, 20 bp, Artificial Sequence
  Description of Artificial Sequence: Synthetic oligonucleotide
  Target: ATXN1; (+) strand; PAM type: NRG; PAM sequence: TAG
gctgtgcaatggcacgatca

SEQ ID NO: 134933 - DNA, 20 bp, Artificial Sequence
  Description of Artificial Sequence: Synthetic oligonucleotide
  Target: ATXN1; (+) strand; PAM type: NRG; PAM sequence: CAG
ggcacgatcatagctcactg

SEQ ID NO: 134934 - DNA, 20 bp, Artificial Sequence
  Description of Artificial Sequence: Synthetic oligonucleotide
  Target: ATXN1; (+) strand; PAM type: NRG; PAM sequence: TGG
tcactgcagcctctaactcc

SEQ ID NO: 134935 - DNA, 20 bp, Artificial Sequence
  Description of Artificial Sequence: Synthetic oligonucleotide
  Target: ATXN1; (+) strand; PAM type: NRG; PAM sequence: GGG
cactgcagcctctaactcct

SEQ ID NO: 134936 - DNA, 20 bp, Artificial Sequence
  Description of Artificial Sequence: Synthetic oligonucleotide
  Target: ATXN1; (+) strand; PAM type: NRG; PAM sequence: AAG
agcctctaactcctgggctc

SEQ ID NO: 134937 - DNA, 20 bp, Artificial Sequence
  Description of Artificial Sequence: Synthetic oligonucleotide
  Target: ATXN1; (+) strand; PAM type: NRG; PAM sequence: CAG
ctcaagcaatcctcctgcct

SEQ ID NO: 134938 - DNA, 20 bp, Artificial Sequence
  Description of Artificial Sequence: Synthetic oligonucleotide
  Target: ATXN1; (+) strand; PAM type: NRG; PAM sequence: CAG
aatcctcctgcctcagcctc

SEQ ID NO: 134939 - DNA, 20 bp, Artificial Sequence
  Description of Artificial Sequence: Synthetic oligonucleotide
  Target: ATXN1; (+) strand; PAM type: NRG; PAM sequence: GAG
tcctcctgcctcagcctcca

SEQ ID NO: 134940 - DNA, 20 bp, Artificial Sequence
  Description of Artificial Sequence: Synthetic oligonucleotide
  Target: ATXN1; (+) strand; PAM type: NRG; PAM sequence: AGG
cctcctgcctcagcctccag

SEQ ID NO: 134941 - DNA, 20 bp, Artificial Sequence
  Description of Artificial Sequence: Synthetic oligonucleotide
  Target: ATXN1; (+) strand; PAM type: NRG; PAM sequence: GAG
tcctgcctcagcctccagag

SEQ ID NO: 134942 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctccagaggagc

SEQ ID NO: 134943 - DNA, 20 bp, Artificial Sequence
  Description of Artificial Sequence: Synthetic oligonucleotide
  Target: ATXN1; (+) strand; PAM type: NRG; PAM sequence: GGG
cctcagcctccagaggagct

SEQ ID NO: 134944 - DNA, 20 bp, Artificial Sequence
  Description of Artificial Sequence: Synthetic oligonucleotide
  Target: ATXN1; (+) strand; PAM type: NRG; PAM sequence: CAG
ctccagaggagctgggacta

SEQ ID NO: 134945 - DNA, 20 bp, Artificial Sequence
  Description of Artificial Sequence: Synthetic oligonucleotide
  Target: ATXN1; (+) strand; PAM type: NRG; PAM sequence: TGG
cagatgcacgcctccatgct

SEQ ID NO: 134946 - DNA, 20 bp, Artificial Sequence
  Description of Artificial Sequence: Synthetic oligonucleotide
  Target: ATXN1; (+) strand; PAM type: NRG; PAM sequence: AAG
atttttacttattttttgta

SEQ ID NO: 134947 - DNA, 20 bp, Artificial Sequence
  Description of Artificial Sequence: Synthetic oligonucleotide
  Target: ATXN1; (+) strand; PAM type: NRG; PAM sequence: GAG
tacttattttttgtaaagac

SEQ ID NO: 134948 - DNA, 20 bp, Artificial Sequence
  Description of Artificial Sequence: Synthetic oligonucleotide
  Target: ATXN1; (+) strand; PAM type: NRG; PAM sequence: AGG
acttattttttgtaaagacg

SEQ ID NO: 134949 - DNA, 20 bp, Artificial Sequence
  Description of Artificial Sequence: Synthetic oligonucleotide
  Target: ATXN1; (+) strand; PAM type: NRG; PAM sequence: AAG
acgaggtctctatcttgcca

SEQ ID NO: 134950 - DNA, 20 bp, Artificial Sequence
  Description of Artificial Sequence: Synthetic oligonucleotide
  Target: ATXN1; (+) strand; PAM type: NRG; PAM sequence: TGG
caaagctgatcttgaactcc

SEQ ID NO: 134951 - DNA, 20 bp, Artificial Sequence
  Description of Artificial Sequence: Synthetic oligonucleotide
  Target: ATXN1; (+) strand; PAM type: NRG; PAM sequence: AAG
gatcttgaactcctggcctc

SEQ ID NO: 134952 - DNA, 20 bp, Artificial Sequence
  Description of Artificial Sequence: Synthetic oligonucleotide
  Target: ATXN1; (+) strand; PAM type: NRG; PAM sequence: TGG
ctcaagcaatcctctcatct

SEQ ID NO: 134953 - DNA, 20 bp, Artificial Sequence
  Description of Artificial Sequence: Synthetic oligonucleotide
  Target: ATXN1; (+) strand; PAM type: NRG; PAM sequence: AAG
cctctcatcttggcctccca

SEQ ID NO: 134954 - DNA, 20 bp, Artificial Sequence
  Description of Artificial Sequence: Synthetic oligonucleotide
  Target: ATXN1; (+) strand; PAM type: NRG; PAM sequence: TGG
atcttggcctcccaaagtgc

SEQ ID NO: 134955 - DNA, 20 bp, Artificial Sequence
  Description of Artificial Sequence: Synthetic oligonucleotide
  Target: ATXN1; (+) strand; PAM type: NRG; PAM sequence: CAG
cctcccaaagtgctggataa

SEQ ID NO: 134956 - DNA, 20 bp, Artificial Sequence
  Description of Artificial Sequence: Synthetic oligonucleotide
  Target: ATXN1; (+) strand; PAM type: NRG; PAM sequence: AGG
ctcccaaagtgctggataac

SEQ ID NO: 134957 - DNA, 20 bp, Artificial Sequence
  Description of Artificial Sequence: Synthetic oligonucleotide
  Target: ATXN1; (+) strand; PAM type: NRG; PAM sequence: TGG
aaagtgctggataacaggtg

SEQ ID NO: 134958 - DNA, 20 bp, Artificial Sequence
  Description of Artificial Sequence: Synthetic oligonucleotide
  Target: ATXN1; (+) strand; PAM type: NRG; PAM sequence: CAG
acaggtgtggccaccgtgcc

SEQ ID NO: 134959 - DNA, 20 bp, Artificial Sequence
  Description of Artificial Sequence: Synthetic oligonucleotide
  Target: ATXN1; (+) strand; PAM type: NRG; PAM sequence: CAG
gtggccaccgtgcccagcct

SEQ ID NO: 134960 - DNA, 20 bp, Artificial Sequence
  Description of Artificial Sequence: Synthetic oligonucleotide
  Target: ATXN1; (+) strand; PAM type: NRG; PAM sequence: AAG
ctccttttctcccctatcca

SEQ ID NO: 134961 - DNA, 20 bp, Artificial Sequence
  Description of Artificial Sequence: Synthetic oligonucleotide
  Target: ATXN1; (+) strand; PAM type: NRG; PAM sequence: TGG
tttctcccctatccaaagcc

SEQ ID NO: 134962 - DNA, 20 bp, Artificial Sequence
  Description of Artificial Sequence: Synthetic oligonucleotide
  Target: ATXN1; (+) strand; PAM type: NRG; PAM sequence: AAG
tatccaaagcctggtaaaca

SEQ ID NO: 134963 - DNA, 20 bp, Artificial Sequence
  Description of Artificial Sequence: Synthetic oligonucleotide
  Target: ATXN1; (+) strand; PAM type: NRG; PAM sequence: GAG
caaagcctggtaaacaaagt

SEQ ID NO: 134964 - DNA, 20 bp, Artificial Sequence
  Description of Artificial Sequence: Synthetic oligonucleotide
  Target: ATXN1; (+) strand; PAM type: NRG; PAM sequence: CGG
ctgatttgcatatctaaaat

SEQ ID NO: 134965 - DNA, 20 bp, Artificial Sequence
  Description of Artificial Sequence: Synthetic oligonucleotide
  Target: ATXN1; (+) strand; PAM type: NRG; PAM sequence: GGG
tgatttgcatatctaaaatc

SEQ ID NO: 134966 - DNA, 20 bp, Artificial Sequence
  Description of Artificial Sequence: Synthetic oligonucleotide
  Target: ATXN1; (+) strand; PAM type: NRG; PAM sequence: TGG
gcatatctaaaatcgggtgc

SEQ ID NO: 134967 - DNA, 20 bp, Artificial Sequence
  Description of Artificial Sequence: Synthetic oligonucleotide
  Target: ATXN1; (+) strand; PAM type: NRG; PAM sequence: TAG
ctggatgcctgcaaatatga

SEQ ID NO: 134968 - DNA, 20 bp, Artificial Sequence
  Description of Artificial Sequence: Synthetic oligonucleotide
  Target: ATXN1; (+) strand; PAM type: NRG; PAM sequence: AGG
tggatgcctgcaaatatgat

SEQ ID NO: 134969 - DNA, 20 bp, Artificial Sequence
  Description of Artificial Sequence: Synthetic oligonucleotide
  Target: ATXN1; (+) strand; PAM type: NRG; PAM sequence: GGG
ggatgcctgcaaatatgata

SEQ ID NO: 134970 - DNA, 20 bp, Artificial Sequence
  Description of Artificial Sequence: Synthetic oligonucleotide
  Target: ATXN1; (+) strand; PAM type: NRG; PAM sequence: TGG
atgatagggaaatatgtatt

SEQ ID NO: 134971 - DNA, 20 bp, Artificial Sequence
  Description of Artificial Sequence: Synthetic oligonucleotide
  Target: ATXN1; (+) strand; PAM type: NRG; PAM sequence: CAG
gaaatatgtatttggaacct

SEQ ID NO: 134972 - DNA, 20 bp, Artificial Sequence
  Description of Artificial Sequence: Synthetic oligonucleotide
  Target: ATXN1; (+) strand; PAM type: NRG; PAM sequence: AGG
aaatatgtatttggaacctc

SEQ ID NO: 134973 - DNA, 20 bp, Artificial Sequence
  Description of Artificial Sequence: Synthetic oligonucleotide
  Target: ATXN1; (+) strand; PAM type: NRG; PAM sequence: CAG
tggaacctcaggtgaaaccc

SEQ ID NO: 134974 - DNA, 20 bp, Artificial Sequence
  Description of Artificial Sequence: Synthetic oligonucleotide
  Target: ATXN1; (+) strand; PAM type: NRG; PAM sequence: AAG
cattaaaatcatcacatttg

SEQ ID NO: 134975 - DNA, 20 bp, Artificial Sequence
  Description of Artificial Sequence: Synthetic oligonucleotide
  Target: ATXN1; (+) strand; PAM type: NRG; PAM sequence: AGG
attaaaatcatcacatttga

SEQ ID NO: 134976 - DNA, 20 bp, Artificial Sequence
  Description of Artificial Sequence: Synthetic oligonucleotide
  Target: ATXN1; (+) strand; PAM type: NRG; PAM sequence: GAG
taaaatcatcacatttgaag

SEQ ID NO: 134977 - DNA, 20 bp, Artificial Sequence
  Description of Artificial Sequence: Synthetic oligonucleotide
  Target: ATXN1; (+) strand; PAM type: NRG; PAM sequence: AAG
ctttgtaatgctgatatgta

SEQ ID NO: 134978 - DNA, 20 bp, Artificial Sequence
  Description of Artificial Sequence: Synthetic oligonucleotide
  Target: ATXN1; (+) strand; PAM type: NRG; PAM sequence: CAG
gtaaagatcccattaaaaca

SEQ ID NO: 134979 - DNA, 20 bp, Artificial Sequence
  Description of Artificial Sequence: Synthetic oligonucleotide
  Target: ATXN1; (+) strand; PAM type: NRG; PAM sequence: TGG
ctttgatttaaaaatgactt

SEQ ID NO: 134980 - DNA, 20 bp, Artificial Sequence
  Description of Artificial Sequence: Synthetic oligonucleotide
  Target: ATXN1; (+) strand; PAM type: NRG; PAM sequence: AAG
ggattcctatgtcacgttaa

SEQ ID NO: 134981 - DNA, 20 bp, Artificial Sequence
  Description of Artificial Sequence: Synthetic oligonucleotide
  Target: ATXN1; (+) strand; PAM type: NRG; PAM sequence: TGG
atgtcacgttaaaagtgtgt

SEQ ID NO: 134982 - DNA, 20 bp, Artificial Sequence
  Description of Artificial Sequence: Synthetic oligonucleotide
  Target: ATXN1; (+) strand; PAM type: NRG; PAM sequence: GGG
tgtcacgttaaaagtgtgtt

SEQ ID NO: 134983 - DNA, 20 bp, Artificial Sequence
  Description of Artificial Sequence: Synthetic oligonucleotide
  Target: ATXN1; (+) strand; PAM type: NRG; PAM sequence: CAG
agtgtgttgggcattttatc

SEQ ID NO: 134984 - DNA, 20 bp, Artificial Sequence
  Description of Artificial Sequence: Synthetic oligonucleotide
  Target: ATXN1; (+) strand; PAM type: NRG; PAM sequence: TAG
gggcattttatccagtgact

SEQ ID NO: 134985 - DNA, 20 bp, Artificial Sequence
  Description of Artificial Sequence: Synthetic oligonucleotide
  Target: ATXN1; (+) strand; PAM type: NRG; PAM sequence: CAG
agtgacttagattatccttt

SEQ ID NO: 134986 - DNA, 20 bp, Artificial Sequence
  Description of Artificial Sequence: Synthetic oligonucleotide
  Target: ATXN1; (+) strand; PAM type: NRG; PAM sequence: AGG
gtgacttagattatcctttc

SEQ ID NO: 134987 - DNA, 20 bp, Artificial Sequence
  Description of Artificial Sequence: Synthetic oligonucleotide
  Target: ATXN1; (+) strand; PAM type: NRG; PAM sequence: GAG
gacttagattatcctttcag

SEQ ID NO: 134988 - DNA, 20 bp, Artificial Sequence
  Description of Artificial Sequence: Synthetic oligonucleotide
  Target: ATXN1; (+) strand; PAM type: NRG; PAM sequence: AAG
gaaatactgtacttcattgt

SEQ ID NO: 134989 - DNA, 20 bp, Artificial Sequence
  Description of Artificial Sequence: Synthetic oligonucleotide
  Target: ATXN1; (+) strand; PAM type: NRG; PAM sequence: GAG
cttcattgtaagtccttaat

SEQ ID NO: 134990 - DNA, 20 bp, Artificial Sequence
  Description of Artificial Sequence: Synthetic oligonucleotide
  Target: ATXN1; (+) strand; PAM type: NRG; PAM sequence: AGG
ttcattgtaagtccttaatg

SEQ ID NO: 134991 - DNA, 20 bp, Artificial Sequence
  Description of Artificial Sequence: Synthetic oligonucleotide
  Target: ATXN1; (+) strand; PAM type: NRG; PAM sequence: GGG
tcattgtaagtccttaatga

SEQ ID NO: 134992 - DNA, 20 bp, Artificial Sequence
  Description of Artificial Sequence: Synthetic oligonucleotide
  Target: ATXN1; (+) strand; PAM type: NRG; PAM sequence: TAG
gtccttaatgagggaccaat

SEQ ID NO: 134993 - DNA, 20 bp, Artificial Sequence
  Description of Artificial Sequence: Synthetic oligonucleotide
  Target: ATXN1; (+) strand; PAM type: NRG; PAM sequence: TGG
ccctccacttcaaattcctc

SEQ ID NO: 134994 - DNA, 20 bp, Artificial Sequence
  Description of Artificial Sequence: Synthetic oligonucleotide
  Target: ATXN1; (+) strand; PAM type: NRG; PAM sequence: GGG
cctccacttcaaattcctct

SEQ ID NO: 134995 - DNA, 20 bp, Artificial Sequence
  Description of Artificial Sequence: Synthetic oligonucleotide
  Target: ATXN1; (+) strand; PAM type: NRG; PAM sequence: GAG
ttcaaattcctctgggaaat

SEQ ID NO: 134996 - DNA, 20 bp, Artificial Sequence
  Description of Artificial Sequence: Synthetic oligonucleotide
  Target: ATXN1; (+) strand; PAM type: NRG; PAM sequence: AGG
tcaaattcctctgggaaatg

SEQ ID NO: 134997 - DNA, 20 bp, Artificial Sequence
  Description of Artificial Sequence: Synthetic oligonucleotide
  Target: ATXN1; (+) strand; PAM type: NRG; PAM sequence: CAG
attcctctgggaaatgaggt

SEQ ID NO: 134998 - DNA, 20 bp, Artificial Sequence
  Description of Artificial Sequence: Synthetic oligonucleotide
  Target: ATXN1; (+) strand; PAM type: NRG; PAM sequence: AAG
cagaatccacttcccaccca

SEQ ID NO: 134999 - DNA, 20 bp, Artificial Sequence
  Description of Artificial Sequence: Synthetic oligonucleotide
  Target: ATXN1; (+) strand; PAM type: NRG; PAM sequence: TGG
ttcccacccaaagcacctca

SEQ ID NO: 135000 - DNA, 20 bp, Artificial Sequence
  Description of Artificial Sequence: Synthetic oligonucleotide
  Target: ATXN1; (+) strand; PAM type: NRG; PAM sequence: GAG
cccacccaaagcacctcatg

SEQ ID NO: 135001 - DNA, 20 bp, Artificial Sequence
  Description of Artificial Sequence: Synthetic oligonucleotide
  Target: ATXN1; (+) strand; PAM type: NRG; PAM sequence: AGG
ccacccaaagcacctcatgg

SEQ ID NO: 135002 - DNA, 20 bp, Artificial Sequence
  Description of Artificial Sequence: Synthetic oligonucleotide
  Target: ATXN1; (+) strand; PAM type: NRG; PAM sequence: CAG
ggaggctgcatcaaatacta

SEQ ID NO: 135003 - DNA, 20 bp, Artificial Sequence
  Description of Artificial Sequence: Synthetic oligonucleotide
  Target: ATXN1; (+) strand; PAM type: NRG; PAM sequence: CAG
ggctgcatcaaatactacag

SEQ ID NO: 135004 - DNA, 20 bp, Artificial Sequence
  Description of Artificial Sequence: Synthetic oligonucleotide
  Target: ATXN1; (+) strand; PAM type: NRG; PAM sequence: AAG
tactacagcagcatttgtca

SEQ ID NO: 135005 - DNA, 20 bp, Artificial Sequence
  Description of Artificial Sequence: Synthetic oligonucleotide
  Target: ATXN1; (+) strand; PAM type: NRG; PAM sequence: AGG
actacagcagcatttgtcaa

SEQ ID NO: 135006 - DNA, 20 bp, Artificial Sequence
  Description of Artificial Sequence: Synthetic oligonucleotide
  Target: ATXN1; (+) strand; PAM type: NRG; PAM sequence: GGG
ctacagcagcatttgtcaaa

SEQ ID NO: 135007 - DNA, 20 bp, Artificial Sequence
  Description of Artificial Sequence: Synthetic oligonucleotide
  Target: ATXN1; (+) strand; PAM type: NRG; PAM sequence: GGG
tacagcagcatttgtcaaag

SEQ ID NO: 135008 - DNA, 20 bp, Artificial Sequence
  Description of Artificial Sequence: Synthetic oligonucleotide
  Target: ATXN1; (+) strand; PAM type: NRG; PAM sequence: GAG
cagcagcatttgtcaaaggg

SEQ ID NO: 135009 - DNA, 20 bp, Artificial Sequence
  Description of Artificial Sequence: Synthetic oligonucleotide
  Target: ATXN1; (+) strand; PAM type: NRG; PAM sequence: AAG
tcaaaggggagccctttcca

SEQ ID NO: 135010 - DNA, 20 bp, Artificial Sequence
  Description of Artificial Sequence: Synthetic oligonucleotide
  Target: ATXN1; (+) strand; PAM type: NRG; PAM sequence: AGG
caaaggggagccctttccaa

SEQ ID NO: 135011 - DNA, 20 bp, Artificial Sequence
  Description of Artificial Sequence: Synthetic oligonucleotide
  Target: ATXN1; (+) strand; PAM type: NRG; PAM sequence: AAG
ggggagccctttccaaaggc

SEQ ID NO: 135012 - DNA, 20 bp, Artificial Sequence
  Description of Artificial Sequence: Synthetic oligonucleotide
  Target: ATXN1; (+) strand; PAM type: NRG; PAM sequence: TGG
agccctttccaaaggcaaga

SEQ ID NO: 135013 - DNA, 20 bp, Artificial Sequence
  Description of Artificial Sequence: Synthetic oligonucleotide
  Target: ATXN1; (+) strand; PAM type: NRG; PAM sequence: GGG
gccctttccaaaggcaagat

SEQ ID NO: 135014 - DNA, 20 bp, Artificial Sequence
  Description of Artificial Sequence: Synthetic oligonucleotide
  Target: ATXN1; (+) strand; PAM type: NRG; PAM sequence: TAG
ctttccaaaggcaagatggg

SEQ ID NO: 135015 - DNA, 20 bp, Artificial Sequence
  Description of Artificial Sequence: Synthetic oligonucleotide
  Target: ATXN1; (+) strand; PAM type: NRG; PAM sequence: AAG
tccaaaggcaagatgggtag

SEQ ID NO: 135016 - DNA, 20 bp, Artificial Sequence
  Description of Artificial Sequence: Synthetic oligonucleotide
  Target: ATXN1; (+) strand; PAM type: NRG; PAM sequence: AGG
ccaaaggcaagatgggtaga

SEQ ID NO: 135017 - DNA, 20 bp, Artificial Sequence
  Description of Artificial Sequence: Synthetic oligonucleotide
  Target: ATXN1; (+) strand; PAM type: NRG; PAM sequence: GAG
aaaggcaagatgggtagaag

SEQ ID NO: 135018 - DNA, 20 bp, Artificial Sequence
  Description of Artificial Sequence: Synthetic oligonucleotide
  Target: ATXN1; (+) strand; PAM type: NRG; PAM sequence: AAG
tagaaggagaaatcttcatc

SEQ ID NO: 135019 - DNA, 20 bp, Artificial Sequence
  Description of Artificial Sequence: Synthetic oligonucleotide
  Target: ATXN1; (+) strand; PAM type: NRG; PAM sequence: AGG
agaaggagaaatcttcatca

SEQ ID NO: 135020 - DNA, 20 bp, Artificial Sequence
  Description of Artificial Sequence: Synthetic oligonucleotide
  Target: ATXN1; (+) strand; PAM type: NRG; PAM sequence: GGG
gaaggagaaatcttcatcaa

SEQ ID NO: 135021 - DNA, 20 bp, Artificial Sequence
  Description of Artificial Sequence: Synthetic oligonucleotide
  Target: ATXN1; (+) strand; PAM type: NRG; PAM sequence: CAG
agggctatgccttccaccga

SEQ ID NO: 135022 - DNA, 20 bp, Artificial Sequence
  Description of Artificial Sequence: Synthetic oligonucleotide
  Target: ATXN1; (+) strand; PAM type: NRG; PAM sequence: AGG
gggctatgccttccaccgac

SEQ ID NO: 135023 - DNA, 20 bp, Artificial Sequence
  Description of Artificial Sequence: Synthetic oligonucleotide
  Target: ATXN1; (+) strand; PAM type: NRG; PAM sequence: CAG
atgccttccaccgacaggca

SEQ ID NO: 135024 - DNA, 20 bp, Artificial Sequence
  Description of Artificial Sequence: Synthetic oligonucleotide
  Target: ATXN1; (+) strand; PAM type: NRG; PAM sequence: GAG
gccttccaccgacaggcaca

SEQ ID NO: 135025 - DNA, 20 bp, Artificial Sequence
  Description of Artificial Sequence: Synthetic oligonucleotide
  Target: ATXN1; (+) strand; PAM type: NRG; PAM sequence: AAG
accgacaggcacagagcaca

SEQ ID NO: 135026 - DNA, 20 bp, Artificial Sequence
  Description of Artificial Sequence: Synthetic oligonucleotide
  Target: ATXN1; (+) strand; PAM type: NRG; PAM sequence: AAG
gacaggcacagagcacaaag

SEQ ID NO: 135027 - DNA, 20 bp, Artificial Sequence
  Description of Artificial Sequence: Synthetic oligonucleotide
  Target: ATXN1; (+) strand; PAM type: NRG; PAM sequence: CAG
gcacagagcacaaagaagct

SEQ ID NO: 135028 - DNA, 20 bp, Artificial Sequence
  Description of Artificial Sequence: Synthetic oligonucleotide
  Target: ATXN1; (+) strand; PAM type: NRG; PAM sequence: AAG
agaagctcagcatttactat

SEQ ID NO: 135029 - DNA, 20 bp, Artificial Sequence
  Description of Artificial Sequence: Synthetic oligonucleotide
  Target: ATXN1; (+) strand; PAM type: NRG; PAM sequence: CAG
atttactataagatcttgca

SEQ ID NO: 135030 - DNA, 20 bp, Artificial Sequence
  Description of Artificial Sequence: Synthetic oligonucleotide
  Target: ATXN1; (+) strand; PAM type: NRG; PAM sequence: AGG
tttactataagatcttgcac

SEQ ID NO: 135031 - DNA, 20 bp, Artificial Sequence
  Description of Artificial Sequence: Synthetic oligonucleotide
  Target: ATXN1; (+) strand; PAM type: NRG; PAM sequence: GAG
tactataagatcttgcacag

SEQ ID NO: 135032 - DNA, 20 bp, Artificial Sequence
  Description of Artificial Sequence: Synthetic oligonucleotide
  Target: ATXN1; (+) strand; PAM type: NRG; PAM sequence: AAG
tgcacaggagctgttcaaac

SEQ ID NO: 135033 - DNA, 20 bp, Artificial Sequence
  Description of Artificial Sequence: Synthetic oligonucleotide
  Target: ATXN1; (+) strand; PAM type: NRG; PAM sequence: AAG
ggagctgttcaaacaagctg

SEQ ID NO: 135034 - DNA, 20 bp, Artificial Sequence
  Description of Artificial Sequence: Synthetic oligonucleotide
  Target: ATXN1; (+) strand; PAM type: NRG; PAM sequence: CAG
cacacccacgaatttcatct

SEQ ID NO: 135035 - DNA, 20 bp, Artificial Sequence
  Description of Artificial Sequence: Synthetic oligonucleotide
  Target: ATXN1; (+) strand; PAM type: NRG; PAM sequence: CAG
ctctcttttacctgctgcca

SEQ ID NO: 135036 - DNA, 20 bp, Artificial Sequence
  Description of Artificial Sequence: Synthetic oligonucleotide
  Target: ATXN1; (+) strand; PAM type: NRG; PAM sequence: AGG
tctcttttacctgctgccac

SEQ ID NO: 135037 - DNA, 20 bp, Artificial Sequence
  Description of Artificial Sequence: Synthetic oligonucleotide
  Target: ATXN1; (+) strand; PAM type: NRG; PAM sequence: GGG
ctcttttacctgctgccaca

SEQ ID NO: 135038 - DNA, 20 bp, Artificial Sequence
  Description of Artificial Sequence: Synthetic oligonucleotide
  Target: ATXN1; (+) strand; PAM type: NRG; PAM sequence: CAG
tttacctgctgccacaggga

SEQ ID NO: 135039 - DNA, 20 bp, Artificial Sequence
  Description of Artificial Sequence: Synthetic oligonucleotide
  Target: ATXN1; (+) strand; PAM type: NRG; PAM sequence: TGG
cagccttcctgctccctgat

SEQ ID NO: 135040 - DNA, 20 bp, Artificial Sequence
  Description of Artificial Sequence: Synthetic oligonucleotide
  Target: ATXN1; (+) strand; PAM type: NRG; PAM sequence: GGG
agccttcctgctccctgatt

SEQ ID NO: 135041 - DNA, 20 bp, Artificial Sequence
  Description of Artificial Sequence: Synthetic oligonucleotide
  Target: ATXN1; (+) strand; PAM type: NRG; PAM sequence: TGG
tccctgattgggtgtctcgc

SEQ ID NO: 135042 - DNA, 20 bp, Artificial Sequence
  Description of Artificial Sequence: Synthetic oligonucleotide
  Target: ATXN1; (+) strand; PAM type: NRG; PAM sequence: CAG
gctggctgtgcactcacctg

SEQ ID NO: 135043 - DNA, 20 bp, Artificial Sequence
  Description of Artificial Sequence: Synthetic oligonucleotide
  Target: ATXN1; (+) strand; PAM type: NRG; PAM sequence: AGG
ctggctgtgcactcacctgc

SEQ ID NO: 135044 - DNA, 20 bp, Artificial Sequence
  Description of Artificial Sequence: Synthetic oligonucleotide
  Target: ATXN1; (+) strand; PAM type: NRG; PAM sequence: GGG
tggctgtgcactcacctgca

SEQ ID NO: 135045 - DNA, 20 bp, Artificial Sequence
  Description of Artificial Sequence: Synthetic oligonucleotide
  Target: ATXN1; (+) strand; PAM type: NRG; PAM sequence: CAG
gtgcactcacctgcagggcg

SEQ ID NO: 135046 - DNA, 20 bp, Artificial Sequence
  Description of Artificial Sequence: Synthetic oligonucleotide
  Target: ATXN1; (+) strand; PAM type: NRG; PAM sequence: AGG
tgcactcacctgcagggcgc

SEQ ID NO: 135047 - DNA, 20 bp, Artificial Sequence
  Description of Artificial Sequence: Synthetic oligonucleotide
  Target: ATXN1; (+) strand; PAM type: NRG; PAM sequence: GGG
gcactcacctgcagggcgca

SEQ ID NO: 135048 - DNA, 20 bp, Artificial Sequence
  Description of Artificial Sequence: Synthetic oligonucleotide
  Target: ATXN1; (+) strand; PAM type: NRG; PAM sequence: CAG
ctccatctgcatcatgcact

SEQ ID NO: 135049 - DNA, 20 bp, Artificial Sequence
  Description of Artificial Sequence: Synthetic oligonucleotide
  Target: ATXN1; (+) strand; PAM type: NRG; PAM sequence: GAG
ccatctgcatcatgcactca

SEQ ID NO: 135050 - DNA, 20 bp, Artificial Sequence
  Description of Artificial Sequence: Synthetic oligonucleotide
  Target: ATXN1; (+) strand; PAM type: NRG; PAM sequence: AGG
catctgcatcatgcactcag

SEQ ID NO: 135051 - DNA, 20 bp, Artificial Sequence
  Description of Artificial Sequence: Synthetic oligonucleotide
  Target: ATXN1; (+) strand; PAM type: NRG; PAM sequence: GGG
atctgcatcatgcactcaga

SEQ ID NO: 135052 - DNA, 20 bp, Artificial Sequence
  Description of Artificial Sequence: Synthetic oligonucleotide
  Target: ATXN1; (+) strand; PAM type: NRG; PAM sequence: GGG
tctgcatcatgcactcagag

SEQ ID NO: 135053 - DNA, 20 bp, Artificial Sequence
  Description of Artificial Sequence: Synthetic oligonucleotide
  Target: ATXN1; (+) strand; PAM type: NRG; PAM sequence: GAG
tgcatcatgcactcagaggg

SEQ ID NO: 135054 - DNA, 20 bp, Artificial Sequence
  Description of Artificial Sequence: Synthetic oligonucleotide
  Target: ATXN1; (+) strand; PAM type: NRG; PAM sequence: TGG
agaggggagtgccactgctc

SEQ ID NO: 135055 - DNA, 20 bp, Artificial Sequence
  Description of Artificial Sequence: Synthetic oligonucleotide
  Target: ATXN1; (+) strand; PAM type: NRG; PAM sequence: GGG
gaggggagtgccactgctct

SEQ ID NO: 135056 - DNA, 20 bp, Artificial Sequence
  Description of Artificial Sequence: Synthetic oligonucleotide
  Target: ATXN1; (+) strand; PAM type: NRG; PAM sequence: CAG
gtgccactgctctgggtcac

SEQ ID NO: 135057 - DNA, 20 bp, Artificial Sequence
  Description of Artificial Sequence: Synthetic oligonucleotide
  Target: ATXN1; (+) strand; PAM type: NRG; PAM sequence: TGG
tctgggtcaccagcctgctc

SEQ ID NO: 135058 - DNA, 20 bp, Artificial Sequence
  Description of Artificial Sequence: Synthetic oligonucleotide
  Target: ATXN1; (+) strand; PAM type: NRG; PAM sequence: CAG
agcctgctctggctctgccg

SEQ ID NO: 135059 - DNA, 20 bp, Artificial Sequence
  Description of Artificial Sequence: Synthetic oligonucleotide
  Target: ATXN1; (+) strand; PAM type: NRG; PAM sequence: CAG
ctggctctgccgcagcctcc

SEQ ID NO: 135060 - DNA, 20 bp, Artificial Sequence
  Description of Artificial Sequence: Synthetic oligonucleotide
  Target: ATXN1; (+) strand; PAM type: NRG; PAM sequence: AGG
tggctctgccgcagcctccc

SEQ ID NO: 135061 - DNA, 20 bp, Artificial Sequence
  Description of Artificial Sequence: Synthetic oligonucleotide
  Target: ATXN1; (+) strand; PAM type: NRG; PAM sequence: GGG
ggctctgccgcagcctccca

SEQ ID NO: 135062 - DNA, 20 bp, Artificial Sequence
  Description of Artificial Sequence: Synthetic oligonucleotide
  Target: ATXN1; (+) strand; PAM type: NRG; PAM sequence: GGG
gctctgccgcagcctcccag

SEQ ID NO: 135063 - DNA, 20 bp, Artificial Sequence
  Description of Artificial Sequence: Synthetic oligonucleotide
  Target: ATXN1; (+) strand; PAM type: NRG; PAM sequence: GAG
ccgcagcctcccaggggatt

SEQ ID NO: 135064 - DNA, 20 bp, Artificial Sequence
  Description of Artificial Sequence: Synthetic oligonucleotide
  Target: ATXN1; (+) strand; PAM type: NRG; PAM sequence: TAG
tgagctcctactccttccac

SEQ ID NO: 135065 - DNA, 20 bp, Artificial Sequence
  Description of Artificial Sequence: Synthetic oligonucleotide
  Target: ATXN1; (+) strand; PAM type: NRG; PAM sequence: AAG
gctcctactccttccactag

SEQ ID NO: 135066 - DNA, 20 bp, Artificial Sequence
  Description of Artificial Sequence: Synthetic oligonucleotide
  Target: ATXN1; (+) strand; PAM type: NRG; PAM sequence: TGG
tactccttccactagaagca

SEQ ID NO: 135067 - DNA, 20 bp, Artificial Sequence
  Description of Artificial Sequence: Synthetic oligonucleotide
  Target: ATXN1; (+) strand; PAM type: NRG; PAM sequence: GAG
ccttccactagaagcatggt

SEQ ID NO: 135068 - DNA, 20 bp, Artificial Sequence
  Description of Artificial Sequence: Synthetic oligonucleotide
  Target: ATXN1; (+) strand; PAM type: NRG; PAM sequence: TAG
tagaagcatggtgagcaaat

SEQ ID NO: 135069 - DNA, 20 bp, Artificial Sequence
  Description of Artificial Sequence: Synthetic oligonucleotide
  Target: ATXN1; (+) strand; PAM type: NRG; PAM sequence: GAG
gaagcatggtgagcaaatta

SEQ ID NO: 135070 - DNA, 20 bp, Artificial Sequence
  Description of Artificial Sequence: Synthetic oligonucleotide
  Target: ATXN1; (+) strand; PAM type: NRG; PAM sequence: AGG
aagcatggtgagcaaattag

SEQ ID NO: 135071 - DNA, 20 bp, Artificial Sequence
  Description of Artificial Sequence: Synthetic oligonucleotide
  Target: ATXN1; (+) strand; PAM type: NRG; PAM sequence: CGG
ttagaggttataaacacctc

SEQ ID NO: 135072 - DNA, 20 bp, Artificial Sequence
  Description of Artificial Sequence: Synthetic oligonucleotide
  Target: ATXN1; (+) strand; PAM type: NRG; PAM sequence: TGG
gaggttataaacacctccgg

SEQ ID NO: 135073 - DNA, 20 bp, Artificial Sequence
  Description of Artificial Sequence: Synthetic oligonucleotide
  Target: ATXN1; (+) strand; PAM type: NRG; PAM sequence: AAG
gttataaacacctccggtgg

SEQ ID NO: 135074 - DNA, 20 bp, Artificial Sequence
  Description of Artificial Sequence: Synthetic oligonucleotide
  Target: ATXN1; (+) strand; PAM type: NRG; PAM sequence: AGG
ttataaacacctccggtgga

SEQ ID NO: 135075 - DNA, 20 bp, Artificial Sequence
  Description of Artificial Sequence: Synthetic oligonucleotide
  Target: ATXN1; (+) strand; PAM type: NRG; PAM sequence: GAG
ataaacacctccggtggaag

SEQ ID NO: 135076 - DNA, 20 bp, Artificial Sequence
  Description of Artificial Sequence: Synthetic oligonucleotide
  Target: ATXN1; (+) strand; PAM type: NRG; PAM sequence: AGG
taaacacctccggtggaagg

SEQ ID NO: 135077 - DNA, 20 bp, Artificial Sequence
  Description of Artificial Sequence: Synthetic oligonucleotide
  Target: ATXN1; (+) strand; PAM type: NRG; PAM sequence: GAG
aacacctccggtggaaggag

SEQ ID NO: 135078 - DNA, 20 bp, Artificial Sequence
  Description of Artificial Sequence: Synthetic oligonucleotide
  Target: ATXN1; (+) strand; PAM type: NRG; PAM sequence: TGG
tggaaggaggagaattcctt

SEQ ID NO: 135079 - DNA, 20 bp, Artificial Sequence
  Description of Artificial Sequence: Synthetic oligonucleotide
  Target: ATXN1; (+) strand; PAM type: NRG; PAM sequence: GGG
ggaaggaggagaattccttt

SEQ ID NO: 135080 - DNA, 20 bp, Artificial Sequence
  Description of Artificial Sequence: Synthetic oligonucleotide
  Target: ATXN1; (+) strand; PAM type: NRG; PAM sequence: AAG
agaattcctttgggctttgt

SEQ ID NO: 135081 - DNA, 20 bp, Artificial Sequence
  Description of Artificial Sequence: Synthetic oligonucleotide
  Target: ATXN1; (+) strand; PAM type: NRG; PAM sequence: AGG
gaattcctttgggctttgta

SEQ ID NO: 135082 - DNA, 20 bp, Artificial Sequence
  Description of Artificial Sequence: Synthetic oligonucleotide
  Target: ATXN1; (+) strand; PAM type: NRG; PAM sequence: GGG
aattcctttgggctttgtaa

SEQ ID NO: 135083 - DNA, 20 bp, Artificial Sequence
  Description of Artificial Sequence: Synthetic oligonucleotide
  Target: ATXN1; (+) strand; PAM type: NRG; PAM sequence: CAG
gctttgtaagggaacctcgt

SEQ ID NO: 135084 - DNA, 20 bp, Artificial Sequence
  Description of Artificial Sequence: Synthetic oligonucleotide
  Target: ATXN1; (+) strand; PAM type: NRG; PAM sequence: AAG
aagggaacctcgtcagccgc

SEQ ID NO: 135085 - DNA, 20 bp, Artificial Sequence
  Description of Artificial Sequence: Synthetic oligonucleotide
  Target: ATXN1; (+) strand; PAM type: NRG; PAM sequence: CGG
tcgtcagccgcaagaatctc

SEQ ID NO: 135086 - DNA, 20 bp, Artificial Sequence
  Description of Artificial Sequence: Synthetic oligonucleotide
  Target: ATXN1; (+) strand; PAM type: NRG; PAM sequence: GGG
cgtcagccgcaagaatctcc

SEQ ID NO: 135087 - DNA, 20 bp, Artificial Sequence
  Description of Artificial Sequence: Synthetic oligonucleotide
  Target: ATXN1; (+) strand; PAM type: NRG; PAM sequence: GGG
gtcagccgcaagaatctccg

SEQ ID NO: 135088 - DNA, 20 bp, Artificial Sequence
  Description of Artificial Sequence: Synthetic oligonucleotide
  Target: ATXN1; (+) strand; PAM type: NRG; PAM sequence: AAG
cgcaagaatctccggggtat

SEQ ID NO: 135089 - DNA, 20 bp, Artificial Sequence
  Description of Artificial Sequence: Synthetic oligonucleotide
  Target: ATXN1; (+) strand; PAM type: NRG; PAM sequence: TAG
aatctccggggtataagaca

SEQ ID NO: 135090 - DNA, 20 bp, Artificial Sequence
  Description of Artificial Sequence: Synthetic oligonucleotide
  Target: ATXN1; (+) strand; PAM type: NRG; PAM sequence: AGG
atctccggggtataagacat

SEQ ID NO: 135091 - DNA, 20 bp, Artificial Sequence
  Description of Artificial Sequence: Synthetic oligonucleotide
  Target: ATXN1; (+) strand; PAM type: NRG; PAM sequence: TGG
acatgctcacccttgcccct

SEQ ID NO: 135092 - DNA, 20 bp, Artificial Sequence
  Description of Artificial Sequence: Synthetic oligonucleotide
  Target: ATXN1; (+) strand; PAM type: NRG; PAM sequence: TGG
cccttgccccttggccctgt

SEQ ID NO: 135093 - DNA, 20 bp, Artificial Sequence
  Description of Artificial Sequence: Synthetic oligonucleotide
  Target: ATXN1; (+) strand; PAM type: NRG; PAM sequence: GGG
ccttgccccttggccctgtt

SEQ ID NO: 135094 - DNA, 20 bp, Artificial Sequence
  Description of Artificial Sequence: Synthetic oligonucleotide
  Target: ATXN1; (+) strand; PAM type: NRG; PAM sequence: TGG
ttggccctgttgggcatatg

SEQ ID NO: 135095 - DNA, 20 bp, Artificial Sequence
  Description of Artificial Sequence: Synthetic oligonucleotide
  Target: ATXN1; (+) strand; PAM type: NRG; PAM sequence: TGG
cctttttctgcccacaatta

SEQ ID NO: 135096 - DNA, 20 bp, Artificial Sequence
  Description of Artificial Sequence: Synthetic oligonucleotide
  Target: ATXN1; (+) strand; PAM type: NRG; PAM sequence: CAG
ttttctgcccacaattatgg

SEQ ID NO: 135097 - DNA, 20 bp, Artificial Sequence
  Description of Artificial Sequence: Synthetic oligonucleotide
  Target: ATXN1; (+) strand; PAM type: NRG; PAM sequence: CAG
ttatggcagaaatgcccatc

SEQ ID NO: 135098 - DNA, 20 bp, Artificial Sequence
  Description of Artificial Sequence: Synthetic oligonucleotide
  Target: ATXN1; (+) strand; PAM type: NRG; PAM sequence: AGG
tatggcagaaatgcccatcc

SEQ ID NO: 135099 - DNA, 20 bp, Artificial Sequence
  Description of Artificial Sequence: Synthetic oligonucleotide
  Target: ATXN1; (+) strand; PAM type: NRG; PAM sequence: AAG
aatgctgcttcacatgttcg

SEQ ID NO: 135100 - DNA, 20 bp, Artificial Sequence
  Description of Artificial Sequence: Synthetic oligonucleotide
  Target: ATXN1; (+) strand; PAM type: NRG; PAM sequence: TGG
tgttcgaagaatgcctcaca

SEQ ID NO: 135101 - DNA, 20 bp, Artificial Sequence
  Description of Artificial Sequence: Synthetic oligonucleotide
  Target: ATXN1; (+) strand; PAM type: NRG; PAM sequence: GAG
gaagaatgcctcacatggtt

SEQ ID NO: 135102 - DNA, 20 bp, Artificial Sequence
  Description of Artificial Sequence: Synthetic oligonucleotide
  Target: ATXN1; (+) strand; PAM type: NRG; PAM sequence: TGG
cacatggttgagaatactgc

SEQ ID NO: 135103 - DNA, 20 bp, Artificial Sequence
  Description of Artificial Sequence: Synthetic oligonucleotide
  Target: ATXN1; (+) strand; PAM type: NRG; PAM sequence: AAG
gaatactgctggtcctcaac

SEQ ID NO: 135104 - DNA, 20 bp, Artificial Sequence
  Description of Artificial Sequence: Synthetic oligonucleotide
  Target: ATXN1; (+) strand; PAM type: NRG; PAM sequence: CAG
tactgctggtcctcaacaag

SEQ ID NO: 135105 - DNA, 20 bp, Artificial Sequence
  Description of Artificial Sequence: Synthetic oligonucleotide
  Target: ATXN1; (+) strand; PAM type: NRG; PAM sequence: GAG
tctatttttttttttttttt

SEQ ID NO: 135106 - DNA, 20 bp, Artificial Sequence
  Description of Artificial Sequence: Synthetic oligonucleotide
  Target: ATXN1; (+) strand; PAM type: NRG; PAM sequence: CAG
ttttttttttttttttgaga

SEQ ID NO: 135107 - DNA, 20 bp, Artificial Sequence
  Description of Artificial Sequence: Synthetic oligonucleotide
  Target: ATXN1; (+) strand; PAM type: NRG; PAM sequence: GAG
ttttttttttttttgagaca

SEQ ID NO: 135108 - DNA, 20 bp, Artificial Sequence
  Description of Artificial Sequence: Synthetic oligonucleotide
  Target: ATXN1; (+) strand; PAM type: NRG; PAM sequence: CAG
cagagtcttgctctgtcacc

SEQ ID NO: 135109 - DNA, 20 bp, Artificial Sequence
  Description of Artificial Sequence: Synthetic oligonucleotide
  Target: ATXN1; (+) strand; PAM type: NRG; PAM sequence: AGG
agagtcttgctctgtcaccc

SEQ ID NO: 135110 - DNA, 20 bp, Artificial Sequence
  Description of Artificial Sequence: Synthetic oligonucleotide
  Target: ATXN1; (+) strand; PAM type: NRG; PAM sequence: TGG
tcttgctctgtcacccaggc

SEQ ID NO: 135111 - DNA, 20 bp, Artificial Sequence
  Description of Artificial Sequence: Synthetic oligonucleotide
  Target: ATXN1; (+) strand; PAM type: NRG; PAM sequence: GAG
ttgctctgtcacccaggctg

SEQ ID NO: 135112 - DNA, 20 bp, Artificial Sequence
  Description of Artificial Sequence: Synthetic oligonucleotide
  Target: ATXN1; (+) strand; PAM type: NRG; PAM sequence: CAG
ctgtcacccaggctggagtg

SEQ ID NO: 135113 - DNA, 20 bp, Artificial Sequence
  Description of Artificial Sequence: Synthetic oligonucleotide
  Target: ATXN1; (+) strand; PAM type: NRG; PAM sequence: TGG
tcacccaggctggagtgcag

SEQ ID NO: 135114 - DNA, 20 bp, Artificial Sequence
  Description of Artificial Sequence: Synthetic oligonucleotide
  Target: ATXN1; (+) strand; PAM type: NRG; PAM sequence: TGG
ggagtgcagtggcgcaatct

SEQ ID NO: 135115 - DNA, 20 bp, Artificial Sequence
  Description of Artificial Sequence: Synthetic oligonucleotide
  Target: ATXN1; (+) strand; PAM type: NRG; PAM sequence: CAG
ggcgcaatcttggctcactg

SEQ ID NO: 135116 - DNA, 20 bp, Artificial Sequence
  Description of Artificial Sequence: Synthetic oligonucleotide
  Target: ATXN1; (+) strand; PAM type: NRG; PAM sequence: CAG
tcactgcagcctctacctct

SEQ ID NO: 135117 - DNA, 20 bp, Artificial Sequence
  Description of Artificial Sequence: Synthetic oligonucleotide
  Target: ATXN1; (+) strand; PAM type: NRG; PAM sequence: TAG
agcctctacctctcagattc

SEQ ID NO: 135118 - DNA, 20 bp, Artificial Sequence
  Description of Artificial Sequence: Synthetic oligonucleotide
  Target: ATXN1; (+) strand; PAM type: NRG; PAM sequence: CAG
ttctcctgcctctgcctccc

SEQ ID NO: 135119 - DNA, 20 bp, Artificial Sequence
  Description of Artificial Sequence: Synthetic oligonucleotide
  Target: ATXN1; (+) strand; PAM type: NRG; PAM sequence: TAG
tcctgcctctgcctccccag

SEQ ID NO: 135120 - DNA, 20 bp, Artificial Sequence
  Description of Artificial Sequence: Synthetic oligonucleotide
  Target: ATXN1; (+) strand; PAM type: NRG; PAM sequence: TGG
gcctctgcctccccagtagc

SEQ ID NO: 135121 - DNA, 20 bp, Artificial Sequence
  Description of Artificial Sequence: Synthetic oligonucleotide
  Target: ATXN1; (+) strand; PAM type: NRG; PAM sequence: GGG
cctctgcctccccagtagct

SEQ ID NO: 135122 - DNA, 20 bp, Artificial Sequence
  Description of Artificial Sequence: Synthetic oligonucleotide
  Target: ATXN1; (+) strand; PAM type: NRG; PAM sequence: CAG
ctccccagtagctgggcttc

SEQ ID NO: 135123 - DNA, 20 bp, Artificial Sequence
  Description of Artificial Sequence: Synthetic oligonucleotide
  Target: ATXN1; (+) strand; PAM type: NRG; PAM sequence: AGG
tccccagtagctgggcttcc

SEQ ID NO: 135124 - DNA, 20 bp, Artificial Sequence
  Description of Artificial Sequence: Synthetic oligonucleotide
  Target: ATXN1; (+) strand; PAM type: NRG; PAM sequence: TGG
caggcacatgccaccacact

SEQ ID NO: 135125 - DNA, 20 bp, Artificial Sequence
  Description of Artificial Sequence: Synthetic oligonucleotide
  Target: ATXN1; (+) strand; PAM type: NRG; PAM sequence: CAG
tggctatttttttgtatttt

SEQ ID NO: 135126 - DNA, 20 bp, Artificial Sequence
  Description of Artificial Sequence: Synthetic oligonucleotide
  Target: ATXN1; (+) strand; PAM type: NRG; PAM sequence: GAG
atttttttgtattttcagtc

SEQ ID NO: 135127 - DNA, 20 bp, Artificial Sequence
  Description of Artificial Sequence: Synthetic oligonucleotide
  Target: ATXN1; (+) strand; PAM type: NRG; PAM sequence: CGG
ttttgtattttcagtcgaga

SEQ ID NO: 135128 - DNA, 20 bp, Artificial Sequence
  Description of Artificial Sequence: Synthetic oligonucleotide
  Target: ATXN1; (+) strand; PAM type: NRG; PAM sequence: GGG
tttgtattttcagtcgagac

SEQ ID NO: 135129 - DNA, 20 bp, Artificial Sequence
  Description of Artificial Sequence: Synthetic oligonucleotide
  Target: ATXN1; (+) strand; PAM type: NRG; PAM sequence: GGG
ttgtattttcagtcgagacg

SEQ ID NO: 135130 - DNA, 20 bp, Artificial Sequence
  Description of Artificial Sequence: Synthetic oligonucleotide
  Target: ATXN1; (+) strand; PAM type: NRG; PAM sequence: TGG
gagacggggtttcaccatgt

SEQ ID NO: 135131 - DNA, 20 bp, Artificial Sequence
  Description of Artificial Sequence: Synthetic oligonucleotide
  Target: ATXN1; (+) strand; PAM type: NRG; PAM sequence: TAG
cggggtttcaccatgttggt

SEQ ID NO: 135132 - DNA, 20 bp, Artificial Sequence
  Description of Artificial Sequence: Synthetic oligonucleotide
  Target: ATXN1; (+) strand; PAM type: NRG; PAM sequence: AGG
ggggtttcaccatgttggtt

SEQ ID NO: 135133 - DNA, 20 bp, Artificial Sequence
  Description of Artificial Sequence: Synthetic oligonucleotide
  Target: ATXN1; (+) strand; PAM type: NRG; PAM sequence: CAG
tgatctcaaactcccgacct

SEQ ID NO: 135134 - DNA, 20 bp, Artificial Sequence
  Description of Artificial Sequence: Synthetic oligonucleotide
  Target: ATXN1; (+) strand; PAM type: NRG; PAM sequence: AGG
gatctcaaactcccgacctc

SEQ ID NO: 135135 - DNA, 20 bp, Artificial Sequence
  Description of Artificial Sequence: Synthetic oligonucleotide
  Target: ATXN1; (+) strand; PAM type: NRG; PAM sequence: CGG
ctcaggtgatccacccgcct

SEQ ID NO: 135136 - DNA, 20 bp, Artificial Sequence
  Description of Artificial Sequence: Synthetic oligonucleotide
  Target: ATXN1; (+) strand; PAM type: NRG; PAM sequence: AAG
tccacccgcctcggcctccc

SEQ ID NO: 135137 - DNA, 20 bp, Artificial Sequence
  Description of Artificial Sequence: Synthetic oligonucleotide
  Target: ATXN1; (+) strand; PAM type: NRG; PAM sequence: AGG
ccacccgcctcggcctccca

SEQ ID NO: 135138 - DNA, 20 bp, Artificial Sequence
  Description of Artificial Sequence: Synthetic oligonucleotide
  Target: ATXN1; (+) strand; PAM type: NRG; PAM sequence: TGG
gcctcggcctcccaaggtgc

SEQ ID NO: 135139 - DNA, 20 bp, Artificial Sequence
  Description of Artificial Sequence: Synthetic oligonucleotide
  Target: ATXN1; (+) strand; PAM type: NRG; PAM sequence: GGG
cctcggcctcccaaggtgct

SEQ ID NO: 135140 - DNA, 20 bp, Artificial Sequence
  Description of Artificial Sequence: Synthetic oligonucleotide
  Target: ATXN1; (+) strand; PAM type: NRG; PAM sequence: CAG
tcccaaggtgctgggatttg

SEQ ID NO: 135141 - DNA, 20 bp, Artificial Sequence
  Description of Artificial Sequence: Synthetic oligonucleotide
  Target: ATXN1; (+) strand; PAM type: NRG; PAM sequence: AGG
cccaaggtgctgggatttgc

SEQ ID NO: 135142 - DNA, 20 bp, Artificial Sequence
  Description of Artificial Sequence: Synthetic oligonucleotide
  Target: ATXN1; (+) strand; PAM type: NRG; PAM sequence: GAG
gtgctgggatttgcaggcgt

SEQ ID NO: 135143 - DNA, 20 bp, Artificial Sequence
  Description of Artificial Sequence: Synthetic oligonucleotide
  Target: ATXN1; (+) strand; PAM type: NRG; PAM sequence: TGG
caggcgtgagccaccatgcc

SEQ ID NO: 135144 - DNA, 20 bp, Artificial Sequence
  Description of Artificial Sequence: Synthetic oligonucleotide
  Target: ATXN1; (+) strand; PAM type: NRG; PAM sequence: AAG
cctaaaactattcttgatgt

SEQ ID NO: 135145 - DNA, 20 bp, Artificial Sequence
  Description of Artificial Sequence: Synthetic oligonucleotide
  Target: ATXN1; (+) strand; PAM type: NRG; PAM sequence: AGG
ctaaaactattcttgatgta

SEQ ID NO: 135146 - DNA, 20 bp, Artificial Sequence
  Description of Artificial Sequence: Synthetic oligonucleotide
  Target: ATXN1; (+) strand; PAM type: NRG; PAM sequence: GAG
aaaactattcttgatgtaag

SEQ ID NO: 135147 - DNA, 20 bp, Artificial Sequence
  Description of Artificial Sequence: Synthetic oligonucleotide
  Target: ATXN1; (+) strand; PAM type: NRG; PAM sequence: AAG
aaacatattcctaaatgcta

SEQ ID NO: 135148 - DNA, 20 bp, Artificial Sequence
  Description of Artificial Sequence: Synthetic oligonucleotide
  Target: ATXN1; (+) strand; PAM type: NRG; PAM sequence: AGG
aacatattcctaaatgctaa

SEQ ID NO: 135149 - DNA, 20 bp, Artificial Sequence
  Description of Artificial Sequence: Synthetic oligonucleotide
  Target: ATXN1; (+) strand; PAM type: NRG; PAM sequence: CAG
atattcctaaatgctaaagg

SEQ ID NO: 135150 - DNA, 20 bp, Artificial Sequence
  Description of Artificial Sequence: Synthetic oligonucleotide
  Target: ATXN1; (+) strand; PAM type: NRG; PAM sequence: TGG
aggcagtgctgccaaatcca

SEQ ID NO: 135151 - DNA, 20 bp, Artificial Sequence
  Description of Artificial Sequence: Synthetic oligonucleotide
  Target: ATXN1; (+) strand; PAM type: NRG; PAM sequence: CAG
gctgccaaatccatggctcc

SEQ ID NO: 135152 - DNA, 20 bp, Artificial Sequence
  Description of Artificial Sequence: Synthetic oligonucleotide
  Target: ATXN1; (+) strand; PAM type: NRG; PAM sequence: TAG
caaatccatggctcccagca

SEQ ID NO: 135153 - DNA, 20 bp, Artificial Sequence
  Description of Artificial Sequence: Synthetic oligonucleotide
  Target: ATXN1; (+) strand; PAM type: NRG; PAM sequence: AGG
aaatccatggctcccagcat

SEQ ID NO: 135154 - DNA, 20 bp, Artificial Sequence
  Description of Artificial Sequence: Synthetic oligonucleotide
  Target: ATXN1; (+) strand; PAM type: NRG; PAM sequence: AAG
atggctcccagcataggcta

SEQ ID NO: 135155 - DNA, 20 bp, Artificial Sequence
  Description of Artificial Sequence: Synthetic oligonucleotide
  Target: ATXN1; (+) strand; PAM type: NRG; PAM sequence: TAG
agcataggctaaagttttat

SEQ ID NO: 135156 - DNA, 20 bp, Artificial Sequence
  Description of Artificial Sequence: Synthetic oligonucleotide
  Target: ATXN1; (+) strand; PAM type: NRG; PAM sequence: AGG
gcataggctaaagttttatt

SEQ ID NO: 135157 - DNA, 20 bp, Artificial Sequence
  Description of Artificial Sequence: Synthetic oligonucleotide
  Target: ATXN1; (+) strand; PAM type: NRG; PAM sequence: GAG
ataggctaaagttttattag

SEQ ID NO: 135158 - DNA, 20 bp, Artificial Sequence
  Description of Artificial Sequence: Synthetic oligonucleotide
  Target: ATXN1; (+) strand; PAM type: NRG; PAM sequence: CAG
ctaaagttttattaggagac

SEQ ID NO: 135159 - DNA, 20 bp, Artificial Sequence
  Description of Artificial Sequence: Synthetic oligonucleotide
  Target: ATXN1; (+) strand; PAM type: NRG; PAM sequence: AGG
taaagttttattaggagacc

SEQ ID NO: 135160 - DNA, 20 bp, Artificial Sequence
  Description of Artificial Sequence: Synthetic oligonucleotide
  Target: ATXN1; (+) strand; PAM type: NRG; PAM sequence: GAG
aagttttattaggagaccag

SEQ ID NO: 135161 - DNA, 20 bp, Artificial Sequence
  Description of Artificial Sequence: Synthetic oligonucleotide
  Target: ATXN1; (+) strand; PAM type: NRG; PAM sequence: TGG
accaggagtgcacacatctc

SEQ ID NO: 135162 - DNA, 20 bp, Artificial Sequence
  Description of Artificial Sequence: Synthetic oligonucleotide
  Target: ATXN1; (+) strand; PAM type: NRG; PAM sequence: CAG
ggagtgcacacatctctggc

SEQ ID NO: 135163 - DNA, 20 bp, Artificial Sequence
  Description of Artificial Sequence: Synthetic oligonucleotide
  Target: ATXN1; (+) strand; PAM type: NRG; PAM sequence: AGG
gagtgcacacatctctggcc

SEQ ID NO: 135164 - DNA, 20 bp, Artificial Sequence
  Description of Artificial Sequence: Synthetic oligonucleotide
  Target: ATXN1; (+) strand; PAM type: NRG; PAM sequence: GGG
agtgcacacatctctggcca

SEQ ID NO: 135165 - DNA, 20 bp, Artificial Sequence
  Description of Artificial Sequence: Synthetic oligonucleotide
  Target: ATXN1; (+) strand; PAM type: NRG; PAM sequence: CAG
cacacatctctggccaggga

SEQ ID NO: 135166 - DNA, 20 bp, Artificial Sequence
  Description of Artificial Sequence: Synthetic oligonucleotide
  Target: ATXN1; (+) strand; PAM type: NRG; PAM sequence: AAG
atctctggccagggacagca

SEQ ID NO: 135167 - DNA, 20 bp, Artificial Sequence
  Description of Artificial Sequence: Synthetic oligonucleotide
  Target: ATXN1; (+) strand; PAM type: NRG; PAM sequence: AAG
ctggccagggacagcaaaga

SEQ ID NO: 135168 - DNA, 20 bp, Artificial Sequence
  Description of Artificial Sequence: Synthetic oligonucleotide
  Target: ATXN1; (+) strand; PAM type: NRG; PAM sequence: AGG
tggccagggacagcaaagaa

SEQ ID NO: 135169 - DNA, 20 bp, Artificial Sequence
  Description of Artificial Sequence: Synthetic oligonucleotide
  Target: ATXN1; (+) strand; PAM type: NRG; PAM sequence: CAG
ccagggacagcaaagaaagg

SEQ ID NO: 135170 - DNA, 20 bp, Artificial Sequence
  Description of Artificial Sequence: Synthetic oligonucleotide
  Target: ATXN1; (+) strand; PAM type: NRG; PAM sequence: GAG
gacagcaaagaaaggcagct

SEQ ID NO: 135171 - DNA, 20 bp, Artificial Sequence
  Description of Artificial Sequence: Synthetic oligonucleotide
  Target: ATXN1; (+) strand; PAM type: NRG; PAM sequence: TGG
gctgagtcctacaacactgc

SEQ ID NO: 135172 - DNA, 20 bp, Artificial Sequence
  Description of Artificial Sequence: Synthetic oligonucleotide
  Target: ATXN1; (+) strand; PAM type: NRG; PAM sequence: AAG
gagtcctacaacactgctgg

SEQ ID NO: 135173 - DNA, 20 bp, Artificial Sequence
  Description of Artificial Sequence: Synthetic oligonucleotide
  Target: ATXN1; (+) strand; PAM type: NRG; PAM sequence: AGG
agtcctacaacactgctgga

SEQ ID NO: 135174 - DNA, 20 bp, Artificial Sequence
  Description of Artificial Sequence: Synthetic oligonucleotide
  Target: ATXN1; (+) strand; PAM type: NRG; PAM sequence: GAG
tcctacaacactgctggaag

SEQ ID NO: 135175 - DNA, 20 bp, Artificial Sequence
  Description of Artificial Sequence: Synthetic oligonucleotide
  Target: ATXN1; (+) strand; PAM type: NRG; PAM sequence: AAG
tacaacactgctggaaggag

SEQ ID NO: 135176 - DNA, 20 bp, Artificial Sequence
  Description of Artificial Sequence: Synthetic oligonucleotide
  Target: ATXN1; (+) strand; PAM type: NRG; PAM sequence: CAG
ctgctggaaggagaagccaa

SEQ ID NO: 135177 - DNA, 20 bp, Artificial Sequence
  Description of Artificial Sequence: Synthetic oligonucleotide
  Target: ATXN1; (+) strand; PAM type: NRG; PAM sequence: TAG
ggaaggagaagccaacagtc

SEQ ID NO: 135178 - DNA, 20 bp, Artificial Sequence
  Description of Artificial Sequence: Synthetic oligonucleotide
  Target: ATXN1; (+) strand; PAM type: NRG; PAM sequence: AGG
gaaggagaagccaacagtct

SEQ ID NO: 135179 - DNA, 20 bp, Artificial Sequence
  Description of Artificial Sequence: Synthetic oligonucleotide
  Target: ATXN1; (+) strand; PAM type: NRG; PAM sequence: AAG
gtctaggatttaaaaaaaaa

SEQ ID NO: 135180 - DNA, 20 bp, Artificial Sequence
  Description of Artificial Sequence: Synthetic oligonucleotide
  Target: ATXN1; (+) strand; PAM type: NRG; PAM sequence: AAG
taggatttaaaaaaaaaaag

SEQ ID NO: 135181 - DNA, 20 bp, Artificial Sequence
  Description of Artificial Sequence: Synthetic oligonucleotide
  Target: ATXN1; (+) strand; PAM type: NRG; PAM sequence: GAG
tttaaaaaaaaaaagaagct

SEQ ID NO: 135182 - DNA, 20 bp, Artificial Sequence
  Description of Artificial Sequence: Synthetic oligonucleotide
  Target: ATXN1; (+) strand; PAM type: NRG; PAM sequence: AAG
aagaagctgagtctgccatt

SEQ ID NO: 135183 - DNA, 20 bp, Artificial Sequence
  Description of Artificial Sequence: Synthetic oligonucleotide
  Target: ATXN1; (+) strand; PAM type: NRG; PAM sequence: AAG
tgagtctgccattaagaatg

SEQ ID NO: 135184 - DNA, 20 bp, Artificial Sequence
  Description of Artificial Sequence: Synthetic oligonucleotide
  Target: ATXN1; (+) strand; PAM type: NRG; PAM sequence: CAG
aatgaagtaaattgctaaca

SEQ ID NO: 135185 - DNA, 20 bp, Artificial Sequence
  Description of Artificial Sequence: Synthetic oligonucleotide
  Target: ATXN1; (+) strand; PAM type: NRG; PAM sequence: TGG
acacacacaaaatgataaac

SEQ ID NO: 135186 - DNA, 20 bp, Artificial Sequence
  Description of Artificial Sequence: Synthetic oligonucleotide
  Target: ATXN1; (+) strand; PAM type: NRG; PAM sequence: GAG
acacaaaatgataaactggt

SEQ ID NO: 135187 - DNA, 20 bp, Artificial Sequence
  Description of Artificial Sequence: Synthetic oligonucleotide
  Target: ATXN1; (+) strand; PAM type: NRG; PAM sequence: AGG
cacaaaatgataaactggtg

SEQ ID NO: 135188 - DNA, 20 bp, Artificial Sequence
  Description of Artificial Sequence: Synthetic oligonucleotide
  Target: ATXN1; (+) strand; PAM type: NRG; PAM sequence: TAG
gaggtgatgaatatattaac

SEQ ID NO: 135189 - DNA, 20 bp, Artificial Sequence
  Description of Artificial Sequence: Synthetic oligonucleotide
  Target: ATXN1; (+) strand; PAM type: NRG; PAM sequence: AAG
ttattgcctataaatataaa

SEQ ID NO: 135190 - DNA, 20 bp, Artificial Sequence
  Description of Artificial Sequence: Synthetic oligonucleotide
  Target: ATXN1; (+) strand; PAM type: NRG; PAM sequence: AAG
aaagttaaaacaaaaaatta

SEQ ID NO: 135191 - DNA, 20 bp, Artificial Sequence
  Description of Artificial Sequence: Synthetic oligonucleotide
  Target: ATXN1; (+) strand; PAM type: NRG; PAM sequence: TGG
caaaaaattaaagaaataaa

SEQ ID NO: 135192 - DNA, 20 bp, Artificial Sequence
  Description of Artificial Sequence: Synthetic oligonucleotide
  Target: ATXN1; (+) strand; PAM type: NRG; PAM sequence: AAG
aattaaagaaataaatggtg

SEQ ID NO: 135193 - DNA, 20 bp, Artificial Sequence
  Description of Artificial Sequence: Synthetic oligonucleotide
  Target: ATXN1; (+) strand; PAM type: NRG; PAM sequence: TAG
atgctttcatgcatgctaca

SEQ ID NO: 135194 - DNA, 20 bp, Artificial Sequence
  Description of Artificial Sequence: Synthetic oligonucleotide
  Target: ATXN1; (+) strand; PAM type: NRG; PAM sequence: CGG
catagcttgtcacaacctgc

SEQ ID NO: 135195 - DNA, 20 bp, Artificial Sequence
  Description of Artificial Sequence: Synthetic oligonucleotide
  Target: ATXN1; (+) strand; PAM type: NRG; PAM sequence: CGG
cttgtcacaacctgccggaa

SEQ ID NO: 135196 - DNA, 20 bp, Artificial Sequence
  Description of Artificial Sequence: Synthetic oligonucleotide
  Target: ATXN1; (+) strand; PAM type: NRG; PAM sequence: GGG
ttgtcacaacctgccggaac

SEQ ID NO: 135197 - DNA, 20 bp, Artificial Sequence
  Description of Artificial Sequence: Synthetic oligonucleotide
  Target: ATXN1; (+) strand; PAM type: NRG; PAM sequence: AAG
tgccaatgtgacatgctttt

SEQ ID NO: 135198 - DNA, 20 bp, Artificial Sequence
  Description of Artificial Sequence: Synthetic oligonucleotide
  Target: ATXN1; (+) strand; PAM type: NRG; PAM sequence: CAG
gtgacatgcttttaagatca

SEQ ID NO: 135199 - DNA, 20 bp, Artificial Sequence
  Description of Artificial Sequence: Synthetic oligonucleotide
  Target: ATXN1; (+) strand; PAM type: NRG; PAM sequence: CAG
cttttaagatcacagccctc

SEQ ID NO: 135200 - DNA, 20 bp, Artificial Sequence
  Description of Artificial Sequence: Synthetic oligonucleotide
  Target: ATXN1; (+) strand; PAM type: NRG; PAM sequence: AAG
atacctgaaactccataatt

SEQ ID NO: 135201 - DNA, 20 bp, Artificial Sequence
  Description of Artificial Sequence: Synthetic oligonucleotide
  Target: ATXN1; (+) strand; PAM type: NRG; PAM sequence: GAG
acctgaaactccataattaa

SEQ ID NO: 135202 - DNA, 20 bp, Artificial Sequence
  Description of Artificial Sequence: Synthetic oligonucleotide
  Target: ATXN1; (+) strand; PAM type: NRG; PAM sequence: AAG
gagttatttccttttgttta

SEQ ID NO: 135203 - DNA, 20 bp, Artificial Sequence
  Description of Artificial Sequence: Synthetic oligonucleotide
  Target: ATXN1; (+) strand; PAM type: NRG; PAM sequence: CAG
tgttttctcttttgaaattt

SEQ ID NO: 135204 - DNA, 20 bp, Artificial Sequence
  Description of Artificial Sequence: Synthetic oligonucleotide
  Target: ATXN1; (+) strand; PAM type: NRG; PAM sequence: TGG
ttcagtataatatgctactt

SEQ ID NO: 135205 - DNA, 20 bp, Artificial Sequence
  Description of Artificial Sequence: Synthetic oligonucleotide
  Target: ATXN1; (+) strand; PAM type: NRG; PAM sequence: AAG
agtataatatgctactttgg

SEQ ID NO: 135206 - DNA, 20 bp, Artificial Sequence
  Description of Artificial Sequence: Synthetic oligonucleotide
  Target: ATXN1; (+) strand; PAM type: NRG; PAM sequence: TGG
ataatatgctactttggaag

SEQ ID NO: 135207 - DNA, 20 bp, Artificial Sequence
  Description of Artificial Sequence: Synthetic oligonucleotide
  Target: ATXN1; (+) strand; PAM type: NRG; PAM sequence: CAG
tactttggaagtggtatatc

SEQ ID NO: 135208 - DNA, 20 bp, Artificial Sequence
  Description of Artificial Sequence: Synthetic oligonucleotide
  Target: ATXN1; (+) strand; PAM type: NRG; PAM sequence: AAG
atatgcatattttaaaatca

SEQ ID NO: 135209 - DNA, 20 bp, Artificial Sequence
  Description of Artificial Sequence: Synthetic oligonucleotide
  Target: ATXN1; (+) strand; PAM type: NRG; PAM sequence: GAG
catattttaaaatcaaagcc

SEQ ID NO: 135210 - DNA, 20 bp, Artificial Sequence
  Description of Artificial Sequence: Synthetic oligonucleotide
  Target: ATXN1; (+) strand; PAM type: NRG; PAM sequence: CAG
atcctaactttaccactttc

SEQ ID NO: 135211 - DNA, 20 bp, Artificial Sequence
  Description of Artificial Sequence: Synthetic oligonucleotide
  Target: ATXN1; (+) strand; PAM type: NRG; PAM sequence: GAG
ctttccagctctgtcacttt

SEQ ID NO: 135212 - DNA, 20 bp, Artificial Sequence
  Description of Artificial Sequence: Synthetic oligonucleotide
  Target: ATXN1; (+) strand; PAM type: NRG; PAM sequence: AGG
tttccagctctgtcactttg

SEQ ID NO: 135213 - DNA, 20 bp, Artificial Sequence
  Description of Artificial Sequence: Synthetic oligonucleotide
  Target: ATXN1; (+) strand; PAM type: NRG; PAM sequence: TGG
actttgaggaaattatttac

SEQ ID NO: 135214 - DNA, 20 bp, Artificial Sequence
  Description of Artificial Sequence: Synthetic oligonucleotide
  Target: ATXN1; (+) strand; PAM type: NRG; PAM sequence: AAG
tatttactggcttgaccctc

SEQ ID NO: 135215 - DNA, 20 bp, Artificial Sequence
  Description of Artificial Sequence: Synthetic oligonucleotide
  Target: ATXN1; (+) strand; PAM type: NRG; PAM sequence: AAG
ctcaagttcatccgctgtaa

SEQ ID NO: 135216 - DNA, 20 bp, Artificial Sequence
  Description of Artificial Sequence: Synthetic oligonucleotide
  Target: ATXN1; (+) strand; PAM type: NRG; PAM sequence: AGG
tcaagttcatccgctgtaaa

SEQ ID NO: 135217 - DNA, 20 bp, Artificial Sequence
  Description of Artificial Sequence: Synthetic oligonucleotide
  Target: ATXN1; (+) strand; PAM type: NRG; PAM sequence: GAG
aagttcatccgctgtaaaag

SEQ ID NO: 135218 - DNA, 20 bp, Artificial Sequence
  Description of Artificial Sequence: Synthetic oligonucleotide
  Target: ATXN1; (+) strand; PAM type: NRG; PAM sequence: CAG
ggagtcactaacgcttgtct

SEQ ID NO: 135219 - DNA, 20 bp, Artificial Sequence
  Description of Artificial Sequence: Synthetic oligonucleotide
  Target: ATXN1; (+) strand; PAM type: NRG; PAM sequence: AAG
gtcactaacgcttgtctcag

SEQ ID NO: 135220 - DNA, 20 bp, Artificial Sequence
  Description of Artificial Sequence: Synthetic oligonucleotide
  Target: ATXN1; (+) strand; PAM type: NRG; PAM sequence: AGG
tcactaacgcttgtctcaga

SEQ ID NO: 135221 - DNA, 20 bp, Artificial Sequence
  Description of Artificial Sequence: Synthetic oligonucleotide
  Target: ATXN1; (+) strand; PAM type: NRG; PAM sequence: CGG
gttacgtatataaaactacg

SEQ ID NO: 135222 - DNA, 20 bp, Artificial Sequence
  Description of Artificial Sequence: Synthetic oligonucleotide
  Target: ATXN1; (+) strand; PAM type: NRG; PAM sequence: CAG
gtatataaaactacgcggcc

SEQ ID NO: 135223 - DNA, 20 bp, Artificial Sequence
  Description of Artificial Sequence: Synthetic oligonucleotide
  Target: ATXN1; (+) strand; PAM type: NRG; PAM sequence: CAG
cgcggcccagaccacaccca

SEQ ID NO: 135224 - DNA, 20 bp, Artificial Sequence
  Description of Artificial Sequence: Synthetic oligonucleotide
  Target: ATXN1; (+) strand; PAM type: NRG; PAM sequence: CAG
ggcccagaccacacccacag

SEQ ID NO: 135225 - DNA, 20 bp, Artificial Sequence
  Description of Artificial Sequence: Synthetic oligonucleotide
  Target: ATXN1; (+) strand; PAM type: NRG; PAM sequence: CGG
ccacacccacagcagccact

SEQ ID NO: 135226 - DNA, 20 bp, Artificial Sequence
  Description of Artificial Sequence: Synthetic oligonucleotide
  Target: ATXN1; (+) strand; PAM type: NRG; PAM sequence: TGG
cacagcagccactcggacac

SEQ ID NO: 135227 - DNA, 20 bp, Artificial Sequence
  Description of Artificial Sequence: Synthetic oligonucleotide
  Target: ATXN1; (+) strand; PAM type: NRG; PAM sequence: CAG
ttttcccctctctttctaca

SEQ ID NO: 135228 - DNA, 20 bp, Artificial Sequence
  Description of Artificial Sequence: Synthetic oligonucleotide
  Target: ATXN1; (+) strand; PAM type: NRG; PAM sequence: CAG
tcccctctctttctacacag

SEQ ID NO: 135229 - DNA, 20 bp, Artificial Sequence
  Description of Artificial Sequence: Synthetic oligonucleotide
  Target: ATXN1; (+) strand; PAM type: NRG; PAM sequence: AGG
cccctctctttctacacagc

SEQ ID NO: 135230 - DNA, 20 bp, Artificial Sequence
  Description of Artificial Sequence: Synthetic oligonucleotide
  Target: ATXN1; (+) strand; PAM type: NRG; PAM sequence: AAG
ctttctacacagcaggtcat

SEQ ID NO: 135231 - DNA, 20 bp, Artificial Sequence
  Description of Artificial Sequence: Synthetic oligonucleotide
  Target: ATXN1; (+) strand; PAM type: NRG; PAM sequence: AAG
tctacacagcaggtcataag

SEQ ID NO: 135232 - DNA, 20 bp, Artificial Sequence
  Description of Artificial Sequence: Synthetic oligonucleotide
  Target: ATXN1; (+) strand; PAM type: NRG; PAM sequence: AAG
cacagcaggtcataagaagt

SEQ ID NO: 135233 - DNA, 20 bp, Artificial Sequence
  Description of Artificial Sequence: Synthetic oligonucleotide
  Target: ATXN1; (+) strand; PAM type: NRG; PAM sequence: AGG
acagcaggtcataagaagta

SEQ ID NO: 135234 - DNA, 20 bp, Artificial Sequence
  Description of Artificial Sequence: Synthetic oligonucleotide
  Target: ATXN1; (+) strand; PAM type: NRG; PAM sequence: AAG
ataagaagtaaggacaactc

SEQ ID NO: 135235 - DNA, 20 bp, Artificial Sequence
  Description of Artificial Sequence: Synthetic oligonucleotide
  Target: ATXN1; (+) strand; PAM type: NRG; PAM sequence: AGG
taagaagtaaggacaactca

SEQ ID NO: 135236 - DNA, 20 bp, Artificial Sequence
  Description of Artificial Sequence: Synthetic oligonucleotide
  Target: ATXN1; (+) strand; PAM type: NRG; PAM sequence: TGG
taaggacaactcaaggatgc

SEQ ID NO: 135237 - DNA, 20 bp, Artificial Sequence
  Description of Artificial Sequence: Synthetic oligonucleotide
  Target: ATXN1; (+) strand; PAM type: NRG; PAM sequence: TGG
actcaaggatgctggcttcc

SEQ ID NO: 135238 - DNA, 20 bp, Artificial Sequence
  Description of Artificial Sequence: Synthetic oligonucleotide
  Target: ATXN1; (+) strand; PAM type: NRG; PAM sequence: TGG
aggatgctggcttcctggtg

SEQ ID NO: 135239 - DNA, 20 bp, Artificial Sequence
  Description of Artificial Sequence: Synthetic oligonucleotide
  Target: ATXN1; (+) strand; PAM type: NRG; PAM sequence: AAG
gcttcctggtgtggaatgat

SEQ ID NO: 135240 - DNA, 20 bp, Artificial Sequence
  Description of Artificial Sequence: Synthetic oligonucleotide
  Target: ATXN1; (+) strand; PAM type: NRG; PAM sequence: AGG
cttcctggtgtggaatgata

SEQ ID NO: 135241 - DNA, 20 bp, Artificial Sequence
  Description of Artificial Sequence: Synthetic oligonucleotide
  Target: ATXN1; (+) strand; PAM type: NRG; PAM sequence: CGG
cctggtgtggaatgataagg

SEQ ID NO: 135242 - DNA, 20 bp, Artificial Sequence
  Description of Artificial Sequence: Synthetic oligonucleotide
  Target: ATXN1; (+) strand; PAM type: NRG; PAM sequence: CAG
gtgtggaatgataaggcggc

SEQ ID NO: 135243 - DNA, 20 bp, Artificial Sequence
  Description of Artificial Sequence: Synthetic oligonucleotide
  Target: ATXN1; (+) strand; PAM type: NRG; PAM sequence: AAG
ggaatgataaggcggccagc

SEQ ID NO: 135244 - DNA, 20 bp, Artificial Sequence
  Description of Artificial Sequence: Synthetic oligonucleotide
  Target: ATXN1; (+) strand; PAM type: NRG; PAM sequence: TGG
tgataaggcggccagcaagc

SEQ ID NO: 135245 - DNA, 20 bp, Artificial Sequence
  Description of Artificial Sequence: Synthetic oligonucleotide
  Target: ATXN1; (+) strand; PAM type: NRG; PAM sequence: GAG
ataaggcggccagcaagctg

SEQ ID NO: 135246 - DNA, 20 bp, Artificial Sequence
  Description of Artificial Sequence: Synthetic oligonucleotide
  Target: ATXN1; (+) strand; PAM type: NRG; PAM sequence: TGG
aggcggccagcaagctggag

SEQ ID NO: 135247 - DNA, 20 bp, Artificial Sequence
  Description of Artificial Sequence: Synthetic oligonucleotide
  Target: ATXN1; (+) strand; PAM type: NRG; PAM sequence: GGG
ggcggccagcaagctggagt

SEQ ID NO: 135248 - DNA, 20 bp, Artificial Sequence
  Description of Artificial Sequence: Synthetic oligonucleotide
  Target: ATXN1; (+) strand; PAM type: NRG; PAM sequence: GGG
gcggccagcaagctggagtg

SEQ ID NO: 135249 - DNA, 20 bp, Artificial Sequence
  Description of Artificial Sequence: Synthetic oligonucleotide
  Target: ATXN1; (+) strand; PAM type: NRG; PAM sequence: GGG
cggccagcaagctggagtgg

SEQ ID NO: 135250 - DNA, 20 bp, Artificial Sequence
  Description of Artificial Sequence: Synthetic oligonucleotide
  Target: ATXN1; (+) strand; PAM type: NRG; PAM sequence: TGG
ccagcaagctggagtggggg

SEQ ID NO: 135251 - DNA, 20 bp, Artificial Sequence
  Description of Artificial Sequence: Synthetic oligonucleotide
  Target: ATXN1; (+) strand; PAM type: NRG; PAM sequence: CAG
gcaagctggagtgggggtgg

SEQ ID NO: 135252 - DNA, 20 bp, Artificial Sequence
  Description of Artificial Sequence: Synthetic oligonucleotide
  Target: ATXN1; (+) strand; PAM type: NRG; PAM sequence: AGG
caagctggagtgggggtggc

SEQ ID NO: 135253 - DNA, 20 bp, Artificial Sequence
  Description of Artificial Sequence: Synthetic oligonucleotide
  Target: ATXN1; (+) strand; PAM type: NRG; PAM sequence: GAG
agctggagtgggggtggcag

SEQ ID NO: 135254 - DNA, 20 bp, Artificial Sequence
  Description of Artificial Sequence: Synthetic oligonucleotide
  Target: ATXN1; (+) strand; PAM type: NRG; PAM sequence: AAG
gagtgggggtggcaggagaa

SEQ ID NO: 135255 - DNA, 20 bp, Artificial Sequence
  Description of Artificial Sequence: Synthetic oligonucleotide
  Target: ATXN1; (+) strand; PAM type: NRG; PAM sequence: AGG
agtgggggtggcaggagaaa

SEQ ID NO: 135256 - DNA, 20 bp, Artificial Sequence
  Description of Artificial Sequence: Synthetic oligonucleotide
  Target: ATXN1; (+) strand; PAM type: NRG; PAM sequence: TGG
tggcaggagaaaaggacacc

SEQ ID NO: 135257 - DNA, 20 bp, Artificial Sequence
  Description of Artificial Sequence: Synthetic oligonucleotide
  Target: ATXN1; (+) strand; PAM type: NRG; PAM sequence: GGG
ggcaggagaaaaggacacct

SEQ ID NO: 135258 - DNA, 20 bp, Artificial Sequence
  Description of Artificial Sequence: Synthetic oligonucleotide
  Target: ATXN1; (+) strand; PAM type: NRG; PAM sequence: CAG
aggacacctgggccccatga

SEQ ID NO: 135259 - DNA, 20 bp, Artificial Sequence
  Description of Artificial Sequence: Synthetic oligonucleotide
  Target: ATXN1; (+) strand; PAM type: NRG; PAM sequence: TGG
cagaacctgtttcacaaatg

SEQ ID NO: 135260 - DNA, 20 bp, Artificial Sequence
  Description of Artificial Sequence: Synthetic oligonucleotide
  Target: ATXN1; (+) strand; PAM type: NRG; PAM sequence: GAG
acctgtttcacaaatgtggt

SEQ ID NO: 135261 - DNA, 20 bp, Artificial Sequence
  Description of Artificial Sequence: Synthetic oligonucleotide
  Target: ATXN1; (+) strand; PAM type: NRG; PAM sequence: AGG
cctgtttcacaaatgtggtg

SEQ ID NO: 135262 - DNA, 20 bp, Artificial Sequence
  Description of Artificial Sequence: Synthetic oligonucleotide
  Target: ATXN1; (+) strand; PAM type: NRG; PAM sequence: GGG
ctgtttcacaaatgtggtga

SEQ ID NO: 135263 - DNA, 20 bp, Artificial Sequence
  Description of Artificial Sequence: Synthetic oligonucleotide
  Target: ATXN1; (+) strand; PAM type: NRG; PAM sequence: GGG
tgtttcacaaatgtggtgag

SEQ ID NO: 135264 - DNA, 20 bp, Artificial Sequence
  Description of Artificial Sequence: Synthetic oligonucleotide
  Target: ATXN1; (+) strand; PAM type: NRG; PAM sequence: GAG
tttcacaaatgtggtgaggg

SEQ ID NO: 135265 - DNA, 20 bp, Artificial Sequence
  Description of Artificial Sequence: Synthetic oligonucleotide
  Target: ATXN1; (+) strand; PAM type: NRG; PAM sequence: CAG
tggtgaggggagctctgctc

SEQ ID NO: 135266 - DNA, 20 bp, Artificial Sequence
  Description of Artificial Sequence: Synthetic oligonucleotide
  Target: ATXN1; (+) strand; PAM type: NRG; PAM sequence: AAG
gctctgctccagtgcacaaa

SEQ ID NO: 135267 - DNA, 20 bp, Artificial Sequence
  Description of Artificial Sequence: Synthetic oligonucleotide
  Target: ATXN1; (+) strand; PAM type: NRG; PAM sequence: AGG
ctctgctccagtgcacaaaa

SEQ ID NO: 135268 - DNA, 20 bp, Artificial Sequence
  Description of Artificial Sequence: Synthetic oligonucleotide
  Target: ATXN1; (+) strand; PAM type: NRG; PAM sequence: CAG
tccagtgcacaaaaaggctg

SEQ ID NO: 135269 - DNA, 20 bp, Artificial Sequence
  Description of Artificial Sequence: Synthetic oligonucleotide
  Target: ATXN1; (+) strand; PAM type: NRG; PAM sequence: AGG
ccagtgcacaaaaaggctgc

SEQ ID NO: 135270 - DNA, 20 bp, Artificial Sequence
  Description of Artificial Sequence: Synthetic oligonucleotide
  Target: ATXN1; (+) strand; PAM type: NRG; PAM sequence: CAG
tgcaggctgacaccattttg

SEQ ID NO: 135271 - DNA, 20 bp, Artificial Sequence
  Description of Artificial Sequence: Synthetic oligonucleotide
  Target: ATXN1; (+) strand; PAM type: NRG; PAM sequence: TGG
caccattttgcagtgttcac

SEQ ID NO: 135272 - DNA, 20 bp, Artificial Sequence
  Description of Artificial Sequence: Synthetic oligonucleotide
  Target: ATXN1; (+) strand; PAM type: NRG; PAM sequence: AAG
attttgcagtgttcactggc

SEQ ID NO: 135273 - DNA, 20 bp, Artificial Sequence
  Description of Artificial Sequence: Synthetic oligonucleotide
  Target: ATXN1; (+) strand; PAM type: NRG; PAM sequence: AGG
ttttgcagtgttcactggca

SEQ ID NO: 135274 - DNA, 20 bp, Artificial Sequence
  Description of Artificial Sequence: Synthetic oligonucleotide
  Target: ATXN1; (+) strand; PAM type: NRG; PAM sequence: TAG
cactggcaaggctgctgaca

SEQ ID NO: 135275 - DNA, 20 bp, Artificial Sequence
  Description of Artificial Sequence: Synthetic oligonucleotide
  Target: ATXN1; (+) strand; PAM type: NRG; PAM sequence: TGG
aaggctgctgacatagaaac

SEQ ID NO: 135276 - DNA, 20 bp, Artificial Sequence
  Description of Artificial Sequence: Synthetic oligonucleotide
  Target: ATXN1; (+) strand; PAM type: NRG; PAM sequence: AAG
agaaactggcctccgtcaaa

SEQ ID NO: 135277 - DNA, 20 bp, Artificial Sequence
  Description of Artificial Sequence: Synthetic oligonucleotide
  Target: ATXN1; (+) strand; PAM type: NRG; PAM sequence: TGG
agtcacacctctccttttcc

SEQ ID NO: 135278 - DNA, 20 bp, Artificial Sequence
  Description of Artificial Sequence: Synthetic oligonucleotide
  Target: ATXN1; (+) strand; PAM type: NRG; PAM sequence: TGG
cacctctccttttcctggct

SEQ ID NO: 135279 - DNA, 20 bp, Artificial Sequence
  Description of Artificial Sequence: Synthetic oligonucleotide
  Target: ATXN1; (+) strand; PAM type: NRG; PAM sequence: CAG
ccttttcctggcttggtgtc

SEQ ID NO: 135280 - DNA, 20 bp, Artificial Sequence
  Description of Artificial Sequence: Synthetic oligonucleotide
  Target: ATXN1; (+) strand; PAM type: NRG; PAM sequence: AAG
tggcttggtgtccagctgaa

SEQ ID NO: 135281 - DNA, 20 bp, Artificial Sequence
  Description of Artificial Sequence: Synthetic oligonucleotide
  Target: ATXN1; (+) strand; PAM type: NRG; PAM sequence: GAG
gcttggtgtccagctgaaaa

SEQ ID NO: 135282 - DNA, 20 bp, Artificial Sequence
  Description of Artificial Sequence: Synthetic oligonucleotide
  Target: ATXN1; (+) strand; PAM type: NRG; PAM sequence: AGG
cttggtgtccagctgaaaag

SEQ ID NO: 135283 - DNA, 20 bp, Artificial Sequence
  Description of Artificial Sequence: Synthetic oligonucleotide
  Target: ATXN1; (+) strand; PAM type: NRG; PAM sequence: GAG
tggtgtccagctgaaaagag

SEQ ID NO: 135284 - DNA, 20 bp, Artificial Sequence
  Description of Artificial Sequence: Synthetic oligonucleotide
  Target: ATXN1; (+) strand; PAM type: NRG; PAM sequence: AGG
ggtgtccagctgaaaagagg

SEQ ID NO: 135285 - DNA, 20 bp, Artificial Sequence
  Description of Artificial Sequence: Synthetic oligonucleotide
  Target: ATXN1; (+) strand; PAM type: NRG; PAM sequence: GGG
gtgtccagctgaaaagagga

SEQ ID NO: 135286 - DNA, 20 bp, Artificial Sequence
  Description of Artificial Sequence: Synthetic oligonucleotide
  Target: ATXN1; (+) strand; PAM type: NRG; PAM sequence: GGG
tgtccagctgaaaagaggag

SEQ ID NO: 135287 - DNA, 20 bp, Artificial Sequence
  Description of Artificial Sequence: Synthetic oligonucleotide
  Target: ATXN1; (+) strand; PAM type: NRG; PAM sequence: TGG
aggaggggttcatgtgcatc

SEQ ID NO: 135288 - DNA, 20 bp, Artificial Sequence
  Description of Artificial Sequence: Synthetic oligonucleotide
  Target: ATXN1; (+) strand; PAM type: NRG; PAM sequence: CAG
ggggttcatgtgcatctgga

SEQ ID NO: 135289 - DNA, 20 bp, Artificial Sequence
  Description of Artificial Sequence: Synthetic oligonucleotide
  Target: ATXN1; (+) strand; PAM type: NRG; PAM sequence: AAG
catctggacagctttacccc

SEQ ID NO: 135290 - DNA, 20 bp, Artificial Sequence
  Description of Artificial Sequence: Synthetic oligonucleotide
  Target: ATXN1; (+) strand; PAM type: NRG; PAM sequence: AGG
atctggacagctttacccca

SEQ ID NO: 135291 - DNA, 20 bp, Artificial Sequence
  Description of Artificial Sequence: Synthetic oligonucleotide
  Target: ATXN1; (+) strand; PAM type: NRG; PAM sequence: GGG
tctggacagctttaccccaa

SEQ ID NO: 135292 - DNA, 20 bp, Artificial Sequence
  Description of Artificial Sequence: Synthetic oligonucleotide
  Target: ATXN1; (+) strand; PAM type: NRG; PAM sequence: AAG
tttaccccaagggcacctgc

SEQ ID NO: 135293 - DNA, 20 bp, Artificial Sequence
  Description of Artificial Sequence: Synthetic oligonucleotide
  Target: ATXN1; (+) strand; PAM type: NRG; PAM sequence: AGG
ttaccccaagggcacctgca

SEQ ID NO: 135294 - DNA, 20 bp, Artificial Sequence
  Description of Artificial Sequence: Synthetic oligonucleotide
  Target: ATXN1; (+) strand; PAM type: NRG; PAM sequence: TAG
ccccaagggcacctgcaagg

SEQ ID NO: 135295 - DNA, 20 bp, Artificial Sequence
  Description of Artificial Sequence: Synthetic oligonucleotide
  Target: ATXN1; (+) strand; PAM type: NRG; PAM sequence: TAG
caagggcacctgcaaggtag

SEQ ID NO: 135296 - DNA, 20 bp, Artificial Sequence
  Description of Artificial Sequence: Synthetic oligonucleotide
  Target: ATXN1; (+) strand; PAM type: NRG; PAM sequence: AGG
aagggcacctgcaaggtagt

SEQ ID NO: 135297 - DNA, 20 bp, Artificial Sequence
  Description of Artificial Sequence: Synthetic oligonucleotide
  Target: ATXN1; (+) strand; PAM type: NRG; PAM sequence: GAG
gggcacctgcaaggtagtag

SEQ ID NO: 135298 - DNA, 20 bp, Artificial Sequence
  Description of Artificial Sequence: Synthetic oligonucleotide
  Target: ATXN1; (+) strand; PAM type: NRG; PAM sequence: CAG
cacctgcaaggtagtaggag

SEQ ID NO: 135299 - DNA, 20 bp, Artificial Sequence
  Description of Artificial Sequence: Synthetic oligonucleotide
  Target: ATXN1; (+) strand; PAM type: NRG; PAM sequence: GAG
gcaaggtagtaggagcagat

SEQ ID NO: 135300 - DNA, 20 bp, Artificial Sequence
  Description of Artificial Sequence: Synthetic oligonucleotide
  Target: ATXN1; (+) strand; PAM type: NRG; PAM sequence: AGG
caaggtagtaggagcagatg

SEQ ID NO: 135301 - DNA, 20 bp, Artificial Sequence
  Description of Artificial Sequence: Synthetic oligonucleotide
  Target: ATXN1; (+) strand; PAM type: NRG; PAM sequence: TGG
agtaggagcagatgaggcta

SEQ ID NO: 135302 - DNA, 20 bp, Artificial Sequence
  Description of Artificial Sequence: Synthetic oligonucleotide
  Target: ATXN1; (+) strand; PAM type: NRG; PAM sequence: CAG
ggagcagatgaggctatggc

SEQ ID NO: 135303 - DNA, 20 bp, Artificial Sequence
  Description of Artificial Sequence: Synthetic oligonucleotide
  Target: ATXN1; (+) strand; PAM type: NRG; PAM sequence: CAG
atgaggctatggccagatga

SEQ ID NO: 135304 - DNA, 20 bp, Artificial Sequence
  Description of Artificial Sequence: Synthetic oligonucleotide
  Target: ATXN1; (+) strand; PAM type: NRG; PAM sequence: AGG
tgaggctatggccagatgac

SEQ ID NO: 135305 - DNA, 20 bp, Artificial Sequence
  Description of Artificial Sequence: Synthetic oligonucleotide
  Target: ATXN1; (+) strand; PAM type: NRG; PAM sequence: GGG
gaggctatggccagatgaca

SEQ ID NO: 135306 - DNA, 20 bp, Artificial Sequence
  Description of Artificial Sequence: Synthetic oligonucleotide
  Target: ATXN1; (+) strand; PAM type: NRG; PAM sequence: GGG
aggctatggccagatgacag

SEQ ID NO: 135307 - DNA, 20 bp, Artificial Sequence
  Description of Artificial Sequence: Synthetic oligonucleotide
  Target: ATXN1; (+) strand; PAM type: NRG; PAM sequence: GGG
ggctatggccagatgacagg

SEQ ID NO: 135308 - DNA, 20 bp, Artificial Sequence
  Description of Artificial Sequence: Synthetic oligonucleotide
  Target: ATXN1; (+) strand; PAM type: NRG; PAM sequence: CAG
cagatgacagggggacatgc

SEQ ID NO: 135309 - DNA, 20 bp, Artificial Sequence
  Description of Artificial Sequence: Synthetic oligonucleotide
  Target: ATXN1; (+) strand; PAM type: NRG; PAM sequence: CAG
atgacagggggacatgccag

SEQ ID NO: 135310 - DNA, 20 bp, Artificial Sequence
  Description of Artificial Sequence: Synthetic oligonucleotide
  Target: ATXN1; (+) strand; PAM type: NRG; PAM sequence: AAG
acagggggacatgccagcag

SEQ ID NO: 135311 - DNA, 20 bp, Artificial Sequence
  Description of Artificial Sequence: Synthetic oligonucleotide
  Target: ATXN1; (+) strand; PAM type: NRG; PAM sequence: AGG
cagggggacatgccagcaga

SEQ ID NO: 135312 - DNA, 20 bp, Artificial Sequence
  Description of Artificial Sequence: Synthetic oligonucleotide
  Target: ATXN1; (+) strand; PAM type: NRG; PAM sequence: CAG
gccagcagaaggaactaatg

SEQ ID NO: 135313 - DNA, 20 bp, Artificial Sequence
  Description of Artificial Sequence: Synthetic oligonucleotide
  Target: ATXN1; (+) strand; PAM type: NRG; PAM sequence: TGG
taatgcagcttccaacttgc

SEQ ID NO: 135314 - DNA, 20 bp, Artificial Sequence
  Description of Artificial Sequence: Synthetic oligonucleotide
  Target: ATXN1; (+) strand; PAM type: NRG; PAM sequence: CAG
gcttccaacttgctggtgcc

SEQ ID NO: 135315 - DNA, 20 bp, Artificial Sequence
  Description of Artificial Sequence: Synthetic oligonucleotide
  Target: ATXN1; (+) strand; PAM type: NRG; PAM sequence: CAG
ccaacttgctggtgcccagc

SEQ ID NO: 135316 - DNA, 20 bp, Artificial Sequence
  Description of Artificial Sequence: Synthetic oligonucleotide
  Target: ATXN1; (+) strand; PAM type: NRG; PAM sequence: TGG
ccagccagaccccactgatt

SEQ ID NO: 135317 - DNA, 20 bp, Artificial Sequence
  Description of Artificial Sequence: Synthetic oligonucleotide
  Target: ATXN1; (+) strand; PAM type: NRG; PAM sequence: GAG
agccagaccccactgatttg

SEQ ID NO: 135318 - DNA, 20 bp, Artificial Sequence
  Description of Artificial Sequence: Synthetic oligonucleotide
  Target: ATXN1; (+) strand; PAM type: NRG; PAM sequence: TGG
aaaactgatctgacacccaa

SEQ ID NO: 135319 - DNA, 20 bp, Artificial Sequence
  Description of Artificial Sequence: Synthetic oligonucleotide
  Target: ATXN1; (+) strand; PAM type: NRG; PAM sequence: AAG
gacacccaatggtgtcacca

SEQ ID NO: 135320 - DNA, 20 bp, Artificial Sequence
  Description of Artificial Sequence: Synthetic oligonucleotide
  Target: ATXN1; (+) strand; PAM type: NRG; PAM sequence: CAG
tgttttcttttcctatgcat

SEQ ID NO: 135321 - DNA, 20 bp, Artificial Sequence
  Description of Artificial Sequence: Synthetic oligonucleotide
  Target: ATXN1; (+) strand; PAM type: NRG; PAM sequence: CAG
tgcatcagtacctccacacc

SEQ ID NO: 135322 - DNA, 20 bp, Artificial Sequence
  Description of Artificial Sequence: Synthetic oligonucleotide
  Target: ATXN1; (+) strand; PAM type: NRG; PAM sequence: AGG
gcatcagtacctccacaccc

SEQ ID NO: 135323 - DNA, 20 bp, Artificial Sequence
  Description of Artificial Sequence: Synthetic oligonucleotide
  Target: ATXN1; (+) strand; PAM type: NRG; PAM sequence: GGG
catcagtacctccacaccca

SEQ ID NO: 135324 - DNA, 20 bp, Artificial Sequence
  Description of Artificial Sequence: Synthetic oligonucleotide
  Target: ATXN1; (+) strand; PAM type: NRG; PAM sequence: CAG
gtacctccacacccagggat

SEQ ID NO: 135325 - DNA, 20 bp, Artificial Sequence
  Description of Artificial Sequence: Synthetic oligonucleotide
  Target: ATXN1; (+) strand; PAM type: NRG; PAM sequence: AAG
tcttccttcacctcactcta

SEQ ID NO: 135326 - DNA, 20 bp, Artificial Sequence
  Description of Artificial Sequence: Synthetic oligonucleotide
  Target: ATXN1; (+) strand; PAM type: NRG; PAM sequence: AGG
cttccttcacctcactctaa

SEQ ID NO: 135327 - DNA, 20 bp, Artificial Sequence
  Description of Artificial Sequence: Synthetic oligonucleotide
  Target: ATXN1; (+) strand; PAM type: NRG; PAM sequence: GGG
ttccttcacctcactctaaa

SEQ ID NO: 135328 - DNA, 20 bp, Artificial Sequence
  Description of Artificial Sequence: Synthetic oligonucleotide
  Target: ATXN1; (+) strand; PAM type: NRG; PAM sequence: CAG
ttcacctcactctaaagggc

SEQ ID NO: 135329 - DNA, 20 bp, Artificial Sequence
  Description of Artificial Sequence: Synthetic oligonucleotide
  Target: ATXN1; (+) strand; PAM type: NRG; PAM sequence: AAG
gccagccatcattgccttcc

SEQ ID NO: 135330 - DNA, 20 bp, Artificial Sequence
  Description of Artificial Sequence: Synthetic oligonucleotide
  Target: ATXN1; (+) strand; PAM type: NRG; PAM sequence: AGG
ccagccatcattgccttcca

SEQ ID NO: 135331 - DNA, 20 bp, Artificial Sequence
  Description of Artificial Sequence: Synthetic oligonucleotide
  Target: ATXN1; (+) strand; PAM type: NRG; PAM sequence: AAG
tgccttccaaggtatgaacc

SEQ ID NO: 135332 - DNA, 20 bp, Artificial Sequence
  Description of Artificial Sequence: Synthetic oligonucleotide
  Target: ATXN1; (+) strand; PAM type: NRG; PAM sequence: CAG
aagaaatgtcaccactcact

SEQ ID NO: 135333 - DNA, 20 bp, Artificial Sequence
  Description of Artificial Sequence: Synthetic oligonucleotide
  Target: ATXN1; (+) strand; PAM type: NRG; PAM sequence: AGG
agaaatgtcaccactcactc

SEQ ID NO: 135334 - DNA, 20 bp, Artificial Sequence
  Description of Artificial Sequence: Synthetic oligonucleotide
  Target: ATXN1; (+) strand; PAM type: NRG; PAM sequence: CAG
tcaccactcactcaggtgaa

SEQ ID NO: 135335 - DNA, 20 bp, Artificial Sequence
  Description of Artificial Sequence: Synthetic oligonucleotide
  Target: ATXN1; (+) strand; PAM type: NRG; PAM sequence: AGG
caccactcactcaggtgaac

SEQ ID NO: 135336 - DNA, 20 bp, Artificial Sequence
  Description of Artificial Sequence: Synthetic oligonucleotide
  Target: ATXN1; (+) strand; PAM type: NRG; PAM sequence: CAG
tcactcaggtgaacaggcca

SEQ ID NO: 135337 - DNA, 20 bp, Artificial Sequence
  Description of Artificial Sequence: Synthetic oligonucleotide
  Target: ATXN1; (+) strand; PAM type: NRG; PAM sequence: GAG
actcaggtgaacaggccaca

SEQ ID NO: 135338 - DNA, 20 bp, Artificial Sequence
  Description of Artificial Sequence: Synthetic oligonucleotide
  Target: ATXN1; (+) strand; PAM type: NRG; PAM sequence: AGG
ctcaggtgaacaggccacag

SEQ ID NO: 135339 - DNA, 20 bp, Artificial Sequence
  Description of Artificial Sequence: Synthetic oligonucleotide
  Target: ATXN1; (+) strand; PAM type: NRG; PAM sequence: AAG
aacaggccacagaggactaa

SEQ ID NO: 135340 - DNA, 20 bp, Artificial Sequence
  Description of Artificial Sequence: Synthetic oligonucleotide
  Target: ATXN1; (+) strand; PAM type: NRG; PAM sequence: TGG
ccacagaggactaaaagtgc

SEQ ID NO: 135341 - DNA, 20 bp, Artificial Sequence
  Description of Artificial Sequence: Synthetic oligonucleotide
  Target: ATXN1; (+) strand; PAM type: NRG; PAM sequence: TAG
gactaaaagtgctggcccta

SEQ ID NO: 135342 - DNA, 20 bp, Artificial Sequence
  Description of Artificial Sequence: Synthetic oligonucleotide
  Target: ATXN1; (+) strand; PAM type: NRG; PAM sequence: CAG
taaaagtgctggccctatag

SEQ ID NO: 135343 - DNA, 20 bp, Artificial Sequence
  Description of Artificial Sequence: Synthetic oligonucleotide
  Target: ATXN1; (+) strand; PAM type: NRG; PAM sequence: CAG
atagcagcctcatgcaaaaa

SEQ ID NO: 135344 - DNA, 20 bp, Artificial Sequence
  Description of Artificial Sequence: Synthetic oligonucleotide
  Target: ATXN1; (+) strand; PAM type: NRG; PAM sequence: GAG
caaaaacagatttgtgcact

SEQ ID NO: 135345 - DNA, 20 bp, Artificial Sequence
  Description of Artificial Sequence: Synthetic oligonucleotide
  Target: ATXN1; (+) strand; PAM type: NRG; PAM sequence: AAG
aaacagatttgtgcactgag

SEQ ID NO: 135346 - DNA, 20 bp, Artificial Sequence
  Description of Artificial Sequence: Synthetic oligonucleotide
  Target: ATXN1; (+) strand; PAM type: NRG; PAM sequence: AAG
agaagacttttgaaatttga

SEQ ID NO: 135347 - DNA, 20 bp, Artificial Sequence
  Description of Artificial Sequence: Synthetic oligonucleotide
  Target: ATXN1; (+) strand; PAM type: NRG; PAM sequence: AGG
gaagacttttgaaatttgaa

SEQ ID NO: 135348 - DNA, 20 bp, Artificial Sequence
  Description of Artificial Sequence: Synthetic oligonucleotide
  Target: ATXN1; (+) strand; PAM type: NRG; PAM sequence: AAG
aaatttgaaaggccgctact

SEQ ID NO: 135349 - DNA, 20 bp, Artificial Sequence
  Description of Artificial Sequence: Synthetic oligonucleotide
  Target: ATXN1; (+) strand; PAM type: NRG; PAM sequence: AAG
tttgaaaggccgctactaag

SEQ ID NO: 135350 - DNA, 20 bp, Artificial Sequence
  Description of Artificial Sequence: Synthetic oligonucleotide
  Target: ATXN1; (+) strand; PAM type: NRG; PAM sequence: AAG
ctaagaagataaaccctcca

SEQ ID NO: 135351 - DNA, 20 bp, Artificial Sequence
  Description of Artificial Sequence: Synthetic oligonucleotide
  Target: ATXN1; (+) strand; PAM type: NRG; PAM sequence: AAG
ttattcattaaaaaaaaaac

SEQ ID NO: 135352 - DNA, 20 bp, Artificial Sequence
  Description of Artificial Sequence: Synthetic oligonucleotide
  Target: ATXN1; (+) strand; PAM type: NRG; PAM sequence: TAG
cattaaaaaaaaaacaagct

SEQ ID NO: 135353 - DNA, 20 bp, Artificial Sequence
  Description of Artificial Sequence: Synthetic oligonucleotide
  Target: ATXN1; (+) strand; PAM type: NRG; PAM sequence: AGG
attaaaaaaaaaacaagctt

SEQ ID NO: 135354 - DNA, 20 bp, Artificial Sequence
  Description of Artificial Sequence: Synthetic oligonucleotide
  Target: ATXN1; (+) strand; PAM type: NRG; PAM sequence: CGG
aaaaaaaaacaagcttaggc

SEQ ID NO: 135355 - DNA, 20 bp, Artificial Sequence
  Description of Artificial Sequence: Synthetic oligonucleotide
  Target: ATXN1; (+) strand; PAM type: NRG; PAM sequence: GGG
aaaaaaaacaagcttaggcc

SEQ ID NO: 135356 - DNA, 20 bp, Artificial Sequence
  Description of Artificial Sequence: Synthetic oligonucleotide
  Target: ATXN1; (+) strand; PAM type: NRG; PAM sequence: TGG
aaacaagcttaggccgggca

SEQ ID NO: 135357 - DNA, 20 bp, Artificial Sequence
  Description of Artificial Sequence: Synthetic oligonucleotide
  Target: ATXN1; (+) strand; PAM type: NRG; PAM sequence: TGG
caagcttaggccgggcatgg

SEQ ID NO: 135358 - DNA, 20 bp, Artificial Sequence
  Description of Artificial Sequence: Synthetic oligonucleotide
  Target: ATXN1; (+) strand; PAM type: NRG; PAM sequence: CAG
gtggctcacacctgtaatcc

SEQ ID NO: 135359 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatcccagcattt

SEQ ID NO: 135360 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccagcatttt

SEQ ID NO: 135361 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcattttgg

SEQ ID NO: 135362 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcattttggg

SEQ ID NO: 135363 - DNA, 20 bp, Artificial Sequence
  Description of Artificial Sequence: Synthetic oligonucleotide
  Target: ATXN1; (+) strand; PAM type: NRG; PAM sequence: GAG
tcccagcattttgggaggct

SEQ ID NO: 135364 - DNA, 20 bp, Artificial Sequence
  Description of Artificial Sequence: Synthetic oligonucleotide
  Target: ATXN1; (+) strand; PAM type: NRG; PAM sequence: AGG
cccagcattttgggaggctg

SEQ ID NO: 135365 - DNA, 20 bp, Artificial Sequence
  Description of Artificial Sequence: Synthetic oligonucleotide
  Target: ATXN1; (+) strand; PAM type: NRG; PAM sequence: GAG
gcattttgggaggctgaggc

SEQ ID NO: 135366 - DNA, 20 bp, Artificial Sequence
  Description of Artificial Sequence: Synthetic oligonucleotide
  Target: ATXN1; (+) strand; PAM type: NRG; PAM sequence: CGG
ttttgggaggctgaggcgag

SEQ ID NO: 135367 - DNA, 20 bp, Artificial Sequence
  Description of Artificial Sequence: Synthetic oligonucleotide
  Target: ATXN1; (+) strand; PAM type: NRG; PAM sequence: GAG
ggctgaggcgagcggatcat

SEQ ID NO: 135368 - DNA, 20 bp, Artificial Sequence
  Description of Artificial Sequence: Synthetic oligonucleotide
  Target: ATXN1; (+) strand; PAM type: NRG; PAM sequence: AGG
gctgaggcgagcggatcatg

SEQ ID NO: 135369 - DNA, 20 bp, Artificial Sequence
  Description of Artificial Sequence: Synthetic oligonucleotide
  Target: ATXN1; (+) strand; PAM type: NRG; PAM sequence: CAG
aggcgagcggatcatgaggt

SEQ ID NO: 135370 - DNA, 20 bp, Artificial Sequence
  Description of Artificial Sequence: Synthetic oligonucleotide
  Target: ATXN1; (+) strand; PAM type: NRG; PAM sequence: AAG
cgagcggatcatgaggtcag

SEQ ID NO: 135371 - DNA, 20 bp, Artificial Sequence
  Description of Artificial Sequence: Synthetic oligonucleotide
  Target: ATXN1; (+) strand; PAM type: NRG; PAM sequence: TGG
tcagaagatcgaaaccatcc

SEQ ID NO: 135372 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 135373 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatacaaaaattagc

SEQ ID NO: 135374 - DNA, 20 bp, Artificial Sequence
  Description of Artificial Sequence: Synthetic oligonucleotide
  Target: ATXN1; (+) strand; PAM type: NRG; PAM sequence: GGG
taaaaatacaaaaattagct

SEQ ID NO: 135375 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagctgggta

SEQ ID NO: 135376 - DNA, 20 bp, Artificial Sequence
  Description of Artificial Sequence: Synthetic oligonucleotide
  Target: ATXN1; (+) strand; PAM type: NRG; PAM sequence: TGG
caaaaattagctgggtatgg

SEQ ID NO: 135377 - DNA, 20 bp, Artificial Sequence
  Description of Artificial Sequence: Synthetic oligonucleotide
  Target: ATXN1; (+) strand; PAM type: NRG; PAM sequence: CAG
gtggcacgtgcctgtaatcc

SEQ ID NO: 135378 - DNA, 20 bp, Artificial Sequence
  Description of Artificial Sequence: Synthetic oligonucleotide
  Target: ATXN1; (+) strand; PAM type: NRG; PAM sequence: CAG
tgcctgtaatcccagctact

SEQ ID NO: 135379 - DNA, 20 bp, Artificial Sequence
  Description of Artificial Sequence: Synthetic oligonucleotide
  Target: ATXN1; (+) strand; PAM type: NRG; PAM sequence: AGG
gcctgtaatcccagctactc

SEQ ID NO: 135380 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctactcag

SEQ ID NO: 135381 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctactcagg

SEQ ID NO: 135382 - DNA, 20 bp, Artificial Sequence
  Description of Artificial Sequence: Synthetic oligonucleotide
  Target: ATXN1; (+) strand; PAM type: NRG; PAM sequence: GGG
gtaatcccagctactcagga

SEQ ID NO: 135383 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcaggagggt

SEQ ID NO: 135384 - DNA, 20 bp, Artificial Sequence
  Description of Artificial Sequence: Synthetic oligonucleotide
  Target: ATXN1; (+) strand; PAM type: NRG; PAM sequence: CAG
agctactcaggagggtgaga

SEQ ID NO: 135385 - DNA, 20 bp, Artificial Sequence
  Description of Artificial Sequence: Synthetic oligonucleotide
  Target: ATXN1; (+) strand; PAM type: NRG; PAM sequence: AGG
gctactcaggagggtgagac

SEQ ID NO: 135386 - DNA, 20 bp, Artificial Sequence
  Description of Artificial Sequence: Synthetic oligonucleotide
  Target: ATXN1; (+) strand; PAM type: NRG; PAM sequence: GAG
tactcaggagggtgagacag

SEQ ID NO: 135387 - DNA, 20 bp, Artificial Sequence
  Description of Artificial Sequence: Synthetic oligonucleotide
  Target: ATXN1; (+) strand; PAM type: NRG; PAM sequence: CAG
aggagggtgagacaggagaa

SEQ ID NO: 135388 - DNA, 20 bp, Artificial Sequence
  Description of Artificial Sequence: Synthetic oligonucleotide
  Target: ATXN1; (+) strand; PAM type: NRG; PAM sequence: CAG
gacaggagaacagcttgaac

SEQ ID NO: 135389 - DNA, 20 bp, Artificial Sequence
  Description of Artificial Sequence: Synthetic oligonucleotide
  Target: ATXN1; (+) strand; PAM type: NRG; PAM sequence: AGG
acaggagaacagcttgaacc

SEQ ID NO: 135390 - DNA, 20 bp, Artificial Sequence
  Description of Artificial Sequence: Synthetic oligonucleotide
  Target: ATXN1; (+) strand; PAM type: NRG; PAM sequence: GGG
caggagaacagcttgaacca

SEQ ID NO: 135391 - DNA, 20 bp, Artificial Sequence
  Description of Artificial Sequence: Synthetic oligonucleotide
  Target: ATXN1; (+) strand; PAM type: NRG; PAM sequence: GAG
ggagaacagcttgaaccagg

SEQ ID NO: 135392 - DNA, 20 bp, Artificial Sequence
  Description of Artificial Sequence: Synthetic oligonucleotide
  Target: ATXN1; (+) strand; PAM type: NRG; PAM sequence: CAG
aacagcttgaaccagggagt

SEQ ID NO: 135393 - DNA, 20 bp, Artificial Sequence
  Description of Artificial Sequence: Synthetic oligonucleotide
  Target: ATXN1; (+) strand; PAM type: NRG; PAM sequence: GAG
cagcttgaaccagggagtca

SEQ ID NO: 135394 - DNA, 20 bp, Artificial Sequence
  Description of Artificial Sequence: Synthetic oligonucleotide
  Target: ATXN1; (+) strand; PAM type: NRG; PAM sequence: AGG
agcttgaaccagggagtcag

SEQ ID NO: 135395 - DNA, 20 bp, Artificial Sequence
  Description of Artificial Sequence: Synthetic oligonucleotide
  Target: ATXN1; (+) strand; PAM type: NRG; PAM sequence: CAG
aaccagggagtcagaggttg

SEQ ID NO: 135396 - DNA, 20 bp, Artificial Sequence
  Description of Artificial Sequence: Synthetic oligonucleotide
  Target: ATXN1; (+) strand; PAM type: NRG; PAM sequence: GAG
agggagtcagaggttgcagt

SEQ ID NO: 135397 - DNA, 20 bp, Artificial Sequence
  Description of Artificial Sequence: Synthetic oligonucleotide
  Target: ATXN1; (+) strand; PAM type: NRG; PAM sequence: CAG
gagtcagaggttgcagtgag

SEQ ID NO: 135398 - DNA, 20 bp, Artificial Sequence
  Description of Artificial Sequence: Synthetic oligonucleotide
  Target: ATXN1; (+) strand; PAM type: NRG; PAM sequence: GAG
gtcagaggttgcagtgagca

SEQ ID NO: 135399 - DNA, 20 bp, Artificial Sequence
  Description of Artificial Sequence: Synthetic oligonucleotide
  Target: ATXN1; (+) strand; PAM type: NRG; PAM sequence: CAG
gagatcgcgccactgcactc

SEQ ID NO: 135400 - DNA, 20 bp, Artificial Sequence
  Description of Artificial Sequence: Synthetic oligonucleotide
  Target: ATXN1; (+) strand; PAM type: NRG; PAM sequence: TGG
cgcgccactgcactccagcc

SEQ ID NO: 135401 - DNA, 20 bp, Artificial Sequence
  Description of Artificial Sequence: Synthetic oligonucleotide
  Target: ATXN1; (+) strand; PAM type: NRG; PAM sequence: CAG
actgcactccagcctggtga

SEQ ID NO: 135402 - DNA, 20 bp, Artificial Sequence
  Description of Artificial Sequence: Synthetic oligonucleotide
  Target: ATXN1; (+) strand; PAM type: NRG; PAM sequence: GAG
tgcactccagcctggtgaca

SEQ ID NO: 135403 - DNA, 20 bp, Artificial Sequence
  Description of Artificial Sequence: Synthetic oligonucleotide
  Target: ATXN1; (+) strand; PAM type: NRG; PAM sequence: AAG
ccgtctcaaaaaaaaaaaaa

SEQ ID NO: 135404 - DNA, 20 bp, Artificial Sequence
  Description of Artificial Sequence: Synthetic oligonucleotide
  Target: ATXN1; (+) strand; PAM type: NRG; PAM sequence: TGG
aaaagcttaacttgaatgaa

SEQ ID NO: 135405 - DNA, 20 bp, Artificial Sequence
  Description of Artificial Sequence: Synthetic oligonucleotide
  Target: ATXN1; (+) strand; PAM type: NRG; PAM sequence: GGG
aaagcttaacttgaatgaat

SEQ ID NO: 135406 - DNA, 20 bp, Artificial Sequence
  Description of Artificial Sequence: Synthetic oligonucleotide
  Target: ATXN1; (+) strand; PAM type: NRG; PAM sequence: AAG
taacttgaatgaatgggaac

SEQ ID NO: 135407 - DNA, 20 bp, Artificial Sequence
  Description of Artificial Sequence: Synthetic oligonucleotide
  Target: ATXN1; (+) strand; PAM type: NRG; PAM sequence: GAG
acttgaatgaatgggaacaa

SEQ ID NO: 135408 - DNA, 20 bp, Artificial Sequence
  Description of Artificial Sequence: Synthetic oligonucleotide
  Target: ATXN1; (+) strand; PAM type: NRG; PAM sequence: AGG
cttgaatgaatgggaacaag

SEQ ID NO: 135409 - DNA, 20 bp, Artificial Sequence
  Description of Artificial Sequence: Synthetic oligonucleotide
  Target: ATXN1; (+) strand; PAM type: NRG; PAM sequence: GGG
ttgaatgaatgggaacaaga

SEQ ID NO: 135410 - DNA, 20 bp, Artificial Sequence
  Description of Artificial Sequence: Synthetic oligonucleotide
  Target: ATXN1; (+) strand; PAM type: NRG; PAM sequence: CAG
gttatttaaaaaataataaa

SEQ ID NO: 135411 - DNA, 20 bp, Artificial Sequence
  Description of Artificial Sequence: Synthetic oligonucleotide
  Target: ATXN1; (+) strand; PAM type: NRG; PAM sequence: CAG
taaaaaataataaacagtaa

SEQ ID NO: 135412 - DNA, 20 bp, Artificial Sequence
  Description of Artificial Sequence: Synthetic oligonucleotide
  Target: ATXN1; (+) strand; PAM type: NRG; PAM sequence: AAG
agtaacagctatcacaccta

SEQ ID NO: 135413 - DNA, 20 bp, Artificial Sequence
  Description of Artificial Sequence: Synthetic oligonucleotide
  Target: ATXN1; (+) strand; PAM type: NRG; PAM sequence: AGG
gtaacagctatcacacctaa

SEQ ID NO: 135414 - DNA, 20 bp, Artificial Sequence
  Description of Artificial Sequence: Synthetic oligonucleotide
  Target: ATXN1; (+) strand; PAM type: NRG; PAM sequence: TAG
cacctaaaggtgacattatc

SEQ ID NO: 135415 - DNA, 20 bp, Artificial Sequence
  Description of Artificial Sequence: Synthetic oligonucleotide
  Target: ATXN1; (+) strand; PAM type: NRG; PAM sequence: AAG
tctagaaacattaacatgtc

SEQ ID NO: 135416 - DNA, 20 bp, Artificial Sequence
  Description of Artificial Sequence: Synthetic oligonucleotide
  Target: ATXN1; (+) strand; PAM type: NRG; PAM sequence: CAG
acattaacatgtcaagacat

SEQ ID NO: 135417 - DNA, 20 bp, Artificial Sequence
  Description of Artificial Sequence: Synthetic oligonucleotide
  Target: ATXN1; (+) strand; PAM type: NRG; PAM sequence: AAG
tctgttccttctgttccccc

SEQ ID NO: 135418 - DNA, 20 bp, Artificial Sequence
  Description of Artificial Sequence: Synthetic oligonucleotide
  Target: ATXN1; (+) strand; PAM type: NRG; PAM sequence: GAG
tgttccttctgttcccccaa

SEQ ID NO: 135419 - DNA, 20 bp, Artificial Sequence
  Description of Artificial Sequence: Synthetic oligonucleotide
  Target: ATXN1; (+) strand; PAM type: NRG; PAM sequence: AGG
gttccttctgttcccccaag

SEQ ID NO: 135420 - DNA, 20 bp, Artificial Sequence
  Description of Artificial Sequence: Synthetic oligonucleotide
  Target: ATXN1; (+) strand; PAM type: NRG; PAM sequence: TGG
gttcccccaagaggcctatt

SEQ ID NO: 135421 - DNA, 20 bp, Artificial Sequence
  Description of Artificial Sequence: Synthetic oligonucleotide
  Target: ATXN1; (+) strand; PAM type: NRG; PAM sequence: GAG
tcccccaagaggcctatttg

SEQ ID NO: 135422 - DNA, 20 bp, Artificial Sequence
  Description of Artificial Sequence: Synthetic oligonucleotide
  Target: ATXN1; (+) strand; PAM type: NRG; PAM sequence: CAG
aagaggcctatttggagcac

SEQ ID NO: 135423 - DNA, 20 bp, Artificial Sequence
  Description of Artificial Sequence: Synthetic oligonucleotide
  Target: ATXN1; (+) strand; PAM type: NRG; PAM sequence: TGG
gagcaccagcaaaatgcatt

SEQ ID NO: 135424 - DNA, 20 bp, Artificial Sequence
  Description of Artificial Sequence: Synthetic oligonucleotide
  Target: ATXN1; (+) strand; PAM type: NRG; PAM sequence: GAG
gcaccagcaaaatgcatttg

SEQ ID NO: 135425 - DNA, 20 bp, Artificial Sequence
  Description of Artificial Sequence: Synthetic oligonucleotide
  Target: ATXN1; (+) strand; PAM type: NRG; PAM sequence: AGG
caccagcaaaatgcatttgg

SEQ ID NO: 135426 - DNA, 20 bp, Artificial Sequence
  Description of Artificial Sequence: Synthetic oligonucleotide
  Target: ATXN1; (+) strand; PAM type: NRG; PAM sequence: CAG
tggaggatcactaaatctaa

SEQ ID NO: 135427 - DNA, 20 bp, Artificial Sequence
  Description of Artificial Sequence: Synthetic oligonucleotide
  Target: ATXN1; (+) strand; PAM type: NRG; PAM sequence: TAG
tctaacagtgttcactgctg

SEQ ID NO: 135428 - DNA, 20 bp, Artificial Sequence
  Description of Artificial Sequence: Synthetic oligonucleotide
  Target: ATXN1; (+) strand; PAM type: NRG; PAM sequence: GAG
gttcactgctgtagtgttat

SEQ ID NO: 135429 - DNA, 20 bp, Artificial Sequence
  Description of Artificial Sequence: Synthetic oligonucleotide
  Target: ATXN1; (+) strand; PAM type: NRG; PAM sequence: GAG
tcactgctgtagtgttatga

SEQ ID NO: 135430 - DNA, 20 bp, Artificial Sequence
  Description of Artificial Sequence: Synthetic oligonucleotide
  Target: ATXN1; (+) strand; PAM type: NRG; PAM sequence: CAG
ttatgagagtgtttcacttt

SEQ ID NO: 135431 - DNA, 20 bp, Artificial Sequence
  Description of Artificial Sequence: Synthetic oligonucleotide
  Target: ATXN1; (+) strand; PAM type: NRG; PAM sequence: AGG
tatgagagtgtttcactttc

SEQ ID NO: 135432 - DNA, 20 bp, Artificial Sequence
  Description of Artificial Sequence: Synthetic oligonucleotide
  Target: ATXN1; (+) strand; PAM type: NRG; PAM sequence: AAG
tcactttcaggaaatttcaa

SEQ ID NO: 135433 - DNA, 20 bp, Artificial Sequence
  Description of Artificial Sequence: Synthetic oligonucleotide
  Target: ATXN1; (+) strand; PAM type: NRG; PAM sequence: AGG
cactttcaggaaatttcaaa

SEQ ID NO: 135434 - DNA, 20 bp, Artificial Sequence
  Description of Artificial Sequence: Synthetic oligonucleotide
  Target: ATXN1; (+) strand; PAM type: NRG; PAM sequence: GGG
actttcaggaaatttcaaaa

SEQ ID NO: 135435 - DNA, 20 bp, Artificial Sequence
  Description of Artificial Sequence: Synthetic oligonucleotide
  Target: ATXN1; (+) strand; PAM type: NRG; PAM sequence: AAG
tcaggaaatttcaaaaggga

SEQ ID NO: 135436 - DNA, 20 bp, Artificial Sequence
  Description of Artificial Sequence: Synthetic oligonucleotide
  Target: ATXN1; (+) strand; PAM type: NRG; PAM sequence: AGG
caggaaatttcaaaagggaa

SEQ ID NO: 135437 - DNA, 20 bp, Artificial Sequence
  Description of Artificial Sequence: Synthetic oligonucleotide
  Target: ATXN1; (+) strand; PAM type: NRG; PAM sequence: TGG
gaaatttcaaaagggaaagg

SEQ ID NO: 135438 - DNA, 20 bp, Artificial Sequence
  Description of Artificial Sequence: Synthetic oligonucleotide
  Target: ATXN1; (+) strand; PAM type: NRG; PAM sequence: GGG
aaatttcaaaagggaaaggt

SEQ ID NO: 135439 - DNA, 20 bp, Artificial Sequence
  Description of Artificial Sequence: Synthetic oligonucleotide
  Target: ATXN1; (+) strand; PAM type: NRG; PAM sequence: TGG
gaaacaatgtgtgtcctaca

SEQ ID NO: 135440 - DNA, 20 bp, Artificial Sequence
  Description of Artificial Sequence: Synthetic oligonucleotide
  Target: ATXN1; (+) strand; PAM type: NRG; PAM sequence: TGG
ctacatggaaatctcacatg

SEQ ID NO: 135441 - DNA, 20 bp, Artificial Sequence
  Description of Artificial Sequence: Synthetic oligonucleotide
  Target: ATXN1; (+) strand; PAM type: NRG; PAM sequence: CAG
attgcgtcttttttcttaca

SEQ ID NO: 135442 - DNA, 20 bp, Artificial Sequence
  Description of Artificial Sequence: Synthetic oligonucleotide
  Target: ATXN1; (+) strand; PAM type: NRG; PAM sequence: TGG
agctgccattatataattct

SEQ ID NO: 135443 - DNA, 20 bp, Artificial Sequence
  Description of Artificial Sequence: Synthetic oligonucleotide
  Target: ATXN1; (+) strand; PAM type: NRG; PAM sequence: AAG
ttgttttttatttaataatt

SEQ ID NO: 135444 - DNA, 20 bp, Artificial Sequence
  Description of Artificial Sequence: Synthetic oligonucleotide
  Target: ATXN1; (+) strand; PAM type: NRG; PAM sequence: TGG
ataattaagatgaataatct

SEQ ID NO: 135445 - DNA, 20 bp, Artificial Sequence
  Description of Artificial Sequence: Synthetic oligonucleotide
  Target: ATXN1; (+) strand; PAM type: NRG; PAM sequence: GGG
taattaagatgaataatctt

SEQ ID NO: 135446 - DNA, 20 bp, Artificial Sequence
  Description of Artificial Sequence: Synthetic oligonucleotide
  Target: ATXN1; (+) strand; PAM type: NRG; PAM sequence: GGG
aattaagatgaataatcttg

SEQ ID NO: 135447 - DNA, 20 bp, Artificial Sequence
  Description of Artificial Sequence: Synthetic oligonucleotide
  Target: ATXN1; (+) strand; PAM type: NRG; PAM sequence: TGG
atccattgtatatgtatctg

SEQ ID NO: 135448 - DNA, 20 bp, Artificial Sequence
  Description of Artificial Sequence: Synthetic oligonucleotide
  Target: ATXN1; (+) strand; PAM type: NRG; PAM sequence: TAG
cattgtatatgtatctgtgg

SEQ ID NO: 135449 - DNA, 20 bp, Artificial Sequence
  Description of Artificial Sequence: Synthetic oligonucleotide
  Target: ATXN1; (+) strand; PAM type: NRG; PAM sequence: AGG
attgtatatgtatctgtggt

SEQ ID NO: 135450 - DNA, 20 bp, Artificial Sequence
  Description of Artificial Sequence: Synthetic oligonucleotide
  Target: ATXN1; (+) strand; PAM type: NRG; PAM sequence: CAG
tgtggtaggtttaaaaattc

SEQ ID NO: 135451 - DNA, 20 bp, Artificial Sequence
  Description of Artificial Sequence: Synthetic oligonucleotide
  Target: ATXN1; (+) strand; PAM type: NRG; PAM sequence: TAG
aattccagttgacctttccc

SEQ ID NO: 135452 - DNA, 20 bp, Artificial Sequence
  Description of Artificial Sequence: Synthetic oligonucleotide
  Target: ATXN1; (+) strand; PAM type: NRG; PAM sequence: CAG
gttgacctttccctagcccc

SEQ ID NO: 135453 - DNA, 20 bp, Artificial Sequence
  Description of Artificial Sequence: Synthetic oligonucleotide
  Target: ATXN1; (+) strand; PAM type: NRG; PAM sequence: TGG
cctagcccccagtatacttt

SEQ ID NO: 135454 - DNA, 20 bp, Artificial Sequence
  Description of Artificial Sequence: Synthetic oligonucleotide
  Target: ATXN1; (+) strand; PAM type: NRG; PAM sequence: GGG
ctagcccccagtatactttt

SEQ ID NO: 135455 - DNA, 20 bp, Artificial Sequence
  Description of Artificial Sequence: Synthetic oligonucleotide
  Target: ATXN1; (+) strand; PAM type: NRG; PAM sequence: AAG
ttttgggctacttcctccct

SEQ ID NO: 135456 - DNA, 20 bp, Artificial Sequence
  Description of Artificial Sequence: Synthetic oligonucleotide
  Target: ATXN1; (+) strand; PAM type: NRG; PAM sequence: GAG
ggctacttcctccctaagat

SEQ ID NO: 135457 - DNA, 20 bp, Artificial Sequence
  Description of Artificial Sequence: Synthetic oligonucleotide
  Target: ATXN1; (+) strand; PAM type: NRG; PAM sequence: TGG
atgagctatgtgcacacatg

SEQ ID NO: 135458 - DNA, 20 bp, Artificial Sequence
  Description of Artificial Sequence: Synthetic oligonucleotide
  Target: ATXN1; (+) strand; PAM type: NRG; PAM sequence: AAG
gcacaattttaatactatct

SEQ ID NO: 135459 - DNA, 20 bp, Artificial Sequence
  Description of Artificial Sequence: Synthetic oligonucleotide
  Target: ATXN1; (+) strand; PAM type: NRG; PAM sequence: AAG
gcaaaaccacaaaccaataa

SEQ ID NO: 135460 - DNA, 20 bp, Artificial Sequence
  Description of Artificial Sequence: Synthetic oligonucleotide
  Target: ATXN1; (+) strand; PAM type: NRG; PAM sequence: CGG
aaaccaataaaagcatcatc

SEQ ID NO: 135461 - DNA, 20 bp, Artificial Sequence
  Description of Artificial Sequence: Synthetic oligonucleotide
  Target: ATXN1; (+) strand; PAM type: NRG; PAM sequence: AAG
gcatcatccggtgcttctca

SEQ ID NO: 135462 - DNA, 20 bp, Artificial Sequence
  Description of Artificial Sequence: Synthetic oligonucleotide
  Target: ATXN1; (+) strand; PAM type: NRG; PAM sequence: AAG
tccggtgcttctcaaagcca

SEQ ID NO: 135463 - DNA, 20 bp, Artificial Sequence
  Description of Artificial Sequence: Synthetic oligonucleotide
  Target: ATXN1; (+) strand; PAM type: NRG; PAM sequence: AGG
ccggtgcttctcaaagccaa

SEQ ID NO: 135464 - DNA, 20 bp, Artificial Sequence
  Description of Artificial Sequence: Synthetic oligonucleotide
  Target: ATXN1; (+) strand; PAM type: NRG; PAM sequence: TGG
aaagccaaaggaaatgattt

SEQ ID NO: 135465 - DNA, 20 bp, Artificial Sequence
  Description of Artificial Sequence: Synthetic oligonucleotide
  Target: ATXN1; (+) strand; PAM type: NRG; PAM sequence: GAG
agccaaaggaaatgattttg

SEQ ID NO: 135466 - DNA, 20 bp, Artificial Sequence
  Description of Artificial Sequence: Synthetic oligonucleotide
  Target: ATXN1; (+) strand; PAM type: NRG; PAM sequence: CAG
ctgattacattccattaata

SEQ ID NO: 135467 - DNA, 20 bp, Artificial Sequence
  Description of Artificial Sequence: Synthetic oligonucleotide
  Target: ATXN1; (+) strand; PAM type: NRG; PAM sequence: AAG
ccattaatacagataattaa

SEQ ID NO: 135468 - DNA, 20 bp, Artificial Sequence
  Description of Artificial Sequence: Synthetic oligonucleotide
  Target: ATXN1; (+) strand; PAM type: NRG; PAM sequence: TAG
gactgtataataatgttaaa

SEQ ID NO: 135469 - DNA, 20 bp, Artificial Sequence
  Description of Artificial Sequence: Synthetic oligonucleotide
  Target: ATXN1; (+) strand; PAM type: NRG; PAM sequence: CAG
tgtataataatgttaaatag

SEQ ID NO: 135470 - DNA, 20 bp, Artificial Sequence
  Description of Artificial Sequence: Synthetic oligonucleotide
  Target: ATXN1; (+) strand; PAM type: NRG; PAM sequence: AGG
gtataataatgttaaatagc

SEQ ID NO: 135471 - DNA, 20 bp, Artificial Sequence
  Description of Artificial Sequence: Synthetic oligonucleotide
  Target: ATXN1; (+) strand; PAM type: NRG; PAM sequence: TAG
tgaaaatttctccgtgatat

SEQ ID NO: 135472 - DNA, 20 bp, Artificial Sequence
  Description of Artificial Sequence: Synthetic oligonucleotide
  Target: ATXN1; (+) strand; PAM type: NRG; PAM sequence: AAG
aatcaaattcatctcctctt

SEQ ID NO: 135473 - DNA, 20 bp, Artificial Sequence
  Description of Artificial Sequence: Synthetic oligonucleotide
  Target: ATXN1; (+) strand; PAM type: NRG; PAM sequence: GAG
tcaaattcatctcctcttaa

SEQ ID NO: 135474 - DNA, 20 bp, Artificial Sequence
  Description of Artificial Sequence: Synthetic oligonucleotide
  Target: ATXN1; (+) strand; PAM type: NRG; PAM sequence: CAG
aattcatctcctcttaagag

SEQ ID NO: 135475 - DNA, 20 bp, Artificial Sequence
  Description of Artificial Sequence: Synthetic oligonucleotide
  Target: ATXN1; (+) strand; PAM type: NRG; PAM sequence: TGG
taagagcagcgtataataaa

SEQ ID NO: 135476 - DNA, 20 bp, Artificial Sequence
  Description of Artificial Sequence: Synthetic oligonucleotide
  Target: ATXN1; (+) strand; PAM type: NRG; PAM sequence: GGG
aagagcagcgtataataaat

SEQ ID NO: 135477 - DNA, 20 bp, Artificial Sequence
  Description of Artificial Sequence: Synthetic oligonucleotide
  Target: ATXN1; (+) strand; PAM type: NRG; PAM sequence: TAG
agcagcgtataataaatggg

SEQ ID NO: 135478 - DNA, 20 bp, Artificial Sequence
  Description of Artificial Sequence: Synthetic oligonucleotide
  Target: ATXN1; (+) strand; PAM type: NRG; PAM sequence: AAG
ataataaatgggtagcctaa

SEQ ID NO: 135479 - DNA, 20 bp, Artificial Sequence
  Description of Artificial Sequence: Synthetic oligonucleotide
  Target: ATXN1; (+) strand; PAM type: NRG; PAM sequence: AGG
taataaatgggtagcctaaa

SEQ ID NO: 135480 - DNA, 20 bp, Artificial Sequence
  Description of Artificial Sequence: Synthetic oligonucleotide
  Target: ATXN1; (+) strand; PAM type: NRG; PAM sequence: CAG
cctaaaaggaatgctttgaa

SEQ ID NO: 135481 - DNA, 20 bp, Artificial Sequence
  Description of Artificial Sequence: Synthetic oligonucleotide
  Target: ATXN1; (+) strand; PAM type: NRG; PAM sequence: AAG
ctaaatttaaaactccaaca

SEQ ID NO: 135482 - DNA, 20 bp, Artificial Sequence
  Description of Artificial Sequence: Synthetic oligonucleotide
  Target: ATXN1; (+) strand; PAM type: NRG; PAM sequence: AGG
taaatttaaaactccaacaa

SEQ ID NO: 135483 - DNA, 20 bp, Artificial Sequence
  Description of Artificial Sequence: Synthetic oligonucleotide
  Target: ATXN1; (+) strand; PAM type: NRG; PAM sequence: AAG
tttaaaactccaacaaagga

SEQ ID NO: 135484 - DNA, 20 bp, Artificial Sequence
  Description of Artificial Sequence: Synthetic oligonucleotide
  Target: ATXN1; (+) strand; PAM type: NRG; PAM sequence: AGG
ttaaaactccaacaaaggaa

SEQ ID NO: 135485 - DNA, 20 bp, Artificial Sequence
  Description of Artificial Sequence: Synthetic oligonucleotide
  Target: ATXN1; (+) strand; PAM type: NRG; PAM sequence: AAG
aaggaaaggattattcttct

SEQ ID NO: 135486 - DNA, 20 bp, Artificial Sequence
  Description of Artificial Sequence: Synthetic oligonucleotide
  Target: ATXN1; (+) strand; PAM type: NRG; PAM sequence: AGG
aggaaaggattattcttcta

SEQ ID NO: 135487 - DNA, 20 bp, Artificial Sequence
  Description of Artificial Sequence: Synthetic oligonucleotide
  Target: ATXN1; (+) strand; PAM type: NRG; PAM sequence: AAG
ggattattcttctaaggttc

SEQ ID NO: 135488 - DNA, 20 bp, Artificial Sequence
  Description of Artificial Sequence: Synthetic oligonucleotide
  Target: ATXN1; (+) strand; PAM type: NRG; PAM sequence: GAG
ttctaaggttcaagattcgt

SEQ ID NO: 135489 - DNA, 20 bp, Artificial Sequence
  Description of Artificial Sequence: Synthetic oligonucleotide
  Target: ATXN1; (+) strand; PAM type: NRG; PAM sequence: AGG
tctaaggttcaagattcgtg

SEQ ID NO: 135490 - DNA, 20 bp, Artificial Sequence
  Description of Artificial Sequence: Synthetic oligonucleotide
  Target: ATXN1; (+) strand; PAM type: NRG; PAM sequence: TGG
gttcaagattcgtgaggatt

SEQ ID NO: 135491 - DNA, 20 bp, Artificial Sequence
  Description of Artificial Sequence: Synthetic oligonucleotide
  Target: ATXN1; (+) strand; PAM type: NRG; PAM sequence: AAG
atttggtaacgaaattcctt

SEQ ID NO: 135492 - DNA, 20 bp, Artificial Sequence
  Description of Artificial Sequence: Synthetic oligonucleotide
  Target: ATXN1; (+) strand; PAM type: NRG; PAM sequence: AGG
tttggtaacgaaattcctta

SEQ ID NO: 135493 - DNA, 20 bp, Artificial Sequence
  Description of Artificial Sequence: Synthetic oligonucleotide
  Target: ATXN1; (+) strand; PAM type: NRG; PAM sequence: CAG
gtaacgaaattccttaagga

SEQ ID NO: 135494 - DNA, 20 bp, Artificial Sequence
  Description of Artificial Sequence: Synthetic oligonucleotide
  Target: ATXN1; (+) strand; PAM type: NRG; PAM sequence: AAG
attaaaaaattgctatctac

SEQ ID NO: 135495 - DNA, 20 bp, Artificial Sequence
  Description of Artificial Sequence: Synthetic oligonucleotide
  Target: ATXN1; (+) strand; PAM type: NRG; PAM sequence: TAG
gccactattttatgtctgta

SEQ ID NO: 135496 - DNA, 20 bp, Artificial Sequence
  Description of Artificial Sequence: Synthetic oligonucleotide
  Target: ATXN1; (+) strand; PAM type: NRG; PAM sequence: AAG
tgtatagtgttttaaaatca

SEQ ID NO: 135497 - DNA, 20 bp, Artificial Sequence
  Description of Artificial Sequence: Synthetic oligonucleotide
  Target: ATXN1; (+) strand; PAM type: NRG; PAM sequence: TGG
ttcaacaacaaatgtttgtt

SEQ ID NO: 135498 - DNA, 20 bp, Artificial Sequence
  Description of Artificial Sequence: Synthetic oligonucleotide
  Target: ATXN1; (+) strand; PAM type: NRG; PAM sequence: AAG
tgtttggaataaatgaatga

SEQ ID NO: 135499 - DNA, 20 bp, Artificial Sequence
  Description of Artificial Sequence: Synthetic oligonucleotide
  Target: ATXN1; (+) strand; PAM type: NRG; PAM sequence: CAG
gaataaatgaatgaaagaaa

SEQ ID NO: 135500 - DNA, 20 bp, Artificial Sequence
  Description of Artificial Sequence: Synthetic oligonucleotide
  Target: ATXN1; (+) strand; PAM type: NRG; PAM sequence: AAG
acagcctcaaaatactttac

SEQ ID NO: 135501 - DNA, 20 bp, Artificial Sequence
  Description of Artificial Sequence: Synthetic oligonucleotide
  Target: ATXN1; (+) strand; PAM type: NRG; PAM sequence: AAG
ttacaagtttaatcacctat

SEQ ID NO: 135502 - DNA, 20 bp, Artificial Sequence
  Description of Artificial Sequence: Synthetic oligonucleotide
  Target: ATXN1; (+) strand; PAM type: NRG; PAM sequence: TAG
atcacctataagttatgaat

SEQ ID NO: 135503 - DNA, 20 bp, Artificial Sequence
  Description of Artificial Sequence: Synthetic oligonucleotide
  Target: ATXN1; (+) strand; PAM type: NRG; PAM sequence: AGG
tcacctataagttatgaatt

SEQ ID NO: 135504 - DNA, 20 bp, Artificial Sequence
  Description of Artificial Sequence: Synthetic oligonucleotide
  Target: ATXN1; (+) strand; PAM type: NRG; PAM sequence: CAG
cctataagttatgaattagg

SEQ ID NO: 135505 - DNA, 20 bp, Artificial Sequence
  Description of Artificial Sequence: Synthetic oligonucleotide
  Target: ATXN1; (+) strand; PAM type: NRG; PAM sequence: TGG
gattgaatcatttacctcgc

SEQ ID NO: 135506 - DNA, 20 bp, Artificial Sequence
  Description of Artificial Sequence: Synthetic oligonucleotide
  Target: ATXN1; (+) strand; PAM type: NRG; PAM sequence: GGG
attgaatcatttacctcgct

SEQ ID NO: 135507 - DNA, 20 bp, Artificial Sequence
  Description of Artificial Sequence: Synthetic oligonucleotide
  Target: ATXN1; (+) strand; PAM type: NRG; PAM sequence: GGG
ttgaatcatttacctcgctg

SEQ ID NO: 135508 - DNA, 20 bp, Artificial Sequence
  Description of Artificial Sequence: Synthetic oligonucleotide
  Target: ATXN1; (+) strand; PAM type: NRG; PAM sequence: AAG
atcatttacctcgctggggt

SEQ ID NO: 135509 - DNA, 20 bp, Artificial Sequence
  Description of Artificial Sequence: Synthetic oligonucleotide
  Target: ATXN1; (+) strand; PAM type: NRG; PAM sequence: AGG
tcatttacctcgctggggta

SEQ ID NO: 135510 - DNA, 20 bp, Artificial Sequence
  Description of Artificial Sequence: Synthetic oligonucleotide
  Target: ATXN1; (+) strand; PAM type: NRG; PAM sequence: TGG
gctggggtaaggtatatgtc

SEQ ID NO: 135511 - DNA, 20 bp, Artificial Sequence
  Description of Artificial Sequence: Synthetic oligonucleotide
  Target: ATXN1; (+) strand; PAM type: NRG; PAM sequence: AAG
gggtaaggtatatgtctggc

SEQ ID NO: 135512 - DNA, 20 bp, Artificial Sequence
  Description of Artificial Sequence: Synthetic oligonucleotide
  Target: ATXN1; (+) strand; PAM type: NRG; PAM sequence: AAG
ggtatatgtctggcaagcca

SEQ ID NO: 135513 - DNA, 20 bp, Artificial Sequence
  Description of Artificial Sequence: Synthetic oligonucleotide
  Target: ATXN1; (+) strand; PAM type: NRG; PAM sequence: CAG
tatgtctggcaagccaaagc

SEQ ID NO: 135514 - DNA, 20 bp, Artificial Sequence
  Description of Artificial Sequence: Synthetic oligonucleotide
  Target: ATXN1; (+) strand; PAM type: NRG; PAM sequence: TAG
tggcaagccaaagccagaac

SEQ ID NO: 135515 - DNA, 20 bp, Artificial Sequence
  Description of Artificial Sequence: Synthetic oligonucleotide
  Target: ATXN1; (+) strand; PAM type: NRG; PAM sequence: AAG
aaagccagaactagaaactc

SEQ ID NO: 135516 - DNA, 20 bp, Artificial Sequence
  Description of Artificial Sequence: Synthetic oligonucleotide
  Target: ATXN1; (+) strand; PAM type: NRG; PAM sequence: TAG
caagtaattcctttgattct

SEQ ID NO: 135517 - DNA, 20 bp, Artificial Sequence
  Description of Artificial Sequence: Synthetic oligonucleotide
  Target: ATXN1; (+) strand; PAM type: NRG; PAM sequence: CAG
ttgattcttagaaaatgacg

SEQ ID NO: 135518 - DNA, 20 bp, Artificial Sequence
  Description of Artificial Sequence: Synthetic oligonucleotide
  Target: ATXN1; (+) strand; PAM type: NRG; PAM sequence: TAG
ttagaaaatgacgcagttgt

SEQ ID NO: 135519 - DNA, 20 bp, Artificial Sequence
  Description of Artificial Sequence: Synthetic oligonucleotide
  Target: ATXN1; (+) strand; PAM type: NRG; PAM sequence: GAG
agaaaatgacgcagttgtta

SEQ ID NO: 135520 - DNA, 20 bp, Artificial Sequence
  Description of Artificial Sequence: Synthetic oligonucleotide
  Target: ATXN1; (+) strand; PAM type: NRG; PAM sequence: TGG
aatgacgcagttgttagagc

SEQ ID NO: 135521 - DNA, 20 bp, Artificial Sequence
  Description of Artificial Sequence: Synthetic oligonucleotide
  Target: ATXN1; (+) strand; PAM type: NRG; PAM sequence: CAG
ttagagctggttgcctgctg

SEQ ID NO: 135522 - DNA, 20 bp, Artificial Sequence
  Description of Artificial Sequence: Synthetic oligonucleotide
  Target: ATXN1; (+) strand; PAM type: NRG; PAM sequence: TGG
tgtgtactctcaatacaatt

SEQ ID NO: 135523 - DNA, 20 bp, Artificial Sequence
  Description of Artificial Sequence: Synthetic oligonucleotide
  Target: ATXN1; (+) strand; PAM type: NRG; PAM sequence: AAG
gtactctcaatacaatttgg

SEQ ID NO: 135524 - DNA, 20 bp, Artificial Sequence
  Description of Artificial Sequence: Synthetic oligonucleotide
  Target: ATXN1; (+) strand; PAM type: NRG; PAM sequence: AGG
tactctcaatacaatttgga

SEQ ID NO: 135525 - DNA, 20 bp, Artificial Sequence
  Description of Artificial Sequence: Synthetic oligonucleotide
  Target: ATXN1; (+) strand; PAM type: NRG; PAM sequence: TAG
aatttggaaggcatgttatc

SEQ ID NO: 135526 - DNA, 20 bp, Artificial Sequence
  Description of Artificial Sequence: Synthetic oligonucleotide
  Target: ATXN1; (+) strand; PAM type: NRG; PAM sequence: AGG
atttggaaggcatgttatct

SEQ ID NO: 135527 - DNA, 20 bp, Artificial Sequence
  Description of Artificial Sequence: Synthetic oligonucleotide
  Target: ATXN1; (+) strand; PAM type: NRG; PAM sequence: TAG
ggaaggcatgttatctaggc

SEQ ID NO: 135528 - DNA, 20 bp, Artificial Sequence
  Description of Artificial Sequence: Synthetic oligonucleotide
  Target: ATXN1; (+) strand; PAM type: NRG; PAM sequence: AGG
gaaggcatgttatctaggct

SEQ ID NO: 135529 - DNA, 20 bp, Artificial Sequence
  Description of Artificial Sequence: Synthetic oligonucleotide
  Target: ATXN1; (+) strand; PAM type: NRG; PAM sequence: GGG
aaggcatgttatctaggcta

SEQ ID NO: 135530 - DNA, 20 bp, Artificial Sequence
  Description of Artificial Sequence: Synthetic oligonucleotide
  Target: ATXN1; (+) strand; PAM type: NRG; PAM sequence: GGG
aggcatgttatctaggctag

SEQ ID NO: 135531 - DNA, 20 bp, Artificial Sequence
  Description of Artificial Sequence: Synthetic oligonucleotide
  Target: ATXN1; (+) strand; PAM type: NRG; PAM sequence: GAG
gcatgttatctaggctaggg

SEQ ID NO: 135532 - DNA, 20 bp, Artificial Sequence
  Description of Artificial Sequence: Synthetic oligonucleotide
  Target: ATXN1; (+) strand; PAM type: NRG; PAM sequence: AGG
catgttatctaggctagggg

SEQ ID NO: 135533 - DNA, 20 bp, Artificial Sequence
  Description of Artificial Sequence: Synthetic oligonucleotide
  Target: ATXN1; (+) strand; PAM type: NRG; PAM sequence: AAG
ggctaggggaggtaataaca

SEQ ID NO: 135534 - DNA, 20 bp, Artificial Sequence
  Description of Artificial Sequence: Synthetic oligonucleotide
  Target: ATXN1; (+) strand; PAM type: NRG; PAM sequence: AGG
gctaggggaggtaataacaa

SEQ ID NO: 135535 - DNA, 20 bp, Artificial Sequence
  Description of Artificial Sequence: Synthetic oligonucleotide
  Target: ATXN1; (+) strand; PAM type: NRG; PAM sequence: GAG
taggggaggtaataacaaag

SEQ ID NO: 135536 - DNA, 20 bp, Artificial Sequence
  Description of Artificial Sequence: Synthetic oligonucleotide
  Target: ATXN1; (+) strand; PAM type: NRG; PAM sequence: AGG
aggggaggtaataacaaagg

SEQ ID NO: 135537 - DNA, 20 bp, Artificial Sequence
  Description of Artificial Sequence: Synthetic oligonucleotide
  Target: ATXN1; (+) strand; PAM type: NRG; PAM sequence: TAG
aacaaaggaggcataacaat

SEQ ID NO: 135538 - DNA, 20 bp, Artificial Sequence
  Description of Artificial Sequence: Synthetic oligonucleotide
  Target: ATXN1; (+) strand; PAM type: NRG; PAM sequence: AGG
acaaaggaggcataacaatt

SEQ ID NO: 135539 - DNA, 20 bp, Artificial Sequence
  Description of Artificial Sequence: Synthetic oligonucleotide
  Target: ATXN1; (+) strand; PAM type: NRG; PAM sequence: CGG
ggcttgctcctgaaattata

SEQ ID NO: 135540 - DNA, 20 bp, Artificial Sequence
  Description of Artificial Sequence: Synthetic oligonucleotide
  Target: ATXN1; (+) strand; PAM type: NRG; PAM sequence: GGG
gcttgctcctgaaattatac

SEQ ID NO: 135541 - DNA, 20 bp, Artificial Sequence
  Description of Artificial Sequence: Synthetic oligonucleotide
  Target: ATXN1; (+) strand; PAM type: NRG; PAM sequence: TAG
tgctcctgaaattatacggg

SEQ ID NO: 135542 - DNA, 20 bp, Artificial Sequence
  Description of Artificial Sequence: Synthetic oligonucleotide
  Target: ATXN1; (+) strand; PAM type: NRG; PAM sequence: AAG
tacgggtagtcaaaaaaacg

SEQ ID NO: 135543 - DNA, 20 bp, Artificial Sequence
  Description of Artificial Sequence: Synthetic oligonucleotide
  Target: ATXN1; (+) strand; PAM type: NRG; PAM sequence: AGG
acgggtagtcaaaaaaacga

SEQ ID NO: 135544 - DNA, 20 bp, Artificial Sequence
  Description of Artificial Sequence: Synthetic oligonucleotide
  Target: ATXN1; (+) strand; PAM type: NRG; PAM sequence: AAG
ggaccccaccatcacctact

SEQ ID NO: 135545 - DNA, 20 bp, Artificial Sequence
  Description of Artificial Sequence: Synthetic oligonucleotide
  Target: ATXN1; (+) strand; PAM type: NRG; PAM sequence: TGG
tcacctactaagctatgtga

SEQ ID NO: 135546 - DNA, 20 bp, Artificial Sequence
  Description of Artificial Sequence: Synthetic oligonucleotide
  Target: ATXN1; (+) strand; PAM type: NRG; PAM sequence: GGG
cacctactaagctatgtgat

SEQ ID NO: 135547 - DNA, 20 bp, Artificial Sequence
  Description of Artificial Sequence: Synthetic oligonucleotide
  Target: ATXN1; (+) strand; PAM type: NRG; PAM sequence: TAG
taagctatgtgatgggtacc

SEQ ID NO: 135548 - DNA, 20 bp, Artificial Sequence
  Description of Artificial Sequence: Synthetic oligonucleotide
  Target: ATXN1; (+) strand; PAM type: NRG; PAM sequence: TGG
ctatgtgatgggtacctagc

SEQ ID NO: 135549 - DNA, 20 bp, Artificial Sequence
  Description of Artificial Sequence: Synthetic oligonucleotide
  Target: ATXN1; (+) strand; PAM type: NRG; PAM sequence: AAG
gatgggtacctagctggtaa

SEQ ID NO: 135550 - DNA, 20 bp, Artificial Sequence
  Description of Artificial Sequence: Synthetic oligonucleotide
  Target: ATXN1; (+) strand; PAM type: NRG; PAM sequence: AGG
atgggtacctagctggtaaa

SEQ ID NO: 135551 - DNA, 20 bp, Artificial Sequence
  Description of Artificial Sequence: Synthetic oligonucleotide
  Target: ATXN1; (+) strand; PAM type: NRG; PAM sequence: AAG
agctggtaaaaggtgtttcc

SEQ ID NO: 135552 - DNA, 20 bp, Artificial Sequence
  Description of Artificial Sequence: Synthetic oligonucleotide
  Target: ATXN1; (+) strand; PAM type: NRG; PAM sequence: CGG
gtaaaaggtgtttccaagac

SEQ ID NO: 135553 - DNA, 20 bp, Artificial Sequence
  Description of Artificial Sequence: Synthetic oligonucleotide
  Target: ATXN1; (+) strand; PAM type: NRG; PAM sequence: AAG
gtgtttccaagaccggatct

SEQ ID NO: 135554 - DNA, 20 bp, Artificial Sequence
  Description of Artificial Sequence: Synthetic oligonucleotide
  Target: ATXN1; (+) strand; PAM type: NRG; PAM sequence: TAG
accggatctaagttatttca

SEQ ID NO: 135555 - DNA, 20 bp, Artificial Sequence
  Description of Artificial Sequence: Synthetic oligonucleotide
  Target: ATXN1; (+) strand; PAM type: NRG; PAM sequence: AGG
ccggatctaagttatttcat

SEQ ID NO: 135556 - DNA, 20 bp, Artificial Sequence
  Description of Artificial Sequence: Synthetic oligonucleotide
  Target: ATXN1; (+) strand; PAM type: NRG; PAM sequence: TAG
agttatttcataggtaactt

SEQ ID NO: 135557 - DNA, 20 bp, Artificial Sequence
  Description of Artificial Sequence: Synthetic oligonucleotide
  Target: ATXN1; (+) strand; PAM type: NRG; PAM sequence: AAG
atttcataggtaactttaga

SEQ ID NO: 135558 - DNA, 20 bp, Artificial Sequence
  Description of Artificial Sequence: Synthetic oligonucleotide
  Target: ATXN1; (+) strand; PAM type: NRG; PAM sequence: TGG
ttagaaagcacgtcccaacg

SEQ ID NO: 135559 - DNA, 20 bp, Artificial Sequence
  Description of Artificial Sequence: Synthetic oligonucleotide
  Target: ATXN1; (+) strand; PAM type: NRG; PAM sequence: CAG
gaaagcacgtcccaacgtgg

SEQ ID NO: 135560 - DNA, 20 bp, Artificial Sequence
  Description of Artificial Sequence: Synthetic oligonucleotide
  Target: ATXN1; (+) strand; PAM type: NRG; PAM sequence: TAG
attcatgtgtaatttcaaaa

SEQ ID NO: 135561 - DNA, 20 bp, Artificial Sequence
  Description of Artificial Sequence: Synthetic oligonucleotide
  Target: ATXN1; (+) strand; PAM type: NRG; PAM sequence: AGG
ttcatgtgtaatttcaaaat

SEQ ID NO: 135562 - DNA, 20 bp, Artificial Sequence
  Description of Artificial Sequence: Synthetic oligonucleotide
  Target: ATXN1; (+) strand; PAM type: NRG; PAM sequence: GGG
tcatgtgtaatttcaaaata

SEQ ID NO: 135563 - DNA, 20 bp, Artificial Sequence
  Description of Artificial Sequence: Synthetic oligonucleotide
  Target: ATXN1; (+) strand; PAM type: NRG; PAM sequence: CAG
gtaatttcaaaatagggtat

SEQ ID NO: 135564 - DNA, 20 bp, Artificial Sequence
  Description of Artificial Sequence: Synthetic oligonucleotide
  Target: ATXN1; (+) strand; PAM type: NRG; PAM sequence: GAG
aaaatagggtatcagtgtat

SEQ ID NO: 135565 - DNA, 20 bp, Artificial Sequence
  Description of Artificial Sequence: Synthetic oligonucleotide
  Target: ATXN1; (+) strand; PAM type: NRG; PAM sequence: AGG
aaatagggtatcagtgtatg

SEQ ID NO: 135566 - DNA, 20 bp, Artificial Sequence
  Description of Artificial Sequence: Synthetic oligonucleotide
  Target: ATXN1; (+) strand; PAM type: NRG; PAM sequence: TAG
gtatcagtgtatgaggcatg

SEQ ID NO: 135567 - DNA, 20 bp, Artificial Sequence
  Description of Artificial Sequence: Synthetic oligonucleotide
  Target: ATXN1; (+) strand; PAM type: NRG; PAM sequence: AGG
tatcagtgtatgaggcatgt

SEQ ID NO: 135568 - DNA, 20 bp, Artificial Sequence
  Description of Artificial Sequence: Synthetic oligonucleotide
  Target: ATXN1; (+) strand; PAM type: NRG; PAM sequence: TAG
cagtgtatgaggcatgtagg

SEQ ID NO: 135569 - DNA, 20 bp, Artificial Sequence
  Description of Artificial Sequence: Synthetic oligonucleotide
  Target: ATXN1; (+) strand; PAM type: NRG; PAM sequence: AAG
atgaggcatgtaggtagtct

SEQ ID NO: 135570 - DNA, 20 bp, Artificial Sequence
  Description of Artificial Sequence: Synthetic oligonucleotide
  Target: ATXN1; (+) strand; PAM type: NRG; PAM sequence: CAG
gtagtctaagttatgtgaca

SEQ ID NO: 135571 - DNA, 20 bp, Artificial Sequence
  Description of Artificial Sequence: Synthetic oligonucleotide
  Target: ATXN1; (+) strand; PAM type: NRG; PAM sequence: GAG
agtctaagttatgtgacaca

SEQ ID NO: 135572 - DNA, 20 bp, Artificial Sequence
  Description of Artificial Sequence: Synthetic oligonucleotide
  Target: ATXN1; (+) strand; PAM type: NRG; PAM sequence: TAG
gttatgtgacacagagcatt

SEQ ID NO: 135573 - DNA, 20 bp, Artificial Sequence
  Description of Artificial Sequence: Synthetic oligonucleotide
  Target: ATXN1; (+) strand; PAM type: NRG; PAM sequence: AAG
gagcatttagcctacatcaa

SEQ ID NO: 135574 - DNA, 20 bp, Artificial Sequence
  Description of Artificial Sequence: Synthetic oligonucleotide
  Target: ATXN1; (+) strand; PAM type: NRG; PAM sequence: AAG
gaaaaatgaaattcttattt

SEQ ID NO: 135575 - DNA, 20 bp, Artificial Sequence
  Description of Artificial Sequence: Synthetic oligonucleotide
  Target: ATXN1; (+) strand; PAM type: NRG; PAM sequence: GAG
gttgctatcttcactctaat

SEQ ID NO: 135576 - DNA, 20 bp, Artificial Sequence
  Description of Artificial Sequence: Synthetic oligonucleotide
  Target: ATXN1; (+) strand; PAM type: NRG; PAM sequence: TGG
cttcactctaatgagatacg

SEQ ID NO: 135577 - DNA, 20 bp, Artificial Sequence
  Description of Artificial Sequence: Synthetic oligonucleotide
  Target: ATXN1; (+) strand; PAM type: NRG; PAM sequence: TGG
agatacgtggaacaaattac

SEQ ID NO: 135578 - DNA, 20 bp, Artificial Sequence
  Description of Artificial Sequence: Synthetic oligonucleotide
  Target: ATXN1; (+) strand; PAM type: NRG; PAM sequence: GGG
gatacgtggaacaaattact

SEQ ID NO: 135579 - DNA, 20 bp, Artificial Sequence
  Description of Artificial Sequence: Synthetic oligonucleotide
  Target: ATXN1; (+) strand; PAM type: NRG; PAM sequence: GGG
atacgtggaacaaattactg

SEQ ID NO: 135580 - DNA, 20 bp, Artificial Sequence
  Description of Artificial Sequence: Synthetic oligonucleotide
  Target: ATXN1; (+) strand; PAM type: NRG; PAM sequence: TAG
gtggaacaaattactggggc

SEQ ID NO: 135581 - DNA, 20 bp, Artificial Sequence
  Description of Artificial Sequence: Synthetic oligonucleotide
  Target: ATXN1; (+) strand; PAM type: NRG; PAM sequence: TAG
gctagaatgtattataacaa

SEQ ID NO: 135582 - DNA, 20 bp, Artificial Sequence
  Description of Artificial Sequence: Synthetic oligonucleotide
  Target: ATXN1; (+) strand; PAM type: NRG; PAM sequence: AAG
gaatgtattataacaatagt

SEQ ID NO: 135583 - DNA, 20 bp, Artificial Sequence
  Description of Artificial Sequence: Synthetic oligonucleotide
  Target: ATXN1; (+) strand; PAM type: NRG; PAM sequence: AGG
aatgtattataacaatagta

SEQ ID NO: 135584 - DNA, 20 bp, Artificial Sequence
  Description of Artificial Sequence: Synthetic oligonucleotide
  Target: ATXN1; (+) strand; PAM type: NRG; PAM sequence: AAG
gtattataacaatagtaagg

SEQ ID NO: 135585 - DNA, 20 bp, Artificial Sequence
  Description of Artificial Sequence: Synthetic oligonucleotide
  Target: ATXN1; (+) strand; PAM type: NRG; PAM sequence: AAG
ttataacaatagtaaggaag

SEQ ID NO: 135586 - DNA, 20 bp, Artificial Sequence
  Description of Artificial Sequence: Synthetic oligonucleotide
  Target: ATXN1; (+) strand; PAM type: NRG; PAM sequence: AGG
tataacaatagtaaggaaga

SEQ ID NO: 135587 - DNA, 20 bp, Artificial Sequence
  Description of Artificial Sequence: Synthetic oligonucleotide
  Target: ATXN1; (+) strand; PAM type: NRG; PAM sequence: TGG
gtaaggaagaaggttcctgc

SEQ ID NO: 135588 - DNA, 20 bp, Artificial Sequence
  Description of Artificial Sequence: Synthetic oligonucleotide
  Target: ATXN1; (+) strand; PAM type: NRG; PAM sequence: TGG
gaaggttcctgctggatact

SEQ ID NO: 135589 - DNA, 20 bp, Artificial Sequence
  Description of Artificial Sequence: Synthetic oligonucleotide
  Target: ATXN1; (+) strand; PAM type: NRG; PAM sequence: AAG
gttcctgctggatacttggt

SEQ ID NO: 135590 - DNA, 20 bp, Artificial Sequence
  Description of Artificial Sequence: Synthetic oligonucleotide
  Target: ATXN1; (+) strand; PAM type: NRG; PAM sequence: GAG
tcctgctggatacttggtaa

SEQ ID NO: 135591 - DNA, 20 bp, Artificial Sequence
  Description of Artificial Sequence: Synthetic oligonucleotide
  Target: ATXN1; (+) strand; PAM type: NRG; PAM sequence: AGG
cctgctggatacttggtaag

SEQ ID NO: 135592 - DNA, 20 bp, Artificial Sequence
  Description of Artificial Sequence: Synthetic oligonucleotide
  Target: ATXN1; (+) strand; PAM type: NRG; PAM sequence: TGG
gctggatacttggtaagagg

SEQ ID NO: 135593 - DNA, 20 bp, Artificial Sequence
  Description of Artificial Sequence: Synthetic oligonucleotide
  Target: ATXN1; (+) strand; PAM type: NRG; PAM sequence: GGG
ctggatacttggtaagaggt

SEQ ID NO: 135594 - DNA, 20 bp, Artificial Sequence
  Description of Artificial Sequence: Synthetic oligonucleotide
  Target: ATXN1; (+) strand; PAM type: NRG; PAM sequence: TGG
gatacttggtaagaggtggg

SEQ ID NO: 135595 - DNA, 20 bp, Artificial Sequence
  Description of Artificial Sequence: Synthetic oligonucleotide
  Target: ATXN1; (+) strand; PAM type: NRG; PAM sequence: GGG
atacttggtaagaggtgggt

SEQ ID NO: 135596 - DNA, 20 bp, Artificial Sequence
  Description of Artificial Sequence: Synthetic oligonucleotide
  Target: ATXN1; (+) strand; PAM type: NRG; PAM sequence: GGG
tacttggtaagaggtgggtg

SEQ ID NO: 135597 - DNA, 20 bp, Artificial Sequence
  Description of Artificial Sequence: Synthetic oligonucleotide
  Target: ATXN1; (+) strand; PAM type: NRG; PAM sequence: CAG
ggtaagaggtgggtggggtc

SEQ ID NO: 135598 - DNA, 20 bp, Artificial Sequence
  Description of Artificial Sequence: Synthetic oligonucleotide
  Target: ATXN1; (+) strand; PAM type: NRG; PAM sequence: AGG
gtaagaggtgggtggggtcc

SEQ ID NO: 135599 - DNA, 20 bp, Artificial Sequence
  Description of Artificial Sequence: Synthetic oligonucleotide
  Target: ATXN1; (+) strand; PAM type: NRG; PAM sequence: CAG
tgggtggggtccaggatttc

SEQ ID NO: 135600 - DNA, 20 bp, Artificial Sequence
  Description of Artificial Sequence: Synthetic oligonucleotide
  Target: ATXN1; (+) strand; PAM type: NRG; PAM sequence: AGG
gggtggggtccaggatttcc

SEQ ID NO: 135601 - DNA, 20 bp, Artificial Sequence
  Description of Artificial Sequence: Synthetic oligonucleotide
  Target: ATXN1; (+) strand; PAM type: NRG; PAM sequence: GGG
ggtggggtccaggatttcca

SEQ ID NO: 135602 - DNA, 20 bp, Artificial Sequence
  Description of Artificial Sequence: Synthetic oligonucleotide
  Target: ATXN1; (+) strand; PAM type: NRG; PAM sequence: GGG
gtggggtccaggatttccag

SEQ ID NO: 135603 - DNA, 20 bp, Artificial Sequence
  Description of Artificial Sequence: Synthetic oligonucleotide
  Target: ATXN1; (+) strand; PAM type: NRG; PAM sequence: GAG
caggatttccaggggacttt

SEQ ID NO: 135604 - DNA, 20 bp, Artificial Sequence
  Description of Artificial Sequence: Synthetic oligonucleotide
  Target: ATXN1; (+) strand; PAM type: NRG; PAM sequence: CAG
tttctattctgactttctaa

SEQ ID NO: 135605 - DNA, 20 bp, Artificial Sequence
  Description of Artificial Sequence: Synthetic oligonucleotide
  Target: ATXN1; (+) strand; PAM type: NRG; PAM sequence: AGG
ttctattctgactttctaac

SEQ ID NO: 135606 - DNA, 20 bp, Artificial Sequence
  Description of Artificial Sequence: Synthetic oligonucleotide
  Target: ATXN1; (+) strand; PAM type: NRG; PAM sequence: GAG
tttctaacaggatgcaatct

SEQ ID NO: 135607 - DNA, 20 bp, Artificial Sequence
  Description of Artificial Sequence: Synthetic oligonucleotide
  Target: ATXN1; (+) strand; PAM type: NRG; PAM sequence: GAG
tctaacaggatgcaatctga

SEQ ID NO: 135608 - DNA, 20 bp, Artificial Sequence
  Description of Artificial Sequence: Synthetic oligonucleotide
  Target: ATXN1; (+) strand; PAM type: NRG; PAM sequence: CAG
acaggatgcaatctgagagc

SEQ ID NO: 135609 - DNA, 20 bp, Artificial Sequence
  Description of Artificial Sequence: Synthetic oligonucleotide
  Target: ATXN1; (+) strand; PAM type: NRG; PAM sequence: CAG
gatgcaatctgagagccagc

SEQ ID NO: 135610 - DNA, 20 bp, Artificial Sequence
  Description of Artificial Sequence: Synthetic oligonucleotide
  Target: ATXN1; (+) strand; PAM type: NRG; PAM sequence: CAG
cacttaaaatctatttattt

SEQ ID NO: 135611 - DNA, 20 bp, Artificial Sequence
  Description of Artificial Sequence: Synthetic oligonucleotide
  Target: ATXN1; (+) strand; PAM type: NRG; PAM sequence: CAG
ctatttatttcagctgtgcg

SEQ ID NO: 135612 - DNA, 20 bp, Artificial Sequence
  Description of Artificial Sequence: Synthetic oligonucleotide
  Target: ATXN1; (+) strand; PAM type: NRG; PAM sequence: TGG
tttatttcagctgtgcgcag

SEQ ID NO: 135613 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctgtaatcc

SEQ ID NO: 135614 - DNA, 20 bp, Artificial Sequence
  Description of Artificial Sequence: Synthetic oligonucleotide
  Target: ATXN1; (+) strand; PAM type: NRG; PAM sequence: TAG
acgcctgtaatcccagcact

SEQ ID NO: 135615 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcacttagt

SEQ ID NO: 135616 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcacttagtg

SEQ ID NO: 135617 - DNA, 20 bp, Artificial Sequence
  Description of Artificial Sequence: Synthetic oligonucleotide
  Target: ATXN1; (+) strand; PAM type: NRG; PAM sequence: GAG
tcccagcacttagtgaggcc

SEQ ID NO: 135618 - DNA, 20 bp, Artificial Sequence
  Description of Artificial Sequence: Synthetic oligonucleotide
  Target: ATXN1; (+) strand; PAM type: NRG; PAM sequence: AGG
cccagcacttagtgaggccg

SEQ ID NO: 135619 - DNA, 20 bp, Artificial Sequence
  Description of Artificial Sequence: Synthetic oligonucleotide
  Target: ATXN1; (+) strand; PAM type: NRG; PAM sequence: CGG
agcacttagtgaggccgagg

SEQ ID NO: 135620 - DNA, 20 bp, Artificial Sequence
  Description of Artificial Sequence: Synthetic oligonucleotide
  Target: ATXN1; (+) strand; PAM type: NRG; PAM sequence: GGG
gcacttagtgaggccgaggc

SEQ ID NO: 135621 - DNA, 20 bp, Artificial Sequence
  Description of Artificial Sequence: Synthetic oligonucleotide
  Target: ATXN1; (+) strand; PAM type: NRG; PAM sequence: CGG
cttagtgaggccgaggcggg

SEQ ID NO: 135622 - DNA, 20 bp, Artificial Sequence
  Description of Artificial Sequence: Synthetic oligonucleotide
  Target: ATXN1; (+) strand; PAM type: NRG; PAM sequence: GAG
ggccgaggcgggcggaccat

SEQ ID NO: 135623 - DNA, 20 bp, Artificial Sequence
  Description of Artificial Sequence: Synthetic oligonucleotide
  Target: ATXN1; (+) strand; PAM type: NRG; PAM sequence: AGG
gccgaggcgggcggaccatg

SEQ ID NO: 135624 - DNA, 20 bp, Artificial Sequence
  Description of Artificial Sequence: Synthetic oligonucleotide
  Target: ATXN1; (+) strand; PAM type: NRG; PAM sequence: CAG
aggcgggcggaccatgaggt

SEQ ID NO: 135625 - DNA, 20 bp, Artificial Sequence
  Description of Artificial Sequence: Synthetic oligonucleotide
  Target: ATXN1; (+) strand; PAM type: NRG; PAM sequence: AGG
ggcgggcggaccatgaggtc

SEQ ID NO: 135626 - DNA, 20 bp, Artificial Sequence
  Description of Artificial Sequence: Synthetic oligonucleotide
  Target: ATXN1; (+) strand; PAM type: NRG; PAM sequence: GAG
cgggcggaccatgaggtcag

SEQ ID NO: 135627 - DNA, 20 bp, Artificial Sequence
  Description of Artificial Sequence: Synthetic oligonucleotide
  Target: ATXN1; (+) strand; PAM type: NRG; PAM sequence: GAG
gaccatgaggtcaggagatc

SEQ ID NO: 135628 - DNA, 20 bp, Artificial Sequence
  Description of Artificial Sequence: Synthetic oligonucleotide
  Target: ATXN1; (+) strand; PAM type: NRG; PAM sequence: TGG
tcaggagatcgagaccatcc

SEQ ID NO: 135629 - DNA, 20 bp, Artificial Sequence
  Description of Artificial Sequence: Synthetic oligonucleotide
  Target: ATXN1; (+) strand; PAM type: NRG; PAM sequence: CGG
cgagaccatcctggctaaca

SEQ ID NO: 135630 - DNA, 20 bp, Artificial Sequence
  Description of Artificial Sequence: Synthetic oligonucleotide
  Target: ATXN1; (+) strand; PAM type: NRG; PAM sequence: TAG
ctaaaaaatacaaaaaatat

SEQ ID NO: 135631 - DNA, 20 bp, Artificial Sequence
  Description of Artificial Sequence: Synthetic oligonucleotide
  Target: ATXN1; (+) strand; PAM type: NRG; PAM sequence: TGG
aaaatacaaaaaatattagt

SEQ ID NO: 135632 - DNA, 20 bp, Artificial Sequence
  Description of Artificial Sequence: Synthetic oligonucleotide
  Target: ATXN1; (+) strand; PAM type: NRG; PAM sequence: GGG
aaatacaaaaaatattagtt

SEQ ID NO: 135633 - DNA, 20 bp, Artificial Sequence
  Description of Artificial Sequence: Synthetic oligonucleotide
  Target: ATXN1; (+) strand; PAM type: NRG; PAM sequence: TGG
caaaaaatattagttgggtg

SEQ ID NO: 135634 - DNA, 20 bp, Artificial Sequence
  Description of Artificial Sequence: Synthetic oligonucleotide
  Target: ATXN1; (+) strand; PAM type: NRG; PAM sequence: TGG
aaaatattagttgggtgtgg

SEQ ID NO: 135635 - DNA, 20 bp, Artificial Sequence
  Description of Artificial Sequence: Synthetic oligonucleotide
  Target: ATXN1; (+) strand; PAM type: NRG; PAM sequence: CGG
atattagttgggtgtggtgg

SEQ ID NO: 135636 - DNA, 20 bp, Artificial Sequence
  Description of Artificial Sequence: Synthetic oligonucleotide
  Target: ATXN1; (+) strand; PAM type: NRG; PAM sequence: GGG
tattagttgggtgtggtggc

SEQ ID NO: 135637 - DNA, 20 bp, Artificial Sequence
  Description of Artificial Sequence: Synthetic oligonucleotide
  Target: ATXN1; (+) strand; PAM type: NRG; PAM sequence: TAG
ggtgtggtggcgggcacctg

SEQ ID NO: 135638 - DNA, 20 bp, Artificial Sequence
  Description of Artificial Sequence: Synthetic oligonucleotide
  Target: ATXN1; (+) strand; PAM type: NRG; PAM sequence: CAG
gtggcgggcacctgtagtcc

SEQ ID NO: 135639 - DNA, 20 bp, Artificial Sequence
  Description of Artificial Sequence: Synthetic oligonucleotide
  Target: ATXN1; (+) strand; PAM type: NRG; PAM sequence: CGG
cacctgtagtcccagctact

SEQ ID NO: 135640 - DNA, 20 bp, Artificial Sequence
  Description of Artificial Sequence: Synthetic oligonucleotide
  Target: ATXN1; (+) strand; PAM type: NRG; PAM sequence: GGG
acctgtagtcccagctactc

SEQ ID NO: 135641 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagctactcgg

SEQ ID NO: 135642 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagctactcggg

SEQ ID NO: 135643 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcgggaggct

SEQ ID NO: 135644 - DNA, 20 bp, Artificial Sequence
  Description of Artificial Sequence: Synthetic oligonucleotide
  Target: ATXN1; (+) strand; PAM type: NRG; PAM sequence: AGG
cccagctactcgggaggctg

SEQ ID NO: 135645 - DNA, 20 bp, Artificial Sequence
  Description of Artificial Sequence: Synthetic oligonucleotide
  Target: ATXN1; (+) strand; PAM type: NRG; PAM sequence: CAG
agctactcgggaggctgagg

SEQ ID NO: 135646 - DNA, 20 bp, Artificial Sequence
  Description of Artificial Sequence: Synthetic oligonucleotide
  Target: ATXN1; (+) strand; PAM type: NRG; PAM sequence: AGG
gctactcgggaggctgaggc

SEQ ID NO: 135647 - DNA, 20 bp, Artificial Sequence
  Description of Artificial Sequence: Synthetic oligonucleotide
  Target: ATXN1; (+) strand; PAM type: NRG; PAM sequence: TGG
gggaggctgaggcaggaaaa

SEQ ID NO: 135648 - DNA, 20 bp, Artificial Sequence
  Description of Artificial Sequence: Synthetic oligonucleotide
  Target: ATXN1; (+) strand; PAM type: NRG; PAM sequence: CAG
gcaggaaaatggcgtgaacc

SEQ ID NO: 135649 - DNA, 20 bp, Artificial Sequence
  Description of Artificial Sequence: Synthetic oligonucleotide
  Target: ATXN1; (+) strand; PAM type: NRG; PAM sequence: AGG
caggaaaatggcgtgaaccc

SEQ ID NO: 135650 - DNA, 20 bp, Artificial Sequence
  Description of Artificial Sequence: Synthetic oligonucleotide
  Target: ATXN1; (+) strand; PAM type: NRG; PAM sequence: GAG
ggaaaatggcgtgaacccag

SEQ ID NO: 135651 - DNA, 20 bp, Artificial Sequence
  Description of Artificial Sequence: Synthetic oligonucleotide
  Target: ATXN1; (+) strand; PAM type: NRG; PAM sequence: AGG
gaaaatggcgtgaacccagg

SEQ ID NO: 135652 - DNA, 20 bp, Artificial Sequence
  Description of Artificial Sequence: Synthetic oligonucleotide
  Target: ATXN1; (+) strand; PAM type: NRG; PAM sequence: CGG
aatggcgtgaacccaggagg

SEQ ID NO: 135653 - DNA, 20 bp, Artificial Sequence
  Description of Artificial Sequence: Synthetic oligonucleotide
  Target: ATXN1; (+) strand; PAM type: NRG; PAM sequence: GAG
tggcgtgaacccaggaggcg

SEQ ID NO: 135654 - DNA, 20 bp, Artificial Sequence
  Description of Artificial Sequence: Synthetic oligonucleotide
  Target: ATXN1; (+) strand; PAM type: NRG; PAM sequence: CAG
aacccaggaggcggagcttg

SEQ ID NO: 135655 - DNA, 20 bp, Artificial Sequence
  Description of Artificial Sequence: Synthetic oligonucleotide
  Target: ATXN1; (+) strand; PAM type: NRG; PAM sequence: GAG
caggaggcggagcttgcagt

SEQ ID NO: 135656 - DNA, 20 bp, Artificial Sequence
  Description of Artificial Sequence: Synthetic oligonucleotide
  Target: ATXN1; (+) strand; PAM type: NRG; PAM sequence: AAG
ggcggagcttgcagtgagcc

SEQ ID NO: 135657 - DNA, 20 bp, Artificial Sequence
  Description of Artificial Sequence: Synthetic oligonucleotide
  Target: ATXN1; (+) strand; PAM type: NRG; PAM sequence: CAG
aagattgcaccactgcattc

SEQ ID NO: 135658 - DNA, 20 bp, Artificial Sequence
  Description of Artificial Sequence: Synthetic oligonucleotide
  Target: ATXN1; (+) strand; PAM type: NRG; PAM sequence: TGG
tgcaccactgcattccagcc

SEQ ID NO: 135659 - DNA, 20 bp, Artificial Sequence
  Description of Artificial Sequence: Synthetic oligonucleotide
  Target: ATXN1; (+) strand; PAM type: NRG; PAM sequence: CAG
ctgcattccagcctggatga

SEQ ID NO: 135660 - DNA, 20 bp, Artificial Sequence
  Description of Artificial Sequence: Synthetic oligonucleotide
  Target: ATXN1; (+) strand; PAM type: NRG; PAM sequence: GAG
gcattccagcctggatgaca

SEQ ID NO: 135661 - DNA, 20 bp, Artificial Sequence
  Description of Artificial Sequence: Synthetic oligonucleotide
  Target: ATXN1; (+) strand; PAM type: NRG; PAM sequence: GAG
tccagcctggatgacagagt

SEQ ID NO: 135662 - DNA, 20 bp, Artificial Sequence
  Description of Artificial Sequence: Synthetic oligonucleotide
  Target: ATXN1; (+) strand; PAM type: NRG; PAM sequence: AAG
agtgagactttgtctcaaaa

SEQ ID NO: 135663 - DNA, 20 bp, Artificial Sequence
  Description of Artificial Sequence: Synthetic oligonucleotide
  Target: ATXN1; (+) strand; PAM type: NRG; PAM sequence: CAG
atcaatttgtttcaacaatc

SEQ ID NO: 135664 - DNA, 20 bp, Artificial Sequence
  Description of Artificial Sequence: Synthetic oligonucleotide
  Target: ATXN1; (+) strand; PAM type: NRG; PAM sequence: GAG
caatttgtttcaacaatcca

SEQ ID NO: 135665 - DNA, 20 bp, Artificial Sequence
  Description of Artificial Sequence: Synthetic oligonucleotide
  Target: ATXN1; (+) strand; PAM type: NRG; PAM sequence: TAG
tttgtttcaacaatccagag

SEQ ID NO: 135666 - DNA, 20 bp, Artificial Sequence
  Description of Artificial Sequence: Synthetic oligonucleotide
  Target: ATXN1; (+) strand; PAM type: NRG; PAM sequence: AAG
acaatccagagtagaaatac

SEQ ID NO: 135667 - DNA, 20 bp, Artificial Sequence
  Description of Artificial Sequence: Synthetic oligonucleotide
  Target: ATXN1; (+) strand; PAM type: NRG; PAM sequence: TAG
atccagagtagaaatacaag

SEQ ID NO: 135668 - DNA, 20 bp, Artificial Sequence
  Description of Artificial Sequence: Synthetic oligonucleotide
  Target: ATXN1; (+) strand; PAM type: NRG; PAM sequence: AAG
cagagtagaaatacaagtag

SEQ ID NO: 135669 - DNA, 20 bp, Artificial Sequence
  Description of Artificial Sequence: Synthetic oligonucleotide
  Target: ATXN1; (+) strand; PAM type: NRG; PAM sequence: AAG
acaagtagaagattttgtgc

SEQ ID NO: 135670 - DNA, 20 bp, Artificial Sequence
  Description of Artificial Sequence: Synthetic oligonucleotide
  Target: ATXN1; (+) strand; PAM type: NRG; PAM sequence: AAG
tgtgcaagcgtattttgtgc

SEQ ID NO: 135671 - DNA, 20 bp, Artificial Sequence
  Description of Artificial Sequence: Synthetic oligonucleotide
  Target: ATXN1; (+) strand; PAM type: NRG; PAM sequence: AAG
gcaagcgtaatctattttgc

SEQ ID NO: 135672 - DNA, 20 bp, Artificial Sequence
  Description of Artificial Sequence: Synthetic oligonucleotide
  Target: ATXN1; (+) strand; PAM type: NRG; PAM sequence: CAG
agcgtaatctattttgcaag

SEQ ID NO: 135673 - DNA, 20 bp, Artificial Sequence
  Description of Artificial Sequence: Synthetic oligonucleotide
  Target: ATXN1; (+) strand; PAM type: NRG; PAM sequence: TAG
cagaaaattctcacgtattt

SEQ ID NO: 135674 - DNA, 20 bp, Artificial Sequence
  Description of Artificial Sequence: Synthetic oligonucleotide
  Target: ATXN1; (+) strand; PAM type: NRG; PAM sequence: GAG
gaaaattctcacgtatttta

SEQ ID NO: 135675 - DNA, 20 bp, Artificial Sequence
  Description of Artificial Sequence: Synthetic oligonucleotide
  Target: ATXN1; (+) strand; PAM type: NRG; PAM sequence: CAG
attctcacgtattttagagt

SEQ ID NO: 135676 - DNA, 20 bp, Artificial Sequence
  Description of Artificial Sequence: Synthetic oligonucleotide
  Target: ATXN1; (+) strand; PAM type: NRG; PAM sequence: AGG
ttctcacgtattttagagtc

SEQ ID NO: 135677 - DNA, 20 bp, Artificial Sequence
  Description of Artificial Sequence: Synthetic oligonucleotide
  Target: ATXN1; (+) strand; PAM type: NRG; PAM sequence: GGG
tctcacgtattttagagtca

SEQ ID NO: 135678 - DNA, 20 bp, Artificial Sequence
  Description of Artificial Sequence: Synthetic oligonucleotide
  Target: ATXN1; (+) strand; PAM type: NRG; PAM sequence: AAG
ttctcaaatcataaatctta

SEQ ID NO: 135679 - DNA, 20 bp, Artificial Sequence
  Description of Artificial Sequence: Synthetic oligonucleotide
  Target: ATXN1; (+) strand; PAM type: NRG; PAM sequence: CAG
atcataaatcttaaagtttt

SEQ ID NO: 135680 - DNA, 20 bp, Artificial Sequence
  Description of Artificial Sequence: Synthetic oligonucleotide
  Target: ATXN1; (+) strand; PAM type: NRG; PAM sequence: AAG
aagttttcagaatccatgcc

SEQ ID NO: 135681 - DNA, 20 bp, Artificial Sequence
  Description of Artificial Sequence: Synthetic oligonucleotide
  Target: ATXN1; (+) strand; PAM type: NRG; PAM sequence: AGG
agttttcagaatccatgcca

SEQ ID NO: 135682 - DNA, 20 bp, Artificial Sequence
  Description of Artificial Sequence: Synthetic oligonucleotide
  Target: ATXN1; (+) strand; PAM type: NRG; PAM sequence: GGG
gttttcagaatccatgccaa

SEQ ID NO: 135683 - DNA, 20 bp, Artificial Sequence
  Description of Artificial Sequence: Synthetic oligonucleotide
  Target: ATXN1; (+) strand; PAM type: NRG; PAM sequence: AAG
gaatccatgccaagggactt

SEQ ID NO: 135684 - DNA, 20 bp, Artificial Sequence
  Description of Artificial Sequence: Synthetic oligonucleotide
  Target: ATXN1; (+) strand; PAM type: NRG; PAM sequence: AAG
aattaatattgcccccatat

SEQ ID NO: 135685 - DNA, 20 bp, Artificial Sequence
  Description of Artificial Sequence: Synthetic oligonucleotide
  Target: ATXN1; (+) strand; PAM type: NRG; PAM sequence: AAG
taagctgtcttttgtatact

SEQ ID NO: 135686 - DNA, 20 bp, Artificial Sequence
  Description of Artificial Sequence: Synthetic oligonucleotide
  Target: ATXN1; (+) strand; PAM type: NRG; PAM sequence: CAG
gtcttttgtatactaagcat

SEQ ID NO: 135687 - DNA, 20 bp, Artificial Sequence
  Description of Artificial Sequence: Synthetic oligonucleotide
  Target: ATXN1; (+) strand; PAM type: NRG; PAM sequence: AAG
ttgtatactaagcatcagca

SEQ ID NO: 135688 - DNA, 20 bp, Artificial Sequence
  Description of Artificial Sequence: Synthetic oligonucleotide
  Target: ATXN1; (+) strand; PAM type: NRG; PAM sequence: CAG
agcaaagcatctgcccccaa

SEQ ID NO: 135689 - DNA, 20 bp, Artificial Sequence
  Description of Artificial Sequence: Synthetic oligonucleotide
  Target: ATXN1; (+) strand; PAM type: NRG; PAM sequence: TGG
gcccccaacagctattttac

SEQ ID NO: 135690 - DNA, 20 bp, Artificial Sequence
  Description of Artificial Sequence: Synthetic oligonucleotide
  Target: ATXN1; (+) strand; PAM type: NRG; PAM sequence: CAG
aacagctattttactggtcc

SEQ ID NO: 135691 - DNA, 20 bp, Artificial Sequence
  Description of Artificial Sequence: Synthetic oligonucleotide
  Target: ATXN1; (+) strand; PAM type: NRG; PAM sequence: GAG
cagctattttactggtccca

SEQ ID NO: 135692 - DNA, 20 bp, Artificial Sequence
  Description of Artificial Sequence: Synthetic oligonucleotide
  Target: ATXN1; (+) strand; PAM type: NRG; PAM sequence: AGG
agctattttactggtcccag

SEQ ID NO: 135693 - DNA, 20 bp, Artificial Sequence
  Description of Artificial Sequence: Synthetic oligonucleotide
  Target: ATXN1; (+) strand; PAM type: NRG; PAM sequence: AAG
attttactggtcccagagga

SEQ ID NO: 135694 - DNA, 20 bp, Artificial Sequence
  Description of Artificial Sequence: Synthetic oligonucleotide
  Target: ATXN1; (+) strand; PAM type: NRG; PAM sequence: AAG
actggtcccagaggaaagat

SEQ ID NO: 135695 - DNA, 20 bp, Artificial Sequence
  Description of Artificial Sequence: Synthetic oligonucleotide
  Target: ATXN1; (+) strand; PAM type: NRG; PAM sequence: CAG
ggtcccagaggaaagataag

SEQ ID NO: 135696 - DNA, 20 bp, Artificial Sequence
  Description of Artificial Sequence: Synthetic oligonucleotide
  Target: ATXN1; (+) strand; PAM type: NRG; PAM sequence: GAG
tcccagaggaaagataagca

SEQ ID NO: 135697 - DNA, 20 bp, Artificial Sequence
  Description of Artificial Sequence: Synthetic oligonucleotide
  Target: ATXN1; (+) strand; PAM type: NRG; PAM sequence: AAG
ttgtcttccgcaaaatcata

SEQ ID NO: 135698 - DNA, 20 bp, Artificial Sequence
  Description of Artificial Sequence: Synthetic oligonucleotide
  Target: ATXN1; (+) strand; PAM type: NRG; PAM sequence: AAG
tcttccgcaaaatcataaag

SEQ ID NO: 135699 - DNA, 20 bp, Artificial Sequence
  Description of Artificial Sequence: Synthetic oligonucleotide
  Target: ATXN1; (+) strand; PAM type: NRG; PAM sequence: AGG
cttccgcaaaatcataaaga

SEQ ID NO: 135700 - DNA, 20 bp, Artificial Sequence
  Description of Artificial Sequence: Synthetic oligonucleotide
  Target: ATXN1; (+) strand; PAM type: NRG; PAM sequence: AAG
gcaaaatcataaagaaggtc

SEQ ID NO: 135701 - DNA, 20 bp, Artificial Sequence
  Description of Artificial Sequence: Synthetic oligonucleotide
  Target: ATXN1; (+) strand; PAM type: NRG; PAM sequence: TAG
aagaaggtcaagttcatctg

SEQ ID NO: 135702 - DNA, 20 bp, Artificial Sequence
  Description of Artificial Sequence: Synthetic oligonucleotide
  Target: ATXN1; (+) strand; PAM type: NRG; PAM sequence: AGG
agaaggtcaagttcatctgt

SEQ ID NO: 135703 - DNA, 20 bp, Artificial Sequence
  Description of Artificial Sequence: Synthetic oligonucleotide
  Target: ATXN1; (+) strand; PAM type: NRG; PAM sequence: TAG
atctgtaggatccttcccct

SEQ ID NO: 135704 - DNA, 20 bp, Artificial Sequence
  Description of Artificial Sequence: Synthetic oligonucleotide
  Target: ATXN1; (+) strand; PAM type: NRG; PAM sequence: AGG
tctgtaggatccttcccctt

SEQ ID NO: 135705 - DNA, 20 bp, Artificial Sequence
  Description of Artificial Sequence: Synthetic oligonucleotide
  Target: ATXN1; (+) strand; PAM type: NRG; PAM sequence: TAG
atccttccccttaggccctc

SEQ ID NO: 135706 - DNA, 20 bp, Artificial Sequence
  Description of Artificial Sequence: Synthetic oligonucleotide
  Target: ATXN1; (+) strand; PAM type: NRG; PAM sequence: AGG
tccttccccttaggccctct

SEQ ID NO: 135707 - DNA, 20 bp, Artificial Sequence
  Description of Artificial Sequence: Synthetic oligonucleotide
  Target: ATXN1; (+) strand; PAM type: NRG; PAM sequence: TGG
ccctctaggtgcctccccat

SEQ ID NO: 135708 - DNA, 20 bp, Artificial Sequence
  Description of Artificial Sequence: Synthetic oligonucleotide
  Target: ATXN1; (+) strand; PAM type: NRG; PAM sequence: GGG
cctctaggtgcctccccatt

SEQ ID NO: 135709 - DNA, 20 bp, Artificial Sequence
  Description of Artificial Sequence: Synthetic oligonucleotide
  Target: ATXN1; (+) strand; PAM type: NRG; PAM sequence: CAG
ggtgcctccccattgggccc

SEQ ID NO: 135710 - DNA, 20 bp, Artificial Sequence
  Description of Artificial Sequence: Synthetic oligonucleotide
  Target: ATXN1; (+) strand; PAM type: NRG; PAM sequence: AGG
gtgcctccccattgggcccc

SEQ ID NO: 135711 - DNA, 20 bp, Artificial Sequence
  Description of Artificial Sequence: Synthetic oligonucleotide
  Target: ATXN1; (+) strand; PAM type: NRG; PAM sequence: GGG
tgcctccccattgggcccca

SEQ ID NO: 135712 - DNA, 20 bp, Artificial Sequence
  Description of Artificial Sequence: Synthetic oligonucleotide
  Target: ATXN1; (+) strand; PAM type: NRG; PAM sequence: GGG
gcctccccattgggccccag

SEQ ID NO: 135713 - DNA, 20 bp, Artificial Sequence
  Description of Artificial Sequence: Synthetic oligonucleotide
  Target: ATXN1; (+) strand; PAM type: NRG; PAM sequence: CAG
tgccctgtcaacttgaacac

SEQ ID NO: 135714 - DNA, 20 bp, Artificial Sequence
  Description of Artificial Sequence: Synthetic oligonucleotide
  Target: ATXN1; (+) strand; PAM type: NRG; PAM sequence: CAG
tgaacaccagtgaaacacca

SEQ ID NO: 135715 - DNA, 20 bp, Artificial Sequence
  Description of Artificial Sequence: Synthetic oligonucleotide
  Target: ATXN1; (+) strand; PAM type: NRG; PAM sequence: CAG
gtttcaatatgaatacactt

SEQ ID NO: 135716 - DNA, 20 bp, Artificial Sequence
  Description of Artificial Sequence: Synthetic oligonucleotide
  Target: ATXN1; (+) strand; PAM type: NRG; PAM sequence: AAG
caaaaaaaatccatacttta

SEQ ID NO: 135717 - DNA, 20 bp, Artificial Sequence
  Description of Artificial Sequence: Synthetic oligonucleotide
  Target: ATXN1; (+) strand; PAM type: NRG; PAM sequence: AAG
ttaaagcttttaattttttt

SEQ ID NO: 135718 - DNA, 20 bp, Artificial Sequence
  Description of Artificial Sequence: Synthetic oligonucleotide
  Target: ATXN1; (+) strand; PAM type: NRG; PAM sequence: AAG
gcttttaatttttttaattg

SEQ ID NO: 135719 - DNA, 20 bp, Artificial Sequence
  Description of Artificial Sequence: Synthetic oligonucleotide
  Target: ATXN1; (+) strand; PAM type: NRG; PAM sequence: CAG
tttcttttaaattctaacat

SEQ ID NO: 135720 - DNA, 20 bp, Artificial Sequence
  Description of Artificial Sequence: Synthetic oligonucleotide
  Target: ATXN1; (+) strand; PAM type: NRG; PAM sequence: GAG
ttttaaattctaacatcagt

SEQ ID NO: 135721 - DNA, 20 bp, Artificial Sequence
  Description of Artificial Sequence: Synthetic oligonucleotide
  Target: ATXN1; (+) strand; PAM type: NRG; PAM sequence: CAG
taaattctaacatcagtgag

SEQ ID NO: 135722 - DNA, 20 bp, Artificial Sequence
  Description of Artificial Sequence: Synthetic oligonucleotide
  Target: ATXN1; (+) strand; PAM type: NRG; PAM sequence: TAG
aaattctttttttttttttt

SEQ ID NO: 135723 - DNA, 20 bp, Artificial Sequence
  Description of Artificial Sequence: Synthetic oligonucleotide
  Target: ATXN1; (+) strand; PAM type: NRG; PAM sequence: TGG
tctttttttttttttttaga

SEQ ID NO: 135724 - DNA, 20 bp, Artificial Sequence
  Description of Artificial Sequence: Synthetic oligonucleotide
  Target: ATXN1; (+) strand; PAM type: NRG; PAM sequence: GAG
tttttttttttttttagatg

SEQ ID NO: 135725 - DNA, 20 bp, Artificial Sequence
  Description of Artificial Sequence: Synthetic oligonucleotide
  Target: ATXN1; (+) strand; PAM type: NRG; PAM sequence: CAG
tggagtctcgctctgtgacc

SEQ ID NO: 135726 - DNA, 20 bp, Artificial Sequence
  Description of Artificial Sequence: Synthetic oligonucleotide
  Target: ATXN1; (+) strand; PAM type: NRG; PAM sequence: AGG
ggagtctcgctctgtgaccc

SEQ ID NO: 135727 - DNA, 20 bp, Artificial Sequence
  Description of Artificial Sequence: Synthetic oligonucleotide
  Target: ATXN1; (+) strand; PAM type: NRG; PAM sequence: TGG
tctcgctctgtgacccaggc

SEQ ID NO: 135728 - DNA, 20 bp, Artificial Sequence
  Description of Artificial Sequence: Synthetic oligonucleotide
  Target: ATXN1; (+) strand; PAM type: NRG; PAM sequence: GAG
tcgctctgtgacccaggctg

SEQ ID NO: 135729 - DNA, 20 bp, Artificial Sequence
  Description of Artificial Sequence: Synthetic oligonucleotide
  Target: ATXN1; (+) strand; PAM type: NRG; PAM sequence: CAG
ctgtgacccaggctggagtg

SEQ ID NO: 135730 - DNA, 20 bp, Artificial Sequence
  Description of Artificial Sequence: Synthetic oligonucleotide
  Target: ATXN1; (+) strand; PAM type: NRG; PAM sequence: TGG
tgacccaggctggagtgcag

SEQ ID NO: 135731 - DNA, 20 bp, Artificial Sequence
  Description of Artificial Sequence: Synthetic oligonucleotide
  Target: ATXN1; (+) strand; PAM type: NRG; PAM sequence: TGG
ggagtgcagtggcatgatct

SEQ ID NO: 135732 - DNA, 20 bp, Artificial Sequence
  Description of Artificial Sequence: Synthetic oligonucleotide
  Target: ATXN1; (+) strand; PAM type: NRG; PAM sequence: TGG
tcactgcaaccttcgcctcc

SEQ ID NO: 135733 - DNA, 20 bp, Artificial Sequence
  Description of Artificial Sequence: Synthetic oligonucleotide
  Target: ATXN1; (+) strand; PAM type: NRG; PAM sequence: GGG
cactgcaaccttcgcctcct

SEQ ID NO: 135734 - DNA, 20 bp, Artificial Sequence
  Description of Artificial Sequence: Synthetic oligonucleotide
  Target: ATXN1; (+) strand; PAM type: NRG; PAM sequence: AAG
aaccttcgcctcctgggttc

SEQ ID NO: 135735 - DNA, 20 bp, Artificial Sequence
  Description of Artificial Sequence: Synthetic oligonucleotide
  Target: ATXN1; (+) strand; PAM type: NRG; PAM sequence: AAG
ttcgcctcctgggttcaagc

SEQ ID NO: 135736 - DNA, 20 bp, Artificial Sequence
  Description of Artificial Sequence: Synthetic oligonucleotide
  Target: ATXN1; (+) strand; PAM type: NRG; PAM sequence: CAG
ttcaagcaagtctcttgcct

SEQ ID NO: 135737 - DNA, 20 bp, Artificial Sequence
  Description of Artificial Sequence: Synthetic oligonucleotide
  Target: ATXN1; (+) strand; PAM type: NRG; PAM sequence: AAG
gtctcttgcctcagcctccc

SEQ ID NO: 135738 - DNA, 20 bp, Artificial Sequence
  Description of Artificial Sequence: Synthetic oligonucleotide
  Target: ATXN1; (+) strand; PAM type: NRG; PAM sequence: TAG
tcttgcctcagcctcccaag

SEQ ID NO: 135739 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaagtagc

SEQ ID NO: 135740 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaagtagct

SEQ ID NO: 135741 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtagctgggacta

SEQ ID NO: 135742 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagctgggactac

SEQ ID NO: 135743 - DNA, 20 bp, Artificial Sequence
  Description of Artificial Sequence: Synthetic oligonucleotide
  Target: ATXN1; (+) strand; PAM type: NRG; PAM sequence: CAG
agtagctgggactacaggcg

SEQ ID NO: 135744 - DNA, 20 bp, Artificial Sequence
  Description of Artificial Sequence: Synthetic oligonucleotide
  Target: ATXN1; (+) strand; PAM type: NRG; PAM sequence: AGG
gtagctgggactacaggcgc

SEQ ID NO: 135745 - DNA, 20 bp, Artificial Sequence
  Description of Artificial Sequence: Synthetic oligonucleotide
  Target: ATXN1; (+) strand; PAM type: NRG; PAM sequence: TAG
cctgctaatttttgtatttt

SEQ ID NO: 135746 - DNA, 20 bp, Artificial Sequence
  Description of Artificial Sequence: Synthetic oligonucleotide
  Target: ATXN1; (+) strand; PAM type: NRG; PAM sequence: CAG
taatttttgtatttttagta

SEQ ID NO: 135747 - DNA, 20 bp, Artificial Sequence
  Description of Artificial Sequence: Synthetic oligonucleotide
  Target: ATXN1; (+) strand; PAM type: NRG; PAM sequence: TGG
ttttgtatttttagtacaga

SEQ ID NO: 135748 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtacagat

SEQ ID NO: 135749 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtacagatg

SEQ ID NO: 135750 - DNA, 20 bp, Artificial Sequence
  Description of Artificial Sequence: Synthetic oligonucleotide
  Target: ATXN1; (+) strand; PAM type: NRG; PAM sequence: TGG
cagatggggtttcaccgtgt

SEQ ID NO: 135751 - DNA, 20 bp, Artificial Sequence
  Description of Artificial Sequence: Synthetic oligonucleotide
  Target: ATXN1; (+) strand; PAM type: NRG; PAM sequence: CAG
tggggtttcaccgtgttggc

SEQ ID NO: 135752 - DNA, 20 bp, Artificial Sequence
  Description of Artificial Sequence: Synthetic oligonucleotide
  Target: ATXN1; (+) strand; PAM type: NRG; PAM sequence: TGG
tttcaccgtgttggccagaa

SEQ ID NO: 135753 - DNA, 20 bp, Artificial Sequence
  Description of Artificial Sequence: Synthetic oligonucleotide
  Target: ATXN1; (+) strand; PAM type: NRG; PAM sequence: CGG
acctcatgaaccacccgctt

SEQ ID NO: 135754 - DNA, 20 bp, Artificial Sequence
  Description of Artificial Sequence: Synthetic oligonucleotide
  Target: ATXN1; (+) strand; PAM type: NRG; PAM sequence: AAG
ccacccgcttcggcctccca

SEQ ID NO: 135755 - DNA, 20 bp, Artificial Sequence
  Description of Artificial Sequence: Synthetic oligonucleotide
  Target: ATXN1; (+) strand; PAM type: NRG; PAM sequence: GAG
cttcggcctcccaaagtgct

SEQ ID NO: 135756 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgagatta

SEQ ID NO: 135757 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgagattac

SEQ ID NO: 135758 - DNA, 20 bp, Artificial Sequence
  Description of Artificial Sequence: Synthetic oligonucleotide
  Target: ATXN1; (+) strand; PAM type: NRG; PAM sequence: GAG
agtgctgagattacaggcgt

SEQ ID NO: 135759 - DNA, 20 bp, Artificial Sequence
  Description of Artificial Sequence: Synthetic oligonucleotide
  Target: ATXN1; (+) strand; PAM type: NRG; PAM sequence: GAG
gattacaggcgtgagccact

SEQ ID NO: 135760 - DNA, 20 bp, Artificial Sequence
  Description of Artificial Sequence: Synthetic oligonucleotide
  Target: ATXN1; (+) strand; PAM type: NRG; PAM sequence: TGG
caggcgtgagccactgagcc

SEQ ID NO: 135761 - DNA, 20 bp, Artificial Sequence
  Description of Artificial Sequence: Synthetic oligonucleotide
  Target: ATXN1; (+) strand; PAM type: NRG; PAM sequence: CAG
tgagccactgagcctggccg

SEQ ID NO: 135762 - DNA, 20 bp, Artificial Sequence
  Description of Artificial Sequence: Synthetic oligonucleotide
  Target: ATXN1; (+) strand; PAM type: NRG; PAM sequence: CGG
gccgcagcccaaattctgaa

SEQ ID NO: 135763 - DNA, 20 bp, Artificial Sequence
  Description of Artificial Sequence: Synthetic oligonucleotide
  Target: ATXN1; (+) strand; PAM type: NRG; PAM sequence: GGG
ccgcagcccaaattctgaac

SEQ ID NO: 135764 - DNA, 20 bp, Artificial Sequence
  Description of Artificial Sequence: Synthetic oligonucleotide
  Target: ATXN1; (+) strand; PAM type: NRG; PAM sequence: GGG
cgcagcccaaattctgaacg

SEQ ID NO: 135765 - DNA, 20 bp, Artificial Sequence
  Description of Artificial Sequence: Synthetic oligonucleotide
  Target: ATXN1; (+) strand; PAM type: NRG; PAM sequence: AAG
gcccaaattctgaacgggga

SEQ ID NO: 135766 - DNA, 20 bp, Artificial Sequence
  Description of Artificial Sequence: Synthetic oligonucleotide
  Target: ATXN1; (+) strand; PAM type: NRG; PAM sequence: GAG
ccaaattctgaacggggaaa

SEQ ID NO: 135767 - DNA, 20 bp, Artificial Sequence
  Description of Artificial Sequence: Synthetic oligonucleotide
  Target: ATXN1; (+) strand; PAM type: NRG; PAM sequence: AGG
caaattctgaacggggaaag

SEQ ID NO: 135768 - DNA, 20 bp, Artificial Sequence
  Description of Artificial Sequence: Synthetic oligonucleotide
  Target: ATXN1; (+) strand; PAM type: NRG; PAM sequence: AAG
tctgaacggggaaagaggat

SEQ ID NO: 135769 - DNA, 20 bp, Artificial Sequence
  Description of Artificial Sequence: Synthetic oligonucleotide
  Target: ATXN1; (+) strand; PAM type: NRG; PAM sequence: AGG
ctgaacggggaaagaggata

SEQ ID NO: 135770 - DNA, 20 bp, Artificial Sequence
  Description of Artificial Sequence: Synthetic oligonucleotide
  Target: ATXN1; (+) strand; PAM type: NRG; PAM sequence: AAG
gtaacgtctcctacttttgc

SEQ ID NO: 135771 - DNA, 20 bp, Artificial Sequence
  Description of Artificial Sequence: Synthetic oligonucleotide
  Target: ATXN1; (+) strand; PAM type: NRG; PAM sequence: AAG
agcttcttttgcttcctatg

SEQ ID NO: 135772 - DNA, 20 bp, Artificial Sequence
  Description of Artificial Sequence: Synthetic oligonucleotide
  Target: ATXN1; (+) strand; PAM type: NRG; PAM sequence: AGG
gcttcttttgcttcctatga

SEQ ID NO: 135773 - DNA, 20 bp, Artificial Sequence
  Description of Artificial Sequence: Synthetic oligonucleotide
  Target: ATXN1; (+) strand; PAM type: NRG; PAM sequence: AAG
tcctatgaaggcttgccata

SEQ ID NO: 135774 - DNA, 20 bp, Artificial Sequence
  Description of Artificial Sequence: Synthetic oligonucleotide
  Target: ATXN1; (+) strand; PAM type: NRG; PAM sequence: TAG
atgaaggcttgccataaaga

SEQ ID NO: 135775 - DNA, 20 bp, Artificial Sequence
  Description of Artificial Sequence: Synthetic oligonucleotide
  Target: ATXN1; (+) strand; PAM type: NRG; PAM sequence: TGG
aatgctttgacatcacaaac

SEQ ID NO: 135776 - DNA, 20 bp, Artificial Sequence
  Description of Artificial Sequence: Synthetic oligonucleotide
  Target: ATXN1; (+) strand; PAM type: NRG; PAM sequence: GGG
atgctttgacatcacaaact

SEQ ID NO: 135777 - DNA, 20 bp, Artificial Sequence
  Description of Artificial Sequence: Synthetic oligonucleotide
  Target: ATXN1; (+) strand; PAM type: NRG; PAM sequence: TGG
ttcatgttccactgtgacca

SEQ ID NO: 135778 - DNA, 20 bp, Artificial Sequence
  Description of Artificial Sequence: Synthetic oligonucleotide
  Target: ATXN1; (+) strand; PAM type: NRG; PAM sequence: CAG
tgttccactgtgaccatgga

SEQ ID NO: 135779 - DNA, 20 bp, Artificial Sequence
  Description of Artificial Sequence: Synthetic oligonucleotide
  Target: ATXN1; (+) strand; PAM type: NRG; PAM sequence: AGG
gttccactgtgaccatggac

SEQ ID NO: 135780 - DNA, 20 bp, Artificial Sequence
  Description of Artificial Sequence: Synthetic oligonucleotide
  Target: ATXN1; (+) strand; PAM type: NRG; PAM sequence: GAG
catggacaggctatgtaact

SEQ ID NO: 135781 - DNA, 20 bp, Artificial Sequence
  Description of Artificial Sequence: Synthetic oligonucleotide
  Target: ATXN1; (+) strand; PAM type: NRG; PAM sequence: CGG
caggctatgtaactgagctt

SEQ ID NO: 135782 - DNA, 20 bp, Artificial Sequence
  Description of Artificial Sequence: Synthetic oligonucleotide
  Target: ATXN1; (+) strand; PAM type: NRG; PAM sequence: CAG
tcggctactcatttacaaaa

SEQ ID NO: 135783 - DNA, 20 bp, Artificial Sequence
  Description of Artificial Sequence: Synthetic oligonucleotide
  Target: ATXN1; (+) strand; PAM type: NRG; PAM sequence: AGG
cggctactcatttacaaaac

SEQ ID NO: 135784 - DNA, 20 bp, Artificial Sequence
  Description of Artificial Sequence: Synthetic oligonucleotide
  Target: ATXN1; (+) strand; PAM type: NRG; PAM sequence: GAG
taatgtaatataataattat

SEQ ID NO: 135785 - DNA, 20 bp, Artificial Sequence
  Description of Artificial Sequence: Synthetic oligonucleotide
  Target: ATXN1; (+) strand; PAM type: NRG; PAM sequence: AAG
aattatgagataatgatata

SEQ ID NO: 135786 - DNA, 20 bp, Artificial Sequence
  Description of Artificial Sequence: Synthetic oligonucleotide
  Target: ATXN1; (+) strand; PAM type: NRG; PAM sequence: TGG
agataatgatataaagtgat

SEQ ID NO: 135787 - DNA, 20 bp, Artificial Sequence
  Description of Artificial Sequence: Synthetic oligonucleotide
  Target: ATXN1; (+) strand; PAM type: NRG; PAM sequence: AAG
attggcccattgcaatgtta

SEQ ID NO: 135788 - DNA, 20 bp, Artificial Sequence
  Description of Artificial Sequence: Synthetic oligonucleotide
  Target: ATXN1; (+) strand; PAM type: NRG; PAM sequence: GAG
tggcccattgcaatgttaaa

SEQ ID NO: 135789 - DNA, 20 bp, Artificial Sequence
  Description of Artificial Sequence: Synthetic oligonucleotide
  Target: ATXN1; (+) strand; PAM type: NRG; PAM sequence: CAG
gcaatgttaaagagccctct

SEQ ID NO: 135790 - DNA, 20 bp, Artificial Sequence
  Description of Artificial Sequence: Synthetic oligonucleotide
  Target: ATXN1; (+) strand; PAM type: NRG; PAM sequence: AAG
atgttaaagagccctctcag

SEQ ID NO: 135791 - DNA, 20 bp, Artificial Sequence
  Description of Artificial Sequence: Synthetic oligonucleotide
  Target: ATXN1; (+) strand; PAM type: NRG; PAM sequence: AGG
tgttaaagagccctctcaga

SEQ ID NO: 135792 - DNA, 20 bp, Artificial Sequence
  Description of Artificial Sequence: Synthetic oligonucleotide
  Target: ATXN1; (+) strand; PAM type: NRG; PAM sequence: GAG
ttaaagagccctctcagaag

SEQ ID NO: 135793 - DNA, 20 bp, Artificial Sequence
  Description of Artificial Sequence: Synthetic oligonucleotide
  Target: ATXN1; (+) strand; PAM type: NRG; PAM sequence: AAG
gagcaccatactttctttct

SEQ ID NO: 135794 - DNA, 20 bp, Artificial Sequence
  Description of Artificial Sequence: Synthetic oligonucleotide
  Target: ATXN1; (+) strand; PAM type: NRG; PAM sequence: AAG
tctaagtgccgataaaataa

SEQ ID NO: 135795 - DNA, 20 bp, Artificial Sequence
  Description of Artificial Sequence: Synthetic oligonucleotide
  Target: ATXN1; (+) strand; PAM type: NRG; PAM sequence: AAG
gccgataaaataaaagataa

SEQ ID NO: 135796 - DNA, 20 bp, Artificial Sequence
  Description of Artificial Sequence: Synthetic oligonucleotide
  Target: ATXN1; (+) strand; PAM type: NRG; PAM sequence: CAG
gataaaataaaagataaaag

SEQ ID NO: 135797 - DNA, 20 bp, Artificial Sequence
  Description of Artificial Sequence: Synthetic oligonucleotide
  Target: ATXN1; (+) strand; PAM type: NRG; PAM sequence: TGG
aaaagataaaagcagccgac

SEQ ID NO: 135798 - DNA, 20 bp, Artificial Sequence
  Description of Artificial Sequence: Synthetic oligonucleotide
  Target: ATXN1; (+) strand; PAM type: NRG; PAM sequence: GGG
aaagataaaagcagccgact

SEQ ID NO: 135799 - DNA, 20 bp, Artificial Sequence
  Description of Artificial Sequence: Synthetic oligonucleotide
  Target: ATXN1; (+) strand; PAM type: NRG; PAM sequence: CAG
gcagccgactgggattgacc

SEQ ID NO: 135800 - DNA, 20 bp, Artificial Sequence
  Description of Artificial Sequence: Synthetic oligonucleotide
  Target: ATXN1; (+) strand; PAM type: NRG; PAM sequence: AAG
ttgacccagccacctctgct

SEQ ID NO: 135801 - DNA, 20 bp, Artificial Sequence
  Description of Artificial Sequence: Synthetic oligonucleotide
  Target: ATXN1; (+) strand; PAM type: NRG; PAM sequence: AGG
tgacccagccacctctgcta

SEQ ID NO: 135802 - DNA, 20 bp, Artificial Sequence
  Description of Artificial Sequence: Synthetic oligonucleotide
  Target: ATXN1; (+) strand; PAM type: NRG; PAM sequence: GGG
gacccagccacctctgctaa

SEQ ID NO: 135803 - DNA, 20 bp, Artificial Sequence
  Description of Artificial Sequence: Synthetic oligonucleotide
  Target: ATXN1; (+) strand; PAM type: NRG; PAM sequence: TAG
tctgctaagggcctcctacc

SEQ ID NO: 135804 - DNA, 20 bp, Artificial Sequence
  Description of Artificial Sequence: Synthetic oligonucleotide
  Target: ATXN1; (+) strand; PAM type: NRG; PAM sequence: GAG
tgctaagggcctcctaccta

SEQ ID NO: 135805 - DNA, 20 bp, Artificial Sequence
  Description of Artificial Sequence: Synthetic oligonucleotide
  Target: ATXN1; (+) strand; PAM type: NRG; PAM sequence: TGG
cctacctagagtcacctcac

SEQ ID NO: 135806 - DNA, 20 bp, Artificial Sequence
  Description of Artificial Sequence: Synthetic oligonucleotide
  Target: ATXN1; (+) strand; PAM type: NRG; PAM sequence: GGG
ctacctagagtcacctcact

SEQ ID NO: 135807 - DNA, 20 bp, Artificial Sequence
  Description of Artificial Sequence: Synthetic oligonucleotide
  Target: ATXN1; (+) strand; PAM type: NRG; PAM sequence: TGG
agagtcacctcactgggacc

SEQ ID NO: 135808 - DNA, 20 bp, Artificial Sequence
  Description of Artificial Sequence: Synthetic oligonucleotide
  Target: ATXN1; (+) strand; PAM type: NRG; PAM sequence: GGG
gagtcacctcactgggacct

SEQ ID NO: 135809 - DNA, 20 bp, Artificial Sequence
  Description of Artificial Sequence: Synthetic oligonucleotide
  Target: ATXN1; (+) strand; PAM type: NRG; PAM sequence: CAG
cacctcactgggacctggga

SEQ ID NO: 135810 - DNA, 20 bp, Artificial Sequence
  Description of Artificial Sequence: Synthetic oligonucleotide
  Target: ATXN1; (+) strand; PAM type: NRG; PAM sequence: CAG
tgggacagcatgattcttac

SEQ ID NO: 135811 - DNA, 20 bp, Artificial Sequence
  Description of Artificial Sequence: Synthetic oligonucleotide
  Target: ATXN1; (+) strand; PAM type: NRG; PAM sequence: GAG
catgattcttaccagtttct

SEQ ID NO: 135812 - DNA, 20 bp, Artificial Sequence
  Description of Artificial Sequence: Synthetic oligonucleotide
  Target: ATXN1; (+) strand; PAM type: NRG; PAM sequence: GAG
tgattcttaccagtttctga

SEQ ID NO: 135813 - DNA, 20 bp, Artificial Sequence
  Description of Artificial Sequence: Synthetic oligonucleotide
  Target: ATXN1; (+) strand; PAM type: NRG; PAM sequence: GAG
ttaccagtttctgagagctt

SEQ ID NO: 135814 - DNA, 20 bp, Artificial Sequence
  Description of Artificial Sequence: Synthetic oligonucleotide
  Target: ATXN1; (+) strand; PAM type: NRG; PAM sequence: AGG
taccagtttctgagagcttg

SEQ ID NO: 135815 - DNA, 20 bp, Artificial Sequence
  Description of Artificial Sequence: Synthetic oligonucleotide
  Target: ATXN1; (+) strand; PAM type: NRG; PAM sequence: TGG
tttctgagagcttgaggtct

SEQ ID NO: 135816 - DNA, 20 bp, Artificial Sequence
  Description of Artificial Sequence: Synthetic oligonucleotide
  Target: ATXN1; (+) strand; PAM type: NRG; PAM sequence: GGG
ttctgagagcttgaggtctt

SEQ ID NO: 135817 - DNA, 20 bp, Artificial Sequence
  Description of Artificial Sequence: Synthetic oligonucleotide
  Target: ATXN1; (+) strand; PAM type: NRG; PAM sequence: GAG
gcttgaggtcttgggccctc

SEQ ID NO: 135818 - DNA, 20 bp, Artificial Sequence
  Description of Artificial Sequence: Synthetic oligonucleotide
  Target: ATXN1; (+) strand; PAM type: NRG; PAM sequence: CAG
gaggtcttgggccctcgagc

SEQ ID NO: 135819 - DNA, 20 bp, Artificial Sequence
  Description of Artificial Sequence: Synthetic oligonucleotide
  Target: ATXN1; (+) strand; PAM type: NRG; PAM sequence: AGG
aggtcttgggccctcgagcc

SEQ ID NO: 135820 - DNA, 20 bp, Artificial Sequence
  Description of Artificial Sequence: Synthetic oligonucleotide
  Target: ATXN1; (+) strand; PAM type: NRG; PAM sequence: AAG
ctcgagccaggcgtccgcta

SEQ ID NO: 135821 - DNA, 20 bp, Artificial Sequence
  Description of Artificial Sequence: Synthetic oligonucleotide
  Target: ATXN1; (+) strand; PAM type: NRG; PAM sequence: AGG
tcgagccaggcgtccgctaa

SEQ ID NO: 135822 - DNA, 20 bp, Artificial Sequence
  Description of Artificial Sequence: Synthetic oligonucleotide
  Target: ATXN1; (+) strand; PAM type: NRG; PAM sequence: CAG
agccaggcgtccgctaaagg

SEQ ID NO: 135823 - DNA, 20 bp, Artificial Sequence
  Description of Artificial Sequence: Synthetic oligonucleotide
  Target: ATXN1; (+) strand; PAM type: NRG; PAM sequence: AGG
gccaggcgtccgctaaaggc

SEQ ID NO: 135824 - DNA, 20 bp, Artificial Sequence
  Description of Artificial Sequence: Synthetic oligonucleotide
  Target: ATXN1; (+) strand; PAM type: NRG; PAM sequence: GAG
cgtccgctaaaggcaggtct

SEQ ID NO: 135825 - DNA, 20 bp, Artificial Sequence
  Description of Artificial Sequence: Synthetic oligonucleotide
  Target: ATXN1; (+) strand; PAM type: NRG; PAM sequence: AGG
gtccgctaaaggcaggtctg

SEQ ID NO: 135826 - DNA, 20 bp, Artificial Sequence
  Description of Artificial Sequence: Synthetic oligonucleotide
  Target: ATXN1; (+) strand; PAM type: NRG; PAM sequence: TAG
gctaaaggcaggtctgaggt

SEQ ID NO: 135827 - DNA, 20 bp, Artificial Sequence
  Description of Artificial Sequence: Synthetic oligonucleotide
  Target: ATXN1; (+) strand; PAM type: NRG; PAM sequence: CAG
tctgaggttagcccatttcc

SEQ ID NO: 135828 - DNA, 20 bp, Artificial Sequence
  Description of Artificial Sequence: Synthetic oligonucleotide
  Target: ATXN1; (+) strand; PAM type: NRG; PAM sequence: TGG
gttaccattctcctttcccc

SEQ ID NO: 135829 - DNA, 20 bp, Artificial Sequence
  Description of Artificial Sequence: Synthetic oligonucleotide
  Target: ATXN1; (+) strand; PAM type: NRG; PAM sequence: AAG
cccctggcttttctccttcc

SEQ ID NO: 135830 - DNA, 20 bp, Artificial Sequence
  Description of Artificial Sequence: Synthetic oligonucleotide
  Target: ATXN1; (+) strand; PAM type: NRG; PAM sequence: GAG
cctggcttttctccttccaa

SEQ ID NO: 135831 - DNA, 20 bp, Artificial Sequence
  Description of Artificial Sequence: Synthetic oligonucleotide
  Target: ATXN1; (+) strand; PAM type: NRG; PAM sequence: AGG
ctggcttttctccttccaag

SEQ ID NO: 135832 - DNA, 20 bp, Artificial Sequence
  Description of Artificial Sequence: Synthetic oligonucleotide
  Target: ATXN1; (+) strand; PAM type: NRG; PAM sequence: AAG
ttctccttccaagaggcttt

SEQ ID NO: 135833 - DNA, 20 bp, Artificial Sequence
  Description of Artificial Sequence: Synthetic oligonucleotide
  Target: ATXN1; (+) strand; PAM type: NRG; PAM sequence: TGG
actcctccctcctctccttc

SEQ ID NO: 135834 - DNA, 20 bp, Artificial Sequence
  Description of Artificial Sequence: Synthetic oligonucleotide
  Target: ATXN1; (+) strand; PAM type: NRG; PAM sequence: CAG
gtcccctgcctcaactcacc

SEQ ID NO: 135835 - DNA, 20 bp, Artificial Sequence
  Description of Artificial Sequence: Synthetic oligonucleotide
  Target: ATXN1; (+) strand; PAM type: NRG; PAM sequence: GAG
cccctgcctcaactcaccca

SEQ ID NO: 135836 - DNA, 20 bp, Artificial Sequence
  Description of Artificial Sequence: Synthetic oligonucleotide
  Target: ATXN1; (+) strand; PAM type: NRG; PAM sequence: GAG
cctcaactcacccagagact

SEQ ID NO: 135837 - DNA, 20 bp, Artificial Sequence
  Description of Artificial Sequence: Synthetic oligonucleotide
  Target: ATXN1; (+) strand; PAM type: NRG; PAM sequence: CAG
tcacccagagactgagaatg

SEQ ID NO: 135838 - DNA, 20 bp, Artificial Sequence
  Description of Artificial Sequence: Synthetic oligonucleotide
  Target: ATXN1; (+) strand; PAM type: NRG; PAM sequence: TGG
aatgcagtaccattcctcac

SEQ ID NO: 135839 - DNA, 20 bp, Artificial Sequence
  Description of Artificial Sequence: Synthetic oligonucleotide
  Target: ATXN1; (+) strand; PAM type: NRG; PAM sequence: GGG
atgcagtaccattcctcact

SEQ ID NO: 135840 - DNA, 20 bp, Artificial Sequence
  Description of Artificial Sequence: Synthetic oligonucleotide
  Target: ATXN1; (+) strand; PAM type: NRG; PAM sequence: CAG
actgggccaccttccctttc

SEQ ID NO: 135841 - DNA, 20 bp, Artificial Sequence
  Description of Artificial Sequence: Synthetic oligonucleotide
  Target: ATXN1; (+) strand; PAM type: NRG; PAM sequence: AGG
ctgggccaccttccctttcc

SEQ ID NO: 135842 - DNA, 20 bp, Artificial Sequence
  Description of Artificial Sequence: Synthetic oligonucleotide
  Target: ATXN1; (+) strand; PAM type: NRG; PAM sequence: AAG
ccatactccattctgtaata

SEQ ID NO: 135843 - DNA, 20 bp, Artificial Sequence
  Description of Artificial Sequence: Synthetic oligonucleotide
  Target: ATXN1; (+) strand; PAM type: NRG; PAM sequence: TGG
attctgtaataaagttctca

SEQ ID NO: 135844 - DNA, 20 bp, Artificial Sequence
  Description of Artificial Sequence: Synthetic oligonucleotide
  Target: ATXN1; (+) strand; PAM type: NRG; PAM sequence: GGG
ttctgtaataaagttctcat

SEQ ID NO: 135845 - DNA, 20 bp, Artificial Sequence
  Description of Artificial Sequence: Synthetic oligonucleotide
  Target: ATXN1; (+) strand; PAM type: NRG; PAM sequence: GGG
tctgtaataaagttctcatg

SEQ ID NO: 135846 - DNA, 20 bp, Artificial Sequence
  Description of Artificial Sequence: Synthetic oligonucleotide
  Target: ATXN1; (+) strand; PAM type: NRG; PAM sequence: GAG
tgtaataaagttctcatggg

SEQ ID NO: 135847 - DNA, 20 bp, Artificial Sequence
  Description of Artificial Sequence: Synthetic oligonucleotide
  Target: ATXN1; (+) strand; PAM type: NRG; PAM sequence: CAG
tctcatggggagacctccaa

SEQ ID NO: 135848 - DNA, 20 bp, Artificial Sequence
  Description of Artificial Sequence: Synthetic oligonucleotide
  Target: ATXN1; (+) strand; PAM type: NRG; PAM sequence: CAG
ggagacctccaacagcccaa

SEQ ID NO: 135849 - DNA, 20 bp, Artificial Sequence
  Description of Artificial Sequence: Synthetic oligonucleotide
  Target: ATXN1; (+) strand; PAM type: NRG; PAM sequence: GAG
cctccaacagcccaacagtt

SEQ ID NO: 135850 - DNA, 20 bp, Artificial Sequence
  Description of Artificial Sequence: Synthetic oligonucleotide
  Target: ATXN1; (+) strand; PAM type: NRG; PAM sequence: CAG
gcccaacagttgagtgtaca

SEQ ID NO: 135851 - DNA, 20 bp, Artificial Sequence
  Description of Artificial Sequence: Synthetic oligonucleotide
  Target: ATXN1; (+) strand; PAM type: NRG; PAM sequence: GAG
agttgagtgtacacagcctt

SEQ ID NO: 135852 - DNA, 20 bp, Artificial Sequence
  Description of Artificial Sequence: Synthetic oligonucleotide
  Target: ATXN1; (+) strand; PAM type: NRG; PAM sequence: TAG
tgtacacagccttgagtgct

SEQ ID NO: 135853 - DNA, 20 bp, Artificial Sequence
  Description of Artificial Sequence: Synthetic oligonucleotide
  Target: ATXN1; (+) strand; PAM type: NRG; PAM sequence: CGG
acacagccttgagtgcttag

SEQ ID NO: 135854 - DNA, 20 bp, Artificial Sequence
  Description of Artificial Sequence: Synthetic oligonucleotide
  Target: ATXN1; (+) strand; PAM type: NRG; PAM sequence: CAG
agccttgagtgcttagcggc

SEQ ID NO: 135855 - DNA, 20 bp, Artificial Sequence
  Description of Artificial Sequence: Synthetic oligonucleotide
  Target: ATXN1; (+) strand; PAM type: NRG; PAM sequence: CAG
ccagaacctcattgaaaaca

SEQ ID NO: 135856 - DNA, 20 bp, Artificial Sequence
  Description of Artificial Sequence: Synthetic oligonucleotide
  Target: ATXN1; (+) strand; PAM type: NRG; PAM sequence: AAG
cattgaaaacacagttccat

SEQ ID NO: 135857 - DNA, 20 bp, Artificial Sequence
  Description of Artificial Sequence: Synthetic oligonucleotide
  Target: ATXN1; (+) strand; PAM type: NRG; PAM sequence: AGG
attgaaaacacagttccata

SEQ ID NO: 135858 - DNA, 20 bp, Artificial Sequence
  Description of Artificial Sequence: Synthetic oligonucleotide
  Target: ATXN1; (+) strand; PAM type: NRG; PAM sequence: AAG
aaaacacagttccataagga

SEQ ID NO: 135859 - DNA, 20 bp, Artificial Sequence
  Description of Artificial Sequence: Synthetic oligonucleotide
  Target: ATXN1; (+) strand; PAM type: NRG; PAM sequence: AGG
aaacacagttccataaggaa

SEQ ID NO: 135860 - DNA, 20 bp, Artificial Sequence
  Description of Artificial Sequence: Synthetic oligonucleotide
  Target: ATXN1; (+) strand; PAM type: NRG; PAM sequence: CAG
cacagttccataaggaaagg

SEQ ID NO: 135861 - DNA, 20 bp, Artificial Sequence
  Description of Artificial Sequence: Synthetic oligonucleotide
  Target: ATXN1; (+) strand; PAM type: NRG; PAM sequence: AGG
acagttccataaggaaaggc

SEQ ID NO: 135862 - DNA, 20 bp, Artificial Sequence
  Description of Artificial Sequence: Synthetic oligonucleotide
  Target: ATXN1; (+) strand; PAM type: NRG; PAM sequence: AAG
cataaggaaaggcaggtttt

SEQ ID NO: 135863 - DNA, 20 bp, Artificial Sequence
  Description of Artificial Sequence: Synthetic oligonucleotide
  Target: ATXN1; (+) strand; PAM type: NRG; PAM sequence: GAG
ggaaaggcaggttttaagac

SEQ ID NO: 135864 - DNA, 20 bp, Artificial Sequence
  Description of Artificial Sequence: Synthetic oligonucleotide
  Target: ATXN1; (+) strand; PAM type: NRG; PAM sequence: CAG
aaggcaggttttaagacgag

SEQ ID NO: 135865 - DNA, 20 bp, Artificial Sequence
  Description of Artificial Sequence: Synthetic oligonucleotide
  Target: ATXN1; (+) strand; PAM type: NRG; PAM sequence: AGG
aggcaggttttaagacgagc

SEQ ID NO: 135866 - DNA, 20 bp, Artificial Sequence
  Description of Artificial Sequence: Synthetic oligonucleotide
  Target: ATXN1; (+) strand; PAM type: NRG; PAM sequence: CAG
ttttaagacgagcaggtgac

SEQ ID NO: 135867 - DNA, 20 bp, Artificial Sequence
  Description of Artificial Sequence: Synthetic oligonucleotide
  Target: ATXN1; (+) strand; PAM type: NRG; PAM sequence: AGG
tttaagacgagcaggtgacc

SEQ ID NO: 135868 - DNA, 20 bp, Artificial Sequence
  Description of Artificial Sequence: Synthetic oligonucleotide
  Target: ATXN1; (+) strand; PAM type: NRG; PAM sequence: CAG
aagacgagcaggtgaccagg

SEQ ID NO: 135869 - DNA, 20 bp, Artificial Sequence
  Description of Artificial Sequence: Synthetic oligonucleotide
  Target: ATXN1; (+) strand; PAM type: NRG; PAM sequence: AGG
agacgagcaggtgaccaggc

SEQ ID NO: 135870 - DNA, 20 bp, Artificial Sequence
  Description of Artificial Sequence: Synthetic oligonucleotide
  Target: ATXN1; (+) strand; PAM type: NRG; PAM sequence: TGG
aggcaggcccccaccataaa

SEQ ID NO: 135871 - DNA, 20 bp, Artificial Sequence
  Description of Artificial Sequence: Synthetic oligonucleotide
  Target: ATXN1; (+) strand; PAM type: NRG; PAM sequence: GGG
ggcaggcccccaccataaat

SEQ ID NO: 135872 - DNA, 20 bp, Artificial Sequence
  Description of Artificial Sequence: Synthetic oligonucleotide
  Target: ATXN1; (+) strand; PAM type: NRG; PAM sequence: GGG
gcaggcccccaccataaatg

SEQ ID NO: 135873 - DNA, 20 bp, Artificial Sequence
  Description of Artificial Sequence: Synthetic oligonucleotide
  Target: ATXN1; (+) strand; PAM type: NRG; PAM sequence: GAG
gcccccaccataaatggggt

SEQ ID NO: 135874 - DNA, 20 bp, Artificial Sequence
  Description of Artificial Sequence: Synthetic oligonucleotide
  Target: ATXN1; (+) strand; PAM type: NRG; PAM sequence: AAG
aaatggggtgagctcgccaa

SEQ ID NO: 135875 - DNA, 20 bp, Artificial Sequence
  Description of Artificial Sequence: Synthetic oligonucleotide
  Target: ATXN1; (+) strand; PAM type: NRG; PAM sequence: TAG
ggggtgagctcgccaaaagc

SEQ ID NO: 135876 - DNA, 20 bp, Artificial Sequence
  Description of Artificial Sequence: Synthetic oligonucleotide
  Target: ATXN1; (+) strand; PAM type: NRG; PAM sequence: AGG
gggtgagctcgccaaaagct

SEQ ID NO: 135877 - DNA, 20 bp, Artificial Sequence
  Description of Artificial Sequence: Synthetic oligonucleotide
  Target: ATXN1; (+) strand; PAM type: NRG; PAM sequence: TAG
gccaaaagctaggcttgact

SEQ ID NO: 135878 - DNA, 20 bp, Artificial Sequence
  Description of Artificial Sequence: Synthetic oligonucleotide
  Target: ATXN1; (+) strand; PAM type: NRG; PAM sequence: AGG
ccaaaagctaggcttgactt

SEQ ID NO: 135879 - DNA, 20 bp, Artificial Sequence
  Description of Artificial Sequence: Synthetic oligonucleotide
  Target: ATXN1; (+) strand; PAM type: NRG; PAM sequence: TGG
ggcttgacttaggcctcatt

SEQ ID NO: 135880 - DNA, 20 bp, Artificial Sequence
  Description of Artificial Sequence: Synthetic oligonucleotide
  Target: ATXN1; (+) strand; PAM type: NRG; PAM sequence: GAG
cttgacttaggcctcatttg

SEQ ID NO: 135881 - DNA, 20 bp, Artificial Sequence
  Description of Artificial Sequence: Synthetic oligonucleotide
  Target: ATXN1; (+) strand; PAM type: NRG; PAM sequence: AGG
ttgacttaggcctcatttgg

SEQ ID NO: 135882 - DNA, 20 bp, Artificial Sequence
  Description of Artificial Sequence: Synthetic oligonucleotide
  Target: ATXN1; (+) strand; PAM type: NRG; PAM sequence: GAG
taggcctcatttggaggtct

SEQ ID NO: 135883 - DNA, 20 bp, Artificial Sequence
  Description of Artificial Sequence: Synthetic oligonucleotide
  Target: ATXN1; (+) strand; PAM type: NRG; PAM sequence: TGG
aaaatcaaatacaaaaacac

SEQ ID NO: 135884 - DNA, 20 bp, Artificial Sequence
  Description of Artificial Sequence: Synthetic oligonucleotide
  Target: ATXN1; (+) strand; PAM type: NRG; PAM sequence: CAG
atcaaatacaaaaacactgg

SEQ ID NO: 135885 - DNA, 20 bp, Artificial Sequence
  Description of Artificial Sequence: Synthetic oligonucleotide
  Target: ATXN1; (+) strand; PAM type: NRG; PAM sequence: AAG
aaatacaaaaacactggcag

SEQ ID NO: 135886 - DNA, 20 bp, Artificial Sequence
  Description of Artificial Sequence: Synthetic oligonucleotide
  Target: ATXN1; (+) strand; PAM type: NRG; PAM sequence: TAG
caaaaacactggcagaagtt

SEQ ID NO: 135887 - DNA, 20 bp, Artificial Sequence
  Description of Artificial Sequence: Synthetic oligonucleotide
  Target: ATXN1; (+) strand; PAM type: NRG; PAM sequence: GAG
aaaacactggcagaagttta

SEQ ID NO: 135888 - DNA, 20 bp, Artificial Sequence
  Description of Artificial Sequence: Synthetic oligonucleotide
  Target: ATXN1; (+) strand; PAM type: NRG; PAM sequence: GAG
aacactggcagaagtttaga

SEQ ID NO: 135889 - DNA, 20 bp, Artificial Sequence
  Description of Artificial Sequence: Synthetic oligonucleotide
  Target: ATXN1; (+) strand; PAM type: NRG; PAM sequence: AGG
acactggcagaagtttagag

SEQ ID NO: 135890 - DNA, 20 bp, Artificial Sequence
  Description of Artificial Sequence: Synthetic oligonucleotide
  Target: ATXN1; (+) strand; PAM type: NRG; PAM sequence: CAG
ctggcagaagtttagagagg

SEQ ID NO: 135891 - DNA, 20 bp, Artificial Sequence
  Description of Artificial Sequence: Synthetic oligonucleotide
  Target: ATXN1; (+) strand; PAM type: NRG; PAM sequence: AAG
agaagtttagagaggcagaa

SEQ ID NO: 135892 - DNA, 20 bp, Artificial Sequence
  Description of Artificial Sequence: Synthetic oligonucleotide
  Target: ATXN1; (+) strand; PAM type: NRG; PAM sequence: GAG
aagtttagagaggcagaaaa

SEQ ID NO: 135893 - DNA, 20 bp, Artificial Sequence
  Description of Artificial Sequence: Synthetic oligonucleotide
  Target: ATXN1; (+) strand; PAM type: NRG; PAM sequence: AAG
gcagaaaagagcattaccac

SEQ ID NO: 135894 - DNA, 20 bp, Artificial Sequence
  Description of Artificial Sequence: Synthetic oligonucleotide
  Target: ATXN1; (+) strand; PAM type: NRG; PAM sequence: AAG
aaagagcattaccacaagaa

SEQ ID NO: 135895 - DNA, 20 bp, Artificial Sequence
  Description of Artificial Sequence: Synthetic oligonucleotide
  Target: ATXN1; (+) strand; PAM type: NRG; PAM sequence: CGG
cattaccacaagaaaagacg

SEQ ID NO: 135896 - DNA, 20 bp, Artificial Sequence
  Description of Artificial Sequence: Synthetic oligonucleotide
  Target: ATXN1; (+) strand; PAM type: NRG; PAM sequence: GGG
attaccacaagaaaagacgc

SEQ ID NO: 135897 - DNA, 20 bp, Artificial Sequence
  Description of Artificial Sequence: Synthetic oligonucleotide
  Target: ATXN1; (+) strand; PAM type: NRG; PAM sequence: GAG
taccacaagaaaagacgcgg

SEQ ID NO: 135898 - DNA, 20 bp, Artificial Sequence
  Description of Artificial Sequence: Synthetic oligonucleotide
  Target: ATXN1; (+) strand; PAM type: NRG; PAM sequence: AGG
accacaagaaaagacgcggg

SEQ ID NO: 135899 - DNA, 20 bp, Artificial Sequence
  Description of Artificial Sequence: Synthetic oligonucleotide
  Target: ATXN1; (+) strand; PAM type: NRG; PAM sequence: CAG
aaagacgcgggaggcttcac

SEQ ID NO: 135900 - DNA, 20 bp, Artificial Sequence
  Description of Artificial Sequence: Synthetic oligonucleotide
  Target: ATXN1; (+) strand; PAM type: NRG; PAM sequence: CAG
cgcgggaggcttcaccagaa

SEQ ID NO: 135901 - DNA, 20 bp, Artificial Sequence
  Description of Artificial Sequence: Synthetic oligonucleotide
  Target: ATXN1; (+) strand; PAM type: NRG; PAM sequence: AGG
gcgggaggcttcaccagaac

SEQ ID NO: 135902 - DNA, 20 bp, Artificial Sequence
  Description of Artificial Sequence: Synthetic oligonucleotide
  Target: ATXN1; (+) strand; PAM type: NRG; PAM sequence: CAG
ggaggcttcaccagaacagg

SEQ ID NO: 135903 - DNA, 20 bp, Artificial Sequence
  Description of Artificial Sequence: Synthetic oligonucleotide
  Target: ATXN1; (+) strand; PAM type: NRG; PAM sequence: AGG
gaggcttcaccagaacaggc

SEQ ID NO: 135904 - DNA, 20 bp, Artificial Sequence
  Description of Artificial Sequence: Synthetic oligonucleotide
  Target: ATXN1; (+) strand; PAM type: NRG; PAM sequence: GAG
ggcttcaccagaacaggcag

SEQ ID NO: 135905 - DNA, 20 bp, Artificial Sequence
  Description of Artificial Sequence: Synthetic oligonucleotide
  Target: ATXN1; (+) strand; PAM type: NRG; PAM sequence: AGG
gcttcaccagaacaggcagg

SEQ ID NO: 135906 - DNA, 20 bp, Artificial Sequence
  Description of Artificial Sequence: Synthetic oligonucleotide
  Target: ATXN1; (+) strand; PAM type: NRG; PAM sequence: AAG
tcaccagaacaggcaggagg

SEQ ID NO: 135907 - DNA, 20 bp, Artificial Sequence
  Description of Artificial Sequence: Synthetic oligonucleotide
  Target: ATXN1; (+) strand; PAM type: NRG; PAM sequence: TAG
ccagaacaggcaggaggaag

SEQ ID NO: 135908 - DNA, 20 bp, Artificial Sequence
  Description of Artificial Sequence: Synthetic oligonucleotide
  Target: ATXN1; (+) strand; PAM type: NRG; PAM sequence: AGG
cagaacaggcaggaggaagt

SEQ ID NO: 135909 - DNA, 20 bp, Artificial Sequence
  Description of Artificial Sequence: Synthetic oligonucleotide
  Target: ATXN1; (+) strand; PAM type: NRG; PAM sequence: GAG
acaggcaggaggaagtaggt

SEQ ID NO: 135910 - DNA, 20 bp, Artificial Sequence
  Description of Artificial Sequence: Synthetic oligonucleotide
  Target: ATXN1; (+) strand; PAM type: NRG; PAM sequence: AGG
caggcaggaggaagtaggtg

SEQ ID NO: 135911 - DNA, 20 bp, Artificial Sequence
  Description of Artificial Sequence: Synthetic oligonucleotide
  Target: ATXN1; (+) strand; PAM type: NRG; PAM sequence: CAG
aggaggaagtaggtgaggca

SEQ ID NO: 135912 - DNA, 20 bp, Artificial Sequence
  Description of Artificial Sequence: Synthetic oligonucleotide
  Target: ATXN1; (+) strand; PAM type: NRG; PAM sequence: CAG
aggaagtaggtgaggcacag

SEQ ID NO: 135913 - DNA, 20 bp, Artificial Sequence
  Description of Artificial Sequence: Synthetic oligonucleotide
  Target: ATXN1; (+) strand; PAM type: NRG; PAM sequence: AGG
ggaagtaggtgaggcacagc

SEQ ID NO: 135914 - DNA, 20 bp, Artificial Sequence
  Description of Artificial Sequence: Synthetic oligonucleotide
  Target: ATXN1; (+) strand; PAM type: NRG; PAM sequence: AAG
taggtgaggcacagcaggtg

SEQ ID NO: 135915 - DNA, 20 bp, Artificial Sequence
  Description of Artificial Sequence: Synthetic oligonucleotide
  Target: ATXN1; (+) strand; PAM type: NRG; PAM sequence: TGG
gtgaggcacagcaggtgaag

SEQ ID NO: 135916 - DNA, 20 bp, Artificial Sequence
  Description of Artificial Sequence: Synthetic oligonucleotide
  Target: ATXN1; (+) strand; PAM type: NRG; PAM sequence: GGG
tgaggcacagcaggtgaagt

SEQ ID NO: 135917 - DNA, 20 bp, Artificial Sequence
  Description of Artificial Sequence: Synthetic oligonucleotide
  Target: ATXN1; (+) strand; PAM type: NRG; PAM sequence: GGG
gaggcacagcaggtgaagtg

SEQ ID NO: 135918 - DNA, 20 bp, Artificial Sequence
  Description of Artificial Sequence: Synthetic oligonucleotide
  Target: ATXN1; (+) strand; PAM type: NRG; PAM sequence: GGG
aggcacagcaggtgaagtgg

SEQ ID NO: 135919 - DNA, 20 bp, Artificial Sequence
  Description of Artificial Sequence: Synthetic oligonucleotide
  Target: ATXN1; (+) strand; PAM type: NRG; PAM sequence: AAG
cacagcaggtgaagtggggg

SEQ ID NO: 135920 - DNA, 20 bp, Artificial Sequence
  Description of Artificial Sequence: Synthetic oligonucleotide
  Target: ATXN1; (+) strand; PAM type: NRG; PAM sequence: CAG
aagtgggggaagtgttccac

SEQ ID NO: 135921 - DNA, 20 bp, Artificial Sequence
  Description of Artificial Sequence: Synthetic oligonucleotide
  Target: ATXN1; (+) strand; PAM type: NRG; PAM sequence: AGG
agtgggggaagtgttccacc

SEQ ID NO: 135922 - DNA, 20 bp, Artificial Sequence
  Description of Artificial Sequence: Synthetic oligonucleotide
  Target: ATXN1; (+) strand; PAM type: NRG; PAM sequence: TGG
agtgttccaccaggtgaaac

SEQ ID NO: 135923 - DNA, 20 bp, Artificial Sequence
  Description of Artificial Sequence: Synthetic oligonucleotide
  Target: ATXN1; (+) strand; PAM type: NRG; PAM sequence: TGG
tccaccaggtgaaactggcc

SEQ ID NO: 135924 - DNA, 20 bp, Artificial Sequence
  Description of Artificial Sequence: Synthetic oligonucleotide
  Target: ATXN1; (+) strand; PAM type: NRG; PAM sequence: TGG
accaggtgaaactggcctgg

SEQ ID NO: 135925 - DNA, 20 bp, Artificial Sequence
  Description of Artificial Sequence: Synthetic oligonucleotide
  Target: ATXN1; (+) strand; PAM type: NRG; PAM sequence: TGG
tgaaactggcctggtggctg

SEQ ID NO: 135926 - DNA, 20 bp, Artificial Sequence
  Description of Artificial Sequence: Synthetic oligonucleotide
  Target: ATXN1; (+) strand; PAM type: NRG; PAM sequence: GGG
gaaactggcctggtggctgt

SEQ ID NO: 135927 - DNA, 20 bp, Artificial Sequence
  Description of Artificial Sequence: Synthetic oligonucleotide
  Target: ATXN1; (+) strand; PAM type: NRG; PAM sequence: GGG
aaactggcctggtggctgtg

SEQ ID NO: 135928 - DNA, 20 bp, Artificial Sequence
  Description of Artificial Sequence: Synthetic oligonucleotide
  Target: ATXN1; (+) strand; PAM type: NRG; PAM sequence: CAG
ggcctggtggctgtggggta

SEQ ID NO: 135929 - DNA, 20 bp, Artificial Sequence
  Description of Artificial Sequence: Synthetic oligonucleotide
  Target: ATXN1; (+) strand; PAM type: NRG; PAM sequence: AGG
gcctggtggctgtggggtac

SEQ ID NO: 135930 - DNA, 20 bp, Artificial Sequence
  Description of Artificial Sequence: Synthetic oligonucleotide
  Target: ATXN1; (+) strand; PAM type: NRG; PAM sequence: GGG
cctggtggctgtggggtaca

SEQ ID NO: 135931 - DNA, 20 bp, Artificial Sequence
  Description of Artificial Sequence: Synthetic oligonucleotide
  Target: ATXN1; (+) strand; PAM type: NRG; PAM sequence: GGG
ctggtggctgtggggtacag

SEQ ID NO: 135932 - DNA, 20 bp, Artificial Sequence
  Description of Artificial Sequence: Synthetic oligonucleotide
  Target: ATXN1; (+) strand; PAM type: NRG; PAM sequence: AAG
gtggctgtggggtacagggg

SEQ ID NO: 135933 - DNA, 20 bp, Artificial Sequence
  Description of Artificial Sequence: Synthetic oligonucleotide
  Target: ATXN1; (+) strand; PAM type: NRG; PAM sequence: GAG
ggctgtggggtacaggggaa

SEQ ID NO: 135934 - DNA, 20 bp, Artificial Sequence
  Description of Artificial Sequence: Synthetic oligonucleotide
  Target: ATXN1; (+) strand; PAM type: NRG; PAM sequence: AGG
gctgtggggtacaggggaag

SEQ ID NO: 135935 - DNA, 20 bp, Artificial Sequence
  Description of Artificial Sequence: Synthetic oligonucleotide
  Target: ATXN1; (+) strand; PAM type: NRG; PAM sequence: GAG
tggggtacaggggaagaggt

SEQ ID NO: 135936 - DNA, 20 bp, Artificial Sequence
  Description of Artificial Sequence: Synthetic oligonucleotide
  Target: ATXN1; (+) strand; PAM type: NRG; PAM sequence: CAG
ggtacaggggaagaggtgag

SEQ ID NO: 135937 - DNA, 20 bp, Artificial Sequence
  Description of Artificial Sequence: Synthetic oligonucleotide
  Target: ATXN1; (+) strand; PAM type: NRG; PAM sequence: AGG
gtacaggggaagaggtgagc

SEQ ID NO: 135938 - DNA, 20 bp, Artificial Sequence
  Description of Artificial Sequence: Synthetic oligonucleotide
  Target: ATXN1; (+) strand; PAM type: NRG; PAM sequence: TGG
aggggaagaggtgagcaggc

SEQ ID NO: 135939 - DNA, 20 bp, Artificial Sequence
  Description of Artificial Sequence: Synthetic oligonucleotide
  Target: ATXN1; (+) strand; PAM type: NRG; PAM sequence: GGG
ggggaagaggtgagcaggct

SEQ ID NO: 135940 - DNA, 20 bp, Artificial Sequence
  Description of Artificial Sequence: Synthetic oligonucleotide
  Target: ATXN1; (+) strand; PAM type: NRG; PAM sequence: GGG
gggaagaggtgagcaggctg

SEQ ID NO: 135941 - DNA, 20 bp, Artificial Sequence
  Description of Artificial Sequence: Synthetic oligonucleotide
  Target: ATXN1; (+) strand; PAM type: NRG; PAM sequence: TGG
aagaggtgagcaggctgggg

SEQ ID NO: 135942 - DNA, 20 bp, Artificial Sequence
  Description of Artificial Sequence: Synthetic oligonucleotide
  Target: ATXN1; (+) strand; PAM type: NRG; PAM sequence: GGG
agaggtgagcaggctggggt

SEQ ID NO: 135943 - DNA, 20 bp, Artificial Sequence
  Description of Artificial Sequence: Synthetic oligonucleotide
  Target: ATXN1; (+) strand; PAM type: NRG; PAM sequence: GGG
gaggtgagcaggctggggtg

SEQ ID NO: 135944 - DNA, 20 bp, Artificial Sequence
  Description of Artificial Sequence: Synthetic oligonucleotide
  Target: ATXN1; (+) strand; PAM type: NRG; PAM sequence: GAG
gagcaggctggggtggggat

SEQ ID NO: 135945 - DNA, 20 bp, Artificial Sequence
  Description of Artificial Sequence: Synthetic oligonucleotide
  Target: ATXN1; (+) strand; PAM type: NRG; PAM sequence: AGG
agcaggctggggtggggatg

SEQ ID NO: 135946 - DNA, 20 bp, Artificial Sequence
  Description of Artificial Sequence: Synthetic oligonucleotide
  Target: ATXN1; (+) strand; PAM type: NRG; PAM sequence: CAG
ggctggggtggggatgagga

SEQ ID NO: 135947 - DNA, 20 bp, Artificial Sequence
  Description of Artificial Sequence: Synthetic oligonucleotide
  Target: ATXN1; (+) strand; PAM type: NRG; PAM sequence: TGG
tggggtggggatgaggacag

SEQ ID NO: 135948 - DNA, 20 bp, Artificial Sequence
  Description of Artificial Sequence: Synthetic oligonucleotide
  Target: ATXN1; (+) strand; PAM type: NRG; PAM sequence: CAG
ggtggggatgaggacagtgg

SEQ ID NO: 135949 - DNA, 20 bp, Artificial Sequence
  Description of Artificial Sequence: Synthetic oligonucleotide
  Target: ATXN1; (+) strand; PAM type: NRG; PAM sequence: AAG
ggggatgaggacagtggcag

SEQ ID NO: 135950 - DNA, 20 bp, Artificial Sequence
  Description of Artificial Sequence: Synthetic oligonucleotide
  Target: ATXN1; (+) strand; PAM type: NRG; PAM sequence: AAG
acagtggcagaagattgacg

SEQ ID NO: 135951 - DNA, 20 bp, Artificial Sequence
  Description of Artificial Sequence: Synthetic oligonucleotide
  Target: ATXN1; (+) strand; PAM type: NRG; PAM sequence: AGG
cagtggcagaagattgacga

SEQ ID NO: 135952 - DNA, 20 bp, Artificial Sequence
  Description of Artificial Sequence: Synthetic oligonucleotide
  Target: ATXN1; (+) strand; PAM type: NRG; PAM sequence: CAG
agattgacgaaggcattgtg

SEQ ID NO: 135953 - DNA, 20 bp, Artificial Sequence
  Description of Artificial Sequence: Synthetic oligonucleotide
  Target: ATXN1; (+) strand; PAM type: NRG; PAM sequence: AAG
attgtgcagcaccccatgca

SEQ ID NO: 135954 - DNA, 20 bp, Artificial Sequence
  Description of Artificial Sequence: Synthetic oligonucleotide
  Target: ATXN1; (+) strand; PAM type: NRG; PAM sequence: AGG
ttgtgcagcaccccatgcaa

SEQ ID NO: 135955 - DNA, 20 bp, Artificial Sequence
  Description of Artificial Sequence: Synthetic oligonucleotide
  Target: ATXN1; (+) strand; PAM type: NRG; PAM sequence: GGG
tgtgcagcaccccatgcaaa

SEQ ID NO: 135956 - DNA, 20 bp, Artificial Sequence
  Description of Artificial Sequence: Synthetic oligonucleotide
  Target: ATXN1; (+) strand; PAM type: NRG; PAM sequence: GGG
gtgcagcaccccatgcaaag

SEQ ID NO: 135957 - DNA, 20 bp, Artificial Sequence
  Description of Artificial Sequence: Synthetic oligonucleotide
  Target: ATXN1; (+) strand; PAM type: NRG; PAM sequence: CAG
aggggcgcctctccgtcaca

SEQ ID NO: 135958 - DNA, 20 bp, Artificial Sequence
  Description of Artificial Sequence: Synthetic oligonucleotide
  Target: ATXN1; (+) strand; PAM type: NRG; PAM sequence: AGG
ggggcgcctctccgtcacac

SEQ ID NO: 135959 - DNA, 20 bp, Artificial Sequence
  Description of Artificial Sequence: Synthetic oligonucleotide
  Target: ATXN1; (+) strand; PAM type: NRG; PAM sequence: TGG
cctctccgtcacacaggtac

SEQ ID NO: 135960 - DNA, 20 bp, Artificial Sequence
  Description of Artificial Sequence: Synthetic oligonucleotide
  Target: ATXN1; (+) strand; PAM type: NRG; PAM sequence: GAG
cgtcacacaggtactggcat

SEQ ID NO: 135961 - DNA, 20 bp, Artificial Sequence
  Description of Artificial Sequence: Synthetic oligonucleotide
  Target: ATXN1; (+) strand; PAM type: NRG; PAM sequence: AGG
gtcacacaggtactggcatg

SEQ ID NO: 135962 - DNA, 20 bp, Artificial Sequence
  Description of Artificial Sequence: Synthetic oligonucleotide
  Target: ATXN1; (+) strand; PAM type: NRG; PAM sequence: GGG
tcacacaggtactggcatga

SEQ ID NO: 135963 - DNA, 20 bp, Artificial Sequence
  Description of Artificial Sequence: Synthetic oligonucleotide
  Target: ATXN1; (+) strand; PAM type: NRG; PAM sequence: TGG
caggtactggcatgagggtg

SEQ ID NO: 135964 - DNA, 20 bp, Artificial Sequence
  Description of Artificial Sequence: Synthetic oligonucleotide
  Target: ATXN1; (+) strand; PAM type: NRG; PAM sequence: GGG
aggtactggcatgagggtgt

SEQ ID NO: 135965 - DNA, 20 bp, Artificial Sequence
  Description of Artificial Sequence: Synthetic oligonucleotide
  Target: ATXN1; (+) strand; PAM type: NRG; PAM sequence: GGG
ggtactggcatgagggtgtg

SEQ ID NO: 135966 - DNA, 20 bp, Artificial Sequence
  Description of Artificial Sequence: Synthetic oligonucleotide
  Target: ATXN1; (+) strand; PAM type: NRG; PAM sequence: GAG
ggcatgagggtgtggggacc

SEQ ID NO: 135967 - DNA, 20 bp, Artificial Sequence
  Description of Artificial Sequence: Synthetic oligonucleotide
  Target: ATXN1; (+) strand; PAM type: NRG; PAM sequence: GAG
gtgtggggaccgagtcctat

SEQ ID NO: 135968 - DNA, 20 bp, Artificial Sequence
  Description of Artificial Sequence: Synthetic oligonucleotide
  Target: ATXN1; (+) strand; PAM type: NRG; PAM sequence: TGG
gaccgagtcctatgagttcc

SEQ ID NO: 135969 - DNA, 20 bp, Artificial Sequence
  Description of Artificial Sequence: Synthetic oligonucleotide
  Target: ATXN1; (+) strand; PAM type: NRG; PAM sequence: GGG
accgagtcctatgagttcct

SEQ ID NO: 135970 - DNA, 20 bp, Artificial Sequence
  Description of Artificial Sequence: Synthetic oligonucleotide
  Target: ATXN1; (+) strand; PAM type: NRG; PAM sequence: CAG
atgagttcctgggtctctac

SEQ ID NO: 135971 - DNA, 20 bp, Artificial Sequence
  Description of Artificial Sequence: Synthetic oligonucleotide
  Target: ATXN1; (+) strand; PAM type: NRG; PAM sequence: AGG
tgagttcctgggtctctacc

SEQ ID NO: 135972 - DNA, 20 bp, Artificial Sequence
  Description of Artificial Sequence: Synthetic oligonucleotide
  Target: ATXN1; (+) strand; PAM type: NRG; PAM sequence: CAG
gggtctctaccaggattttc

SEQ ID NO: 135973 - DNA, 20 bp, Artificial Sequence
  Description of Artificial Sequence: Synthetic oligonucleotide
  Target: ATXN1; (+) strand; PAM type: NRG; PAM sequence: AGG
ggtctctaccaggattttcc

SEQ ID NO: 135974 - DNA, 20 bp, Artificial Sequence
  Description of Artificial Sequence: Synthetic oligonucleotide
  Target: ATXN1; (+) strand; PAM type: NRG; PAM sequence: CAG
tctaccaggattttccaggt

SEQ ID NO: 135975 - DNA, 20 bp, Artificial Sequence
  Description of Artificial Sequence: Synthetic oligonucleotide
  Target: ATXN1; (+) strand; PAM type: NRG; PAM sequence: GAG
ggattttccaggtcagcatc

SEQ ID NO: 135976 - DNA, 20 bp, Artificial Sequence
  Description of Artificial Sequence: Synthetic oligonucleotide
  Target: ATXN1; (+) strand; PAM type: NRG; PAM sequence: TAG
tcgagtgatactatctctcc

SEQ ID NO: 135977 - DNA, 20 bp, Artificial Sequence
  Description of Artificial Sequence: Synthetic oligonucleotide
  Target: ATXN1; (+) strand; PAM type: NRG; PAM sequence: AAG
agtgatactatctctcctag

SEQ ID NO: 135978 - DNA, 20 bp, Artificial Sequence
  Description of Artificial Sequence: Synthetic oligonucleotide
  Target: ATXN1; (+) strand; PAM type: NRG; PAM sequence: TGG
gatactatctctcctagaag

SEQ ID NO: 135979 - DNA, 20 bp, Artificial Sequence
  Description of Artificial Sequence: Synthetic oligonucleotide
  Target: ATXN1; (+) strand; PAM type: NRG; PAM sequence: TGG
actatctctcctagaagtgg

SEQ ID NO: 135980 - DNA, 20 bp, Artificial Sequence
  Description of Artificial Sequence: Synthetic oligonucleotide
  Target: ATXN1; (+) strand; PAM type: NRG; PAM sequence: GGG
ctatctctcctagaagtggt

SEQ ID NO: 135981 - DNA, 20 bp, Artificial Sequence
  Description of Artificial Sequence: Synthetic oligonucleotide
  Target: ATXN1; (+) strand; PAM type: NRG; PAM sequence: TGG
ctagaagtggtgggaactga

SEQ ID NO: 135982 - DNA, 20 bp, Artificial Sequence
  Description of Artificial Sequence: Synthetic oligonucleotide
  Target: ATXN1; (+) strand; PAM type: NRG; PAM sequence: GGG
tagaagtggtgggaactgat

SEQ ID NO: 135983 - DNA, 20 bp, Artificial Sequence
  Description of Artificial Sequence: Synthetic oligonucleotide
  Target: ATXN1; (+) strand; PAM type: NRG; PAM sequence: TGG
ggaactgatgggaatgacca

SEQ ID NO: 135984 - DNA, 20 bp, Artificial Sequence
  Description of Artificial Sequence: Synthetic oligonucleotide
  Target: ATXN1; (+) strand; PAM type: NRG; PAM sequence: AAG
actgatgggaatgaccatgg

SEQ ID NO: 135985 - DNA, 20 bp, Artificial Sequence
  Description of Artificial Sequence: Synthetic oligonucleotide
  Target: ATXN1; (+) strand; PAM type: NRG; PAM sequence: AAG
ggaagctgaatccacaaacc

SEQ ID NO: 135986 - DNA, 20 bp, Artificial Sequence
  Description of Artificial Sequence: Synthetic oligonucleotide
  Target: ATXN1; (+) strand; PAM type: NRG; PAM sequence: AGG
gaagctgaatccacaaacca

SEQ ID NO: 135987 - DNA, 20 bp, Artificial Sequence
  Description of Artificial Sequence: Synthetic oligonucleotide
  Target: ATXN1; (+) strand; PAM type: NRG; PAM sequence: GGG
aagctgaatccacaaaccaa

SEQ ID NO: 135988 - DNA, 20 bp, Artificial Sequence
  Description of Artificial Sequence: Synthetic oligonucleotide
  Target: ATXN1; (+) strand; PAM type: NRG; PAM sequence: TGG
ctccttatcttgtcctctca

SEQ ID NO: 135989 - DNA, 20 bp, Artificial Sequence
  Description of Artificial Sequence: Synthetic oligonucleotide
  Target: ATXN1; (+) strand; PAM type: NRG; PAM sequence: AAG
tatcttgtcctctcatggat

SEQ ID NO: 135990 - DNA, 20 bp, Artificial Sequence
  Description of Artificial Sequence: Synthetic oligonucleotide
  Target: ATXN1; (+) strand; PAM type: NRG; PAM sequence: AGG
atcttgtcctctcatggata

SEQ ID NO: 135991 - DNA, 20 bp, Artificial Sequence
  Description of Artificial Sequence: Synthetic oligonucleotide
  Target: ATXN1; (+) strand; PAM type: NRG; PAM sequence: AAG
ctcatggataaggcttcgta

SEQ ID NO: 135992 - DNA, 20 bp, Artificial Sequence
  Description of Artificial Sequence: Synthetic oligonucleotide
  Target: ATXN1; (+) strand; PAM type: NRG; PAM sequence: AGG
tcatggataaggcttcgtaa

SEQ ID NO: 135993 - DNA, 20 bp, Artificial Sequence
  Description of Artificial Sequence: Synthetic oligonucleotide
  Target: ATXN1; (+) strand; PAM type: NRG; PAM sequence: GGG
catggataaggcttcgtaaa

SEQ ID NO: 135994 - DNA, 20 bp, Artificial Sequence
  Description of Artificial Sequence: Synthetic oligonucleotide
  Target: ATXN1; (+) strand; PAM type: NRG; PAM sequence: GGG
atggataaggcttcgtaaag

SEQ ID NO: 135995 - DNA, 20 bp, Artificial Sequence
  Description of Artificial Sequence: Synthetic oligonucleotide
  Target: ATXN1; (+) strand; PAM type: NRG; PAM sequence: GGG
tggataaggcttcgtaaagg

SEQ ID NO: 135996 - DNA, 20 bp, Artificial Sequence
  Description of Artificial Sequence: Synthetic oligonucleotide
  Target: ATXN1; (+) strand; PAM type: NRG; PAM sequence: GGG
ggataaggcttcgtaaaggg

SEQ ID NO: 135997 - DNA, 20 bp, Artificial Sequence
  Description of Artificial Sequence: Synthetic oligonucleotide
  Target: ATXN1; (+) strand; PAM type: NRG; PAM sequence: AAG
tcgtaaaggggggattcctc

SEQ ID NO: 135998 - DNA, 20 bp, Artificial Sequence
  Description of Artificial Sequence: Synthetic oligonucleotide
  Target: ATXN1; (+) strand; PAM type: NRG; PAM sequence: AGG
cgtaaaggggggattcctca

SEQ ID NO: 135999 - DNA, 20 bp, Artificial Sequence
  Description of Artificial Sequence: Synthetic oligonucleotide
  Target: ATXN1; (+) strand; PAM type: NRG; PAM sequence: AAG
ttcctcaaggtcttttaacc

SEQ ID NO: 136000 - DNA, 20 bp, Artificial Sequence
  Description of Artificial Sequence: Synthetic oligonucleotide
  Target: ATXN1; (+) strand; PAM type: NRG; PAM sequence: TGG
cttttaaccaagtctgcaca

SEQ ID NO: 136001 - DNA, 20 bp, Artificial Sequence
  Description of Artificial Sequence: Synthetic oligonucleotide
  Target: ATXN1; (+) strand; PAM type: NRG; PAM sequence: GGG
ttttaaccaagtctgcacat

SEQ ID NO: 136002 - DNA, 20 bp, Artificial Sequence
  Description of Artificial Sequence: Synthetic oligonucleotide
  Target: ATXN1; (+) strand; PAM type: NRG; PAM sequence: GAG
ttaaccaagtctgcacatgg

SEQ ID NO: 136003 - DNA, 20 bp, Artificial Sequence
  Description of Artificial Sequence: Synthetic oligonucleotide
  Target: ATXN1; (+) strand; PAM type: NRG; PAM sequence: TGG
ctgcacatgggagaaaacga

SEQ ID NO: 136004 - DNA, 20 bp, Artificial Sequence
  Description of Artificial Sequence: Synthetic oligonucleotide
  Target: ATXN1; (+) strand; PAM type: NRG; PAM sequence: AAG
acatgggagaaaacgatgga

SEQ ID NO: 136005 - DNA, 20 bp, Artificial Sequence
  Description of Artificial Sequence: Synthetic oligonucleotide
  Target: ATXN1; (+) strand; PAM type: NRG; PAM sequence: CAG
tgggagaaaacgatggaaag

SEQ ID NO: 136006 - DNA, 20 bp, Artificial Sequence
  Description of Artificial Sequence: Synthetic oligonucleotide
  Target: ATXN1; (+) strand; PAM type: NRG; PAM sequence: TGG
agaaaacgatggaaagcaga

SEQ ID NO: 136007 - DNA, 20 bp, Artificial Sequence
  Description of Artificial Sequence: Synthetic oligonucleotide
  Target: ATXN1; (+) strand; PAM type: NRG; PAM sequence: AAG
agcagatggaaatgcttctc

SEQ ID NO: 136008 - DNA, 20 bp, Artificial Sequence
  Description of Artificial Sequence: Synthetic oligonucleotide
  Target: ATXN1; (+) strand; PAM type: NRG; PAM sequence: AAG
ctcaagaacctctcaataca

SEQ ID NO: 136009 - DNA, 20 bp, Artificial Sequence
  Description of Artificial Sequence: Synthetic oligonucleotide
  Target: ATXN1; (+) strand; PAM type: NRG; PAM sequence: GAG
caagaacctctcaatacaaa

SEQ ID NO: 136010 - DNA, 20 bp, Artificial Sequence
  Description of Artificial Sequence: Synthetic oligonucleotide
  Target: ATXN1; (+) strand; PAM type: NRG; PAM sequence: AAG
cctctcaatacaaagagata

SEQ ID NO: 136011 - DNA, 20 bp, Artificial Sequence
  Description of Artificial Sequence: Synthetic oligonucleotide
  Target: ATXN1; (+) strand; PAM type: NRG; PAM sequence: GAG
tctcaatacaaagagataaa

SEQ ID NO: 136012 - DNA, 20 bp, Artificial Sequence
  Description of Artificial Sequence: Synthetic oligonucleotide
  Target: ATXN1; (+) strand; PAM type: NRG; PAM sequence: AGG
ctcaatacaaagagataaag

SEQ ID NO: 136013 - DNA, 20 bp, Artificial Sequence
  Description of Artificial Sequence: Synthetic oligonucleotide
  Target: ATXN1; (+) strand; PAM type: NRG; PAM sequence: CAG
tacaaagagataaagaggaa

SEQ ID NO: 136014 - DNA, 20 bp, Artificial Sequence
  Description of Artificial Sequence: Synthetic oligonucleotide
  Target: ATXN1; (+) strand; PAM type: NRG; PAM sequence: AGG
acaaagagataaagaggaac

SEQ ID NO: 136015 - DNA, 20 bp, Artificial Sequence
  Description of Artificial Sequence: Synthetic oligonucleotide
  Target: ATXN1; (+) strand; PAM type: NRG; PAM sequence: CAG
agagataaagaggaacaggc

SEQ ID NO: 136016 - DNA, 20 bp, Artificial Sequence
  Description of Artificial Sequence: Synthetic oligonucleotide
  Target: ATXN1; (+) strand; PAM type: NRG; PAM sequence: AGG
gagataaagaggaacaggcc

SEQ ID NO: 136017 - DNA, 20 bp, Artificial Sequence
  Description of Artificial Sequence: Synthetic oligonucleotide
  Target: ATXN1; (+) strand; PAM type: NRG; PAM sequence: TGG
agaggaacaggccaggcaca

SEQ ID NO: 136018 - DNA, 20 bp, Artificial Sequence
  Description of Artificial Sequence: Synthetic oligonucleotide
  Target: ATXN1; (+) strand; PAM type: NRG; PAM sequence: CAG
atggcacacacctgtaacct

SEQ ID NO: 136019 - DNA, 20 bp, Artificial Sequence
  Description of Artificial Sequence: Synthetic oligonucleotide
  Target: ATXN1; (+) strand; PAM type: NRG; PAM sequence: TGG
cacctgtaacctcagcactt

SEQ ID NO: 136020 - DNA, 20 bp, Artificial Sequence
  Description of Artificial Sequence: Synthetic oligonucleotide
  Target: ATXN1; (+) strand; PAM type: NRG; PAM sequence: AAG
ctgtaacctcagcactttgg

SEQ ID NO: 136021 - DNA, 20 bp, Artificial Sequence
  Description of Artificial Sequence: Synthetic oligonucleotide
  Target: ATXN1; (+) strand; PAM type: NRG; PAM sequence: AGG
tgtaacctcagcactttgga

SEQ ID NO: 136022 - DNA, 20 bp, Artificial Sequence
  Description of Artificial Sequence: Synthetic oligonucleotide
  Target: ATXN1; (+) strand; PAM type: NRG; PAM sequence: AAG
cctcagcactttggaaggcc

SEQ ID NO: 136023 - DNA, 20 bp, Artificial Sequence
  Description of Artificial Sequence: Synthetic oligonucleotide
  Target: ATXN1; (+) strand; PAM type: NRG; PAM sequence: AGG
ctcagcactttggaaggcca

SEQ ID NO: 136024 - DNA, 20 bp, Artificial Sequence
  Description of Artificial Sequence: Synthetic oligonucleotide
  Target: ATXN1; (+) strand; PAM type: NRG; PAM sequence: GAG
cagcactttggaaggccaag

SEQ ID NO: 136025 - DNA, 20 bp, Artificial Sequence
  Description of Artificial Sequence: Synthetic oligonucleotide
  Target: ATXN1; (+) strand; PAM type: NRG; PAM sequence: AGG
agcactttggaaggccaagg

SEQ ID NO: 136026 - DNA, 20 bp, Artificial Sequence
  Description of Artificial Sequence: Synthetic oligonucleotide
  Target: ATXN1; (+) strand; PAM type: NRG; PAM sequence: GGG
gcactttggaaggccaagga

SEQ ID NO: 136027 - DNA, 20 bp, Artificial Sequence
  Description of Artificial Sequence: Synthetic oligonucleotide
  Target: ATXN1; (+) strand; PAM type: NRG; PAM sequence: AAG
ctttggaaggccaaggaggg

SEQ ID NO: 136028 - DNA, 20 bp, Artificial Sequence
  Description of Artificial Sequence: Synthetic oligonucleotide
  Target: ATXN1; (+) strand; PAM type: NRG; PAM sequence: GAG
ccaaggagggaagaccactt

SEQ ID NO: 136029 - DNA, 20 bp, Artificial Sequence
  Description of Artificial Sequence: Synthetic oligonucleotide
  Target: ATXN1; (+) strand; PAM type: NRG; PAM sequence: CAG
gagggaagaccacttgagcc

SEQ ID NO: 136030 - DNA, 20 bp, Artificial Sequence
  Description of Artificial Sequence: Synthetic oligonucleotide
  Target: ATXN1; (+) strand; PAM type: NRG; PAM sequence: AGG
agggaagaccacttgagccc

SEQ ID NO: 136031 - DNA, 20 bp, Artificial Sequence
  Description of Artificial Sequence: Synthetic oligonucleotide
  Target: ATXN1; (+) strand; PAM type: NRG; PAM sequence: AAG
ccacttgagcccaggaattc

SEQ ID NO: 136032 - DNA, 20 bp, Artificial Sequence
  Description of Artificial Sequence: Synthetic oligonucleotide
  Target: ATXN1; (+) strand; PAM type: NRG; PAM sequence: CAG
tgagcccaggaattcaagac

SEQ ID NO: 136033 - DNA, 20 bp, Artificial Sequence
  Description of Artificial Sequence: Synthetic oligonucleotide
  Target: ATXN1; (+) strand; PAM type: NRG; PAM sequence: TGG
ccaggaattcaagaccagcc

SEQ ID NO: 136034 - DNA, 20 bp, Artificial Sequence
  Description of Artificial Sequence: Synthetic oligonucleotide
  Target: ATXN1; (+) strand; PAM type: NRG; PAM sequence: GGG
caggaattcaagaccagcct

SEQ ID NO: 136035 - DNA, 20 bp, Artificial Sequence
  Description of Artificial Sequence: Synthetic oligonucleotide
  Target: ATXN1; (+) strand; PAM type: NRG; PAM sequence: CAG
caagaccagcctgggcaaca

SEQ ID NO: 136036 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaacaaaaattatcg

SEQ ID NO: 136037 - DNA, 20 bp, Artificial Sequence
  Description of Artificial Sequence: Synthetic oligonucleotide
  Target: ATXN1; (+) strand; PAM type: NRG; PAM sequence: TGG
acaaaaattatcgtggcacg

SEQ ID NO: 136038 - DNA, 20 bp, Artificial Sequence
  Description of Artificial Sequence: Synthetic oligonucleotide
  Target: ATXN1; (+) strand; PAM type: NRG; PAM sequence: TAG
tggcacgtggtgcacatcta

SEQ ID NO: 136039 - DNA, 20 bp, Artificial Sequence
  Description of Artificial Sequence: Synthetic oligonucleotide
  Target: ATXN1; (+) strand; PAM type: NRG; PAM sequence: CAG
gtggtgcacatctatagttc

SEQ ID NO: 136040 - DNA, 20 bp, Artificial Sequence
  Description of Artificial Sequence: Synthetic oligonucleotide
  Target: ATXN1; (+) strand; PAM type: NRG; PAM sequence: GAG
ttccagctactcaactgact

SEQ ID NO: 136041 - DNA, 20 bp, Artificial Sequence
  Description of Artificial Sequence: Synthetic oligonucleotide
  Target: ATXN1; (+) strand; PAM type: NRG; PAM sequence: AGG
tccagctactcaactgactg

SEQ ID NO: 136042 - DNA, 20 bp, Artificial Sequence
  Description of Artificial Sequence: Synthetic oligonucleotide
  Target: ATXN1; (+) strand; PAM type: NRG; PAM sequence: TGG
agctactcaactgactgagg

SEQ ID NO: 136043 - DNA, 20 bp, Artificial Sequence
  Description of Artificial Sequence: Synthetic oligonucleotide
  Target: ATXN1; (+) strand; PAM type: NRG; PAM sequence: TAG
tactcaactgactgaggtgg

SEQ ID NO: 136044 - DNA, 20 bp, Artificial Sequence
  Description of Artificial Sequence: Synthetic oligonucleotide
  Target: ATXN1; (+) strand; PAM type: NRG; PAM sequence: AGG
actcaactgactgaggtggt

SEQ ID NO: 136045 - DNA, 20 bp, Artificial Sequence
  Description of Artificial Sequence: Synthetic oligonucleotide
  Target: ATXN1; (+) strand; PAM type: NRG; PAM sequence: GAG
aggtggtaggaccattgctt

SEQ ID NO: 136046 - DNA, 20 bp, Artificial Sequence
  Description of Artificial Sequence: Synthetic oligonucleotide
  Target: ATXN1; (+) strand; PAM type: NRG; PAM sequence: CAG
gtaggaccattgcttgagcc

SEQ ID NO: 136047 - DNA, 20 bp, Artificial Sequence
  Description of Artificial Sequence: Synthetic oligonucleotide
  Target: ATXN1; (+) strand; PAM type: NRG; PAM sequence: AGG
taggaccattgcttgagccc

SEQ ID NO: 136048 - DNA, 20 bp, Artificial Sequence
  Description of Artificial Sequence: Synthetic oligonucleotide
  Target: ATXN1; (+) strand; PAM type: NRG; PAM sequence: GAG
ggaccattgcttgagcccag

SEQ ID NO: 136049 - DNA, 20 bp, Artificial Sequence
  Description of Artificial Sequence: Synthetic oligonucleotide
  Target: ATXN1; (+) strand; PAM type: NRG; PAM sequence: GAG
ttgcttgagcccaggagttc

SEQ ID NO: 136050 - DNA, 20 bp, Artificial Sequence
  Description of Artificial Sequence: Synthetic oligonucleotide
  Target: ATXN1; (+) strand; PAM type: NRG; PAM sequence: AGG
tgcttgagcccaggagttcg

SEQ ID NO: 136051 - DNA, 20 bp, Artificial Sequence
  Description of Artificial Sequence: Synthetic oligonucleotide
  Target: ATXN1; (+) strand; PAM type: NRG; PAM sequence: CAG
acaattgtatcactgctctc

SEQ ID NO: 136052 - DNA, 20 bp, Artificial Sequence
  Description of Artificial Sequence: Synthetic oligonucleotide
  Target: ATXN1; (+) strand; PAM type: NRG; PAM sequence: TGG
tgtatcactgctctccagcc

SEQ ID NO: 136053 - DNA, 20 bp, Artificial Sequence
  Description of Artificial Sequence: Synthetic oligonucleotide
  Target: ATXN1; (+) strand; PAM type: NRG; PAM sequence: GGG
gtatcactgctctccagcct

SEQ ID NO: 136054 - DNA, 20 bp, Artificial Sequence
  Description of Artificial Sequence: Synthetic oligonucleotide
  Target: ATXN1; (+) strand; PAM type: NRG; PAM sequence: TGG
ctgctctccagcctgggtga

SEQ ID NO: 136055 - DNA, 20 bp, Artificial Sequence
  Description of Artificial Sequence: Synthetic oligonucleotide
  Target: ATXN1; (+) strand; PAM type: NRG; PAM sequence: GAG
gctctccagcctgggtgatg

SEQ ID NO: 136056 - DNA, 20 bp, Artificial Sequence
  Description of Artificial Sequence: Synthetic oligonucleotide
  Target: ATXN1; (+) strand; PAM type: NRG; PAM sequence: GAG
tctccagcctgggtgatgga

SEQ ID NO: 136057 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggtgatggaga

SEQ ID NO: 136058 - DNA, 20 bp, Artificial Sequence
  Description of Artificial Sequence: Synthetic oligonucleotide
  Target: ATXN1; (+) strand; PAM type: NRG; PAM sequence: AAG
gagaccctgtatctaaaaaa

SEQ ID NO: 136059 - DNA, 20 bp, Artificial Sequence
  Description of Artificial Sequence: Synthetic oligonucleotide
  Target: ATXN1; (+) strand; PAM type: NRG; PAM sequence: AAG
aaaaaagaaaacaaaattaa

SEQ ID NO: 136060 - DNA, 20 bp, Artificial Sequence
  Description of Artificial Sequence: Synthetic oligonucleotide
  Target: ATXN1; (+) strand; PAM type: NRG; PAM sequence: AAG
aaacaaaattaaaagaaata

SEQ ID NO: 136061 - DNA, 20 bp, Artificial Sequence
  Description of Artificial Sequence: Synthetic oligonucleotide
  Target: ATXN1; (+) strand; PAM type: NRG; PAM sequence: CAG
aagaaataaagaaaatgtct

SEQ ID NO: 136062 - DNA, 20 bp, Artificial Sequence
  Description of Artificial Sequence: Synthetic oligonucleotide
  Target: ATXN1; (+) strand; PAM type: NRG; PAM sequence: AGG
agaaataaagaaaatgtctc

SEQ ID NO: 136063 - DNA, 20 bp, Artificial Sequence
  Description of Artificial Sequence: Synthetic oligonucleotide
  Target: ATXN1; (+) strand; PAM type: NRG; PAM sequence: AAG
aataaagaaaatgtctcagg

SEQ ID NO: 136064 - DNA, 20 bp, Artificial Sequence
  Description of Artificial Sequence: Synthetic oligonucleotide
  Target: ATXN1; (+) strand; PAM type: NRG; PAM sequence: AAG
aaagaaaatgtctcaggaag

SEQ ID NO: 136065 - DNA, 20 bp, Artificial Sequence
  Description of Artificial Sequence: Synthetic oligonucleotide
  Target: ATXN1; (+) strand; PAM type: NRG; PAM sequence: CAG
aggaagaagttgttcctctt

SEQ ID NO: 136066 - DNA, 20 bp, Artificial Sequence
  Description of Artificial Sequence: Synthetic oligonucleotide
  Target: ATXN1; (+) strand; PAM type: NRG; PAM sequence: TGG
gttgttcctcttcagacaac

SEQ ID NO: 136067 - DNA, 20 bp, Artificial Sequence
  Description of Artificial Sequence: Synthetic oligonucleotide
  Target: ATXN1; (+) strand; PAM type: NRG; PAM sequence: TAG
ttcttttttttttttttttt

SEQ ID NO: 136068 - DNA, 20 bp, Artificial Sequence
  Description of Artificial Sequence: Synthetic oligonucleotide
  Target: ATXN1; (+) strand; PAM type: NRG; PAM sequence: CAG
tttttttttttttttttaga

SEQ ID NO: 136069 - DNA, 20 bp, Artificial Sequence
  Description of Artificial Sequence: Synthetic oligonucleotide
  Target: ATXN1; (+) strand; PAM type: NRG; PAM sequence: AGG
ttttttttttttttttagac

SEQ ID NO: 136070 - DNA, 20 bp, Artificial Sequence
  Description of Artificial Sequence: Synthetic oligonucleotide
  Target: ATXN1; (+) strand; PAM type: NRG; PAM sequence: CAG
gacaggcttgctttgttgcc

SEQ ID NO: 136071 - DNA, 20 bp, Artificial Sequence
  Description of Artificial Sequence: Synthetic oligonucleotide
  Target: ATXN1; (+) strand; PAM type: NRG; PAM sequence: AGG
acaggcttgctttgttgccc

SEQ ID NO: 136072 - DNA, 20 bp, Artificial Sequence
  Description of Artificial Sequence: Synthetic oligonucleotide
  Target: ATXN1; (+) strand; PAM type: NRG; PAM sequence: TAG
gcttgctttgttgcccaggc

SEQ ID NO: 136073 - DNA, 20 bp, Artificial Sequence
  Description of Artificial Sequence: Synthetic oligonucleotide
  Target: ATXN1; (+) strand; PAM type: NRG; PAM sequence: GAG
ttgctttgttgcccaggcta

SEQ ID NO: 136074 - DNA, 20 bp, Artificial Sequence
  Description of Artificial Sequence: Synthetic oligonucleotide
  Target: ATXN1; (+) strand; PAM type: NRG; PAM sequence: CAG
ttgttgcccaggctagagtg

SEQ ID NO: 136075 - DNA, 20 bp, Artificial Sequence
  Description of Artificial Sequence: Synthetic oligonucleotide
  Target: ATXN1; (+) strand; PAM type: NRG; PAM sequence: TGG
ttgcccaggctagagtgcag

SEQ ID NO: 136076 - DNA, 20 bp, Artificial Sequence
  Description of Artificial Sequence: Synthetic oligonucleotide
  Target: ATXN1; (+) strand; PAM type: NRG; PAM sequence: CAG
ctagagtgcagtggtacaat

SEQ ID NO: 136077 - DNA, 20 bp, Artificial Sequence
  Description of Artificial Sequence: Synthetic oligonucleotide
  Target: ATXN1; (+) strand; PAM type: NRG; PAM sequence: GAG
agagtgcagtggtacaatca

SEQ ID NO: 136078 - DNA, 20 bp, Artificial Sequence
  Description of Artificial Sequence: Synthetic oligonucleotide
  Target: ATXN1; (+) strand; PAM type: NRG; PAM sequence: CAG
ggtacaatcagagctcactg

SEQ ID NO: 136079 - DNA, 20 bp, Artificial Sequence
  Description of Artificial Sequence: Synthetic oligonucleotide
  Target: ATXN1; (+) strand; PAM type: NRG; PAM sequence: CAG
atcagagctcactgcagcct

SEQ ID NO: 136080 - DNA, 20 bp, Artificial Sequence
  Description of Artificial Sequence: Synthetic oligonucleotide
  Target: ATXN1; (+) strand; PAM type: NRG; PAM sequence: TGG
tcactgcagcctcagcctcc

SEQ ID NO: 136081 - DNA, 20 bp, Artificial Sequence
  Description of Artificial Sequence: Synthetic oligonucleotide
  Target: ATXN1; (+) strand; PAM type: NRG; PAM sequence: CAG
cagcctcagcctcctggaac

SEQ ID NO: 136082 - DNA, 20 bp, Artificial Sequence
  Description of Artificial Sequence: Synthetic oligonucleotide
  Target: ATXN1; (+) strand; PAM type: NRG; PAM sequence: AGG
agcctcagcctcctggaacc

SEQ ID NO: 136083 - DNA, 20 bp, Artificial Sequence
  Description of Artificial Sequence: Synthetic oligonucleotide
  Target: ATXN1; (+) strand; PAM type: NRG; PAM sequence: CAG
accaggtgatcctcccactt

SEQ ID NO: 136084 - DNA, 20 bp, Artificial Sequence
  Description of Artificial Sequence: Synthetic oligonucleotide
  Target: ATXN1; (+) strand; PAM type: NRG; PAM sequence: GAG
tcctcccacttcagccttct

SEQ ID NO: 136085 - DNA, 20 bp, Artificial Sequence
  Description of Artificial Sequence: Synthetic oligonucleotide
  Target: ATXN1; (+) strand; PAM type: NRG; PAM sequence: TAG
tcccacttcagccttctgag

SEQ ID NO: 136086 - DNA, 20 bp, Artificial Sequence
  Description of Artificial Sequence: Synthetic oligonucleotide
  Target: ATXN1; (+) strand; PAM type: NRG; PAM sequence: CGG
acttcagccttctgagtagc

SEQ ID NO: 136087 - DNA, 20 bp, Artificial Sequence
  Description of Artificial Sequence: Synthetic oligonucleotide
  Target: ATXN1; (+) strand; PAM type: NRG; PAM sequence: GGG
cttcagccttctgagtagcc

SEQ ID NO: 136088 - DNA, 20 bp, Artificial Sequence
  Description of Artificial Sequence: Synthetic oligonucleotide
  Target: ATXN1; (+) strand; PAM type: NRG; PAM sequence: CAG
cttctgagtagccgggacca

SEQ ID NO: 136089 - DNA, 20 bp, Artificial Sequence
  Description of Artificial Sequence: Synthetic oligonucleotide
  Target: ATXN1; (+) strand; PAM type: NRG; PAM sequence: AGG
ttctgagtagccgggaccac

SEQ ID NO: 136090 - DNA, 20 bp, Artificial Sequence
  Description of Artificial Sequence: Synthetic oligonucleotide
  Target: ATXN1; (+) strand; PAM type: NRG; PAM sequence: TGG
caggcacacatcaccatgcc

SEQ ID NO: 136091 - DNA, 20 bp, Artificial Sequence
  Description of Artificial Sequence: Synthetic oligonucleotide
  Target: ATXN1; (+) strand; PAM type: NRG; PAM sequence: TAG
ctgattaaaaaaaaaaaatg

SEQ ID NO: 136092 - DNA, 20 bp, Artificial Sequence
  Description of Artificial Sequence: Synthetic oligonucleotide
  Target: ATXN1; (+) strand; PAM type: NRG; PAM sequence: GAG
gattaaaaaaaaaaaatgta

SEQ ID NO: 136093 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaatgtagagat

SEQ ID NO: 136094 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaaatgtagagatg

SEQ ID NO: 136095 - DNA, 20 bp, Artificial Sequence
  Description of Artificial Sequence: Synthetic oligonucleotide
  Target: ATXN1; (+) strand; PAM type: NRG; PAM sequence: CAG
tgaggcctcactatgttgcc

SEQ ID NO: 136096 - DNA, 20 bp, Artificial Sequence
  Description of Artificial Sequence: Synthetic oligonucleotide
  Target: ATXN1; (+) strand; PAM type: NRG; PAM sequence: AGG
gaggcctcactatgttgccc

SEQ ID NO: 136097 - DNA, 20 bp, Artificial Sequence
  Description of Artificial Sequence: Synthetic oligonucleotide
  Target: ATXN1; (+) strand; PAM type: NRG; PAM sequence: TAG
cctcactatgttgcccaggc

SEQ ID NO: 136098 - DNA, 20 bp, Artificial Sequence
  Description of Artificial Sequence: Synthetic oligonucleotide
  Target: ATXN1; (+) strand; PAM type: NRG; PAM sequence: AAG
tagtctcaaactcctgccct

SEQ ID NO: 136099 - DNA, 20 bp, Artificial Sequence
  Description of Artificial Sequence: Synthetic oligonucleotide
  Target: ATXN1; (+) strand; PAM type: NRG; PAM sequence: TGG
cctaagcaatcctcccactt

SEQ ID NO: 136100 - DNA, 20 bp, Artificial Sequence
  Description of Artificial Sequence: Synthetic oligonucleotide
  Target: ATXN1; (+) strand; PAM type: NRG; PAM sequence: AAG
cctcccactttggcttcaca

SEQ ID NO: 136101 - DNA, 20 bp, Artificial Sequence
  Description of Artificial Sequence: Synthetic oligonucleotide
  Target: ATXN1; (+) strand; PAM type: NRG; PAM sequence: TGG
actttggcttcacaaagtgc

SEQ ID NO: 136102 - DNA, 20 bp, Artificial Sequence
  Description of Artificial Sequence: Synthetic oligonucleotide
  Target: ATXN1; (+) strand; PAM type: NRG; PAM sequence: AAG
agtgctggaaatacacactc

SEQ ID NO: 136103 - DNA, 20 bp, Artificial Sequence
  Description of Artificial Sequence: Synthetic oligonucleotide
  Target: ATXN1; (+) strand; PAM type: NRG; PAM sequence: CAG
cacactcaagccactgcacc

SEQ ID NO: 136104 - DNA, 20 bp, Artificial Sequence
  Description of Artificial Sequence: Synthetic oligonucleotide
  Target: ATXN1; (+) strand; PAM type: NRG; PAM sequence: TGG
actgcacccagctgaccacc

SEQ ID NO: 136105 - DNA, 20 bp, Artificial Sequence
  Description of Artificial Sequence: Synthetic oligonucleotide
  Target: ATXN1; (+) strand; PAM type: NRG; PAM sequence: TGG
ccagctgaccacctggattt

SEQ ID NO: 136106 - DNA, 20 bp, Artificial Sequence
  Description of Artificial Sequence: Synthetic oligonucleotide
  Target: ATXN1; (+) strand; PAM type: NRG; PAM sequence: AAG
tgaccacctggattttggaa

SEQ ID NO: 136107 - DNA, 20 bp, Artificial Sequence
  Description of Artificial Sequence: Synthetic oligonucleotide
  Target: ATXN1; (+) strand; PAM type: NRG; PAM sequence: GAG
accacctggattttggaaaa

SEQ ID NO: 136108 - DNA, 20 bp, Artificial Sequence
  Description of Artificial Sequence: Synthetic oligonucleotide
  Target: ATXN1; (+) strand; PAM type: NRG; PAM sequence: AGG
ccacctggattttggaaaag

SEQ ID NO: 136109 - DNA, 20 bp, Artificial Sequence
  Description of Artificial Sequence: Synthetic oligonucleotide
  Target: ATXN1; (+) strand; PAM type: NRG; PAM sequence: CGG
gattttggaaaagaggaaaa

SEQ ID NO: 136110 - DNA, 20 bp, Artificial Sequence
  Description of Artificial Sequence: Synthetic oligonucleotide
  Target: ATXN1; (+) strand; PAM type: NRG; PAM sequence: AAG
tttggaaaagaggaaaacgg

SEQ ID NO: 136111 - DNA, 20 bp, Artificial Sequence
  Description of Artificial Sequence: Synthetic oligonucleotide
  Target: ATXN1; (+) strand; PAM type: NRG; PAM sequence: TAG
gaaaacggaagtctgactgt

SEQ ID NO: 136112 - DNA, 20 bp, Artificial Sequence
  Description of Artificial Sequence: Synthetic oligonucleotide
  Target: ATXN1; (+) strand; PAM type: NRG; PAM sequence: TGG
ggaagtctgactgttagatg

SEQ ID NO: 136113 - DNA, 20 bp, Artificial Sequence
  Description of Artificial Sequence: Synthetic oligonucleotide
  Target: ATXN1; (+) strand; PAM type: NRG; PAM sequence: GGG
gaagtctgactgttagatgt

SEQ ID NO: 136114 - DNA, 20 bp, Artificial Sequence
  Description of Artificial Sequence: Synthetic oligonucleotide
  Target: ATXN1; (+) strand; PAM type: NRG; PAM sequence: CAG
tgactgttagatgtgggaat

SEQ ID NO: 136115 - DNA, 20 bp, Artificial Sequence
  Description of Artificial Sequence: Synthetic oligonucleotide
  Target: ATXN1; (+) strand; PAM type: NRG; PAM sequence: TGG
ttatattacatgcacatgta

SEQ ID NO: 136116 - DNA, 20 bp, Artificial Sequence
  Description of Artificial Sequence: Synthetic oligonucleotide
  Target: ATXN1; (+) strand; PAM type: NRG; PAM sequence: AAG
tgtatggtgcatatcataac

SEQ ID NO: 136117 - DNA, 20 bp, Artificial Sequence
  Description of Artificial Sequence: Synthetic oligonucleotide
  Target: ATXN1; (+) strand; PAM type: NRG; PAM sequence: GAG
tatggtgcatatcataacaa

SEQ ID NO: 136118 - DNA, 20 bp, Artificial Sequence
  Description of Artificial Sequence: Synthetic oligonucleotide
  Target: ATXN1; (+) strand; PAM type: NRG; PAM sequence: AAG
gtgcatatcataacaagaga

SEQ ID NO: 136119 - DNA, 20 bp, Artificial Sequence
  Description of Artificial Sequence: Synthetic oligonucleotide
  Target: ATXN1; (+) strand; PAM type: NRG; PAM sequence: TAG
agagaaagtgttaaacacac

SEQ ID NO: 136120 - DNA, 20 bp, Artificial Sequence
  Description of Artificial Sequence: Synthetic oligonucleotide
  Target: ATXN1; (+) strand; PAM type: NRG; PAM sequence: GAG
agaaagtgttaaacacacta

SEQ ID NO: 136121 - DNA, 20 bp, Artificial Sequence
  Description of Artificial Sequence: Synthetic oligonucleotide
  Target: ATXN1; (+) strand; PAM type: NRG; PAM sequence: TAG
gttaaacacactagagacat

SEQ ID NO: 136122 - DNA, 20 bp, Artificial Sequence
  Description of Artificial Sequence: Synthetic oligonucleotide
  Target: ATXN1; (+) strand; PAM type: NRG; PAM sequence: AAG
gagacattagaaaacaaatc

SEQ ID NO: 136123 - DNA, 20 bp, Artificial Sequence
  Description of Artificial Sequence: Synthetic oligonucleotide
  Target: ATXN1; (+) strand; PAM type: NRG; PAM sequence: AGG
agacattagaaaacaaatca

SEQ ID NO: 136124 - DNA, 20 bp, Artificial Sequence
  Description of Artificial Sequence: Synthetic oligonucleotide
  Target: ATXN1; (+) strand; PAM type: NRG; PAM sequence: GAG
tagaaaacaaatcaaggact

SEQ ID NO: 136125 - DNA, 20 bp, Artificial Sequence
  Description of Artificial Sequence: Synthetic oligonucleotide
  Target: ATXN1; (+) strand; PAM type: NRG; PAM sequence: AGG
agaaaacaaatcaaggactg

SEQ ID NO: 136126 - DNA, 20 bp, Artificial Sequence
  Description of Artificial Sequence: Synthetic oligonucleotide
  Target: ATXN1; (+) strand; PAM type: NRG; PAM sequence: AAG
aaggactgaggaacaataaa

SEQ ID NO: 136127 - DNA, 20 bp, Artificial Sequence
  Description of Artificial Sequence: Synthetic oligonucleotide
  Target: ATXN1; (+) strand; PAM type: NRG; PAM sequence: TGG
aacaataaaaagtgttgcaa

SEQ ID NO: 136128 - DNA, 20 bp, Artificial Sequence
  Description of Artificial Sequence: Synthetic oligonucleotide
  Target: ATXN1; (+) strand; PAM type: NRG; PAM sequence: AAG
aaagtgttgcaatggtgtaa

SEQ ID NO: 136129 - DNA, 20 bp, Artificial Sequence
  Description of Artificial Sequence: Synthetic oligonucleotide
  Target: ATXN1; (+) strand; PAM type: NRG; PAM sequence: TAG
tgtaaaagtaatacaaatta

SEQ ID NO: 136130 - DNA, 20 bp, Artificial Sequence
  Description of Artificial Sequence: Synthetic oligonucleotide
  Target: ATXN1; (+) strand; PAM type: NRG; PAM sequence: CAG
actaatgcccaattactatg

SEQ ID NO: 136131 - DNA, 20 bp, Artificial Sequence
  Description of Artificial Sequence: Synthetic oligonucleotide
  Target: ATXN1; (+) strand; PAM type: NRG; PAM sequence: CAG
tgcccaattactatgcagca

SEQ ID NO: 136132 - DNA, 20 bp, Artificial Sequence
  Description of Artificial Sequence: Synthetic oligonucleotide
  Target: ATXN1; (+) strand; PAM type: NRG; PAM sequence: TAG
tatgcagcacagtatcaatt

SEQ ID NO: 136133 - DNA, 20 bp, Artificial Sequence
  Description of Artificial Sequence: Synthetic oligonucleotide
  Target: ATXN1; (+) strand; PAM type: NRG; PAM sequence: TGG
gcagcacagtatcaatttag

SEQ ID NO: 136134 - DNA, 20 bp, Artificial Sequence
  Description of Artificial Sequence: Synthetic oligonucleotide
  Target: ATXN1; (+) strand; PAM type: NRG; PAM sequence: AAG
tccgattgactcacttgtat

SEQ ID NO: 136135 - DNA, 20 bp, Artificial Sequence
  Description of Artificial Sequence: Synthetic oligonucleotide
  Target: ATXN1; (+) strand; PAM type: NRG; PAM sequence: CAG
taaattctcctttatatgtt

SEQ ID NO: 136136 - DNA, 20 bp, Artificial Sequence
  Description of Artificial Sequence: Synthetic oligonucleotide
  Target: ATXN1; (+) strand; PAM type: NRG; PAM sequence: AGG
aaattctcctttatatgttc

SEQ ID NO: 136137 - DNA, 20 bp, Artificial Sequence
  Description of Artificial Sequence: Synthetic oligonucleotide
  Target: ATXN1; (+) strand; PAM type: NRG; PAM sequence: CAG
ttttgtgatgcgtgtaattg

SEQ ID NO: 136138 - DNA, 20 bp, Artificial Sequence
  Description of Artificial Sequence: Synthetic oligonucleotide
  Target: ATXN1; (+) strand; PAM type: NRG; PAM sequence: TGG
atgcgtgtaattgcagaact

SEQ ID NO: 136139 - DNA, 20 bp, Artificial Sequence
  Description of Artificial Sequence: Synthetic oligonucleotide
  Target: ATXN1; (+) strand; PAM type: NRG; PAM sequence: GGG
tgcgtgtaattgcagaactt

SEQ ID NO: 136140 - DNA, 20 bp, Artificial Sequence
  Description of Artificial Sequence: Synthetic oligonucleotide
  Target: ATXN1; (+) strand; PAM type: NRG; PAM sequence: GAG
cgtgtaattgcagaacttgg

SEQ ID NO: 136141 - DNA, 20 bp, Artificial Sequence
  Description of Artificial Sequence: Synthetic oligonucleotide
  Target: ATXN1; (+) strand; PAM type: NRG; PAM sequence: TAG
taattgcagaacttgggagc

SEQ ID NO: 136142 - DNA, 20 bp, Artificial Sequence
  Description of Artificial Sequence: Synthetic oligonucleotide
  Target: ATXN1; (+) strand; PAM type: NRG; PAM sequence: TGG
gcagaacttgggagctagaa

SEQ ID NO: 136143 - DNA, 20 bp, Artificial Sequence
  Description of Artificial Sequence: Synthetic oligonucleotide
  Target: ATXN1; (+) strand; PAM type: NRG; PAM sequence: GAG
tgggagctagaatggacctt

SEQ ID NO: 136144 - DNA, 20 bp, Artificial Sequence
  Description of Artificial Sequence: Synthetic oligonucleotide
  Target: ATXN1; (+) strand; PAM type: NRG; PAM sequence: AGG
gggagctagaatggaccttg

SEQ ID NO: 136145 - DNA, 20 bp, Artificial Sequence
  Description of Artificial Sequence: Synthetic oligonucleotide
  Target: ATXN1; (+) strand; PAM type: NRG; PAM sequence: GAG
gagctagaatggaccttgag

SEQ ID NO: 136146 - DNA, 20 bp, Artificial Sequence
  Description of Artificial Sequence: Synthetic oligonucleotide
  Target: ATXN1; (+) strand; PAM type: NRG; PAM sequence: CAG
acgccaacgctttcacttca

SEQ ID NO: 136147 - DNA, 20 bp, Artificial Sequence
  Description of Artificial Sequence: Synthetic oligonucleotide
  Target: ATXN1; (+) strand; PAM type: NRG; PAM sequence: TAG
acgctttcacttcacagatg

SEQ ID NO: 136148 - DNA, 20 bp, Artificial Sequence
  Description of Artificial Sequence: Synthetic oligonucleotide
  Target: ATXN1; (+) strand; PAM type: NRG; PAM sequence: GAG
acttcacagatgtagacacc

SEQ ID NO: 136149 - DNA, 20 bp, Artificial Sequence
  Description of Artificial Sequence: Synthetic oligonucleotide
  Target: ATXN1; (+) strand; PAM type: NRG; PAM sequence: AGG
cttcacagatgtagacaccg

SEQ ID NO: 136150 - DNA, 20 bp, Artificial Sequence
  Description of Artificial Sequence: Synthetic oligonucleotide
  Target: ATXN1; (+) strand; PAM type: NRG; PAM sequence: AAG
gatgtagacaccgaggctta

SEQ ID NO: 136151 - DNA, 20 bp, Artificial Sequence
  Description of Artificial Sequence: Synthetic oligonucleotide
  Target: ATXN1; (+) strand; PAM type: NRG; PAM sequence: GAG
tgtagacaccgaggcttaaa

SEQ ID NO: 136152 - DNA, 20 bp, Artificial Sequence
  Description of Artificial Sequence: Synthetic oligonucleotide
  Target: ATXN1; (+) strand; PAM type: NRG; PAM sequence: AGG
gtagacaccgaggcttaaag

SEQ ID NO: 136153 - DNA, 20 bp, Artificial Sequence
  Description of Artificial Sequence: Synthetic oligonucleotide
  Target: ATXN1; (+) strand; PAM type: NRG; PAM sequence: GGG
tagacaccgaggcttaaaga

SEQ ID NO: 136154 - DNA, 20 bp, Artificial Sequence
  Description of Artificial Sequence: Synthetic oligonucleotide
  Target: ATXN1; (+) strand; PAM type: NRG; PAM sequence: AAG
aaagagggtatgactttccc

SEQ ID NO: 136155 - DNA, 20 bp, Artificial Sequence
  Description of Artificial Sequence: Synthetic oligonucleotide
  Target: ATXN1; (+) strand; PAM type: NRG; PAM sequence: AGG
aagagggtatgactttccca

SEQ ID NO: 136156 - DNA, 20 bp, Artificial Sequence
  Description of Artificial Sequence: Synthetic oligonucleotide
  Target: ATXN1; (+) strand; PAM type: NRG; PAM sequence: AAG
tatgactttcccaaggccac

SEQ ID NO: 136157 - DNA, 20 bp, Artificial Sequence
  Description of Artificial Sequence: Synthetic oligonucleotide
  Target: ATXN1; (+) strand; PAM type: NRG; PAM sequence: GAG
tgactttcccaaggccacaa

SEQ ID NO: 136158 - DNA, 20 bp, Artificial Sequence
  Description of Artificial Sequence: Synthetic oligonucleotide
  Target: ATXN1; (+) strand; PAM type: NRG; PAM sequence: AGG
gactttcccaaggccacaag

SEQ ID NO: 136159 - DNA, 20 bp, Artificial Sequence
  Description of Artificial Sequence: Synthetic oligonucleotide
  Target: ATXN1; (+) strand; PAM type: NRG; PAM sequence: TAG
tcccaaggccacaagaggac

SEQ ID NO: 136160 - DNA, 20 bp, Artificial Sequence
  Description of Artificial Sequence: Synthetic oligonucleotide
  Target: ATXN1; (+) strand; PAM type: NRG; PAM sequence: CAG
gccacaagaggactagttta

SEQ ID NO: 136161 - DNA, 20 bp, Artificial Sequence
  Description of Artificial Sequence: Synthetic oligonucleotide
  Target: ATXN1; (+) strand; PAM type: NRG; PAM sequence: CAG
acaagaggactagtttacag

SEQ ID NO: 136162 - DNA, 20 bp, Artificial Sequence
  Description of Artificial Sequence: Synthetic oligonucleotide
  Target: ATXN1; (+) strand; PAM type: NRG; PAM sequence: GAG
aagaggactagtttacagca

SEQ ID NO: 136163 - DNA, 20 bp, Artificial Sequence
  Description of Artificial Sequence: Synthetic oligonucleotide
  Target: ATXN1; (+) strand; PAM type: NRG; PAM sequence: TGG
ggactagtttacagcagagc

SEQ ID NO: 136164 - DNA, 20 bp, Artificial Sequence
  Description of Artificial Sequence: Synthetic oligonucleotide
  Target: ATXN1; (+) strand; PAM type: NRG; PAM sequence: GGG
gactagtttacagcagagct

SEQ ID NO: 136165 - DNA, 20 bp, Artificial Sequence
  Description of Artificial Sequence: Synthetic oligonucleotide
  Target: ATXN1; (+) strand; PAM type: NRG; PAM sequence: CAG
gcagagctgggcttatataa

SEQ ID NO: 136166 - DNA, 20 bp, Artificial Sequence
  Description of Artificial Sequence: Synthetic oligonucleotide
  Target: ATXN1; (+) strand; PAM type: NRG; PAM sequence: AGG
cagagctgggcttatataac

SEQ ID NO: 136167 - DNA, 20 bp, Artificial Sequence
  Description of Artificial Sequence: Synthetic oligonucleotide
  Target: ATXN1; (+) strand; PAM type: NRG; PAM sequence: GGG
agagctgggcttatataaca

SEQ ID NO: 136168 - DNA, 20 bp, Artificial Sequence
  Description of Artificial Sequence: Synthetic oligonucleotide
  Target: ATXN1; (+) strand; PAM type: NRG; PAM sequence: GAG
tatataacagggctgcccat

SEQ ID NO: 136169 - DNA, 20 bp, Artificial Sequence
  Description of Artificial Sequence: Synthetic oligonucleotide
  Target: ATXN1; (+) strand; PAM type: NRG; PAM sequence: AAG
gggctgcccatgagccctgc

SEQ ID NO: 136170 - DNA, 20 bp, Artificial Sequence
  Description of Artificial Sequence: Synthetic oligonucleotide
  Target: ATXN1; (+) strand; PAM type: NRG; PAM sequence: AGG
ggctgcccatgagccctgca

SEQ ID NO: 136171 - DNA, 20 bp, Artificial Sequence
  Description of Artificial Sequence: Synthetic oligonucleotide
  Target: ATXN1; (+) strand; PAM type: NRG; PAM sequence: CAG
ccatgagccctgcaaggctc

SEQ ID NO: 136172 - DNA, 20 bp, Artificial Sequence
  Description of Artificial Sequence: Synthetic oligonucleotide
  Target: ATXN1; (+) strand; PAM type: NRG; PAM sequence: GAG
atgagccctgcaaggctcca

SEQ ID NO: 136173 - DNA, 20 bp, Artificial Sequence
  Description of Artificial Sequence: Synthetic oligonucleotide
  Target: ATXN1; (+) strand; PAM type: NRG; PAM sequence: AAG
aaggctccagagctattctt

SEQ ID NO: 136174 - DNA, 20 bp, Artificial Sequence
  Description of Artificial Sequence: Synthetic oligonucleotide
  Target: ATXN1; (+) strand; PAM type: NRG; PAM sequence: TAG
ttcttaagatcctctgcact

SEQ ID NO: 136175 - DNA, 20 bp, Artificial Sequence
  Description of Artificial Sequence: Synthetic oligonucleotide
  Target: ATXN1; (+) strand; PAM type: NRG; PAM sequence: CAG
tctgcacttagacaatgctg

SEQ ID NO: 136176 - DNA, 20 bp, Artificial Sequence
  Description of Artificial Sequence: Synthetic oligonucleotide
  Target: ATXN1; (+) strand; PAM type: NRG; PAM sequence: AGG
ctgcacttagacaatgctgc

SEQ ID NO: 136177 - DNA, 20 bp, Artificial Sequence
  Description of Artificial Sequence: Synthetic oligonucleotide
  Target: ATXN1; (+) strand; PAM type: NRG; PAM sequence: GGG
tgcacttagacaatgctgca

SEQ ID NO: 136178 - DNA, 20 bp, Artificial Sequence
  Description of Artificial Sequence: Synthetic oligonucleotide
  Target: ATXN1; (+) strand; PAM type: NRG; PAM sequence: AAG
cactctcttctttattttgt

SEQ ID NO: 136179 - DNA, 20 bp, Artificial Sequence
  Description of Artificial Sequence: Synthetic oligonucleotide
  Target: ATXN1; (+) strand; PAM type: NRG; PAM sequence: AAG
tcacaattcaaaattattca

SEQ ID NO: 136180 - DNA, 20 bp, Artificial Sequence
  Description of Artificial Sequence: Synthetic oligonucleotide
  Target: ATXN1; (+) strand; PAM type: NRG; PAM sequence: GAG
acaattcaaaattattcaaa

SEQ ID NO: 136181 - DNA, 20 bp, Artificial Sequence
  Description of Artificial Sequence: Synthetic oligonucleotide
  Target: ATXN1; (+) strand; PAM type: NRG; PAM sequence: TGG
tcaaaattattcaaagagaa

SEQ ID NO: 136182 - DNA, 20 bp, Artificial Sequence
  Description of Artificial Sequence: Synthetic oligonucleotide
  Target: ATXN1; (+) strand; PAM type: NRG; PAM sequence: GGG
caaaattattcaaagagaat

SEQ ID NO: 136183 - DNA, 20 bp, Artificial Sequence
  Description of Artificial Sequence: Synthetic oligonucleotide
  Target: ATXN1; (+) strand; PAM type: NRG; PAM sequence: CAG
tattcaaagagaatgggaaa

SEQ ID NO: 136184 - DNA, 20 bp, Artificial Sequence
  Description of Artificial Sequence: Synthetic oligonucleotide
  Target: ATXN1; (+) strand; PAM type: NRG; PAM sequence: AGG
attcaaagagaatgggaaac

SEQ ID NO: 136185 - DNA, 20 bp, Artificial Sequence
  Description of Artificial Sequence: Synthetic oligonucleotide
  Target: ATXN1; (+) strand; PAM type: NRG; PAM sequence: TGG
tgggaaacaggtatgatgca

SEQ ID NO: 136186 - DNA, 20 bp, Artificial Sequence
  Description of Artificial Sequence: Synthetic oligonucleotide
  Target: ATXN1; (+) strand; PAM type: NRG; PAM sequence: GGG
gggaaacaggtatgatgcat

SEQ ID NO: 136187 - DNA, 20 bp, Artificial Sequence
  Description of Artificial Sequence: Synthetic oligonucleotide
  Target: ATXN1; (+) strand; PAM type: NRG; PAM sequence: GGG
ggaaacaggtatgatgcatg

SEQ ID NO: 136188 - DNA, 20 bp, Artificial Sequence
  Description of Artificial Sequence: Synthetic oligonucleotide
  Target: ATXN1; (+) strand; PAM type: NRG; PAM sequence: GGG
gaaacaggtatgatgcatgg

SEQ ID NO: 136189 - DNA, 20 bp, Artificial Sequence
  Description of Artificial Sequence: Synthetic oligonucleotide
  Target: ATXN1; (+) strand; PAM type: NRG; PAM sequence: AAG
acaggtatgatgcatggggg

SEQ ID NO: 136190 - DNA, 20 bp, Artificial Sequence
  Description of Artificial Sequence: Synthetic oligonucleotide
  Target: ATXN1; (+) strand; PAM type: NRG; PAM sequence: GAG
aggtatgatgcatgggggaa

SEQ ID NO: 136191 - DNA, 20 bp, Artificial Sequence
  Description of Artificial Sequence: Synthetic oligonucleotide
  Target: ATXN1; (+) strand; PAM type: NRG; PAM sequence: AGG
ggtatgatgcatgggggaag

SEQ ID NO: 136192 - DNA, 20 bp, Artificial Sequence
  Description of Artificial Sequence: Synthetic oligonucleotide
  Target: ATXN1; (+) strand; PAM type: NRG; PAM sequence: CAG
catgggggaagaggtatgct

SEQ ID NO: 136193 - DNA, 20 bp, Artificial Sequence
  Description of Artificial Sequence: Synthetic oligonucleotide
  Target: ATXN1; (+) strand; PAM type: NRG; PAM sequence: AGG
atgggggaagaggtatgctc

SEQ ID NO: 136194 - DNA, 20 bp, Artificial Sequence
  Description of Artificial Sequence: Synthetic oligonucleotide
  Target: ATXN1; (+) strand; PAM type: NRG; PAM sequence: GGG
tgggggaagaggtatgctca

SEQ ID NO: 136195 - DNA, 20 bp, Artificial Sequence
  Description of Artificial Sequence: Synthetic oligonucleotide
  Target: ATXN1; (+) strand; PAM type: NRG; PAM sequence: CAG
aagaggtatgctcagggatt

SEQ ID NO: 136196 - DNA, 20 bp, Artificial Sequence
  Description of Artificial Sequence: Synthetic oligonucleotide
  Target: ATXN1; (+) strand; PAM type: NRG; PAM sequence: TGG
atgctcagggattcagatgc

SEQ ID NO: 136197 - DNA, 20 bp, Artificial Sequence
  Description of Artificial Sequence: Synthetic oligonucleotide
  Target: ATXN1; (+) strand; PAM type: NRG; PAM sequence: GAG
gctcagggattcagatgctg

SEQ ID NO: 136198 - DNA, 20 bp, Artificial Sequence
  Description of Artificial Sequence: Synthetic oligonucleotide
  Target: ATXN1; (+) strand; PAM type: NRG; PAM sequence: TGG
gattcagatgctggagctct

SEQ ID NO: 136199 - DNA, 20 bp, Artificial Sequence
  Description of Artificial Sequence: Synthetic oligonucleotide
  Target: ATXN1; (+) strand; PAM type: NRG; PAM sequence: AAG
agatgctggagctcttggtt

SEQ ID NO: 136200 - DNA, 20 bp, Artificial Sequence
  Description of Artificial Sequence: Synthetic oligonucleotide
  Target: ATXN1; (+) strand; PAM type: NRG; PAM sequence: TGG
gctcttggttaagcaacttt

SEQ ID NO: 136201 - DNA, 20 bp, Artificial Sequence
  Description of Artificial Sequence: Synthetic oligonucleotide
  Target: ATXN1; (+) strand; PAM type: NRG; PAM sequence: TAG
cttttggatcatatgatact

SEQ ID NO: 136202 - DNA, 20 bp, Artificial Sequence
  Description of Artificial Sequence: Synthetic oligonucleotide
  Target: ATXN1; (+) strand; PAM type: NRG; PAM sequence: AAG
ttggatcatatgatacttag

SEQ ID NO: 136203 - DNA, 20 bp, Artificial Sequence
  Description of Artificial Sequence: Synthetic oligonucleotide
  Target: ATXN1; (+) strand; PAM type: NRG; PAM sequence: CAG
agaagaactaccatctctct

SEQ ID NO: 136204 - DNA, 20 bp, Artificial Sequence
  Description of Artificial Sequence: Synthetic oligonucleotide
  Target: ATXN1; (+) strand; PAM type: NRG; PAM sequence: AAG
gaactaccatctctctcagt

SEQ ID NO: 136205 - DNA, 20 bp, Artificial Sequence
  Description of Artificial Sequence: Synthetic oligonucleotide
  Target: ATXN1; (+) strand; PAM type: NRG; PAM sequence: AAG
ctaccatctctctcagtaag

SEQ ID NO: 136206 - DNA, 20 bp, Artificial Sequence
  Description of Artificial Sequence: Synthetic oligonucleotide
  Target: ATXN1; (+) strand; PAM type: NRG; PAM sequence: TAG
atctctctcagtaagaagat

SEQ ID NO: 136207 - DNA, 20 bp, Artificial Sequence
  Description of Artificial Sequence: Synthetic oligonucleotide
  Target: ATXN1; (+) strand; PAM type: NRG; PAM sequence: CAG
tctctcagtaagaagattag

SEQ ID NO: 136208 - DNA, 20 bp, Artificial Sequence
  Description of Artificial Sequence: Synthetic oligonucleotide
  Target: ATXN1; (+) strand; PAM type: NRG; PAM sequence: AGG
ctctcagtaagaagattagc

SEQ ID NO: 136209 - DNA, 20 bp, Artificial Sequence
  Description of Artificial Sequence: Synthetic oligonucleotide
  Target: ATXN1; (+) strand; PAM type: NRG; PAM sequence: GAG
ctcagtaagaagattagcag

SEQ ID NO: 136210 - DNA, 20 bp, Artificial Sequence
  Description of Artificial Sequence: Synthetic oligonucleotide
  Target: ATXN1; (+) strand; PAM type: NRG; PAM sequence: TGG
gattagcaggagaatacata

SEQ ID NO: 136211 - DNA, 20 bp, Artificial Sequence
  Description of Artificial Sequence: Synthetic oligonucleotide
  Target: ATXN1; (+) strand; PAM type: NRG; PAM sequence: CAG
gcaggagaatacatatggta

SEQ ID NO: 136212 - DNA, 20 bp, Artificial Sequence
  Description of Artificial Sequence: Synthetic oligonucleotide
  Target: ATXN1; (+) strand; PAM type: NRG; PAM sequence: TAG
ggagaatacatatggtacag

SEQ ID NO: 136213 - DNA, 20 bp, Artificial Sequence
  Description of Artificial Sequence: Synthetic oligonucleotide
  Target: ATXN1; (+) strand; PAM type: NRG; PAM sequence: CAG
tatggtacagtagaaaaatg

SEQ ID NO: 136214 - DNA, 20 bp, Artificial Sequence
  Description of Artificial Sequence: Synthetic oligonucleotide
  Target: ATXN1; (+) strand; PAM type: NRG; PAM sequence: AGG
atggtacagtagaaaaatgc

SEQ ID NO: 136215 - DNA, 20 bp, Artificial Sequence
  Description of Artificial Sequence: Synthetic oligonucleotide
  Target: ATXN1; (+) strand; PAM type: NRG; PAM sequence: AAG
tagaaaaatgcaggttattc

SEQ ID NO: 136216 - DNA, 20 bp, Artificial Sequence
  Description of Artificial Sequence: Synthetic oligonucleotide
  Target: ATXN1; (+) strand; PAM type: NRG; PAM sequence: CAG
aaaaatgcaggttattcaag

SEQ ID NO: 136217 - DNA, 20 bp, Artificial Sequence
  Description of Artificial Sequence: Synthetic oligonucleotide
  Target: ATXN1; (+) strand; PAM type: NRG; PAM sequence: TAG
ggttattcaagcagtgaccc

SEQ ID NO: 136218 - DNA, 20 bp, Artificial Sequence
  Description of Artificial Sequence: Synthetic oligonucleotide
  Target: ATXN1; (+) strand; PAM type: NRG; PAM sequence: AGG
gttattcaagcagtgaccct

SEQ ID NO: 136219 - DNA, 20 bp, Artificial Sequence
  Description of Artificial Sequence: Synthetic oligonucleotide
  Target: ATXN1; (+) strand; PAM type: NRG; PAM sequence: GAG
tcaagcagtgaccctaggat

SEQ ID NO: 136220 - DNA, 20 bp, Artificial Sequence
  Description of Artificial Sequence: Synthetic oligonucleotide
  Target: ATXN1; (+) strand; PAM type: NRG; PAM sequence: AAG
tgaccctaggatgagcctca

SEQ ID NO: 136221 - DNA, 20 bp, Artificial Sequence
  Description of Artificial Sequence: Synthetic oligonucleotide
  Target: ATXN1; (+) strand; PAM type: NRG; PAM sequence: TAG
ggatgagcctcaaagcttac

SEQ ID NO: 136222 - DNA, 20 bp, Artificial Sequence
  Description of Artificial Sequence: Synthetic oligonucleotide
  Target: ATXN1; (+) strand; PAM type: NRG; PAM sequence: TGG
ctcaaagcttactagctatg

SEQ ID NO: 136223 - DNA, 20 bp, Artificial Sequence
  Description of Artificial Sequence: Synthetic oligonucleotide
  Target: ATXN1; (+) strand; PAM type: NRG; PAM sequence: TGG
agcttactagctatgtggtc

SEQ ID NO: 136224 - DNA, 20 bp, Artificial Sequence
  Description of Artificial Sequence: Synthetic oligonucleotide
  Target: ATXN1; (+) strand; PAM type: NRG; PAM sequence: AAG
ctagctatgtggtctggaac

SEQ ID NO: 136225 - DNA, 20 bp, Artificial Sequence
  Description of Artificial Sequence: Synthetic oligonucleotide
  Target: ATXN1; (+) strand; PAM type: NRG; PAM sequence: TAG
atgtggtctggaacaagcta

SEQ ID NO: 136226 - DNA, 20 bp, Artificial Sequence
  Description of Artificial Sequence: Synthetic oligonucleotide
  Target: ATXN1; (+) strand; PAM type: NRG; PAM sequence: CGG
aacaagctatagaaacttgc

SEQ ID NO: 136227 - DNA, 20 bp, Artificial Sequence
  Description of Artificial Sequence: Synthetic oligonucleotide
  Target: ATXN1; (+) strand; PAM type: NRG; PAM sequence: GGG
acaagctatagaaacttgcc

SEQ ID NO: 136228 - DNA, 20 bp, Artificial Sequence
  Description of Artificial Sequence: Synthetic oligonucleotide
  Target: ATXN1; (+) strand; PAM type: NRG; PAM sequence: TGG
atattcccttaaccgtaaaa

SEQ ID NO: 136229 - DNA, 20 bp, Artificial Sequence
  Description of Artificial Sequence: Synthetic oligonucleotide
  Target: ATXN1; (+) strand; PAM type: NRG; PAM sequence: AAG
cccttaaccgtaaaatggcc

SEQ ID NO: 136230 - DNA, 20 bp, Artificial Sequence
  Description of Artificial Sequence: Synthetic oligonucleotide
  Target: ATXN1; (+) strand; PAM type: NRG; PAM sequence: CAG
gccaagataacgatactgac

SEQ ID NO: 136231 - DNA, 20 bp, Artificial Sequence
  Description of Artificial Sequence: Synthetic oligonucleotide
  Target: ATXN1; (+) strand; PAM type: NRG; PAM sequence: AGG
ccaagataacgatactgacc

SEQ ID NO: 136232 - DNA, 20 bp, Artificial Sequence
  Description of Artificial Sequence: Synthetic oligonucleotide
  Target: ATXN1; (+) strand; PAM type: NRG; PAM sequence: TAG
ataacgatactgaccaggtg

SEQ ID NO: 136233 - DNA, 20 bp, Artificial Sequence
  Description of Artificial Sequence: Synthetic oligonucleotide
  Target: ATXN1; (+) strand; PAM type: NRG; PAM sequence: CAG
gtgtctcatgcctataatcc

SEQ ID NO: 136234 - DNA, 20 bp, Artificial Sequence
  Description of Artificial Sequence: Synthetic oligonucleotide
  Target: ATXN1; (+) strand; PAM type: NRG; PAM sequence: TGG
tgcctataatcccagcactt

SEQ ID NO: 136235 - DNA, 20 bp, Artificial Sequence
  Description of Artificial Sequence: Synthetic oligonucleotide
  Target: ATXN1; (+) strand; PAM type: NRG; PAM sequence: GGG
gcctataatcccagcacttt

SEQ ID NO: 136236 - DNA, 20 bp, Artificial Sequence
  Description of Artificial Sequence: Synthetic oligonucleotide
  Target: ATXN1; (+) strand; PAM type: NRG; PAM sequence: GAG
ctataatcccagcactttgg

SEQ ID NO: 136237 - DNA, 20 bp, Artificial Sequence
  Description of Artificial Sequence: Synthetic oligonucleotide
  Target: ATXN1; (+) strand; PAM type: NRG; PAM sequence: AGG
tataatcccagcactttggg

SEQ ID NO: 136238 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggct

SEQ ID NO: 136239 - DNA, 20 bp, Artificial Sequence
  Description of Artificial Sequence: Synthetic oligonucleotide
  Target: ATXN1; (+) strand; PAM type: NRG; PAM sequence: TGG
agcactttgggaggctgaga

SEQ ID NO: 136240 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggctgagat

SEQ ID NO: 136241 - DNA, 20 bp, Artificial Sequence
  Description of Artificial Sequence: Synthetic oligonucleotide
  Target: ATXN1; (+) strand; PAM type: NRG; PAM sequence: GAG
actttgggaggctgagatgg

SEQ ID NO: 136242 - DNA, 20 bp, Artificial Sequence
  Description of Artificial Sequence: Synthetic oligonucleotide
  Target: ATXN1; (+) strand; PAM type: NRG; PAM sequence: AGG
ctttgggaggctgagatggg

SEQ ID NO: 136243 - DNA, 20 bp, Artificial Sequence
  Description of Artificial Sequence: Synthetic oligonucleotide
  Target: ATXN1; (+) strand; PAM type: NRG; PAM sequence: GAG
ctgagatgggaggatcactt

SEQ ID NO: 136244 - DNA, 20 bp, Artificial Sequence
  Description of Artificial Sequence: Synthetic oligonucleotide
  Target: ATXN1; (+) strand; PAM type: NRG; PAM sequence: CAG
atgggaggatcacttgagcc

SEQ ID NO: 136245 - DNA, 20 bp, Artificial Sequence
  Description of Artificial Sequence: Synthetic oligonucleotide
  Target: ATXN1; (+) strand; PAM type: NRG; PAM sequence: AGG
tgggaggatcacttgagccc

SEQ ID NO: 136246 - DNA, 20 bp, Artificial Sequence
  Description of Artificial Sequence: Synthetic oligonucleotide
  Target: ATXN1; (+) strand; PAM type: NRG; PAM sequence: GAG
ggaggatcacttgagcccag

SEQ ID NO: 136247 - DNA, 20 bp, Artificial Sequence
  Description of Artificial Sequence: Synthetic oligonucleotide
  Target: ATXN1; (+) strand; PAM type: NRG; PAM sequence: AAG
tcacttgagcccaggagttc

SEQ ID NO: 136248 - DNA, 20 bp, Artificial Sequence
  Description of Artificial Sequence: Synthetic oligonucleotide
  Target: ATXN1; (+) strand; PAM type: NRG; PAM sequence: CAG
tgagcccaggagttcaagac

SEQ ID NO: 136249 - DNA, 20 bp, Artificial Sequence
  Description of Artificial Sequence: Synthetic oligonucleotide
  Target: ATXN1; (+) strand; PAM type: NRG; PAM sequence: TGG
ccaggagttcaagaccagcc

SEQ ID NO: 136250 - DNA, 20 bp, Artificial Sequence
  Description of Artificial Sequence: Synthetic oligonucleotide
  Target: ATXN1; (+) strand; PAM type: NRG; PAM sequence: GGG
caggagttcaagaccagcct

SEQ ID NO: 136251 - DNA, 20 bp, Artificial Sequence
  Description of Artificial Sequence: Synthetic oligonucleotide
  Target: ATXN1; (+) strand; PAM type: NRG; PAM sequence: GAG
gaccagcctgggaaacatgt

SEQ ID NO: 136252 - DNA, 20 bp, Artificial Sequence
  Description of Artificial Sequence: Synthetic oligonucleotide
  Target: ATXN1; (+) strand; PAM type: NRG; PAM sequence: TAG
acaaataatgtttaaaaaat

SEQ ID NO: 136253 - DNA, 20 bp, Artificial Sequence
  Description of Artificial Sequence: Synthetic oligonucleotide
  Target: ATXN1; (+) strand; PAM type: NRG; PAM sequence: CAG
ataatgtttaaaaaattagc

SEQ ID NO: 136254 - DNA, 20 bp, Artificial Sequence
  Description of Artificial Sequence: Synthetic oligonucleotide
  Target: ATXN1; (+) strand; PAM type: NRG; PAM sequence: AGG
taatgtttaaaaaattagcc

SEQ ID NO: 136255 - DNA, 20 bp, Artificial Sequence
  Description of Artificial Sequence: Synthetic oligonucleotide
  Target: ATXN1; (+) strand; PAM type: NRG; PAM sequence: TGG
tttaaaaaattagccaggtg

SEQ ID NO: 136256 - DNA, 20 bp, Artificial Sequence
  Description of Artificial Sequence: Synthetic oligonucleotide
  Target: ATXN1; (+) strand; PAM type: NRG; PAM sequence: TGG
aaaaaattagccaggtgtgg

SEQ ID NO: 136257 - DNA, 20 bp, Artificial Sequence
  Description of Artificial Sequence: Synthetic oligonucleotide
  Target: ATXN1; (+) strand; PAM type: NRG; PAM sequence: TAG
ggtgtggtggcacgtacata

SEQ ID NO: 136258 - DNA, 20 bp, Artificial Sequence
  Description of Artificial Sequence: Synthetic oligonucleotide
  Target: ATXN1; (+) strand; PAM type: NRG; PAM sequence: CAG
ggtggcacgtacatatagtc

SEQ ID NO: 136259 - DNA, 20 bp, Artificial Sequence
  Description of Artificial Sequence: Synthetic oligonucleotide
  Target: ATXN1; (+) strand; PAM type: NRG; PAM sequence: CAG
gtacatatagtccagatact

SEQ ID NO: 136260 - DNA, 20 bp, Artificial Sequence
  Description of Artificial Sequence: Synthetic oligonucleotide
  Target: ATXN1; (+) strand; PAM type: NRG; PAM sequence: AGG
tacatatagtccagatactc

SEQ ID NO: 136261 - DNA, 20 bp, Artificial Sequence
  Description of Artificial Sequence: Synthetic oligonucleotide
  Target: ATXN1; (+) strand; PAM type: NRG; PAM sequence: GAG
catatagtccagatactcag

SEQ ID NO: 136262 - DNA, 20 bp, Artificial Sequence
  Description of Artificial Sequence: Synthetic oligonucleotide
  Target: ATXN1; (+) strand; PAM type: NRG; PAM sequence: AGG
atatagtccagatactcagg

SEQ ID NO: 136263 - DNA, 20 bp, Artificial Sequence
  Description of Artificial Sequence: Synthetic oligonucleotide
  Target: ATXN1; (+) strand; PAM type: NRG; PAM sequence: GAG
gtccagatactcaggaggat

SEQ ID NO: 136264 - DNA, 20 bp, Artificial Sequence
  Description of Artificial Sequence: Synthetic oligonucleotide
  Target: ATXN1; (+) strand; PAM type: NRG; PAM sequence: AGG
tccagatactcaggaggatg

SEQ ID NO: 136265 - DNA, 20 bp, Artificial Sequence
  Description of Artificial Sequence: Synthetic oligonucleotide
  Target: ATXN1; (+) strand; PAM type: NRG; PAM sequence: TGG
agatactcaggaggatgagg

SEQ ID NO: 136266 - DNA, 20 bp, Artificial Sequence
  Description of Artificial Sequence: Synthetic oligonucleotide
  Target: ATXN1; (+) strand; PAM type: NRG; PAM sequence: GGG
gatactcaggaggatgaggt

SEQ ID NO: 136267 - DNA, 20 bp, Artificial Sequence
  Description of Artificial Sequence: Synthetic oligonucleotide
  Target: ATXN1; (+) strand; PAM type: NRG; PAM sequence: GGG
atactcaggaggatgaggtg

SEQ ID NO: 136268 - DNA, 20 bp, Artificial Sequence
  Description of Artificial Sequence: Synthetic oligonucleotide
  Target: ATXN1; (+) strand; PAM type: NRG; PAM sequence: GGG
tactcaggaggatgaggtgg

SEQ ID NO: 136269 - DNA, 20 bp, Artificial Sequence
  Description of Artificial Sequence: Synthetic oligonucleotide
  Target: ATXN1; (+) strand; PAM type: NRG; PAM sequence: GGG
actcaggaggatgaggtggg

SEQ ID NO: 136270 - DNA, 20 bp, Artificial Sequence
  Description of Artificial Sequence: Synthetic oligonucleotide
  Target: ATXN1; (+) strand; PAM type: NRG; PAM sequence: CAG
gtggggggatcgcttgaacc

SEQ ID NO: 136271 - DNA, 20 bp, Artificial Sequence
  Description of Artificial Sequence: Synthetic oligonucleotide
  Target: ATXN1; (+) strand; PAM type: NRG; PAM sequence: AGG
tggggggatcgcttgaaccc

SEQ ID NO: 136272 - DNA, 20 bp, Artificial Sequence
  Description of Artificial Sequence: Synthetic oligonucleotide
  Target: ATXN1; (+) strand; PAM type: NRG; PAM sequence: GAG
gggggatcgcttgaacccag

SEQ ID NO: 136273 - DNA, 20 bp, Artificial Sequence
  Description of Artificial Sequence: Synthetic oligonucleotide
  Target: ATXN1; (+) strand; PAM type: NRG; PAM sequence: AAG
tcgcttgaacccaggagttc

SEQ ID NO: 136274 - DNA, 20 bp, Artificial Sequence
  Description of Artificial Sequence: Synthetic oligonucleotide
  Target: ATXN1; (+) strand; PAM type: NRG; PAM sequence: AGG
cgcttgaacccaggagttca

SEQ ID NO: 136275 - DNA, 20 bp, Artificial Sequence
  Description of Artificial Sequence: Synthetic oligonucleotide
  Target: ATXN1; (+) strand; PAM type: NRG; PAM sequence: GAG
caggagttcaaggctgctgt

SEQ ID NO: 136276 - DNA, 20 bp, Artificial Sequence
  Description of Artificial Sequence: Synthetic oligonucleotide
  Target: ATXN1; (+) strand; PAM type: NRG; PAM sequence: AGG
aggagttcaaggctgctgtg

SEQ ID NO: 136277 - DNA, 20 bp, Artificial Sequence
  Description of Artificial Sequence: Synthetic oligonucleotide
  Target: ATXN1; (+) strand; PAM type: NRG; PAM sequence: CAG
acaatcacgccactgcactc

SEQ ID NO: 136278 - DNA, 20 bp, Artificial Sequence
  Description of Artificial Sequence: Synthetic oligonucleotide
  Target: ATXN1; (+) strand; PAM type: NRG; PAM sequence: TGG
cacgccactgcactccagcc

SEQ ID NO: 136279 - DNA, 20 bp, Artificial Sequence
  Description of Artificial Sequence: Synthetic oligonucleotide
  Target: ATXN1; (+) strand; PAM type: NRG; PAM sequence: GAG
cgccactgcactccagcctg

SEQ ID NO: 136280 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctggagta

SEQ ID NO: 136281 - DNA, 20 bp, Artificial Sequence
  Description of Artificial Sequence: Synthetic oligonucleotide
  Target: ATXN1; (+) strand; PAM type: NRG; PAM sequence: TGG
tggagtacagtgtgtcactc

SEQ ID NO: 136282 - DNA, 20 bp, Artificial Sequence
  Description of Artificial Sequence: Synthetic oligonucleotide
  Target: ATXN1; (+) strand; PAM type: NRG; PAM sequence: GAG
gagtacagtgtgtcactctg

SEQ ID NO: 136283 - DNA, 20 bp, Artificial Sequence
  Description of Artificial Sequence: Synthetic oligonucleotide
  Target: ATXN1; (+) strand; PAM type: NRG; PAM sequence: CAG
acagtgtgtcactctggaga

SEQ ID NO: 136284 - DNA, 20 bp, Artificial Sequence
  Description of Artificial Sequence: Synthetic oligonucleotide
  Target: ATXN1; (+) strand; PAM type: NRG; PAM sequence: GAG
agtgtgtcactctggagaca

SEQ ID NO: 136285 - DNA, 20 bp, Artificial Sequence
  Description of Artificial Sequence: Synthetic oligonucleotide
  Target: ATXN1; (+) strand; PAM type: NRG; PAM sequence: GAG
tgtcactctggagacagagc

SEQ ID NO: 136286 - DNA, 20 bp, Artificial Sequence
  Description of Artificial Sequence: Synthetic oligonucleotide
  Target: ATXN1; (+) strand; PAM type: NRG; PAM sequence: AAG
ctcaaaaacaaacaaacaaa

SEQ ID NO: 136287 - DNA, 20 bp, Artificial Sequence
  Description of Artificial Sequence: Synthetic oligonucleotide
  Target: ATXN1; (+) strand; PAM type: NRG; PAM sequence: AAG
aaagaatgacaattaactca

SEQ ID NO: 136288 - DNA, 20 bp, Artificial Sequence
  Description of Artificial Sequence: Synthetic oligonucleotide
  Target: ATXN1; (+) strand; PAM type: NRG; PAM sequence: GAG
agaatgacaattaactcaaa

SEQ ID NO: 136289 - DNA, 20 bp, Artificial Sequence
  Description of Artificial Sequence: Synthetic oligonucleotide
  Target: ATXN1; (+) strand; PAM type: NRG; PAM sequence: TGG
acaattaactcaaagagtta

SEQ ID NO: 136290 - DNA, 20 bp, Artificial Sequence
  Description of Artificial Sequence: Synthetic oligonucleotide
  Target: ATXN1; (+) strand; PAM type: NRG; PAM sequence: GGG
caattaactcaaagagttat

SEQ ID NO: 136291 - DNA, 20 bp, Artificial Sequence
  Description of Artificial Sequence: Synthetic oligonucleotide
  Target: ATXN1; (+) strand; PAM type: NRG; PAM sequence: GAG
aactcaaagagttatgggat

SEQ ID NO: 136292 - DNA, 20 bp, Artificial Sequence
  Description of Artificial Sequence: Synthetic oligonucleotide
  Target: ATXN1; (+) strand; PAM type: NRG; PAM sequence: AAG
aaagagttatgggatgagat

SEQ ID NO: 136293 - DNA, 20 bp, Artificial Sequence
  Description of Artificial Sequence: Synthetic oligonucleotide
  Target: ATXN1; (+) strand; PAM type: NRG; PAM sequence: AGG
aagagttatgggatgagata

SEQ ID NO: 136294 - DNA, 20 bp, Artificial Sequence
  Description of Artificial Sequence: Synthetic oligonucleotide
  Target: ATXN1; (+) strand; PAM type: NRG; PAM sequence: TAG
atgagataaggttctatatt

SEQ ID NO: 136295 - DNA, 20 bp, Artificial Sequence
  Description of Artificial Sequence: Synthetic oligonucleotide
  Target: ATXN1; (+) strand; PAM type: NRG; PAM sequence: TAG
ggttctatatttagaacacc

SEQ ID NO: 136296 - DNA, 20 bp, Artificial Sequence
  Description of Artificial Sequence: Synthetic oligonucleotide
  Target: ATXN1; (+) strand; PAM type: NRG; PAM sequence: CAG
tatatttagaacacctagca

SEQ ID NO: 136297 - DNA, 20 bp, Artificial Sequence
  Description of Artificial Sequence: Synthetic oligonucleotide
  Target: ATXN1; (+) strand; PAM type: NRG; PAM sequence: AGG
atatttagaacacctagcac

SEQ ID NO: 136298 - DNA, 20 bp, Artificial Sequence
  Description of Artificial Sequence: Synthetic oligonucleotide
  Target: ATXN1; (+) strand; PAM type: NRG; PAM sequence: TAG
agaacacctagcacaggaca

SEQ ID NO: 136299 - DNA, 20 bp, Artificial Sequence
  Description of Artificial Sequence: Synthetic oligonucleotide
  Target: ATXN1; (+) strand; PAM type: NRG; PAM sequence: AGG
gaacacctagcacaggacat

SEQ ID NO: 136300 - DNA, 20 bp, Artificial Sequence
  Description of Artificial Sequence: Synthetic oligonucleotide
  Target: ATXN1; (+) strand; PAM type: NRG; PAM sequence: CAG
acataggctcaatcaatatt

SEQ ID NO: 136301 - DNA, 20 bp, Artificial Sequence
  Description of Artificial Sequence: Synthetic oligonucleotide
  Target: ATXN1; (+) strand; PAM type: NRG; PAM sequence: TAG
ctttactatgtctccttaca

SEQ ID NO: 136302 - DNA, 20 bp, Artificial Sequence
  Description of Artificial Sequence: Synthetic oligonucleotide
  Target: ATXN1; (+) strand; PAM type: NRG; PAM sequence: AAG
tctccttacatagtgctgct

SEQ ID NO: 136303 - DNA, 20 bp, Artificial Sequence
  Description of Artificial Sequence: Synthetic oligonucleotide
  Target: ATXN1; (+) strand; PAM type: NRG; PAM sequence: AAG
cttacatagtgctgctaaga

SEQ ID NO: 136304 - DNA, 20 bp, Artificial Sequence
  Description of Artificial Sequence: Synthetic oligonucleotide
  Target: ATXN1; (+) strand; PAM type: NRG; PAM sequence: TGG
tcacctgcgaacacatgtga

SEQ ID NO: 136305 - DNA, 20 bp, Artificial Sequence
  Description of Artificial Sequence: Synthetic oligonucleotide
  Target: ATXN1; (+) strand; PAM type: NRG; PAM sequence: GGG
cacctgcgaacacatgtgat

SEQ ID NO: 136306 - DNA, 20 bp, Artificial Sequence
  Description of Artificial Sequence: Synthetic oligonucleotide
  Target: ATXN1; (+) strand; PAM type: NRG; PAM sequence: TGG
gaacacatgtgatgggtacc

SEQ ID NO: 136307 - DNA, 20 bp, Artificial Sequence
  Description of Artificial Sequence: Synthetic oligonucleotide
  Target: ATXN1; (+) strand; PAM type: NRG; PAM sequence: TGG
acatgtgatgggtacctgga

SEQ ID NO: 136308 - DNA, 20 bp, Artificial Sequence
  Description of Artificial Sequence: Synthetic oligonucleotide
  Target: ATXN1; (+) strand; PAM type: NRG; PAM sequence: AAG
ggatggtgaaacgtatttcc

SEQ ID NO: 136309 - DNA, 20 bp, Artificial Sequence
  Description of Artificial Sequence: Synthetic oligonucleotide
  Target: ATXN1; (+) strand; PAM type: NRG; PAM sequence: CAG
gtgaaacgtatttccaagac

SEQ ID NO: 136310 - DNA, 20 bp, Artificial Sequence
  Description of Artificial Sequence: Synthetic oligonucleotide
  Target: ATXN1; (+) strand; PAM type: NRG; PAM sequence: AGG
tgaaacgtatttccaagacc

SEQ ID NO: 136311 - DNA, 20 bp, Artificial Sequence
  Description of Artificial Sequence: Synthetic oligonucleotide
  Target: ATXN1; (+) strand; PAM type: NRG; PAM sequence: AAG
gtatttccaagaccaggtct

SEQ ID NO: 136312 - DNA, 20 bp, Artificial Sequence
  Description of Artificial Sequence: Synthetic oligonucleotide
  Target: ATXN1; (+) strand; PAM type: NRG; PAM sequence: TGG
accaggtctaagttatttca

SEQ ID NO: 136313 - DNA, 20 bp, Artificial Sequence
  Description of Artificial Sequence: Synthetic oligonucleotide
  Target: ATXN1; (+) strand; PAM type: NRG; PAM sequence: AAG
atgaaatctaatgttatctt

SEQ ID NO: 136314 - DNA, 20 bp, Artificial Sequence
  Description of Artificial Sequence: Synthetic oligonucleotide
  Target: ATXN1; (+) strand; PAM type: NRG; PAM sequence: AAG
taatgttatcttaagatcca

SEQ ID NO: 136315 - DNA, 20 bp, Artificial Sequence
  Description of Artificial Sequence: Synthetic oligonucleotide
  Target: ATXN1; (+) strand; PAM type: NRG; PAM sequence: CAG
ttatcttaagatccaaagtg

SEQ ID NO: 136316 - DNA, 20 bp, Artificial Sequence
  Description of Artificial Sequence: Synthetic oligonucleotide
  Target: ATXN1; (+) strand; PAM type: NRG; PAM sequence: GAG
atcttaagatccaaagtgca

SEQ ID NO: 136317 - DNA, 20 bp, Artificial Sequence
  Description of Artificial Sequence: Synthetic oligonucleotide
  Target: ATXN1; (+) strand; PAM type: NRG; PAM sequence: AGG
tcttaagatccaaagtgcag

SEQ ID NO: 136318 - DNA, 20 bp, Artificial Sequence
  Description of Artificial Sequence: Synthetic oligonucleotide
  Target: ATXN1; (+) strand; PAM type: NRG; PAM sequence: AAG
tccaaagtgcagaggatctt

SEQ ID NO: 136319 - DNA, 20 bp, Artificial Sequence
  Description of Artificial Sequence: Synthetic oligonucleotide
  Target: ATXN1; (+) strand; PAM type: NRG; PAM sequence: TAG
agtgcagaggatcttaagaa

SEQ ID NO: 136320 - DNA, 20 bp, Artificial Sequence
  Description of Artificial Sequence: Synthetic oligonucleotide
  Target: ATXN1; (+) strand; PAM type: NRG; PAM sequence: TGG
gaggatcttaagaatagctc

SEQ ID NO: 136321 - DNA, 20 bp, Artificial Sequence
  Description of Artificial Sequence: Synthetic oligonucleotide
  Target: ATXN1; (+) strand; PAM type: NRG; PAM sequence: GAG
ggatcttaagaatagctctg

SEQ ID NO: 136322 - DNA, 20 bp, Artificial Sequence
  Description of Artificial Sequence: Synthetic oligonucleotide
  Target: ATXN1; (+) strand; PAM type: NRG; PAM sequence: CAG
agaatagctctggagccatg

SEQ ID NO: 136323 - DNA, 20 bp, Artificial Sequence
  Description of Artificial Sequence: Synthetic oligonucleotide
  Target: ATXN1; (+) strand; PAM type: NRG; PAM sequence: AGG
gaatagctctggagccatgc

SEQ ID NO: 136324 - DNA, 20 bp, Artificial Sequence
  Description of Artificial Sequence: Synthetic oligonucleotide
  Target: ATXN1; (+) strand; PAM type: NRG; PAM sequence: GGG
aatagctctggagccatgca

SEQ ID NO: 136325 - DNA, 20 bp, Artificial Sequence
  Description of Artificial Sequence: Synthetic oligonucleotide
  Target: ATXN1; (+) strand; PAM type: NRG; PAM sequence: GGG
atagctctggagccatgcag

SEQ ID NO: 136326 - DNA, 20 bp, Artificial Sequence
  Description of Artificial Sequence: Synthetic oligonucleotide
  Target: ATXN1; (+) strand; PAM type: NRG; PAM sequence: TGG
tggagccatgcaggggataa

SEQ ID NO: 136327 - DNA, 20 bp, Artificial Sequence
  Description of Artificial Sequence: Synthetic oligonucleotide
  Target: ATXN1; (+) strand; PAM type: NRG; PAM sequence: GGG
ggagccatgcaggggataat

SEQ ID NO: 136328 - DNA, 20 bp, Artificial Sequence
  Description of Artificial Sequence: Synthetic oligonucleotide
  Target: ATXN1; (+) strand; PAM type: NRG; PAM sequence: CAG
gccatgcaggggataatggg

SEQ ID NO: 136329 - DNA, 20 bp, Artificial Sequence
  Description of Artificial Sequence: Synthetic oligonucleotide
  Target: ATXN1; (+) strand; PAM type: NRG; PAM sequence: TGG
tttgtttgttcgtttgtttg

SEQ ID NO: 136330 - DNA, 20 bp, Artificial Sequence
  Description of Artificial Sequence: Synthetic oligonucleotide
  Target: ATXN1; (+) strand; PAM type: NRG; PAM sequence: TGG
gtttgtggtttttttgtttg

SEQ ID NO: 136331 - DNA, 20 bp, Artificial Sequence
  Description of Artificial Sequence: Synthetic oligonucleotide
  Target: ATXN1; (+) strand; PAM type: NRG; PAM sequence: GGG
tttgtggtttttttgtttgt

SEQ ID NO: 136332 - DNA, 20 bp, Artificial Sequence
  Description of Artificial Sequence: Synthetic oligonucleotide
  Target: ATXN1; (+) strand; PAM type: NRG; PAM sequence: GAG
tttttttatttttatttttt

SEQ ID NO: 136333 - DNA, 20 bp, Artificial Sequence
  Description of Artificial Sequence: Synthetic oligonucleotide
  Target: ATXN1; (+) strand; PAM type: NRG; PAM sequence: CAG
tatttttattttttgagaca

SEQ ID NO: 136334 - DNA, 20 bp, Artificial Sequence
  Description of Artificial Sequence: Synthetic oligonucleotide
  Target: ATXN1; (+) strand; PAM type: NRG; PAM sequence: CAG
cacagtcttgctctgtcgcc

SEQ ID NO: 136335 - DNA, 20 bp, Artificial Sequence
  Description of Artificial Sequence: Synthetic oligonucleotide
  Target: ATXN1; (+) strand; PAM type: NRG; PAM sequence: AGG
acagtcttgctctgtcgccc

SEQ ID NO: 136336 - DNA, 20 bp, Artificial Sequence
  Description of Artificial Sequence: Synthetic oligonucleotide
  Target: ATXN1; (+) strand; PAM type: NRG; PAM sequence: TGG
tcttgctctgtcgcccaggc

SEQ ID NO: 136337 - DNA, 20 bp, Artificial Sequence
  Description of Artificial Sequence: Synthetic oligonucleotide
  Target: ATXN1; (+) strand; PAM type: NRG; PAM sequence: GAG
ttgctctgtcgcccaggctg

SEQ ID NO: 136338 - DNA, 20 bp, Artificial Sequence
  Description of Artificial Sequence: Synthetic oligonucleotide
  Target: ATXN1; (+) strand; PAM type: NRG; PAM sequence: CGG
ctgtcgcccaggctggagtc

SEQ ID NO: 136339 - DNA, 20 bp, Artificial Sequence
  Description of Artificial Sequence: Synthetic oligonucleotide
  Target: ATXN1; (+) strand; PAM type: NRG; PAM sequence: TGG
tcgcccaggctggagtccgg

SEQ ID NO: 136340 - DNA, 20 bp, Artificial Sequence
  Description of Artificial Sequence: Synthetic oligonucleotide
  Target: ATXN1; (+) strand; PAM type: NRG; PAM sequence: CGG
ggagtccggtggtgcgatct

SEQ ID NO: 136341 - DNA, 20 bp, Artificial Sequence
  Description of Artificial Sequence: Synthetic oligonucleotide
  Target: ATXN1; (+) strand; PAM type: NRG; PAM sequence: TGG
tcactgtgacctccgactcc

SEQ ID NO: 136342 - DNA, 20 bp, Artificial Sequence
  Description of Artificial Sequence: Synthetic oligonucleotide
  Target: ATXN1; (+) strand; PAM type: NRG; PAM sequence: GGG
cactgtgacctccgactcct

SEQ ID NO: 136343 - DNA, 20 bp, Artificial Sequence
  Description of Artificial Sequence: Synthetic oligonucleotide
  Target: ATXN1; (+) strand; PAM type: NRG; PAM sequence: AAG
gacctccgactcctgggttc

SEQ ID NO: 136344 - DNA, 20 bp, Artificial Sequence
  Description of Artificial Sequence: Synthetic oligonucleotide
  Target: ATXN1; (+) strand; PAM type: NRG; PAM sequence: CAG
ttcaagtgattctcctgcct

SEQ ID NO: 136345 - DNA, 20 bp, Artificial Sequence
  Description of Artificial Sequence: Synthetic oligonucleotide
  Target: ATXN1; (+) strand; PAM type: NRG; PAM sequence: AAG
ttctcctgcctcagcctccc

SEQ ID NO: 136346 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcccaag

SEQ ID NO: 136347 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaagtagc

SEQ ID NO: 136348 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaagtagct

SEQ ID NO: 136349 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtagctgggacta

SEQ ID NO: 136350 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagctgggactac

SEQ ID NO: 136351 - DNA, 20 bp, Artificial Sequence
  Description of Artificial Sequence: Synthetic oligonucleotide
  Target: ATXN1; (+) strand; PAM type: NRG; PAM sequence: TGG
caggcgcctgccaccaaacc

SEQ ID NO: 136352 - DNA, 20 bp, Artificial Sequence
  Description of Artificial Sequence: Synthetic oligonucleotide
  Target: ATXN1; (+) strand; PAM type: NRG; PAM sequence: TAG
tggctaattttttgtatttt

SEQ ID NO: 136353 - DNA, 20 bp, Artificial Sequence
  Description of Artificial Sequence: Synthetic oligonucleotide
  Target: ATXN1; (+) strand; PAM type: NRG; PAM sequence: TAG
ctaattttttgtatttttag

SEQ ID NO: 136354 - DNA, 20 bp, Artificial Sequence
  Description of Artificial Sequence: Synthetic oligonucleotide
  Target: ATXN1; (+) strand; PAM type: NRG; PAM sequence: GAG
aattttttgtatttttagta

SEQ ID NO: 136355 - DNA, 20 bp, Artificial Sequence
  Description of Artificial Sequence: Synthetic oligonucleotide
  Target: ATXN1; (+) strand; PAM type: NRG; PAM sequence: TGG
ttttgtatttttagtagaga

SEQ ID NO: 136356 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtagagat

SEQ ID NO: 136357 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagatg

SEQ ID NO: 136358 - DNA, 20 bp, Artificial Sequence
  Description of Artificial Sequence: Synthetic oligonucleotide
  Target: ATXN1; (+) strand; PAM type: NRG; PAM sequence: TAG
gagatggggtttcgccgtgt

SEQ ID NO: 136359 - DNA, 20 bp, Artificial Sequence
  Description of Artificial Sequence: Synthetic oligonucleotide
  Target: ATXN1; (+) strand; PAM type: NRG; PAM sequence: CAG
tggggtttcgccgtgttagc

SEQ ID NO: 136360 - DNA, 20 bp, Artificial Sequence
  Description of Artificial Sequence: Synthetic oligonucleotide
  Target: ATXN1; (+) strand; PAM type: NRG; PAM sequence: AGG
ggggtttcgccgtgttagcc

SEQ ID NO: 136361 - DNA, 20 bp, Artificial Sequence
  Description of Artificial Sequence: Synthetic oligonucleotide
  Target: ATXN1; (+) strand; PAM type: NRG; PAM sequence: CGG
tttcgccgtgttagccagga

SEQ ID NO: 136362 - DNA, 20 bp, Artificial Sequence
  Description of Artificial Sequence: Synthetic oligonucleotide
  Target: ATXN1; (+) strand; PAM type: NRG; PAM sequence: CAG
acctcgtgatccgcccgcct

SEQ ID NO: 136363 - DNA, 20 bp, Artificial Sequence
  Description of Artificial Sequence: Synthetic oligonucleotide
  Target: ATXN1; (+) strand; PAM type: NRG; PAM sequence: AAG
ccgcccgcctcagcctcccg

SEQ ID NO: 136364 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccgaagtgc

SEQ ID NO: 136365 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccgaagtgct

SEQ ID NO: 136366 - DNA, 20 bp, Artificial Sequence
  Description of Artificial Sequence: Synthetic oligonucleotide
  Target: ATXN1; (+) strand; PAM type: NRG; PAM sequence: AAG
tcccgaagtgctgggattac

SEQ ID NO: 136367 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaagcat

SEQ ID NO: 136368 - DNA, 20 bp, Artificial Sequence
  Description of Artificial Sequence: Synthetic oligonucleotide
  Target: ATXN1; (+) strand; PAM type: NRG; PAM sequence: CGG
caagcatgagccatcacgcc

SEQ ID NO: 136369 - DNA, 20 bp, Artificial Sequence
  Description of Artificial Sequence: Synthetic oligonucleotide
  Target: ATXN1; (+) strand; PAM type: NRG; PAM sequence: TGG
cccggccctaaattgaattt

SEQ ID NO: 136370 - DNA, 20 bp, Artificial Sequence
  Description of Artificial Sequence: Synthetic oligonucleotide
  Target: ATXN1; (+) strand; PAM type: NRG; PAM sequence: GGG
ccggccctaaattgaatttt

SEQ ID NO: 136371 - DNA, 20 bp, Artificial Sequence
  Description of Artificial Sequence: Synthetic oligonucleotide
  Target: ATXN1; (+) strand; PAM type: NRG; PAM sequence: GGG
cggccctaaattgaattttg

SEQ ID NO: 136372 - DNA, 20 bp, Artificial Sequence
  Description of Artificial Sequence: Synthetic oligonucleotide
  Target: ATXN1; (+) strand; PAM type: NRG; PAM sequence: GGG
ggccctaaattgaattttgg

SEQ ID NO: 136373 - DNA, 20 bp, Artificial Sequence
  Description of Artificial Sequence: Synthetic oligonucleotide
  Target: ATXN1; (+) strand; PAM type: NRG; PAM sequence: AAG
ctaaattgaattttggggga

SEQ ID NO: 136374 - DNA, 20 bp, Artificial Sequence
  Description of Artificial Sequence: Synthetic oligonucleotide
  Target: ATXN1; (+) strand; PAM type: NRG; PAM sequence: CAG
gaattttgggggaaagtata

SEQ ID NO: 136375 - DNA, 20 bp, Artificial Sequence
  Description of Artificial Sequence: Synthetic oligonucleotide
  Target: ATXN1; (+) strand; PAM type: NRG; PAM sequence: GAG
gggaaagtatacagttccat

SEQ ID NO: 136376 - DNA, 20 bp, Artificial Sequence
  Description of Artificial Sequence: Synthetic oligonucleotide
  Target: ATXN1; (+) strand; PAM type: NRG; PAM sequence: GAG
tgtgttgtttgtttgttttt

SEQ ID NO: 136377 - DNA, 20 bp, Artificial Sequence
  Description of Artificial Sequence: Synthetic oligonucleotide
  Target: ATXN1; (+) strand; PAM type: NRG; PAM sequence: CGG
ttgtttgtttgtttttgaga

SEQ ID NO: 136378 - DNA, 20 bp, Artificial Sequence
  Description of Artificial Sequence: Synthetic oligonucleotide
  Target: ATXN1; (+) strand; PAM type: NRG; PAM sequence: CAG
ggacttttgctcttattgcg

SEQ ID NO: 136379 - DNA, 20 bp, Artificial Sequence
  Description of Artificial Sequence: Synthetic oligonucleotide
  Target: ATXN1; (+) strand; PAM type: NRG; PAM sequence: AGG
gacttttgctcttattgcgc

SEQ ID NO: 136380 - DNA, 20 bp, Artificial Sequence
  Description of Artificial Sequence: Synthetic oligonucleotide
  Target: ATXN1; (+) strand; PAM type: NRG; PAM sequence: TGG
tttgctcttattgcgcaggc

SEQ ID NO: 136381 - DNA, 20 bp, Artificial Sequence
  Description of Artificial Sequence: Synthetic oligonucleotide
  Target: ATXN1; (+) strand; PAM type: NRG; PAM sequence: GAG
tgctcttattgcgcaggctg

SEQ ID NO: 136382 - DNA, 20 bp, Artificial Sequence
  Description of Artificial Sequence: Synthetic oligonucleotide
  Target: ATXN1; (+) strand; PAM type: NRG; PAM sequence: TGG
ttgcgcaggctggagtacaa

SEQ ID NO: 136383 - DNA, 20 bp, Artificial Sequence
  Description of Artificial Sequence: Synthetic oligonucleotide
  Target: ATXN1; (+) strand; PAM type: NRG; PAM sequence: TGG
ggagtacaatggtgcgatct

SEQ ID NO: 136384 - DNA, 20 bp, Artificial Sequence
  Description of Artificial Sequence: Synthetic oligonucleotide
  Target: ATXN1; (+) strand; PAM type: NRG; PAM sequence: CGG
tcactgcaacctctgcctcc

SEQ ID NO: 136385 - DNA, 20 bp, Artificial Sequence
  Description of Artificial Sequence: Synthetic oligonucleotide
  Target: ATXN1; (+) strand; PAM type: NRG; PAM sequence: GGG
cactgcaacctctgcctccc

SEQ ID NO: 136386 - DNA, 20 bp, Artificial Sequence
  Description of Artificial Sequence: Synthetic oligonucleotide
  Target: ATXN1; (+) strand; PAM type: NRG; PAM sequence: AAG
aacctctgcctcccgggttc

SEQ ID NO: 136387 - DNA, 20 bp, Artificial Sequence
  Description of Artificial Sequence: Synthetic oligonucleotide
  Target: ATXN1; (+) strand; PAM type: NRG; PAM sequence: CAG
ttcaagcgattctcctgcct

SEQ ID NO: 136388 - DNA, 20 bp, Artificial Sequence
  Description of Artificial Sequence: Synthetic oligonucleotide
  Target: ATXN1; (+) strand; PAM type: NRG; PAM sequence: AAG
ttctcctgcctcagcctccc

SEQ ID NO: 136389 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcccaag

SEQ ID NO: 136390 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaagtagc

SEQ ID NO: 136391 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaagtagct

SEQ ID NO: 136392 - DNA, 20 bp, Artificial Sequence
  Description of Artificial Sequence: Synthetic oligonucleotide
  Target: ATXN1; (+) strand; PAM type: NRG; PAM sequence: CAG
ctcccaagtagctgggatta

SEQ ID NO: 136393 - DNA, 20 bp, Artificial Sequence
  Description of Artificial Sequence: Synthetic oligonucleotide
  Target: ATXN1; (+) strand; PAM type: NRG; PAM sequence: AGG
tcccaagtagctgggattac

SEQ ID NO: 136394 - DNA, 20 bp, Artificial Sequence
  Description of Artificial Sequence: Synthetic oligonucleotide
  Target: ATXN1; (+) strand; PAM type: NRG; PAM sequence: CAG
caggcatgcgccaacatgcc

SEQ ID NO: 136395 - DNA, 20 bp, Artificial Sequence
  Description of Artificial Sequence: Synthetic oligonucleotide
  Target: ATXN1; (+) strand; PAM type: NRG; PAM sequence: TAG
cagctaatgttttgtatttt

SEQ ID NO: 136396 - DNA, 20 bp, Artificial Sequence
  Description of Artificial Sequence: Synthetic oligonucleotide
  Target: ATXN1; (+) strand; PAM type: NRG; PAM sequence: TAG
ctaatgttttgtatttttag

SEQ ID NO: 136397 - DNA, 20 bp, Artificial Sequence
  Description of Artificial Sequence: Synthetic oligonucleotide
  Target: ATXN1; (+) strand; PAM type: NRG; PAM sequence: GAG
aatgttttgtatttttagta

SEQ ID NO: 136398 - DNA, 20 bp, Artificial Sequence
  Description of Artificial Sequence: Synthetic oligonucleotide
  Target: ATXN1; (+) strand; PAM type: NRG; PAM sequence: TGG
ttttgtatttttagtagaga

SEQ ID NO: 136399 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtagagat

SEQ ID NO: 136400 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagatg

SEQ ID NO: 136401 - DNA, 20 bp, Artificial Sequence
  Description of Artificial Sequence: Synthetic oligonucleotide
  Target: ATXN1; (+) strand; PAM type: NRG; PAM sequence: CAG
tagtagagatggggtttcac

SEQ ID NO: 136402 - DNA, 20 bp, Artificial Sequence
  Description of Artificial Sequence: Synthetic oligonucleotide
  Target: ATXN1; (+) strand; PAM type: NRG; PAM sequence: CAG
cagtttaaaactcctgacct

SEQ ID NO: 136403 - DNA, 20 bp, Artificial Sequence
  Description of Artificial Sequence: Synthetic oligonucleotide
  Target: ATXN1; (+) strand; PAM type: NRG; PAM sequence: AGG
agtttaaaactcctgacctc

SEQ ID NO: 136404 - DNA, 20 bp, Artificial Sequence
  Description of Artificial Sequence: Synthetic oligonucleotide
  Target: ATXN1; (+) strand; PAM type: NRG; PAM sequence: TGG
ctcaggtgatccacccgcct

SEQ ID NO: 136405 - DNA, 20 bp, Artificial Sequence
  Description of Artificial Sequence: Synthetic oligonucleotide
  Target: ATXN1; (+) strand; PAM type: NRG; PAM sequence: AAG
ccacccgccttggcctccca

SEQ ID NO: 136406 - DNA, 20 bp, Artificial Sequence
  Description of Artificial Sequence: Synthetic oligonucleotide
  Target: ATXN1; (+) strand; PAM type: NRG; PAM sequence: TGG
gccttggcctcccaaagtgt

SEQ ID NO: 136407 - DNA, 20 bp, Artificial Sequence
  Description of Artificial Sequence: Synthetic oligonucleotide
  Target: ATXN1; (+) strand; PAM type: NRG; PAM sequence: GGG
ccttggcctcccaaagtgtt

SEQ ID NO: 136408 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgttgggatta

SEQ ID NO: 136409 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgttgggattac

SEQ ID NO: 136410 - DNA, 20 bp, Artificial Sequence
  Description of Artificial Sequence: Synthetic oligonucleotide
  Target: ATXN1; (+) strand; PAM type: NRG; PAM sequence: GAG
agtgttgggattacaggcat

SEQ ID NO: 136411 - DNA, 20 bp, Artificial Sequence
  Description of Artificial Sequence: Synthetic oligonucleotide
  Target: ATXN1; (+) strand; PAM type: NRG; PAM sequence: CGG
caggcatgagccaccgcgtc

SEQ ID NO: 136412 - DNA, 20 bp, Artificial Sequence
  Description of Artificial Sequence: Synthetic oligonucleotide
  Target: ATXN1; (+) strand; PAM type: NRG; PAM sequence: CAG
catgagccaccgcgtccggc

SEQ ID NO: 136413 - DNA, 20 bp, Artificial Sequence
  Description of Artificial Sequence: Synthetic oligonucleotide
  Target: ATXN1; (+) strand; PAM type: NRG; PAM sequence: AGG
atgagccaccgcgtccggcc

SEQ ID NO: 136414 - DNA, 20 bp, Artificial Sequence
  Description of Artificial Sequence: Synthetic oligonucleotide
  Target: ATXN1; (+) strand; PAM type: NRG; PAM sequence: CAG
agccaccgcgtccggccagg

SEQ ID NO: 136415 - DNA, 20 bp, Artificial Sequence
  Description of Artificial Sequence: Synthetic oligonucleotide
  Target: ATXN1; (+) strand; PAM type: NRG; PAM sequence: AAG
gccaggcagccctgttatat

SEQ ID NO: 136416 - DNA, 20 bp, Artificial Sequence
  Description of Artificial Sequence: Synthetic oligonucleotide
  Target: ATXN1; (+) strand; PAM type: NRG; PAM sequence: CAG
gcagccctgttatataagcc

SEQ ID NO: 136417 - DNA, 20 bp, Artificial Sequence
  Description of Artificial Sequence: Synthetic oligonucleotide
  Target: ATXN1; (+) strand; PAM type: NRG; PAM sequence: TAG
agcccagctctgctgtaaac

SEQ ID NO: 136418 - DNA, 20 bp, Artificial Sequence
  Description of Artificial Sequence: Synthetic oligonucleotide
  Target: ATXN1; (+) strand; PAM type: NRG; PAM sequence: TGG
tgctgtaaactagtcctttg

SEQ ID NO: 136419 - DNA, 20 bp, Artificial Sequence
  Description of Artificial Sequence: Synthetic oligonucleotide
  Target: ATXN1; (+) strand; PAM type: NRG; PAM sequence: TGG
aaactagtcctttgtggcct

SEQ ID NO: 136420 - DNA, 20 bp, Artificial Sequence
  Description of Artificial Sequence: Synthetic oligonucleotide
  Target: ATXN1; (+) strand; PAM type: NRG; PAM sequence: GGG
aactagtcctttgtggcctt

SEQ ID NO: 136421 - DNA, 20 bp, Artificial Sequence
  Description of Artificial Sequence: Synthetic oligonucleotide
  Target: ATXN1; (+) strand; PAM type: NRG; PAM sequence: AAG
agtcctttgtggccttggga

SEQ ID NO: 136422 - DNA, 20 bp, Artificial Sequence
  Description of Artificial Sequence: Synthetic oligonucleotide
  Target: ATXN1; (+) strand; PAM type: NRG; PAM sequence: AAG
gggaaagttataccctctct

SEQ ID NO: 136423 - DNA, 20 bp, Artificial Sequence
  Description of Artificial Sequence: Synthetic oligonucleotide
  Target: ATXN1; (+) strand; PAM type: NRG; PAM sequence: CAG
gttataccctctctaagcct

SEQ ID NO: 136424 - DNA, 20 bp, Artificial Sequence
  Description of Artificial Sequence: Synthetic oligonucleotide
  Target: ATXN1; (+) strand; PAM type: NRG; PAM sequence: AAG
cctcagtttctacatctgtg

SEQ ID NO: 136425 - DNA, 20 bp, Artificial Sequence
  Description of Artificial Sequence: Synthetic oligonucleotide
  Target: ATXN1; (+) strand; PAM type: NRG; PAM sequence: AAG
tttctacatctgtgaagtga

SEQ ID NO: 136426 - DNA, 20 bp, Artificial Sequence
  Description of Artificial Sequence: Synthetic oligonucleotide
  Target: ATXN1; (+) strand; PAM type: NRG; PAM sequence: AGG
ttctacatctgtgaagtgaa

SEQ ID NO: 136427 - DNA, 20 bp, Artificial Sequence
  Description of Artificial Sequence: Synthetic oligonucleotide
  Target: ATXN1; (+) strand; PAM type: NRG; PAM sequence: GGG
tctacatctgtgaagtgaaa

SEQ ID NO: 136428 - DNA, 20 bp, Artificial Sequence
  Description of Artificial Sequence: Synthetic oligonucleotide
  Target: ATXN1; (+) strand; PAM type: NRG; PAM sequence: TGG
catctgtgaagtgaaagggt

SEQ ID NO: 136429 - DNA, 20 bp, Artificial Sequence
  Description of Artificial Sequence: Synthetic oligonucleotide
  Target: ATXN1; (+) strand; PAM type: NRG; PAM sequence: AAG
tgaagtgaaagggttggcgt

SEQ ID NO: 136430 - DNA, 20 bp, Artificial Sequence
  Description of Artificial Sequence: Synthetic oligonucleotide
  Target: ATXN1; (+) strand; PAM type: NRG; PAM sequence: AGG
gaagtgaaagggttggcgta

SEQ ID NO: 136431 - DNA, 20 bp, Artificial Sequence
  Description of Artificial Sequence: Synthetic oligonucleotide
  Target: ATXN1; (+) strand; PAM type: NRG; PAM sequence: GGG
aagtgaaagggttggcgtaa

SEQ ID NO: 136432 - DNA, 20 bp, Artificial Sequence
  Description of Artificial Sequence: Synthetic oligonucleotide
  Target: ATXN1; (+) strand; PAM type: NRG; PAM sequence: AAG
ttggcgtaagggacctctcc

SEQ ID NO: 136433 - DNA, 20 bp, Artificial Sequence
  Description of Artificial Sequence: Synthetic oligonucleotide
  Target: ATXN1; (+) strand; PAM type: NRG; PAM sequence: AGG
tggcgtaagggacctctcca

SEQ ID NO: 136434 - DNA, 20 bp, Artificial Sequence
  Description of Artificial Sequence: Synthetic oligonucleotide
  Target: ATXN1; (+) strand; PAM type: NRG; PAM sequence: TAG
gacctctccaaggtccattc

SEQ ID NO: 136435 - DNA, 20 bp, Artificial Sequence
  Description of Artificial Sequence: Synthetic oligonucleotide
  Target: ATXN1; (+) strand; PAM type: NRG; PAM sequence: AAG
caaggtccattctagctccc

SEQ ID NO: 136436 - DNA, 20 bp, Artificial Sequence
  Description of Artificial Sequence: Synthetic oligonucleotide
  Target: ATXN1; (+) strand; PAM type: NRG; PAM sequence: TAG
caattatgtgcatcacaaaa

SEQ ID NO: 136437 - DNA, 20 bp, Artificial Sequence
  Description of Artificial Sequence: Synthetic oligonucleotide
  Target: ATXN1; (+) strand; PAM type: NRG; PAM sequence: AGG
aattatgtgcatcacaaaat

SEQ ID NO: 136438 - DNA, 20 bp, Artificial Sequence
  Description of Artificial Sequence: Synthetic oligonucleotide
  Target: ATXN1; (+) strand; PAM type: NRG; PAM sequence: TGG
gcatcacaaaataggaaacc

SEQ ID NO: 136439 - DNA, 20 bp, Artificial Sequence
  Description of Artificial Sequence: Synthetic oligonucleotide
  Target: ATXN1; (+) strand; PAM type: NRG; PAM sequence: AAG
aataggaaacctggacatat

SEQ ID NO: 136440 - DNA, 20 bp, Artificial Sequence
  Description of Artificial Sequence: Synthetic oligonucleotide
  Target: ATXN1; (+) strand; PAM type: NRG; PAM sequence: AGG
ataggaaacctggacatata

SEQ ID NO: 136441 - DNA, 20 bp, Artificial Sequence
  Description of Artificial Sequence: Synthetic oligonucleotide
  Target: ATXN1; (+) strand; PAM type: NRG; PAM sequence: GGG
taggaaacctggacatataa

SEQ ID NO: 136442 - DNA, 20 bp, Artificial Sequence
  Description of Artificial Sequence: Synthetic oligonucleotide
  Target: ATXN1; (+) strand; PAM type: NRG; PAM sequence: GAG
ggaaacctggacatataagg

SEQ ID NO: 136443 - DNA, 20 bp, Artificial Sequence
  Description of Artificial Sequence: Synthetic oligonucleotide
  Target: ATXN1; (+) strand; PAM type: NRG; PAM sequence: AAG
tggacatataagggagaatt

SEQ ID NO: 136444 - DNA, 20 bp, Artificial Sequence
  Description of Artificial Sequence: Synthetic oligonucleotide
  Target: ATXN1; (+) strand; PAM type: NRG; PAM sequence: AAG
tcaaaaaatgtaaattatgc

SEQ ID NO: 136445 - DNA, 20 bp, Artificial Sequence
  Description of Artificial Sequence: Synthetic oligonucleotide
  Target: ATXN1; (+) strand; PAM type: NRG; PAM sequence: GAG
aaaatgtaaattatgcaagt

SEQ ID NO: 136446 - DNA, 20 bp, Artificial Sequence
  Description of Artificial Sequence: Synthetic oligonucleotide
  Target: ATXN1; (+) strand; PAM type: NRG; PAM sequence: CAG
aattatgcaagtgagacaat

SEQ ID NO: 136447 - DNA, 20 bp, Artificial Sequence
  Description of Artificial Sequence: Synthetic oligonucleotide
  Target: ATXN1; (+) strand; PAM type: NRG; PAM sequence: TGG
ttaattgatattgcgctgca

SEQ ID NO: 136448 - DNA, 20 bp, Artificial Sequence
  Description of Artificial Sequence: Synthetic oligonucleotide
  Target: ATXN1; (+) strand; PAM type: NRG; PAM sequence: GAG
tattgcgctgcatggtaatt

SEQ ID NO: 136449 - DNA, 20 bp, Artificial Sequence
  Description of Artificial Sequence: Synthetic oligonucleotide
  Target: ATXN1; (+) strand; PAM type: NRG; PAM sequence: TGG
cgctgcatggtaattgagct

SEQ ID NO: 136450 - DNA, 20 bp, Artificial Sequence
  Description of Artificial Sequence: Synthetic oligonucleotide
  Target: ATXN1; (+) strand; PAM type: NRG; PAM sequence: AAG
gcatggtaattgagcttgga

SEQ ID NO: 136451 - DNA, 20 bp, Artificial Sequence
  Description of Artificial Sequence: Synthetic oligonucleotide
  Target: ATXN1; (+) strand; PAM type: NRG; PAM sequence: CAG
gaaagcatgtcccaatgtgt

SEQ ID NO: 136452 - DNA, 20 bp, Artificial Sequence
  Description of Artificial Sequence: Synthetic oligonucleotide
  Target: ATXN1; (+) strand; PAM type: NRG; PAM sequence: TGG
attcatgtgtaacttcaaaa

SEQ ID NO: 136453 - DNA, 20 bp, Artificial Sequence
  Description of Artificial Sequence: Synthetic oligonucleotide
  Target: ATXN1; (+) strand; PAM type: NRG; PAM sequence: CAG
gtaacttcaaaatggaatgt

SEQ ID NO: 136454 - DNA, 20 bp, Artificial Sequence
  Description of Artificial Sequence: Synthetic oligonucleotide
  Target: ATXN1; (+) strand; PAM type: NRG; PAM sequence: TGG
caaaatggaatgtcagtgtc

SEQ ID NO: 136455 - DNA, 20 bp, Artificial Sequence
  Description of Artificial Sequence: Synthetic oligonucleotide
  Target: ATXN1; (+) strand; PAM type: NRG; PAM sequence: GGG
aaaatggaatgtcagtgtct

SEQ ID NO: 136456 - DNA, 20 bp, Artificial Sequence
  Description of Artificial Sequence: Synthetic oligonucleotide
  Target: ATXN1; (+) strand; PAM type: NRG; PAM sequence: GGG
aaatggaatgtcagtgtctg

SEQ ID NO: 136457 - DNA, 20 bp, Artificial Sequence
  Description of Artificial Sequence: Synthetic oligonucleotide
  Target: ATXN1; (+) strand; PAM type: NRG; PAM sequence: TGG
tggaatgtcagtgtctgggg

SEQ ID NO: 136458 - DNA, 20 bp, Artificial Sequence
  Description of Artificial Sequence: Synthetic oligonucleotide
  Target: ATXN1; (+) strand; PAM type: NRG; PAM sequence: GGG
ggaatgtcagtgtctggggt

SEQ ID NO: 136459 - DNA, 20 bp, Artificial Sequence
  Description of Artificial Sequence: Synthetic oligonucleotide
  Target: ATXN1; (+) strand; PAM type: NRG; PAM sequence: TGG
atgtcagtgtctggggtggg

SEQ ID NO: 136460 - DNA, 20 bp, Artificial Sequence
  Description of Artificial Sequence: Synthetic oligonucleotide
  Target: ATXN1; (+) strand; PAM type: NRG; PAM sequence: GGG
tgtcagtgtctggggtgggt

SEQ ID NO: 136461 - DNA, 20 bp, Artificial Sequence
  Description of Artificial Sequence: Synthetic oligonucleotide
  Target: ATXN1; (+) strand; PAM type: NRG; PAM sequence: AAG
tggggtgggtgggaaatcca

SEQ ID NO: 136462 - DNA, 20 bp, Artificial Sequence
  Description of Artificial Sequence: Synthetic oligonucleotide
  Target: ATXN1; (+) strand; PAM type: NRG; PAM sequence: AGG
ggggtgggtgggaaatccaa

SEQ ID NO: 136463 - DNA, 20 bp, Artificial Sequence
  Description of Artificial Sequence: Synthetic oligonucleotide
  Target: ATXN1; (+) strand; PAM type: NRG; PAM sequence: GGG
gggtgggtgggaaatccaaa

SEQ ID NO: 136464 - DNA, 20 bp, Artificial Sequence
  Description of Artificial Sequence: Synthetic oligonucleotide
  Target: ATXN1; (+) strand; PAM type: NRG; PAM sequence: AAG
tgggtgggaaatccaaaggg

SEQ ID NO: 136465 - DNA, 20 bp, Artificial Sequence
  Description of Artificial Sequence: Synthetic oligonucleotide
  Target: ATXN1; (+) strand; PAM type: NRG; PAM sequence: AAG
gaaatccaaagggaagttct

SEQ ID NO: 136466 - DNA, 20 bp, Artificial Sequence
  Description of Artificial Sequence: Synthetic oligonucleotide
  Target: ATXN1; (+) strand; PAM type: NRG; PAM sequence: GAG
aatccaaagggaagttctaa

SEQ ID NO: 136467 - DNA, 20 bp, Artificial Sequence
  Description of Artificial Sequence: Synthetic oligonucleotide
  Target: ATXN1; (+) strand; PAM type: NRG; PAM sequence: AAG
aaagggaagttctaagagtg

SEQ ID NO: 136468 - DNA, 20 bp, Artificial Sequence
  Description of Artificial Sequence: Synthetic oligonucleotide
  Target: ATXN1; (+) strand; PAM type: NRG; PAM sequence: TAG
tgaagcctgtttccatctga

SEQ ID NO: 136469 - DNA, 20 bp, Artificial Sequence
  Description of Artificial Sequence: Synthetic oligonucleotide
  Target: ATXN1; (+) strand; PAM type: NRG; PAM sequence: AGG
gaagcctgtttccatctgat

SEQ ID NO: 136470 - DNA, 20 bp, Artificial Sequence
  Description of Artificial Sequence: Synthetic oligonucleotide
  Target: ATXN1; (+) strand; PAM type: NRG; PAM sequence: TAG
tgaatatgtacccatctctc

SEQ ID NO: 136471 - DNA, 20 bp, Artificial Sequence
  Description of Artificial Sequence: Synthetic oligonucleotide
  Target: ATXN1; (+) strand; PAM type: NRG; PAM sequence: AGG
gaatatgtacccatctctct

SEQ ID NO: 136472 - DNA, 20 bp, Artificial Sequence
  Description of Artificial Sequence: Synthetic oligonucleotide
  Target: ATXN1; (+) strand; PAM type: NRG; PAM sequence: TGG
cccatctctctaggcaacca

SEQ ID NO: 136473 - DNA, 20 bp, Artificial Sequence
  Description of Artificial Sequence: Synthetic oligonucleotide
  Target: ATXN1; (+) strand; PAM type: NRG; PAM sequence: TAG
tgctttacatcaaaatgtgt

SEQ ID NO: 136474 - DNA, 20 bp, Artificial Sequence
  Description of Artificial Sequence: Synthetic oligonucleotide
  Target: ATXN1; (+) strand; PAM type: NRG; PAM sequence: TAG
tttacatcaaaatgtgttag

SEQ ID NO: 136475 - DNA, 20 bp, Artificial Sequence
  Description of Artificial Sequence: Synthetic oligonucleotide
  Target: ATXN1; (+) strand; PAM type: NRG; PAM sequence: TGG
agtagaaaacaaaaatacct

SEQ ID NO: 136476 - DNA, 20 bp, Artificial Sequence
  Description of Artificial Sequence: Synthetic oligonucleotide
  Target: ATXN1; (+) strand; PAM type: NRG; PAM sequence: GGG
gtagaaaacaaaaatacctt

SEQ ID NO: 136477 - DNA, 20 bp, Artificial Sequence
  Description of Artificial Sequence: Synthetic oligonucleotide
  Target: ATXN1; (+) strand; PAM type: NRG; PAM sequence: AAG
aaacaaaaataccttgggtc

SEQ ID NO: 136478 - DNA, 20 bp, Artificial Sequence
  Description of Artificial Sequence: Synthetic oligonucleotide
  Target: ATXN1; (+) strand; PAM type: NRG; PAM sequence: AAG
agcatatccccaaattccta

SEQ ID NO: 136479 - DNA, 20 bp, Artificial Sequence
  Description of Artificial Sequence: Synthetic oligonucleotide
  Target: ATXN1; (+) strand; PAM type: NRG; PAM sequence: TGG
tatccccaaattcctaaaga

SEQ ID NO: 136480 - DNA, 20 bp, Artificial Sequence
  Description of Artificial Sequence: Synthetic oligonucleotide
  Target: ATXN1; (+) strand; PAM type: NRG; PAM sequence: AAG
tttttatgcccaaaatctct

SEQ ID NO: 136481 - DNA, 20 bp, Artificial Sequence
  Description of Artificial Sequence: Synthetic oligonucleotide
  Target: ATXN1; (+) strand; PAM type: NRG; PAM sequence: CAG
aatctctaagaaattgatca

SEQ ID NO: 136482 - DNA, 20 bp, Artificial Sequence
  Description of Artificial Sequence: Synthetic oligonucleotide
  Target: ATXN1; (+) strand; PAM type: NRG; PAM sequence: TGG
attgatcacagatcctaata

SEQ ID NO: 136483 - DNA, 20 bp, Artificial Sequence
  Description of Artificial Sequence: Synthetic oligonucleotide
  Target: ATXN1; (+) strand; PAM type: NRG; PAM sequence: CAG
gatcctaatatggtcaacca

SEQ ID NO: 136484 - DNA, 20 bp, Artificial Sequence
  Description of Artificial Sequence: Synthetic oligonucleotide
  Target: ATXN1; (+) strand; PAM type: NRG; PAM sequence: AGG
atcctaatatggtcaaccac

SEQ ID NO: 136485 - DNA, 20 bp, Artificial Sequence
  Description of Artificial Sequence: Synthetic oligonucleotide
  Target: ATXN1; (+) strand; PAM type: NRG; PAM sequence: CAG
tatggtcaaccacaggtctg

SEQ ID NO: 136486 - DNA, 20 bp, Artificial Sequence
  Description of Artificial Sequence: Synthetic oligonucleotide
  Target: ATXN1; (+) strand; PAM type: NRG; PAM sequence: AGG
atggtcaaccacaggtctgc

SEQ ID NO: 136487 - DNA, 20 bp, Artificial Sequence
  Description of Artificial Sequence: Synthetic oligonucleotide
  Target: ATXN1; (+) strand; PAM type: NRG; PAM sequence: TGG
caggtcacaacatatctttt

SEQ ID NO: 136488 - DNA, 20 bp, Artificial Sequence
  Description of Artificial Sequence: Synthetic oligonucleotide
  Target: ATXN1; (+) strand; PAM type: NRG; PAM sequence: GGG
aggtcacaacatatcttttt

SEQ ID NO: 136489 - DNA, 20 bp, Artificial Sequence
  Description of Artificial Sequence: Synthetic oligonucleotide
  Target: ATXN1; (+) strand; PAM type: NRG; PAM sequence: TGG
acaacatatctttttgggca

SEQ ID NO: 136490 - DNA, 20 bp, Artificial Sequence
  Description of Artificial Sequence: Synthetic oligonucleotide
  Target: ATXN1; (+) strand; PAM type: NRG; PAM sequence: AAG
gggcatggtctgaaatgccc

SEQ ID NO: 136491 - DNA, 20 bp, Artificial Sequence
  Description of Artificial Sequence: Synthetic oligonucleotide
  Target: ATXN1; (+) strand; PAM type: NRG; PAM sequence: AGG
ggcatggtctgaaatgccca

SEQ ID NO: 136492 - DNA, 20 bp, Artificial Sequence
  Description of Artificial Sequence: Synthetic oligonucleotide
  Target: ATXN1; (+) strand; PAM type: NRG; PAM sequence: GAG
ctgaaatgcccaaggcatcc

SEQ ID NO: 136493 - DNA, 20 bp, Artificial Sequence
  Description of Artificial Sequence: Synthetic oligonucleotide
  Target: ATXN1; (+) strand; PAM type: NRG; PAM sequence: AGG
tgaaatgcccaaggcatccg

SEQ ID NO: 136494 - DNA, 20 bp, Artificial Sequence
  Description of Artificial Sequence: Synthetic oligonucleotide
  Target: ATXN1; (+) strand; PAM type: NRG; PAM sequence: AAG
gcccaaggcatccgaggaaa

SEQ ID NO: 136495 - DNA, 20 bp, Artificial Sequence
  Description of Artificial Sequence: Synthetic oligonucleotide
  Target: ATXN1; (+) strand; PAM type: NRG; PAM sequence: TGG
tccgaggaaaaagacgtgct

SEQ ID NO: 136496 - DNA, 20 bp, Artificial Sequence
  Description of Artificial Sequence: Synthetic oligonucleotide
  Target: ATXN1; (+) strand; PAM type: NRG; PAM sequence: TAG
aaaaagacgtgcttggtcta

SEQ ID NO: 136497 - DNA, 20 bp, Artificial Sequence
  Description of Artificial Sequence: Synthetic oligonucleotide
  Target: ATXN1; (+) strand; PAM type: NRG; PAM sequence: AAG
acgtgcttggtctatagaca

SEQ ID NO: 136498 - DNA, 20 bp, Artificial Sequence
  Description of Artificial Sequence: Synthetic oligonucleotide
  Target: ATXN1; (+) strand; PAM type: NRG; PAM sequence: AGG
cgtgcttggtctatagacaa

SEQ ID NO: 136499 - DNA, 20 bp, Artificial Sequence
  Description of Artificial Sequence: Synthetic oligonucleotide
  Target: ATXN1; (+) strand; PAM type: NRG; PAM sequence: CGG
atagacaaaggcccctcaat

SEQ ID NO: 136500 - DNA, 20 bp, Artificial Sequence
  Description of Artificial Sequence: Synthetic oligonucleotide
  Target: ATXN1; (+) strand; PAM type: NRG; PAM sequence: TGG
gacaaaggcccctcaatcgg

SEQ ID NO: 136501 - DNA, 20 bp, Artificial Sequence
  Description of Artificial Sequence: Synthetic oligonucleotide
  Target: ATXN1; (+) strand; PAM type: NRG; PAM sequence: GAG
aaggcccctcaatcggtggt

SEQ ID NO: 136502 - DNA, 20 bp, Artificial Sequence
  Description of Artificial Sequence: Synthetic oligonucleotide
  Target: ATXN1; (+) strand; PAM type: NRG; PAM sequence: TAG
ctcaatcggtggtgagacaa

SEQ ID NO: 136503 - DNA, 20 bp, Artificial Sequence
  Description of Artificial Sequence: Synthetic oligonucleotide
  Target: ATXN1; (+) strand; PAM type: NRG; PAM sequence: AGG
tcaatcggtggtgagacaat

SEQ ID NO: 136504 - DNA, 20 bp, Artificial Sequence
  Description of Artificial Sequence: Synthetic oligonucleotide
  Target: ATXN1; (+) strand; PAM type: NRG; PAM sequence: CAG
ggtgagacaataggattcta

SEQ ID NO: 136505 - DNA, 20 bp, Artificial Sequence
  Description of Artificial Sequence: Synthetic oligonucleotide
  Target: ATXN1; (+) strand; PAM type: NRG; PAM sequence: TAG
cttcccatatataatcttgt

SEQ ID NO: 136506 - DNA, 20 bp, Artificial Sequence
  Description of Artificial Sequence: Synthetic oligonucleotide
  Target: ATXN1; (+) strand; PAM type: NRG; PAM sequence: AAG
tgttagtaaatgaaacatta

SEQ ID NO: 136507 - DNA, 20 bp, Artificial Sequence
  Description of Artificial Sequence: Synthetic oligonucleotide
  Target: ATXN1; (+) strand; PAM type: NRG; PAM sequence: TGG
aatgaaacattaaagtctca

SEQ ID NO: 136508 - DNA, 20 bp, Artificial Sequence
  Description of Artificial Sequence: Synthetic oligonucleotide
  Target: ATXN1; (+) strand; PAM type: NRG; PAM sequence: GAG
tgaaacattaaagtctcatg

SEQ ID NO: 136509 - DNA, 20 bp, Artificial Sequence
  Description of Artificial Sequence: Synthetic oligonucleotide
  Target: ATXN1; (+) strand; PAM type: NRG; PAM sequence: AAG
ttaaagtctcatggagaaaa

SEQ ID NO: 136510 - DNA, 20 bp, Artificial Sequence
  Description of Artificial Sequence: Synthetic oligonucleotide
  Target: ATXN1; (+) strand; PAM type: NRG; PAM sequence: CAG
ctcatggagaaaaaagtctg

SEQ ID NO: 136511 - DNA, 20 bp, Artificial Sequence
  Description of Artificial Sequence: Synthetic oligonucleotide
  Target: ATXN1; (+) strand; PAM type: NRG; PAM sequence: CAG
tgtctgttttatgctataaa

SEQ ID NO: 136512 - DNA, 20 bp, Artificial Sequence
  Description of Artificial Sequence: Synthetic oligonucleotide
  Target: ATXN1; (+) strand; PAM type: NRG; PAM sequence: CAG
ttatgctataaacagatctc

SEQ ID NO: 136513 - DNA, 20 bp, Artificial Sequence
  Description of Artificial Sequence: Synthetic oligonucleotide
  Target: ATXN1; (+) strand; PAM type: NRG; PAM sequence: TGG
tgctatgtgctgaatgacat

SEQ ID NO: 136514 - DNA, 20 bp, Artificial Sequence
  Description of Artificial Sequence: Synthetic oligonucleotide
  Target: ATXN1; (+) strand; PAM type: NRG; PAM sequence: GAG
ctatgtgctgaatgacattg

SEQ ID NO: 136515 - DNA, 20 bp, Artificial Sequence
  Description of Artificial Sequence: Synthetic oligonucleotide
  Target: ATXN1; (+) strand; PAM type: NRG; PAM sequence: TGG
tgtgctgaatgacattggag

SEQ ID NO: 136516 - DNA, 20 bp, Artificial Sequence
  Description of Artificial Sequence: Synthetic oligonucleotide
  Target: ATXN1; (+) strand; PAM type: NRG; PAM sequence: GGG
gtgctgaatgacattggagt

SEQ ID NO: 136517 - DNA, 20 bp, Artificial Sequence
  Description of Artificial Sequence: Synthetic oligonucleotide
  Target: ATXN1; (+) strand; PAM type: NRG; PAM sequence: GAG
gctgaatgacattggagtgg

SEQ ID NO: 136518 - DNA, 20 bp, Artificial Sequence
  Description of Artificial Sequence: Synthetic oligonucleotide
  Target: ATXN1; (+) strand; PAM type: NRG; PAM sequence: TGG
gacattggagtgggagccac

SEQ ID NO: 136519 - DNA, 20 bp, Artificial Sequence
  Description of Artificial Sequence: Synthetic oligonucleotide
  Target: ATXN1; (+) strand; PAM type: NRG; PAM sequence: AAG
gagccactggctttacctgc

SEQ ID NO: 136520 - DNA, 20 bp, Artificial Sequence
  Description of Artificial Sequence: Synthetic oligonucleotide
  Target: ATXN1; (+) strand; PAM type: NRG; PAM sequence: CAG
ctggctttacctgcaagcct

SEQ ID NO: 136521 - DNA, 20 bp, Artificial Sequence
  Description of Artificial Sequence: Synthetic oligonucleotide
  Target: ATXN1; (+) strand; PAM type: NRG; PAM sequence: TAG
ttacctgcaagcctcagctt

SEQ ID NO: 136522 - DNA, 20 bp, Artificial Sequence
  Description of Artificial Sequence: Synthetic oligonucleotide
  Target: ATXN1; (+) strand; PAM type: NRG; PAM sequence: CAG
tgcaagcctcagctttagtc

SEQ ID NO: 136523 - DNA, 20 bp, Artificial Sequence
  Description of Artificial Sequence: Synthetic oligonucleotide
  Target: ATXN1; (+) strand; PAM type: NRG; PAM sequence: TGG
agatctgttccacgcaaccc

SEQ ID NO: 136524 - DNA, 20 bp, Artificial Sequence
  Description of Artificial Sequence: Synthetic oligonucleotide
  Target: ATXN1; (+) strand; PAM type: NRG; PAM sequence: TAG
tggcaatattacctctgttc

SEQ ID NO: 136525 - DNA, 20 bp, Artificial Sequence
  Description of Artificial Sequence: Synthetic oligonucleotide
  Target: ATXN1; (+) strand; PAM type: NRG; PAM sequence: TGG
ttctagaaccatctgcgact

SEQ ID NO: 136526 - DNA, 20 bp, Artificial Sequence
  Description of Artificial Sequence: Synthetic oligonucleotide
  Target: ATXN1; (+) strand; PAM type: NRG; PAM sequence: AAG
tgcgacttggatgttctgcc

SEQ ID NO: 136527 - DNA, 20 bp, Artificial Sequence
  Description of Artificial Sequence: Synthetic oligonucleotide
  Target: ATXN1; (+) strand; PAM type: NRG; PAM sequence: CAG
tctacatctgtctgcctatc

SEQ ID NO: 136528 - DNA, 20 bp, Artificial Sequence
  Description of Artificial Sequence: Synthetic oligonucleotide
  Target: ATXN1; (+) strand; PAM type: NRG; PAM sequence: AAG
ctctctttctgtctctctcc

SEQ ID NO: 136529 - DNA, 20 bp, Artificial Sequence
  Description of Artificial Sequence: Synthetic oligonucleotide
  Target: ATXN1; (+) strand; PAM type: NRG; PAM sequence: AGG
tctctttctgtctctctcca

SEQ ID NO: 136530 - DNA, 20 bp, Artificial Sequence
  Description of Artificial Sequence: Synthetic oligonucleotide
  Target: ATXN1; (+) strand; PAM type: NRG; PAM sequence: AAG
tccaaggtctctctttttct

SEQ ID NO: 136531 - DNA, 20 bp, Artificial Sequence
  Description of Artificial Sequence: Synthetic oligonucleotide
  Target: ATXN1; (+) strand; PAM type: NRG; PAM sequence: CAG
acctttgttgacaatcattg

SEQ ID NO: 136532 - DNA, 20 bp, Artificial Sequence
  Description of Artificial Sequence: Synthetic oligonucleotide
  Target: ATXN1; (+) strand; PAM type: NRG; PAM sequence: TGG
ttgttgacaatcattgcagc

SEQ ID NO: 136533 - DNA, 20 bp, Artificial Sequence
  Description of Artificial Sequence: Synthetic oligonucleotide
  Target: ATXN1; (+) strand; PAM type: NRG; PAM sequence: CAG
gacaatcattgcagctggac

SEQ ID NO: 136534 - DNA, 20 bp, Artificial Sequence
  Description of Artificial Sequence: Synthetic oligonucleotide
  Target: ATXN1; (+) strand; PAM type: NRG; PAM sequence: GAG
atcattgcagctggaccagt

SEQ ID NO: 136535 - DNA, 20 bp, Artificial Sequence
  Description of Artificial Sequence: Synthetic oligonucleotide
  Target: ATXN1; (+) strand; PAM type: NRG; PAM sequence: AAG
attgcagctggaccagtgag

SEQ ID NO: 136536 - DNA, 20 bp, Artificial Sequence
  Description of Artificial Sequence: Synthetic oligonucleotide
  Target: ATXN1; (+) strand; PAM type: NRG; PAM sequence: AGG
ttgcagctggaccagtgaga

SEQ ID NO: 136537 - DNA, 20 bp, Artificial Sequence
  Description of Artificial Sequence: Synthetic oligonucleotide
  Target: ATXN1; (+) strand; PAM type: NRG; PAM sequence: GGG
tgcagctggaccagtgagaa

SEQ ID NO: 136538 - DNA, 20 bp, Artificial Sequence
  Description of Artificial Sequence: Synthetic oligonucleotide
  Target: ATXN1; (+) strand; PAM type: NRG; PAM sequence: TAG
accagtgagaagggataaaa

SEQ ID NO: 136539 - DNA, 20 bp, Artificial Sequence
  Description of Artificial Sequence: Synthetic oligonucleotide
  Target: ATXN1; (+) strand; PAM type: NRG; PAM sequence: AAG
agtgagaagggataaaatag

SEQ ID NO: 136540 - DNA, 20 bp, Artificial Sequence
  Description of Artificial Sequence: Synthetic oligonucleotide
  Target: ATXN1; (+) strand; PAM type: NRG; PAM sequence: AAG
aaaatagaagtcaataaata

SEQ ID NO: 136541 - DNA, 20 bp, Artificial Sequence
  Description of Artificial Sequence: Synthetic oligonucleotide
  Target: ATXN1; (+) strand; PAM type: NRG; PAM sequence: TGG
gtcaataaataaagctcttc

SEQ ID NO: 136542 - DNA, 20 bp, Artificial Sequence
  Description of Artificial Sequence: Synthetic oligonucleotide
  Target: ATXN1; (+) strand; PAM type: NRG; PAM sequence: GGG
tcaataaataaagctcttct

SEQ ID NO: 136543 - DNA, 20 bp, Artificial Sequence
  Description of Artificial Sequence: Synthetic oligonucleotide
  Target: ATXN1; (+) strand; PAM type: NRG; PAM sequence: AAG
aaagctcttctgggttcatt

SEQ ID NO: 136544 - DNA, 20 bp, Artificial Sequence
  Description of Artificial Sequence: Synthetic oligonucleotide
  Target: ATXN1; (+) strand; PAM type: NRG; PAM sequence: TGG
aattttgactacactgtgtt

SEQ ID NO: 136545 - DNA, 20 bp, Artificial Sequence
  Description of Artificial Sequence: Synthetic oligonucleotide
  Target: ATXN1; (+) strand; PAM type: NRG; PAM sequence: TGG
gactacactgtgtttggatg

SEQ ID NO: 136546 - DNA, 20 bp, Artificial Sequence
  Description of Artificial Sequence: Synthetic oligonucleotide
  Target: ATXN1; (+) strand; PAM type: NRG; PAM sequence: GGG
actacactgtgtttggatgt

SEQ ID NO: 136547 - DNA, 20 bp, Artificial Sequence
  Description of Artificial Sequence: Synthetic oligonucleotide
  Target: ATXN1; (+) strand; PAM type: NRG; PAM sequence: GGG
ctacactgtgtttggatgtg

SEQ ID NO: 136548 - DNA, 20 bp, Artificial Sequence
  Description of Artificial Sequence: Synthetic oligonucleotide
  Target: ATXN1; (+) strand; PAM type: NRG; PAM sequence: GAG
acactgtgtttggatgtggg

SEQ ID NO: 136549 - DNA, 20 bp, Artificial Sequence
  Description of Artificial Sequence: Synthetic oligonucleotide
  Target: ATXN1; (+) strand; PAM type: NRG; PAM sequence: AAG
tattttttcactcttattca

SEQ ID NO: 136550 - DNA, 20 bp, Artificial Sequence
  Description of Artificial Sequence: Synthetic oligonucleotide
  Target: ATXN1; (+) strand; PAM type: NRG; PAM sequence: TGG
tttgtttccttaaaatatgt

SEQ ID NO: 136551 - DNA, 20 bp, Artificial Sequence
  Description of Artificial Sequence: Synthetic oligonucleotide
  Target: ATXN1; (+) strand; PAM type: NRG; PAM sequence: TAG
tgttggcattcttctctccc

SEQ ID NO: 136552 - DNA, 20 bp, Artificial Sequence
  Description of Artificial Sequence: Synthetic oligonucleotide
  Target: ATXN1; (+) strand; PAM type: NRG; PAM sequence: TAG
tggcattcttctctccctag

SEQ ID NO: 136553 - DNA, 20 bp, Artificial Sequence
  Description of Artificial Sequence: Synthetic oligonucleotide
  Target: ATXN1; (+) strand; PAM type: NRG; PAM sequence: AGG
ggcattcttctctccctagt

SEQ ID NO: 136554 - DNA, 20 bp, Artificial Sequence
  Description of Artificial Sequence: Synthetic oligonucleotide
  Target: ATXN1; (+) strand; PAM type: NRG; PAM sequence: GAG
cattcttctctccctagtag

SEQ ID NO: 136555 - DNA, 20 bp, Artificial Sequence
  Description of Artificial Sequence: Synthetic oligonucleotide
  Target: ATXN1; (+) strand; PAM type: NRG; PAM sequence: GAG
ttcttctctccctagtagga

SEQ ID NO: 136556 - DNA, 20 bp, Artificial Sequence
  Description of Artificial Sequence: Synthetic oligonucleotide
  Target: ATXN1; (+) strand; PAM type: NRG; PAM sequence: AAG
cctagtaggagagcgcctgc

SEQ ID NO: 136557 - DNA, 20 bp, Artificial Sequence
  Description of Artificial Sequence: Synthetic oligonucleotide
  Target: ATXN1; (+) strand; PAM type: NRG; PAM sequence: AGG
ctagtaggagagcgcctgca

SEQ ID NO: 136558 - DNA, 20 bp, Artificial Sequence
  Description of Artificial Sequence: Synthetic oligonucleotide
  Target: ATXN1; (+) strand; PAM type: NRG; PAM sequence: AAG
agcgcctgcaaggatcacaa

SEQ ID NO: 136559 - DNA, 20 bp, Artificial Sequence
  Description of Artificial Sequence: Synthetic oligonucleotide
  Target: ATXN1; (+) strand; PAM type: NRG; PAM sequence: TGG
gcaaggatcacaaaagcttc

SEQ ID NO: 136560 - DNA, 20 bp, Artificial Sequence
  Description of Artificial Sequence: Synthetic oligonucleotide
  Target: ATXN1; (+) strand; PAM type: NRG; PAM sequence: GGG
caaggatcacaaaagcttct

SEQ ID NO: 136561 - DNA, 20 bp, Artificial Sequence
  Description of Artificial Sequence: Synthetic oligonucleotide
  Target: ATXN1; (+) strand; PAM type: NRG; PAM sequence: GGG
aaggatcacaaaagcttctg

SEQ ID NO: 136562 - DNA, 20 bp, Artificial Sequence
  Description of Artificial Sequence: Synthetic oligonucleotide
  Target: ATXN1; (+) strand; PAM type: NRG; PAM sequence: GAG
ggatcacaaaagcttctggg

SEQ ID NO: 136563 - DNA, 20 bp, Artificial Sequence
  Description of Artificial Sequence: Synthetic oligonucleotide
  Target: ATXN1; (+) strand; PAM type: NRG; PAM sequence: AAG
tcacaaaagcttctggggag

SEQ ID NO: 136564 - DNA, 20 bp, Artificial Sequence
  Description of Artificial Sequence: Synthetic oligonucleotide
  Target: ATXN1; (+) strand; PAM type: NRG; PAM sequence: CAG
gcaataatctgctgaataac

SEQ ID NO: 136565 - DNA, 20 bp, Artificial Sequence
  Description of Artificial Sequence: Synthetic oligonucleotide
  Target: ATXN1; (+) strand; PAM type: NRG; PAM sequence: AGG
caataatctgctgaataacc

SEQ ID NO: 136566 - DNA, 20 bp, Artificial Sequence
  Description of Artificial Sequence: Synthetic oligonucleotide
  Target: ATXN1; (+) strand; PAM type: NRG; PAM sequence: CAG
tctgctgaataaccaggccc

SEQ ID NO: 136567 - DNA, 20 bp, Artificial Sequence
  Description of Artificial Sequence: Synthetic oligonucleotide
  Target: ATXN1; (+) strand; PAM type: NRG; PAM sequence: TGG
ccccagctgccaaatgccac

SEQ ID NO: 136568 - DNA, 20 bp, Artificial Sequence
  Description of Artificial Sequence: Synthetic oligonucleotide
  Target: ATXN1; (+) strand; PAM type: NRG; PAM sequence: GGG
cccagctgccaaatgccact

SEQ ID NO: 136569 - DNA, 20 bp, Artificial Sequence
  Description of Artificial Sequence: Synthetic oligonucleotide
  Target: ATXN1; (+) strand; PAM type: NRG; PAM sequence: AAG
ctgccaaatgccactgggaa

SEQ ID NO: 136570 - DNA, 20 bp, Artificial Sequence
  Description of Artificial Sequence: Synthetic oligonucleotide
  Target: ATXN1; (+) strand; PAM type: NRG; PAM sequence: AAG
atgccactgggaaaagtgca

SEQ ID NO: 136571 - DNA, 20 bp, Artificial Sequence
  Description of Artificial Sequence: Synthetic oligonucleotide
  Target: ATXN1; (+) strand; PAM type: NRG; PAM sequence: AGG
tgccactgggaaaagtgcaa

SEQ ID NO: 136572 - DNA, 20 bp, Artificial Sequence
  Description of Artificial Sequence: Synthetic oligonucleotide
  Target: ATXN1; (+) strand; PAM type: NRG; PAM sequence: GGG
gccactgggaaaagtgcaaa

SEQ ID NO: 136573 - DNA, 20 bp, Artificial Sequence
  Description of Artificial Sequence: Synthetic oligonucleotide
  Target: ATXN1; (+) strand; PAM type: NRG; PAM sequence: TGG
gaaaagtgcaaagggtgaat

SEQ ID NO: 136574 - DNA, 20 bp, Artificial Sequence
  Description of Artificial Sequence: Synthetic oligonucleotide
  Target: ATXN1; (+) strand; PAM type: NRG; PAM sequence: GGG
aaaagtgcaaagggtgaatt

SEQ ID NO: 136575 - DNA, 20 bp, Artificial Sequence
  Description of Artificial Sequence: Synthetic oligonucleotide
  Target: ATXN1; (+) strand; PAM type: NRG; PAM sequence: CAG
ctgaatcataaacattatta

SEQ ID NO: 136576 - DNA, 20 bp, Artificial Sequence
  Description of Artificial Sequence: Synthetic oligonucleotide
  Target: ATXN1; (+) strand; PAM type: NRG; PAM sequence: AGG
tgaatcataaacattattac

SEQ ID NO: 136577 - DNA, 20 bp, Artificial Sequence
  Description of Artificial Sequence: Synthetic oligonucleotide
  Target: ATXN1; (+) strand; PAM type: NRG; PAM sequence: AAG
cataaacattattacaggca

SEQ ID NO: 136578 - DNA, 20 bp, Artificial Sequence
  Description of Artificial Sequence: Synthetic oligonucleotide
  Target: ATXN1; (+) strand; PAM type: NRG; PAM sequence: TGG
attattacaggcaaagtgac

SEQ ID NO: 136579 - DNA, 20 bp, Artificial Sequence
  Description of Artificial Sequence: Synthetic oligonucleotide
  Target: ATXN1; (+) strand; PAM type: NRG; PAM sequence: GAG
aaagtgactggctgctactt

SEQ ID NO: 136580 - DNA, 20 bp, Artificial Sequence
  Description of Artificial Sequence: Synthetic oligonucleotide
  Target: ATXN1; (+) strand; PAM type: NRG; PAM sequence: GAG
agtgactggctgctacttga

SEQ ID NO: 136581 - DNA, 20 bp, Artificial Sequence
  Description of Artificial Sequence: Synthetic oligonucleotide
  Target: ATXN1; (+) strand; PAM type: NRG; PAM sequence: TGG
agagttcttctgtacctaat

SEQ ID NO: 136582 - DNA, 20 bp, Artificial Sequence
  Description of Artificial Sequence: Synthetic oligonucleotide
  Target: ATXN1; (+) strand; PAM type: NRG; PAM sequence: CAG
ctgtacctaattggaccatg

SEQ ID NO: 136583 - DNA, 20 bp, Artificial Sequence
  Description of Artificial Sequence: Synthetic oligonucleotide
  Target: ATXN1; (+) strand; PAM type: NRG; PAM sequence: TGG
accatgcagcgtgatactcc

SEQ ID NO: 136584 - DNA, 20 bp, Artificial Sequence
  Description of Artificial Sequence: Synthetic oligonucleotide
  Target: ATXN1; (+) strand; PAM type: NRG; PAM sequence: GGG
ccatgcagcgtgatactcct

SEQ ID NO: 136585 - DNA, 20 bp, Artificial Sequence
  Description of Artificial Sequence: Synthetic oligonucleotide
  Target: ATXN1; (+) strand; PAM type: NRG; PAM sequence: GGG
catgcagcgtgatactcctg

SEQ ID NO: 136586 - DNA, 20 bp, Artificial Sequence
  Description of Artificial Sequence: Synthetic oligonucleotide
  Target: ATXN1; (+) strand; PAM type: NRG; PAM sequence: CAG
gatactcctggggaccatta

SEQ ID NO: 136587 - DNA, 20 bp, Artificial Sequence
  Description of Artificial Sequence: Synthetic oligonucleotide
  Target: ATXN1; (+) strand; PAM type: NRG; PAM sequence: AGG
atactcctggggaccattac

SEQ ID NO: 136588 - DNA, 20 bp, Artificial Sequence
  Description of Artificial Sequence: Synthetic oligonucleotide
  Target: ATXN1; (+) strand; PAM type: NRG; PAM sequence: GGG
tactcctggggaccattaca

SEQ ID NO: 136589 - DNA, 20 bp, Artificial Sequence
  Description of Artificial Sequence: Synthetic oligonucleotide
  Target: ATXN1; (+) strand; PAM type: NRG; PAM sequence: CAG
tggggaccattacagggata

SEQ ID NO: 136590 - DNA, 20 bp, Artificial Sequence
  Description of Artificial Sequence: Synthetic oligonucleotide
  Target: ATXN1; (+) strand; PAM type: NRG; PAM sequence: AGG
ggggaccattacagggatac

SEQ ID NO: 136591 - DNA, 20 bp, Artificial Sequence
  Description of Artificial Sequence: Synthetic oligonucleotide
  Target: ATXN1; (+) strand; PAM type: NRG; PAM sequence: TAG
ccattacagggatacaggtg

SEQ ID NO: 136592 - DNA, 20 bp, Artificial Sequence
  Description of Artificial Sequence: Synthetic oligonucleotide
  Target: ATXN1; (+) strand; PAM type: NRG; PAM sequence: AAG
gtgtagcttacaatatacaa

SEQ ID NO: 136593 - DNA, 20 bp, Artificial Sequence
  Description of Artificial Sequence: Synthetic oligonucleotide
  Target: ATXN1; (+) strand; PAM type: NRG; PAM sequence: AAG
gtgtctgacaatctacgtgt

SEQ ID NO: 136594 - DNA, 20 bp, Artificial Sequence
  Description of Artificial Sequence: Synthetic oligonucleotide
  Target: ATXN1; (+) strand; PAM type: NRG; PAM sequence: TGG
gcctaactttttacattact

SEQ ID NO: 136595 - DNA, 20 bp, Artificial Sequence
  Description of Artificial Sequence: Synthetic oligonucleotide
  Target: ATXN1; (+) strand; PAM type: NRG; PAM sequence: AAG
tttacattacttggtgtgct

SEQ ID NO: 136596 - DNA, 20 bp, Artificial Sequence
  Description of Artificial Sequence: Synthetic oligonucleotide
  Target: ATXN1; (+) strand; PAM type: NRG; PAM sequence: GAG
cttggtgtgctaagtgtcct

SEQ ID NO: 136597 - DNA, 20 bp, Artificial Sequence
  Description of Artificial Sequence: Synthetic oligonucleotide
  Target: ATXN1; (+) strand; PAM type: NRG; PAM sequence: AGG
ttggtgtgctaagtgtcctg

SEQ ID NO: 136598 - DNA, 20 bp, Artificial Sequence
  Description of Artificial Sequence: Synthetic oligonucleotide
  Target: ATXN1; (+) strand; PAM type: NRG; PAM sequence: GGG
tggtgtgctaagtgtcctga

SEQ ID NO: 136599 - DNA, 20 bp, Artificial Sequence
  Description of Artificial Sequence: Synthetic oligonucleotide
  Target: ATXN1; (+) strand; PAM type: NRG; PAM sequence: GAG
gtgtgctaagtgtcctgagg

SEQ ID NO: 136600 - DNA, 20 bp, Artificial Sequence
  Description of Artificial Sequence: Synthetic oligonucleotide
  Target: ATXN1; (+) strand; PAM type: NRG; PAM sequence: TAG
tcctgagggagttcattatt

SEQ ID NO: 136601 - DNA, 20 bp, Artificial Sequence
  Description of Artificial Sequence: Synthetic oligonucleotide
  Target: ATXN1; (+) strand; PAM type: NRG; PAM sequence: GAG
ctgagggagttcattattta

SEQ ID NO: 136602 - DNA, 20 bp, Artificial Sequence
  Description of Artificial Sequence: Synthetic oligonucleotide
  Target: ATXN1; (+) strand; PAM type: NRG; PAM sequence: TAG
aaatttcccctctctgtctt

SEQ ID NO: 136603 - DNA, 20 bp, Artificial Sequence
  Description of Artificial Sequence: Synthetic oligonucleotide
  Target: ATXN1; (+) strand; PAM type: NRG; PAM sequence: GAG
atttcccctctctgtcttta

SEQ ID NO: 136604 - DNA, 20 bp, Artificial Sequence
  Description of Artificial Sequence: Synthetic oligonucleotide
  Target: ATXN1; (+) strand; PAM type: NRG; PAM sequence: AAG
atccatttcccacaaatata

SEQ ID NO: 136605 - DNA, 20 bp, Artificial Sequence
  Description of Artificial Sequence: Synthetic oligonucleotide
  Target: ATXN1; (+) strand; PAM type: NRG; PAM sequence: TGG
atttcccacaaatataaaga

SEQ ID NO: 136606 - DNA, 20 bp, Artificial Sequence
  Description of Artificial Sequence: Synthetic oligonucleotide
  Target: ATXN1; (+) strand; PAM type: NRG; PAM sequence: GGG
tttcccacaaatataaagat

SEQ ID NO: 136607 - DNA, 20 bp, Artificial Sequence
  Description of Artificial Sequence: Synthetic oligonucleotide
  Target: ATXN1; (+) strand; PAM type: NRG; PAM sequence: GGG
ttcccacaaatataaagatg

SEQ ID NO: 136608 - DNA, 20 bp, Artificial Sequence
  Description of Artificial Sequence: Synthetic oligonucleotide
  Target: ATXN1; (+) strand; PAM type: NRG; PAM sequence: GGG
tcccacaaatataaagatgg

SEQ ID NO: 136609 - DNA, 20 bp, Artificial Sequence
  Description of Artificial Sequence: Synthetic oligonucleotide
  Target: ATXN1; (+) strand; PAM type: NRG; PAM sequence: GGG
cccacaaatataaagatggg

SEQ ID NO: 136610 - DNA, 20 bp, Artificial Sequence
  Description of Artificial Sequence: Synthetic oligonucleotide
  Target: ATXN1; (+) strand; PAM type: NRG; PAM sequence: AAG
acaaatataaagatgggggg

SEQ ID NO: 136611 - DNA, 20 bp, Artificial Sequence
  Description of Artificial Sequence: Synthetic oligonucleotide
  Target: ATXN1; (+) strand; PAM type: NRG; PAM sequence: CAG
agatggggggaagtctacac

SEQ ID NO: 136612 - DNA, 20 bp, Artificial Sequence
  Description of Artificial Sequence: Synthetic oligonucleotide
  Target: ATXN1; (+) strand; PAM type: NRG; PAM sequence: AAG
ctacaccagtgctgaaaaaa

SEQ ID NO: 136613 - DNA, 20 bp, Artificial Sequence
  Description of Artificial Sequence: Synthetic oligonucleotide
  Target: ATXN1; (+) strand; PAM type: NRG; PAM sequence: AGG
tacaccagtgctgaaaaaaa

SEQ ID NO: 136614 - DNA, 20 bp, Artificial Sequence
  Description of Artificial Sequence: Synthetic oligonucleotide
  Target: ATXN1; (+) strand; PAM type: NRG; PAM sequence: GAG
caccagtgctgaaaaaaaag

SEQ ID NO: 136615 - DNA, 20 bp, Artificial Sequence
  Description of Artificial Sequence: Synthetic oligonucleotide
  Target: ATXN1; (+) strand; PAM type: NRG; PAM sequence: AGG
accagtgctgaaaaaaaagg

SEQ ID NO: 136616 - DNA, 20 bp, Artificial Sequence
  Description of Artificial Sequence: Synthetic oligonucleotide
  Target: ATXN1; (+) strand; PAM type: NRG; PAM sequence: GGG
ccagtgctgaaaaaaaagga

SEQ ID NO: 136617 - DNA, 20 bp, Artificial Sequence
  Description of Artificial Sequence: Synthetic oligonucleotide
  Target: ATXN1; (+) strand; PAM type: NRG; PAM sequence: CAG
tgaaaaaaaaggagggcacc

SEQ ID NO: 136618 - DNA, 20 bp, Artificial Sequence
  Description of Artificial Sequence: Synthetic oligonucleotide
  Target: ATXN1; (+) strand; PAM type: NRG; PAM sequence: AAG
cacccagcatttttaacatt

SEQ ID NO: 136619 - DNA, 20 bp, Artificial Sequence
  Description of Artificial Sequence: Synthetic oligonucleotide
  Target: ATXN1; (+) strand; PAM type: NRG; PAM sequence: TAG
ttaacattaagacattttgt

SEQ ID NO: 136620 - DNA, 20 bp, Artificial Sequence
  Description of Artificial Sequence: Synthetic oligonucleotide
  Target: ATXN1; (+) strand; PAM type: NRG; PAM sequence: TAG
cattaagacattttgttaga

SEQ ID NO: 136621 - DNA, 20 bp, Artificial Sequence
  Description of Artificial Sequence: Synthetic oligonucleotide
  Target: ATXN1; (+) strand; PAM type: NRG; PAM sequence: CAG
agacattttgttagatagac

SEQ ID NO: 136622 - DNA, 20 bp, Artificial Sequence
  Description of Artificial Sequence: Synthetic oligonucleotide
  Target: ATXN1; (+) strand; PAM type: NRG; PAM sequence: GAG
acattttgttagatagacca

SEQ ID NO: 136623 - DNA, 20 bp, Artificial Sequence
  Description of Artificial Sequence: Synthetic oligonucleotide
  Target: ATXN1; (+) strand; PAM type: NRG; PAM sequence: AAG
tttgttagatagaccagaga

SEQ ID NO: 136624 - DNA, 20 bp, Artificial Sequence
  Description of Artificial Sequence: Synthetic oligonucleotide
  Target: ATXN1; (+) strand; PAM type: NRG; PAM sequence: AAG
ccagagaaagcatcacataa

SEQ ID NO: 136625 - DNA, 20 bp, Artificial Sequence
  Description of Artificial Sequence: Synthetic oligonucleotide
  Target: ATXN1; (+) strand; PAM type: NRG; PAM sequence: AGG
cagagaaagcatcacataaa

SEQ ID NO: 136626 - DNA, 20 bp, Artificial Sequence
  Description of Artificial Sequence: Synthetic oligonucleotide
  Target: ATXN1; (+) strand; PAM type: NRG; PAM sequence: CAG
catcacataaaaggctgaat

SEQ ID NO: 136627 - DNA, 20 bp, Artificial Sequence
  Description of Artificial Sequence: Synthetic oligonucleotide
  Target: ATXN1; (+) strand; PAM type: NRG; PAM sequence: TGG
gctgaatcagaaatgtgtgt

SEQ ID NO: 136628 - DNA, 20 bp, Artificial Sequence
  Description of Artificial Sequence: Synthetic oligonucleotide
  Target: ATXN1; (+) strand; PAM type: NRG; PAM sequence: GGG
ctgaatcagaaatgtgtgtt

SEQ ID NO: 136629 - DNA, 20 bp, Artificial Sequence
  Description of Artificial Sequence: Synthetic oligonucleotide
  Target: ATXN1; (+) strand; PAM type: NRG; PAM sequence: AAG
ttgggattctctttcttgaa

SEQ ID NO: 136630 - DNA, 20 bp, Artificial Sequence
  Description of Artificial Sequence: Synthetic oligonucleotide
  Target: ATXN1; (+) strand; PAM type: NRG; PAM sequence: AGG
tgggattctctttcttgaaa

SEQ ID NO: 136631 - DNA, 20 bp, Artificial Sequence
  Description of Artificial Sequence: Synthetic oligonucleotide
  Target: ATXN1; (+) strand; PAM type: NRG; PAM sequence: TGG
gattctctttcttgaaaagg

SEQ ID NO: 136632 - DNA, 20 bp, Artificial Sequence
  Description of Artificial Sequence: Synthetic oligonucleotide
  Target: ATXN1; (+) strand; PAM type: NRG; PAM sequence: CAG
tctttcttgaaaaggtggca

SEQ ID NO: 136633 - DNA, 20 bp, Artificial Sequence
  Description of Artificial Sequence: Synthetic oligonucleotide
  Target: ATXN1; (+) strand; PAM type: NRG; PAM sequence: GAG
aaaaggtggcacagcactgt

SEQ ID NO: 136634 - DNA, 20 bp, Artificial Sequence
  Description of Artificial Sequence: Synthetic oligonucleotide
  Target: ATXN1; (+) strand; PAM type: NRG; PAM sequence: AAG
aggtggcacagcactgtgag

SEQ ID NO: 136635 - DNA, 20 bp, Artificial Sequence
  Description of Artificial Sequence: Synthetic oligonucleotide
  Target: ATXN1; (+) strand; PAM type: NRG; PAM sequence: AAG
acagcactgtgagaagaaac

SEQ ID NO: 136636 - DNA, 20 bp, Artificial Sequence
  Description of Artificial Sequence: Synthetic oligonucleotide
  Target: ATXN1; (+) strand; PAM type: NRG; PAM sequence: AAG
gcactgtgagaagaaacaag

SEQ ID NO: 136637 - DNA, 20 bp, Artificial Sequence
  Description of Artificial Sequence: Synthetic oligonucleotide
  Target: ATXN1; (+) strand; PAM type: NRG; PAM sequence: GAG
actgtgagaagaaacaagaa

SEQ ID NO: 136638 - DNA, 20 bp, Artificial Sequence
  Description of Artificial Sequence: Synthetic oligonucleotide
  Target: ATXN1; (+) strand; PAM type: NRG; PAM sequence: CAG
gaaacaagaagagattctga

SEQ ID NO: 136639 - DNA, 20 bp, Artificial Sequence
  Description of Artificial Sequence: Synthetic oligonucleotide
  Target: ATXN1; (+) strand; PAM type: NRG; PAM sequence: GAG
aacaagaagagattctgaca

SEQ ID NO: 136640 - DNA, 20 bp, Artificial Sequence
  Description of Artificial Sequence: Synthetic oligonucleotide
  Target: ATXN1; (+) strand; PAM type: NRG; PAM sequence: TGG
aagagattctgacagagcac

SEQ ID NO: 136641 - DNA, 20 bp, Artificial Sequence
  Description of Artificial Sequence: Synthetic oligonucleotide
  Target: ATXN1; (+) strand; PAM type: NRG; PAM sequence: TAG
gattctgacagagcactggt

SEQ ID NO: 136642 - DNA, 20 bp, Artificial Sequence
  Description of Artificial Sequence: Synthetic oligonucleotide
  Target: ATXN1; (+) strand; PAM type: NRG; PAM sequence: TGG
ggttagaaatcttcctaaaa

SEQ ID NO: 136643 - DNA, 20 bp, Artificial Sequence
  Description of Artificial Sequence: Synthetic oligonucleotide
  Target: ATXN1; (+) strand; PAM type: NRG; PAM sequence: TGG
tcctaaaatggactgaacgc

SEQ ID NO: 136644 - DNA, 20 bp, Artificial Sequence
  Description of Artificial Sequence: Synthetic oligonucleotide
  Target: ATXN1; (+) strand; PAM type: NRG; PAM sequence: GAG
ctaaaatggactgaacgctg

SEQ ID NO: 136645 - DNA, 20 bp, Artificial Sequence
  Description of Artificial Sequence: Synthetic oligonucleotide
  Target: ATXN1; (+) strand; PAM type: NRG; PAM sequence: AGG
taaaatggactgaacgctgg

SEQ ID NO: 136646 - DNA, 20 bp, Artificial Sequence
  Description of Artificial Sequence: Synthetic oligonucleotide
  Target: ATXN1; (+) strand; PAM type: NRG; PAM sequence: GAG
atggactgaacgctggaggt

SEQ ID NO: 136647 - DNA, 20 bp, Artificial Sequence
  Description of Artificial Sequence: Synthetic oligonucleotide
  Target: ATXN1; (+) strand; PAM type: NRG; PAM sequence: GAG
ggactgaacgctggaggtga

SEQ ID NO: 136648 - DNA, 20 bp, Artificial Sequence
  Description of Artificial Sequence: Synthetic oligonucleotide
  Target: ATXN1; (+) strand; PAM type: NRG; PAM sequence: CAG
ctgaacgctggaggtgagag

SEQ ID NO: 136649 - DNA, 20 bp, Artificial Sequence
  Description of Artificial Sequence: Synthetic oligonucleotide
  Target: ATXN1; (+) strand; PAM type: NRG; PAM sequence: AGG
tgaacgctggaggtgagagc

SEQ ID NO: 136650 - DNA, 20 bp, Artificial Sequence
  Description of Artificial Sequence: Synthetic oligonucleotide
  Target: ATXN1; (+) strand; PAM type: NRG; PAM sequence: TAG
cgctggaggtgagagcaggc

SEQ ID NO: 136651 - DNA, 20 bp, Artificial Sequence
  Description of Artificial Sequence: Synthetic oligonucleotide
  Target: ATXN1; (+) strand; PAM type: NRG; PAM sequence: CAG
gtgagagcaggctagcaaac

SEQ ID NO: 136652 - DNA, 20 bp, Artificial Sequence
  Description of Artificial Sequence: Synthetic oligonucleotide
  Target: ATXN1; (+) strand; PAM type: NRG; PAM sequence: TAG
gagcaggctagcaaaccaga

SEQ ID NO: 136653 - DNA, 20 bp, Artificial Sequence
  Description of Artificial Sequence: Synthetic oligonucleotide
  Target: ATXN1; (+) strand; PAM type: NRG; PAM sequence: TGG
ctagcaaaccagatagtgtc

SEQ ID NO: 136654 - DNA, 20 bp, Artificial Sequence
  Description of Artificial Sequence: Synthetic oligonucleotide
  Target: ATXN1; (+) strand; PAM type: NRG; PAM sequence: CAG
accagatagtgtctggtgtc

SEQ ID NO: 136655 - DNA, 20 bp, Artificial Sequence
  Description of Artificial Sequence: Synthetic oligonucleotide
  Target: ATXN1; (+) strand; PAM type: NRG; PAM sequence: AGG
ccagatagtgtctggtgtcc

SEQ ID NO: 136656 - DNA, 20 bp, Artificial Sequence
  Description of Artificial Sequence: Synthetic oligonucleotide
  Target: ATXN1; (+) strand; PAM type: NRG; PAM sequence: GGG
cagatagtgtctggtgtcca

SEQ ID NO: 136657 - DNA, 20 bp, Artificial Sequence
  Description of Artificial Sequence: Synthetic oligonucleotide
  Target: ATXN1; (+) strand; PAM type: NRG; PAM sequence: CGG
gtgtccagggcattcacatt

SEQ ID NO: 136658 - DNA, 20 bp, Artificial Sequence
  Description of Artificial Sequence: Synthetic oligonucleotide
  Target: ATXN1; (+) strand; PAM type: NRG; PAM sequence: AAG
tccagggcattcacattcgg

SEQ ID NO: 136659 - DNA, 20 bp, Artificial Sequence
  Description of Artificial Sequence: Synthetic oligonucleotide
  Target: ATXN1; (+) strand; PAM type: NRG; PAM sequence: AGG
ccagggcattcacattcgga

SEQ ID NO: 136660 - DNA, 20 bp, Artificial Sequence
  Description of Artificial Sequence: Synthetic oligonucleotide
  Target: ATXN1; (+) strand; PAM type: NRG; PAM sequence: AAG
attcacattcggaaggcact

SEQ ID NO: 136661 - DNA, 20 bp, Artificial Sequence
  Description of Artificial Sequence: Synthetic oligonucleotide
  Target: ATXN1; (+) strand; PAM type: NRG; PAM sequence: AAG
cacattcggaaggcactaag

SEQ ID NO: 136662 - DNA, 20 bp, Artificial Sequence
  Description of Artificial Sequence: Synthetic oligonucleotide
  Target: ATXN1; (+) strand; PAM type: NRG; PAM sequence: GAG
cattcggaaggcactaagaa

SEQ ID NO: 136663 - DNA, 20 bp, Artificial Sequence
  Description of Artificial Sequence: Synthetic oligonucleotide
  Target: ATXN1; (+) strand; PAM type: NRG; PAM sequence: AAG
aaggcactaagaagagaacc

SEQ ID NO: 136664 - DNA, 20 bp, Artificial Sequence
  Description of Artificial Sequence: Synthetic oligonucleotide
  Target: ATXN1; (+) strand; PAM type: NRG; PAM sequence: AAG
ctaagaagagaaccaagcat

SEQ ID NO: 136665 - DNA, 20 bp, Artificial Sequence
  Description of Artificial Sequence: Synthetic oligonucleotide
  Target: ATXN1; (+) strand; PAM type: NRG; PAM sequence: TGG
gcataagtcctccatgccca

SEQ ID NO: 136666 - DNA, 20 bp, Artificial Sequence
  Description of Artificial Sequence: Synthetic oligonucleotide
  Target: ATXN1; (+) strand; PAM type: NRG; PAM sequence: TGG
cctccatgcccatggccatc

SEQ ID NO: 136667 - DNA, 20 bp, Artificial Sequence
  Description of Artificial Sequence: Synthetic oligonucleotide
  Target: ATXN1; (+) strand; PAM type: NRG; PAM sequence: TGG
ccatgcccatggccatctgg

SEQ ID NO: 136668 - DNA, 20 bp, Artificial Sequence
  Description of Artificial Sequence: Synthetic oligonucleotide
  Target: ATXN1; (+) strand; PAM type: NRG; PAM sequence: GGG
catgcccatggccatctggt

SEQ ID NO: 136669 - DNA, 20 bp, Artificial Sequence
  Description of Artificial Sequence: Synthetic oligonucleotide
  Target: ATXN1; (+) strand; PAM type: NRG; PAM sequence: GAG
atggccatctggtgggatgt

SEQ ID NO: 136670 - DNA, 20 bp, Artificial Sequence
  Description of Artificial Sequence: Synthetic oligonucleotide
  Target: ATXN1; (+) strand; PAM type: NRG; PAM sequence: TAG
atgtgagatgtctctctaca

SEQ ID NO: 136671 - DNA, 20 bp, Artificial Sequence
  Description of Artificial Sequence: Synthetic oligonucleotide
  Target: ATXN1; (+) strand; PAM type: NRG; PAM sequence: CAG
tgagatgtctctctacatag

SEQ ID NO: 136672 - DNA, 20 bp, Artificial Sequence
  Description of Artificial Sequence: Synthetic oligonucleotide
  Target: ATXN1; (+) strand; PAM type: NRG; PAM sequence: AGG
gagatgtctctctacatagc

SEQ ID NO: 136673 - DNA, 20 bp, Artificial Sequence
  Description of Artificial Sequence: Synthetic oligonucleotide
  Target: ATXN1; (+) strand; PAM type: NRG; PAM sequence: CAG
acatagcaggactctgatgc

SEQ ID NO: 136674 - DNA, 20 bp, Artificial Sequence
  Description of Artificial Sequence: Synthetic oligonucleotide
  Target: ATXN1; (+) strand; PAM type: NRG; PAM sequence: AAG
aaaatgcatcctctgctaca

SEQ ID NO: 136675 - DNA, 20 bp, Artificial Sequence
  Description of Artificial Sequence: Synthetic oligonucleotide
  Target: ATXN1; (+) strand; PAM type: NRG; PAM sequence: AGG
aaatgcatcctctgctacaa

SEQ ID NO: 136676 - DNA, 20 bp, Artificial Sequence
  Description of Artificial Sequence: Synthetic oligonucleotide
  Target: ATXN1; (+) strand; PAM type: NRG; PAM sequence: GGG
aatgcatcctctgctacaaa

SEQ ID NO: 136677 - DNA, 20 bp, Artificial Sequence
  Description of Artificial Sequence: Synthetic oligonucleotide
  Target: ATXN1; (+) strand; PAM type: NRG; PAM sequence: GGG
atgcatcctctgctacaaag

SEQ ID NO: 136678 - DNA, 20 bp, Artificial Sequence
  Description of Artificial Sequence: Synthetic oligonucleotide
  Target: ATXN1; (+) strand; PAM type: NRG; PAM sequence: GGG
tgcatcctctgctacaaagg

SEQ ID NO: 136679 - DNA, 20 bp, Artificial Sequence
  Description of Artificial Sequence: Synthetic oligonucleotide
  Target: ATXN1; (+) strand; PAM type: NRG; PAM sequence: TGG
cctctgctacaaagggggct

SEQ ID NO: 136680 - DNA, 20 bp, Artificial Sequence
  Description of Artificial Sequence: Synthetic oligonucleotide
  Target: ATXN1; (+) strand; PAM type: NRG; PAM sequence: GAG
tctgctacaaagggggcttg

SEQ ID NO: 136681 - DNA, 20 bp, Artificial Sequence
  Description of Artificial Sequence: Synthetic oligonucleotide
  Target: ATXN1; (+) strand; PAM type: NRG; PAM sequence: AAG
tacaaagggggcttggagtg

SEQ ID NO: 136682 - DNA, 20 bp, Artificial Sequence
  Description of Artificial Sequence: Synthetic oligonucleotide
  Target: ATXN1; (+) strand; PAM type: NRG; PAM sequence: TAG
aagggggcttggagtgaagc

SEQ ID NO: 136683 - DNA, 20 bp, Artificial Sequence
  Description of Artificial Sequence: Synthetic oligonucleotide
  Target: ATXN1; (+) strand; PAM type: NRG; PAM sequence: AGG
agggggcttggagtgaagct

SEQ ID NO: 136684 - DNA, 20 bp, Artificial Sequence
  Description of Artificial Sequence: Synthetic oligonucleotide
  Target: ATXN1; (+) strand; PAM type: NRG; PAM sequence: GGG
gggggcttggagtgaagcta

SEQ ID NO: 136685 - DNA, 20 bp, Artificial Sequence
  Description of Artificial Sequence: Synthetic oligonucleotide
  Target: ATXN1; (+) strand; PAM type: NRG; PAM sequence: CAG
gcttggagtgaagctagggt

SEQ ID NO: 136686 - DNA, 20 bp, Artificial Sequence
  Description of Artificial Sequence: Synthetic oligonucleotide
  Target: ATXN1; (+) strand; PAM type: NRG; PAM sequence: AGG
cttggagtgaagctagggtc

SEQ ID NO: 136687 - DNA, 20 bp, Artificial Sequence
  Description of Artificial Sequence: Synthetic oligonucleotide
  Target: ATXN1; (+) strand; PAM type: NRG; PAM sequence: GGG
ttggagtgaagctagggtca

SEQ ID NO: 136688 - DNA, 20 bp, Artificial Sequence
  Description of Artificial Sequence: Synthetic oligonucleotide
  Target: ATXN1; (+) strand; PAM type: NRG; PAM sequence: GAG
ggagtgaagctagggtcagg

SEQ ID NO: 136689 - DNA, 20 bp, Artificial Sequence
  Description of Artificial Sequence: Synthetic oligonucleotide
  Target: ATXN1; (+) strand; PAM type: NRG; PAM sequence: AAG
gtgaagctagggtcagggag

SEQ ID NO: 136690 - DNA, 20 bp, Artificial Sequence
  Description of Artificial Sequence: Synthetic oligonucleotide
  Target: ATXN1; (+) strand; PAM type: NRG; PAM sequence: CAG
gctagggtcagggagaagtt

SEQ ID NO: 136691 - DNA, 20 bp, Artificial Sequence
  Description of Artificial Sequence: Synthetic oligonucleotide
  Target: ATXN1; (+) strand; PAM type: NRG; PAM sequence: GAG
gtcagggagaagttcagaat

SEQ ID NO: 136692 - DNA, 20 bp, Artificial Sequence
  Description of Artificial Sequence: Synthetic oligonucleotide
  Target: ATXN1; (+) strand; PAM type: NRG; PAM sequence: TGG
aaccactgtctcttgcacga

SEQ ID NO: 136693 - DNA, 20 bp, Artificial Sequence
  Description of Artificial Sequence: Synthetic oligonucleotide
  Target: ATXN1; (+) strand; PAM type: NRG; PAM sequence: AAG
cgatggcttcacccattgcc

SEQ ID NO: 136694 - DNA, 20 bp, Artificial Sequence
  Description of Artificial Sequence: Synthetic oligonucleotide
  Target: ATXN1; (+) strand; PAM type: NRG; PAM sequence: CAG
tggcttcacccattgccaag

SEQ ID NO: 136695 - DNA, 20 bp, Artificial Sequence
  Description of Artificial Sequence: Synthetic oligonucleotide
  Target: ATXN1; (+) strand; PAM type: NRG; PAM sequence: AAG
ttgccaagcagcaaccatgc

SEQ ID NO: 136696 - DNA, 20 bp, Artificial Sequence
  Description of Artificial Sequence: Synthetic oligonucleotide
  Target: ATXN1; (+) strand; PAM type: NRG; PAM sequence: AGG
tgccaagcagcaaccatgca

SEQ ID NO: 136697 - DNA, 20 bp, Artificial Sequence
  Description of Artificial Sequence: Synthetic oligonucleotide
  Target: ATXN1; (+) strand; PAM type: NRG; PAM sequence: AAG
caagcagcaaccatgcaagg

SEQ ID NO: 136698 - DNA, 20 bp, Artificial Sequence
  Description of Artificial Sequence: Synthetic oligonucleotide
  Target: ATXN1; (+) strand; PAM type: NRG; PAM sequence: TAG
catgcaaggaagaaccccaa

SEQ ID NO: 136699 - DNA, 20 bp, Artificial Sequence
  Description of Artificial Sequence: Synthetic oligonucleotide
  Target: ATXN1; (+) strand; PAM type: NRG; PAM sequence: GAG
tgcaaggaagaaccccaata

SEQ ID NO: 136700 - DNA, 20 bp, Artificial Sequence
  Description of Artificial Sequence: Synthetic oligonucleotide
  Target: ATXN1; (+) strand; PAM type: NRG; PAM sequence: TGG
ccccaatagagattgccctg

SEQ ID NO: 136701 - DNA, 20 bp, Artificial Sequence
  Description of Artificial Sequence: Synthetic oligonucleotide
  Target: ATXN1; (+) strand; PAM type: NRG; PAM sequence: CAG
tagagattgccctgtggctc

SEQ ID NO: 136702 - DNA, 20 bp, Artificial Sequence
  Description of Artificial Sequence: Synthetic oligonucleotide
  Target: ATXN1; (+) strand; PAM type: NRG; PAM sequence: CAG
cagctccctacaaatttgtg

SEQ ID NO: 136703 - DNA, 20 bp, Artificial Sequence
  Description of Artificial Sequence: Synthetic oligonucleotide
  Target: ATXN1; (+) strand; PAM type: NRG; PAM sequence: TGG
cagctgctgaaaaacacacc

SEQ ID NO: 136704 - DNA, 20 bp, Artificial Sequence
  Description of Artificial Sequence: Synthetic oligonucleotide
  Target: ATXN1; (+) strand; PAM type: NRG; PAM sequence: TAG
gctgaaaaacacacctggtc

SEQ ID NO: 136705 - DNA, 20 bp, Artificial Sequence
  Description of Artificial Sequence: Synthetic oligonucleotide
  Target: ATXN1; (+) strand; PAM type: NRG; PAM sequence: AAG
acctggtctagtacattttt

SEQ ID NO: 136706 - DNA, 20 bp, Artificial Sequence
  Description of Artificial Sequence: Synthetic oligonucleotide
  Target: ATXN1; (+) strand; PAM type: NRG; PAM sequence: AAG
ctagtacatttttaagaaca

SEQ ID NO: 136707 - DNA, 20 bp, Artificial Sequence
  Description of Artificial Sequence: Synthetic oligonucleotide
  Target: ATXN1; (+) strand; PAM type: NRG; PAM sequence: CAG
atttttaagaacaaagcctt

SEQ ID NO: 136708 - DNA, 20 bp, Artificial Sequence
  Description of Artificial Sequence: Synthetic oligonucleotide
  Target: ATXN1; (+) strand; PAM type: NRG; PAM sequence: AAG
aagaacaaagccttcagctt

SEQ ID NO: 136709 - DNA, 20 bp, Artificial Sequence
  Description of Artificial Sequence: Synthetic oligonucleotide
  Target: ATXN1; (+) strand; PAM type: NRG; PAM sequence: GAG
aaagccttcagcttaagacc

SEQ ID NO: 136710 - DNA, 20 bp, Artificial Sequence
  Description of Artificial Sequence: Synthetic oligonucleotide
  Target: ATXN1; (+) strand; PAM type: NRG; PAM sequence: AGG
aagccttcagcttaagaccg

SEQ ID NO: 136711 - DNA, 20 bp, Artificial Sequence
  Description of Artificial Sequence: Synthetic oligonucleotide
  Target: ATXN1; (+) strand; PAM type: NRG; PAM sequence: AAG
cttcagcttaagaccgagga

SEQ ID NO: 136712 - DNA, 20 bp, Artificial Sequence
  Description of Artificial Sequence: Synthetic oligonucleotide
  Target: ATXN1; (+) strand; PAM type: NRG; PAM sequence: AGG
ttcagcttaagaccgaggaa

SEQ ID NO: 136713 - DNA, 20 bp, Artificial Sequence
  Description of Artificial Sequence: Synthetic oligonucleotide
  Target: ATXN1; (+) strand; PAM type: NRG; PAM sequence: GAG
cagcttaagaccgaggaaag

SEQ ID NO: 136714 - DNA, 20 bp, Artificial Sequence
  Description of Artificial Sequence: Synthetic oligonucleotide
  Target: ATXN1; (+) strand; PAM type: NRG; PAM sequence: TGG
ggagtccaacctttccctaa

SEQ ID NO: 136715 - DNA, 20 bp, Artificial Sequence
  Description of Artificial Sequence: Synthetic oligonucleotide
  Target: ATXN1; (+) strand; PAM type: NRG; PAM sequence: CAG
ccaacctttccctaatggta

SEQ ID NO: 136716 - DNA, 20 bp, Artificial Sequence
  Description of Artificial Sequence: Synthetic oligonucleotide
  Target: ATXN1; (+) strand; PAM type: NRG; PAM sequence: GAG
aacctttccctaatggtaca

SEQ ID NO: 136717 - DNA, 20 bp, Artificial Sequence
  Description of Artificial Sequence: Synthetic oligonucleotide
  Target: ATXN1; (+) strand; PAM type: NRG; PAM sequence: GAG
taatggtacagagattattt

SEQ ID NO: 136718 - DNA, 20 bp, Artificial Sequence
  Description of Artificial Sequence: Synthetic oligonucleotide
  Target: ATXN1; (+) strand; PAM type: NRG; PAM sequence: CAG
gattatttgagaacaatttc

SEQ ID NO: 136719 - DNA, 20 bp, Artificial Sequence
  Description of Artificial Sequence: Synthetic oligonucleotide
  Target: ATXN1; (+) strand; PAM type: NRG; PAM sequence: AGG
attatttgagaacaatttcc

SEQ ID NO: 136720 - DNA, 20 bp, Artificial Sequence
  Description of Artificial Sequence: Synthetic oligonucleotide
  Target: ATXN1; (+) strand; PAM type: NRG; PAM sequence: GGG
ttatttgagaacaatttcca

SEQ ID NO: 136721 - DNA, 20 bp, Artificial Sequence
  Description of Artificial Sequence: Synthetic oligonucleotide
  Target: ATXN1; (+) strand; PAM type: NRG; PAM sequence: CGG
tttgagaacaatttccaggg

SEQ ID NO: 136722 - DNA, 20 bp, Artificial Sequence
  Description of Artificial Sequence: Synthetic oligonucleotide
  Target: ATXN1; (+) strand; PAM type: NRG; PAM sequence: GGG
ttgagaacaatttccagggc

SEQ ID NO: 136723 - DNA, 20 bp, Artificial Sequence
  Description of Artificial Sequence: Synthetic oligonucleotide
  Target: ATXN1; (+) strand; PAM type: NRG; PAM sequence: TAG
gaacaatttccagggcgggc

SEQ ID NO: 136724 - DNA, 20 bp, Artificial Sequence
  Description of Artificial Sequence: Synthetic oligonucleotide
  Target: ATXN1; (+) strand; PAM type: NRG; PAM sequence: GAG
ccctcccatcattcaatgat

SEQ ID NO: 136725 - DNA, 20 bp, Artificial Sequence
  Description of Artificial Sequence: Synthetic oligonucleotide
  Target: ATXN1; (+) strand; PAM type: NRG; PAM sequence: CAG
tcccatcattcaatgatgag

SEQ ID NO: 136726 - DNA, 20 bp, Artificial Sequence
  Description of Artificial Sequence: Synthetic oligonucleotide
  Target: ATXN1; (+) strand; PAM type: NRG; PAM sequence: TGG
atgatgagcagacccaaaac

SEQ ID NO: 136727 - DNA, 20 bp, Artificial Sequence
  Description of Artificial Sequence: Synthetic oligonucleotide
  Target: ATXN1; (+) strand; PAM type: NRG; PAM sequence: TGG
agacccaaaactggcaacat

SEQ ID NO: 136728 - DNA, 20 bp, Artificial Sequence
  Description of Artificial Sequence: Synthetic oligonucleotide
  Target: ATXN1; (+) strand; PAM type: NRG; PAM sequence: GGG
gacccaaaactggcaacatt

SEQ ID NO: 136729 - DNA, 20 bp, Artificial Sequence
  Description of Artificial Sequence: Synthetic oligonucleotide
  Target: ATXN1; (+) strand; PAM type: NRG; PAM sequence: AAG
actggcaacattgggcttat

SEQ ID NO: 136730 - DNA, 20 bp, Artificial Sequence
  Description of Artificial Sequence: Synthetic oligonucleotide
  Target: ATXN1; (+) strand; PAM type: NRG; PAM sequence: AGG
ctggcaacattgggcttata

SEQ ID NO: 136731 - DNA, 20 bp, Artificial Sequence
  Description of Artificial Sequence: Synthetic oligonucleotide
  Target: ATXN1; (+) strand; PAM type: NRG; PAM sequence: TGG
acattgggcttataaggact

SEQ ID NO: 136732 - DNA, 20 bp, Artificial Sequence
  Description of Artificial Sequence: Synthetic oligonucleotide
  Target: ATXN1; (+) strand; PAM type: NRG; PAM sequence: AAG
aaggacttggttaacaaaac

SEQ ID NO: 136733 - DNA, 20 bp, Artificial Sequence
  Description of Artificial Sequence: Synthetic oligonucleotide
  Target: ATXN1; (+) strand; PAM type: NRG; PAM sequence: AAG
taacaaaacaagaaacatcc

SEQ ID NO: 136734 - DNA, 20 bp, Artificial Sequence
  Description of Artificial Sequence: Synthetic oligonucleotide
  Target: ATXN1; (+) strand; PAM type: NRG; PAM sequence: AAG
caagaaacatccaagaaata

SEQ ID NO: 136735 - DNA, 20 bp, Artificial Sequence
  Description of Artificial Sequence: Synthetic oligonucleotide
  Target: ATXN1; (+) strand; PAM type: NRG; PAM sequence: AGG
aagaaacatccaagaaataa

SEQ ID NO: 136736 - DNA, 20 bp, Artificial Sequence
  Description of Artificial Sequence: Synthetic oligonucleotide
  Target: ATXN1; (+) strand; PAM type: NRG; PAM sequence: AAG
aaacatccaagaaataaagg

SEQ ID NO: 136737 - DNA, 20 bp, Artificial Sequence
  Description of Artificial Sequence: Synthetic oligonucleotide
  Target: ATXN1; (+) strand; PAM type: NRG; PAM sequence: AAG
catccaagaaataaaggaag

SEQ ID NO: 136738 - DNA, 20 bp, Artificial Sequence
  Description of Artificial Sequence: Synthetic oligonucleotide
  Target: ATXN1; (+) strand; PAM type: NRG; PAM sequence: TGG
tttcaaaaaatatttactac

SEQ ID NO: 136739 - DNA, 20 bp, Artificial Sequence
  Description of Artificial Sequence: Synthetic oligonucleotide
  Target: ATXN1; (+) strand; PAM type: NRG; PAM sequence: TAG
aaaatatttactactggaaa

SEQ ID NO: 136740 - DNA, 20 bp, Artificial Sequence
  Description of Artificial Sequence: Synthetic oligonucleotide
  Target: ATXN1; (+) strand; PAM type: NRG; PAM sequence: AAG
ttactactggaaatagaaac

SEQ ID NO: 136741 - DNA, 20 bp, Artificial Sequence
  Description of Artificial Sequence: Synthetic oligonucleotide
  Target: ATXN1; (+) strand; PAM type: NRG; PAM sequence: CAG
ctggaaatagaaacaagttt

SEQ ID NO: 136742 - DNA, 20 bp, Artificial Sequence
  Description of Artificial Sequence: Synthetic oligonucleotide
  Target: ATXN1; (+) strand; PAM type: NRG; PAM sequence: AAG
aatagaaacaagtttcagac

SEQ ID NO: 136743 - DNA, 20 bp, Artificial Sequence
  Description of Artificial Sequence: Synthetic oligonucleotide
  Target: ATXN1; (+) strand; PAM type: NRG; PAM sequence: AAG
agatgtgatttgcacctttg

SEQ ID NO: 136744 - DNA, 20 bp, Artificial Sequence
  Description of Artificial Sequence: Synthetic oligonucleotide
  Target: ATXN1; (+) strand; PAM type: NRG; PAM sequence: AAG
tgtgatttgcacctttgaag

SEQ ID NO: 136745 - DNA, 20 bp, Artificial Sequence
  Description of Artificial Sequence: Synthetic oligonucleotide
  Target: ATXN1; (+) strand; PAM type: NRG; PAM sequence: AGG
gtgatttgcacctttgaaga

SEQ ID NO: 136746 - DNA, 20 bp, Artificial Sequence
  Description of Artificial Sequence: Synthetic oligonucleotide
  Target: ATXN1; (+) strand; PAM type: NRG; PAM sequence: GAG
gatttgcacctttgaagaag

SEQ ID NO: 136747 - DNA, 20 bp, Artificial Sequence
  Description of Artificial Sequence: Synthetic oligonucleotide
  Target: ATXN1; (+) strand; PAM type: NRG; PAM sequence: AGG
atttgcacctttgaagaagg

SEQ ID NO: 136748 - DNA, 20 bp, Artificial Sequence
  Description of Artificial Sequence: Synthetic oligonucleotide
  Target: ATXN1; (+) strand; PAM type: NRG; PAM sequence: GAG
ttgcacctttgaagaaggag

SEQ ID NO: 136749 - DNA, 20 bp, Artificial Sequence
  Description of Artificial Sequence: Synthetic oligonucleotide
  Target: ATXN1; (+) strand; PAM type: NRG; PAM sequence: AGG
tgcacctttgaagaaggagg

SEQ ID NO: 136750 - DNA, 20 bp, Artificial Sequence
  Description of Artificial Sequence: Synthetic oligonucleotide
  Target: ATXN1; (+) strand; PAM type: NRG; PAM sequence: AAG
tttgaagaaggaggaggaaa

SEQ ID NO: 136751 - DNA, 20 bp, Artificial Sequence
  Description of Artificial Sequence: Synthetic oligonucleotide
  Target: ATXN1; (+) strand; PAM type: NRG; PAM sequence: AAG
gaagaaggaggaggaaaaag

SEQ ID NO: 136752 - DNA, 20 bp, Artificial Sequence
  Description of Artificial Sequence: Synthetic oligonucleotide
  Target: ATXN1; (+) strand; PAM type: NRG; PAM sequence: AGG
aagaaggaggaggaaaaaga

SEQ ID NO: 136753 - DNA, 20 bp, Artificial Sequence
  Description of Artificial Sequence: Synthetic oligonucleotide
  Target: ATXN1; (+) strand; PAM type: NRG; PAM sequence: GGG
agaaggaggaggaaaaagaa

SEQ ID NO: 136754 - DNA, 20 bp, Artificial Sequence
  Description of Artificial Sequence: Synthetic oligonucleotide
  Target: ATXN1; (+) strand; PAM type: NRG; PAM sequence: GGG
gaaggaggaggaaaaagaag

SEQ ID NO: 136755 - DNA, 20 bp, Artificial Sequence
  Description of Artificial Sequence: Synthetic oligonucleotide
  Target: ATXN1; (+) strand; PAM type: NRG; PAM sequence: GAG
aggaggaggaaaaagaaggg

SEQ ID NO: 136756 - DNA, 20 bp, Artificial Sequence
  Description of Artificial Sequence: Synthetic oligonucleotide
  Target: ATXN1; (+) strand; PAM type: NRG; PAM sequence: AGG
ggaggaggaaaaagaagggg

SEQ ID NO: 136757 - DNA, 20 bp, Artificial Sequence
  Description of Artificial Sequence: Synthetic oligonucleotide
  Target: ATXN1; (+) strand; PAM type: NRG; PAM sequence: GAG
aggaggaaaaagaaggggag

SEQ ID NO: 136758 - DNA, 20 bp, Artificial Sequence
  Description of Artificial Sequence: Synthetic oligonucleotide
  Target: ATXN1; (+) strand; PAM type: NRG; PAM sequence: CAG
aaaaagaaggggaggagacc

SEQ ID NO: 136759 - DNA, 20 bp, Artificial Sequence
  Description of Artificial Sequence: Synthetic oligonucleotide
  Target: ATXN1; (+) strand; PAM type: NRG; PAM sequence: TAG
aaggggaggagacccagact

SEQ ID NO: 136760 - DNA, 20 bp, Artificial Sequence
  Description of Artificial Sequence: Synthetic oligonucleotide
  Target: ATXN1; (+) strand; PAM type: NRG; PAM sequence: AGG
aggggaggagacccagactt

SEQ ID NO: 136761 - DNA, 20 bp, Artificial Sequence
  Description of Artificial Sequence: Synthetic oligonucleotide
  Target: ATXN1; (+) strand; PAM type: NRG; PAM sequence: AAG
cagacttaggcgtgaatgac

SEQ ID NO: 136762 - DNA, 20 bp, Artificial Sequence
  Description of Artificial Sequence: Synthetic oligonucleotide
  Target: ATXN1; (+) strand; PAM type: NRG; PAM sequence: AAG
gacaagtaaatgaaaacaaa

SEQ ID NO: 136763 - DNA, 20 bp, Artificial Sequence
  Description of Artificial Sequence: Synthetic oligonucleotide
  Target: ATXN1; (+) strand; PAM type: NRG; PAM sequence: TAG
accaacttacaaaaaaaaat

SEQ ID NO: 136764 - DNA, 20 bp, Artificial Sequence
  Description of Artificial Sequence: Synthetic oligonucleotide
  Target: ATXN1; (+) strand; PAM type: NRG; PAM sequence: AGG
ccaacttacaaaaaaaaatt

SEQ ID NO: 136765 - DNA, 20 bp, Artificial Sequence
  Description of Artificial Sequence: Synthetic oligonucleotide
  Target: ATXN1; (+) strand; PAM type: NRG; PAM sequence: AAG
tttcaatgactgattttcca

SEQ ID NO: 136766 - DNA, 20 bp, Artificial Sequence
  Description of Artificial Sequence: Synthetic oligonucleotide
  Target: ATXN1; (+) strand; PAM type: NRG; PAM sequence: AAG
actacattcgatgcaatgaa

SEQ ID NO: 136767 - DNA, 20 bp, Artificial Sequence
  Description of Artificial Sequence: Synthetic oligonucleotide
  Target: ATXN1; (+) strand; PAM type: NRG; PAM sequence: AGG
ctacattcgatgcaatgaaa

SEQ ID NO: 136768 - DNA, 20 bp, Artificial Sequence
  Description of Artificial Sequence: Synthetic oligonucleotide
  Target: ATXN1; (+) strand; PAM type: NRG; PAM sequence: CAG
gatgcaatgaaaaggaaaaa

SEQ ID NO: 136769 - DNA, 20 bp, Artificial Sequence
  Description of Artificial Sequence: Synthetic oligonucleotide
  Target: ATXN1; (+) strand; PAM type: NRG; PAM sequence: TGG
tgaaaaggaaaaacagcctt

SEQ ID NO: 136770 - DNA, 20 bp, Artificial Sequence
  Description of Artificial Sequence: Synthetic oligonucleotide
  Target: ATXN1; (+) strand; PAM type: NRG; PAM sequence: GAG
aaaaggaaaaacagcctttg

SEQ ID NO: 136771 - DNA, 20 bp, Artificial Sequence
  Description of Artificial Sequence: Synthetic oligonucleotide
  Target: ATXN1; (+) strand; PAM type: NRG; PAM sequence: CAG
cagcctttggagcatcaaac

SEQ ID NO: 136772 - DNA, 20 bp, Artificial Sequence
  Description of Artificial Sequence: Synthetic oligonucleotide
  Target: ATXN1; (+) strand; PAM type: NRG; PAM sequence: AAG
ctttggagcatcaaaccagc

SEQ ID NO: 136773 - DNA, 20 bp, Artificial Sequence
  Description of Artificial Sequence: Synthetic oligonucleotide
  Target: ATXN1; (+) strand; PAM type: NRG; PAM sequence: AAG
gagcatcaaaccagcaagtg

SEQ ID NO: 136774 - DNA, 20 bp, Artificial Sequence
  Description of Artificial Sequence: Synthetic oligonucleotide
  Target: ATXN1; (+) strand; PAM type: NRG; PAM sequence: AAG
agtgaagaacaaacctgaaa

SEQ ID NO: 136775 - DNA, 20 bp, Artificial Sequence
  Description of Artificial Sequence: Synthetic oligonucleotide
  Target: ATXN1; (+) strand; PAM type: NRG; PAM sequence: AAG
aacctgaaaaagtctcccaa

SEQ ID NO: 136776 - DNA, 20 bp, Artificial Sequence
  Description of Artificial Sequence: Synthetic oligonucleotide
  Target: ATXN1; (+) strand; PAM type: NRG; PAM sequence: AGG
acctgaaaaagtctcccaaa

SEQ ID NO: 136777 - DNA, 20 bp, Artificial Sequence
  Description of Artificial Sequence: Synthetic oligonucleotide
  Target: ATXN1; (+) strand; PAM type: NRG; PAM sequence: TGG
aaaagtctcccaaaaggcac

SEQ ID NO: 136778 - DNA, 20 bp, Artificial Sequence
  Description of Artificial Sequence: Synthetic oligonucleotide
  Target: ATXN1; (+) strand; PAM type: NRG; PAM sequence: AAG
tcccaaaaggcactggaaaa

SEQ ID NO: 136779 - DNA, 20 bp, Artificial Sequence
  Description of Artificial Sequence: Synthetic oligonucleotide
  Target: ATXN1; (+) strand; PAM type: NRG; PAM sequence: AAG
ggcactggaaaaaagatgaa

SEQ ID NO: 136780 - DNA, 20 bp, Artificial Sequence
  Description of Artificial Sequence: Synthetic oligonucleotide
  Target: ATXN1; (+) strand; PAM type: NRG; PAM sequence: CAG
gatgaaaagtataaacaaat

SEQ ID NO: 136781 - DNA, 20 bp, Artificial Sequence
  Description of Artificial Sequence: Synthetic oligonucleotide
  Target: ATXN1; (+) strand; PAM type: NRG; PAM sequence: TAG
aaaagtataaacaaatcaga

SEQ ID NO: 136782 - DNA, 20 bp, Artificial Sequence
  Description of Artificial Sequence: Synthetic oligonucleotide
  Target: ATXN1; (+) strand; PAM type: NRG; PAM sequence: TGG
acaaatcagatagatgctaa

SEQ ID NO: 136783 - DNA, 20 bp, Artificial Sequence
  Description of Artificial Sequence: Synthetic oligonucleotide
  Target: ATXN1; (+) strand; PAM type: NRG; PAM sequence: CAG
cagatagatgctaatggata

SEQ ID NO: 136784 - DNA, 20 bp, Artificial Sequence
  Description of Artificial Sequence: Synthetic oligonucleotide
  Target: ATXN1; (+) strand; PAM type: NRG; PAM sequence: AGG
agatagatgctaatggatac

SEQ ID NO: 136785 - DNA, 20 bp, Artificial Sequence
  Description of Artificial Sequence: Synthetic oligonucleotide
  Target: ATXN1; (+) strand; PAM type: NRG; PAM sequence: GAG
atagatgctaatggatacag

SEQ ID NO: 136786 - DNA, 20 bp, Artificial Sequence
  Description of Artificial Sequence: Synthetic oligonucleotide
  Target: ATXN1; (+) strand; PAM type: NRG; PAM sequence: AAG
gctaatggatacaggagaca

SEQ ID NO: 136787 - DNA, 20 bp, Artificial Sequence
  Description of Artificial Sequence: Synthetic oligonucleotide
  Target: ATXN1; (+) strand; PAM type: NRG; PAM sequence: TAG
aatggatacaggagacaaag

SEQ ID NO: 136788 - DNA, 20 bp, Artificial Sequence
  Description of Artificial Sequence: Synthetic oligonucleotide
  Target: ATXN1; (+) strand; PAM type: NRG; PAM sequence: AGG
atggatacaggagacaaagt

SEQ ID NO: 136789 - DNA, 20 bp, Artificial Sequence
  Description of Artificial Sequence: Synthetic oligonucleotide
  Target: ATXN1; (+) strand; PAM type: NRG; PAM sequence: AAG
gatacaggagacaaagtagg

SEQ ID NO: 136790 - DNA, 20 bp, Artificial Sequence
  Description of Artificial Sequence: Synthetic oligonucleotide
  Target: ATXN1; (+) strand; PAM type: NRG; PAM sequence: TAG
gacaaagtaggaagccaaca

SEQ ID NO: 136791 - DNA, 20 bp, Artificial Sequence
  Description of Artificial Sequence: Synthetic oligonucleotide
  Target: ATXN1; (+) strand; PAM type: NRG; PAM sequence: GAG
caaagtaggaagccaacata

SEQ ID NO: 136792 - DNA, 20 bp, Artificial Sequence
  Description of Artificial Sequence: Synthetic oligonucleotide
  Target: ATXN1; (+) strand; PAM type: NRG; PAM sequence: TAG
gtaggaagccaacatagaga

SEQ ID NO: 136793 - DNA, 20 bp, Artificial Sequence
  Description of Artificial Sequence: Synthetic oligonucleotide
  Target: ATXN1; (+) strand; PAM type: NRG; PAM sequence: TAG
gagatagcatgattgatgca

SEQ ID NO: 136794 - DNA, 20 bp, Artificial Sequence
  Description of Artificial Sequence: Synthetic oligonucleotide
  Target: ATXN1; (+) strand; PAM type: NRG; PAM sequence: AAG
gcatgattgatgcatagtca

SEQ ID NO: 136795 - DNA, 20 bp, Artificial Sequence
  Description of Artificial Sequence: Synthetic oligonucleotide
  Target: ATXN1; (+) strand; PAM type: NRG; PAM sequence: CAG
catagtcaaagtaaatacca

SEQ ID NO: 136796 - DNA, 20 bp, Artificial Sequence
  Description of Artificial Sequence: Synthetic oligonucleotide
  Target: ATXN1; (+) strand; PAM type: NRG; PAM sequence: AAG
agtcaaagtaaataccacag

SEQ ID NO: 136797 - DNA, 20 bp, Artificial Sequence
  Description of Artificial Sequence: Synthetic oligonucleotide
  Target: ATXN1; (+) strand; PAM type: NRG; PAM sequence: AAG
taccacagaagcaattatta

SEQ ID NO: 136798 - DNA, 20 bp, Artificial Sequence
  Description of Artificial Sequence: Synthetic oligonucleotide
  Target: ATXN1; (+) strand; PAM type: NRG; PAM sequence: AAG
aattattaaagaaataatga

SEQ ID NO: 136799 - DNA, 20 bp, Artificial Sequence
  Description of Artificial Sequence: Synthetic oligonucleotide
  Target: ATXN1; (+) strand; PAM type: NRG; PAM sequence: AAG
aagaaaatttttctaaactg

SEQ ID NO: 136800 - DNA, 20 bp, Artificial Sequence
  Description of Artificial Sequence: Synthetic oligonucleotide
  Target: ATXN1; (+) strand; PAM type: NRG; PAM sequence: CAG
ttttctaaactgaagaaata

SEQ ID NO: 136801 - DNA, 20 bp, Artificial Sequence
  Description of Artificial Sequence: Synthetic oligonucleotide
  Target: ATXN1; (+) strand; PAM type: NRG; PAM sequence: GAG
ttctaaactgaagaaataca

SEQ ID NO: 136802 - DNA, 20 bp, Artificial Sequence
  Description of Artificial Sequence: Synthetic oligonucleotide
  Target: ATXN1; (+) strand; PAM type: NRG; PAM sequence: AAG
accaaaaactcactctatac

SEQ ID NO: 136803 - DNA, 20 bp, Artificial Sequence
  Description of Artificial Sequence: Synthetic oligonucleotide
  Target: ATXN1; (+) strand; PAM type: NRG; PAM sequence: AAG
aaaaactcactctatacaag

SEQ ID NO: 136804 - DNA, 20 bp, Artificial Sequence
  Description of Artificial Sequence: Synthetic oligonucleotide
  Target: ATXN1; (+) strand; PAM type: NRG; PAM sequence: AAG
taatataaattaataaatta

SEQ ID NO: 136805 - DNA, 20 bp, Artificial Sequence
  Description of Artificial Sequence: Synthetic oligonucleotide
  Target: ATXN1; (+) strand; PAM type: NRG; PAM sequence: TGG
ccatctatttatttaccttc

SEQ ID NO: 136806 - DNA, 20 bp, Artificial Sequence
  Description of Artificial Sequence: Synthetic oligonucleotide
  Target: ATXN1; (+) strand; PAM type: NRG; PAM sequence: GAG
taccttctggtgcaactttt

SEQ ID NO: 136807 - DNA, 20 bp, Artificial Sequence
  Description of Artificial Sequence: Synthetic oligonucleotide
  Target: ATXN1; (+) strand; PAM type: NRG; PAM sequence: AGG
accttctggtgcaacttttg

SEQ ID NO: 136808 - DNA, 20 bp, Artificial Sequence
  Description of Artificial Sequence: Synthetic oligonucleotide
  Target: ATXN1; (+) strand; PAM type: NRG; PAM sequence: AAG
ttgaggtcaaaacaactcat

SEQ ID NO: 136809 - DNA, 20 bp, Artificial Sequence
  Description of Artificial Sequence: Synthetic oligonucleotide
  Target: ATXN1; (+) strand; PAM type: NRG; PAM sequence: CAG
caaaacaactcataagcatt

SEQ ID NO: 136810 - DNA, 20 bp, Artificial Sequence
  Description of Artificial Sequence: Synthetic oligonucleotide
  Target: ATXN1; (+) strand; PAM type: NRG; PAM sequence: GAG
acaactcataagcattcagt

SEQ ID NO: 136811 - DNA, 20 bp, Artificial Sequence
  Description of Artificial Sequence: Synthetic oligonucleotide
  Target: ATXN1; (+) strand; PAM type: NRG; PAM sequence: AGG
caactcataagcattcagtg

SEQ ID NO: 136812 - DNA, 20 bp, Artificial Sequence
  Description of Artificial Sequence: Synthetic oligonucleotide
  Target: ATXN1; (+) strand; PAM type: NRG; PAM sequence: GAG
actcataagcattcagtgag

SEQ ID NO: 136813 - DNA, 20 bp, Artificial Sequence
  Description of Artificial Sequence: Synthetic oligonucleotide
  Target: ATXN1; (+) strand; PAM type: NRG; PAM sequence: AGG
ctcataagcattcagtgagg

SEQ ID NO: 136814 - DNA, 20 bp, Artificial Sequence
  Description of Artificial Sequence: Synthetic oligonucleotide
  Target: ATXN1; (+) strand; PAM type: NRG; PAM sequence: AAG
aagcattcagtgaggaggaa

SEQ ID NO: 136815 - DNA, 20 bp, Artificial Sequence
  Description of Artificial Sequence: Synthetic oligonucleotide
  Target: ATXN1; (+) strand; PAM type: NRG; PAM sequence: CAG
agtgaggaggaaaagaaata

SEQ ID NO: 136816 - DNA, 20 bp, Artificial Sequence
  Description of Artificial Sequence: Synthetic oligonucleotide
  Target: ATXN1; (+) strand; PAM type: NRG; PAM sequence: AGG
gtgaggaggaaaagaaatac

SEQ ID NO: 136817 - DNA, 20 bp, Artificial Sequence
  Description of Artificial Sequence: Synthetic oligonucleotide
  Target: ATXN1; (+) strand; PAM type: NRG; PAM sequence: CAG
ggaaaagaaatacaggtaac

SEQ ID NO: 136818 - DNA, 20 bp, Artificial Sequence
  Description of Artificial Sequence: Synthetic oligonucleotide
  Target: ATXN1; (+) strand; PAM type: NRG; PAM sequence: AGG
gaaaagaaatacaggtaacc

SEQ ID NO: 136819 - DNA, 20 bp, Artificial Sequence
  Description of Artificial Sequence: Synthetic oligonucleotide
  Target: ATXN1; (+) strand; PAM type: NRG; PAM sequence: AAG
atacaggtaaccaggtcacc

SEQ ID NO: 136820 - DNA, 20 bp, Artificial Sequence
  Description of Artificial Sequence: Synthetic oligonucleotide
  Target: ATXN1; (+) strand; PAM type: NRG; PAM sequence: AGG
tacaggtaaccaggtcacca

SEQ ID NO: 136821 - DNA, 20 bp, Artificial Sequence
  Description of Artificial Sequence: Synthetic oligonucleotide
  Target: ATXN1; (+) strand; PAM type: NRG; PAM sequence: TGG
aggtaaccaggtcaccaagg

SEQ ID NO: 136822 - DNA, 20 bp, Artificial Sequence
  Description of Artificial Sequence: Synthetic oligonucleotide
  Target: ATXN1; (+) strand; PAM type: NRG; PAM sequence: CAG
caccaaggtggaaaaaaaat

SEQ ID NO: 136823 - DNA, 20 bp, Artificial Sequence
  Description of Artificial Sequence: Synthetic oligonucleotide
  Target: ATXN1; (+) strand; PAM type: NRG; PAM sequence: TAG
aaaaatcagatttctgacaa

SEQ ID NO: 136824 - DNA, 20 bp, Artificial Sequence
  Description of Artificial Sequence: Synthetic oligonucleotide
  Target: ATXN1; (+) strand; PAM type: NRG; PAM sequence: AAG
aatcagatttctgacaatag

SEQ ID NO: 136825 - DNA, 20 bp, Artificial Sequence
  Description of Artificial Sequence: Synthetic oligonucleotide
  Target: ATXN1; (+) strand; PAM type: NRG; PAM sequence: CAG
gaagaaataaaacaactaca

SEQ ID NO: 136826 - DNA, 20 bp, Artificial Sequence
  Description of Artificial Sequence: Synthetic oligonucleotide
  Target: ATXN1; (+) strand; PAM type: NRG; PAM sequence: TGG
aaacaactacacagctctaa

SEQ ID NO: 136827 - DNA, 20 bp, Artificial Sequence
  Description of Artificial Sequence: Synthetic oligonucleotide
  Target: ATXN1; (+) strand; PAM type: NRG; PAM sequence: AAG
actacacagctctaatggca

SEQ ID NO: 136828 - DNA, 20 bp, Artificial Sequence
  Description of Artificial Sequence: Synthetic oligonucleotide
  Target: ATXN1; (+) strand; PAM type: NRG; PAM sequence: AGG
ctacacagctctaatggcaa

SEQ ID NO: 136829 - DNA, 20 bp, Artificial Sequence
  Description of Artificial Sequence: Synthetic oligonucleotide
  Target: ATXN1; (+) strand; PAM type: NRG; PAM sequence: GGG
tacacagctctaatggcaaa

SEQ ID NO: 136830 - DNA, 20 bp, Artificial Sequence
  Description of Artificial Sequence: Synthetic oligonucleotide
  Target: ATXN1; (+) strand; PAM type: NRG; PAM sequence: AAG
aactaaccaactttcctact

SEQ ID NO: 136831 - DNA, 20 bp, Artificial Sequence
  Description of Artificial Sequence: Synthetic oligonucleotide
  Target: ATXN1; (+) strand; PAM type: NRG; PAM sequence: AGG
actaaccaactttcctacta

SEQ ID NO: 136832 - DNA, 20 bp, Artificial Sequence
  Description of Artificial Sequence: Synthetic oligonucleotide
  Target: ATXN1; (+) strand; PAM type: NRG; PAM sequence: GAG
caactttcctactaaggtat

SEQ ID NO: 136833 - DNA, 20 bp, Artificial Sequence
  Description of Artificial Sequence: Synthetic oligonucleotide
  Target: ATXN1; (+) strand; PAM type: NRG; PAM sequence: GAG
actttcctactaaggtatga

SEQ ID NO: 136834 - DNA, 20 bp, Artificial Sequence
  Description of Artificial Sequence: Synthetic oligonucleotide
  Target: ATXN1; (+) strand; PAM type: NRG; PAM sequence: AAG
atgagagttaaaaaataaaa

SEQ ID NO: 136835 - DNA, 20 bp, Artificial Sequence
  Description of Artificial Sequence: Synthetic oligonucleotide
  Target: ATXN1; (+) strand; PAM type: NRG; PAM sequence: AGG
tgagagttaaaaaataaaaa

SEQ ID NO: 136836 - DNA, 20 bp, Artificial Sequence
  Description of Artificial Sequence: Synthetic oligonucleotide
  Target: ATXN1; (+) strand; PAM type: NRG; PAM sequence: TGG
aaaaataaaaaaggcattct

SEQ ID NO: 136837 - DNA, 20 bp, Artificial Sequence
  Description of Artificial Sequence: Synthetic oligonucleotide
  Target: ATXN1; (+) strand; PAM type: NRG; PAM sequence: AAG
aaaaggcattcttggatccc

SEQ ID NO: 136838 - DNA, 20 bp, Artificial Sequence
  Description of Artificial Sequence: Synthetic oligonucleotide
  Target: ATXN1; (+) strand; PAM type: NRG; PAM sequence: AGG
aaaggcattcttggatccca

SEQ ID NO: 136839 - DNA, 20 bp, Artificial Sequence
  Description of Artificial Sequence: Synthetic oligonucleotide
  Target: ATXN1; (+) strand; PAM type: NRG; PAM sequence: GAG
aggcattcttggatcccaag

SEQ ID NO: 136840 - DNA, 20 bp, Artificial Sequence
  Description of Artificial Sequence: Synthetic oligonucleotide
  Target: ATXN1; (+) strand; PAM type: NRG; PAM sequence: TAG
caaaaacacaatgtatttca

SEQ ID NO: 136841 - DNA, 20 bp, Artificial Sequence
  Description of Artificial Sequence: Synthetic oligonucleotide
  Target: ATXN1; (+) strand; PAM type: NRG; PAM sequence: AAG
tatttcatagaatatatttg

SEQ ID NO: 136842 - DNA, 20 bp, Artificial Sequence
  Description of Artificial Sequence: Synthetic oligonucleotide
  Target: ATXN1; (+) strand; PAM type: NRG; PAM sequence: AAG
ttcatagaatatatttgaag

SEQ ID NO: 136843 - DNA, 20 bp, Artificial Sequence
  Description of Artificial Sequence: Synthetic oligonucleotide
  Target: ATXN1; (+) strand; PAM type: NRG; PAM sequence: AAG
aaatttaattttaaacaata

SEQ ID NO: 136844 - DNA, 20 bp, Artificial Sequence
  Description of Artificial Sequence: Synthetic oligonucleotide
  Target: ATXN1; (+) strand; PAM type: NRG; PAM sequence: AAG
taattttaaacaataaagaa

SEQ ID NO: 136845 - DNA, 20 bp, Artificial Sequence
  Description of Artificial Sequence: Synthetic oligonucleotide
  Target: ATXN1; (+) strand; PAM type: NRG; PAM sequence: AGG
aattttaaacaataaagaaa

SEQ ID NO: 136846 - DNA, 20 bp, Artificial Sequence
  Description of Artificial Sequence: Synthetic oligonucleotide
  Target: ATXN1; (+) strand; PAM type: NRG; PAM sequence: GGG
attttaaacaataaagaaaa

SEQ ID NO: 136847 - DNA, 20 bp, Artificial Sequence
  Description of Artificial Sequence: Synthetic oligonucleotide
  Target: ATXN1; (+) strand; PAM type: NRG; PAM sequence: GGG
ttttaaacaataaagaaaag

SEQ ID NO: 136848 - DNA, 20 bp, Artificial Sequence
  Description of Artificial Sequence: Synthetic oligonucleotide
  Target: ATXN1; (+) strand; PAM type: NRG; PAM sequence: TAG
taaacaataaagaaaagggg

SEQ ID NO: 136849 - DNA, 20 bp, Artificial Sequence
  Description of Artificial Sequence: Synthetic oligonucleotide
  Target: ATXN1; (+) strand; PAM type: NRG; PAM sequence: CAG
ggggtagttgtgctttaaaa

SEQ ID NO: 136850 - DNA, 20 bp, Artificial Sequence
  Description of Artificial Sequence: Synthetic oligonucleotide
  Target: ATXN1; (+) strand; PAM type: NRG; PAM sequence: TGG
ctttaaaacagttcacaata

SEQ ID NO: 136851 - DNA, 20 bp, Artificial Sequence
  Description of Artificial Sequence: Synthetic oligonucleotide
  Target: ATXN1; (+) strand; PAM type: NRG; PAM sequence: CAG
aacagttcacaatatggatt

SEQ ID NO: 136852 - DNA, 20 bp, Artificial Sequence
  Description of Artificial Sequence: Synthetic oligonucleotide
  Target: ATXN1; (+) strand; PAM type: NRG; PAM sequence: AGG
acagttcacaatatggattc

SEQ ID NO: 136853 - DNA, 20 bp, Artificial Sequence
  Description of Artificial Sequence: Synthetic oligonucleotide
  Target: ATXN1; (+) strand; PAM type: NRG; PAM sequence: CAG
tcacaatatggattcaggcc

SEQ ID NO: 136854 - DNA, 20 bp, Artificial Sequence
  Description of Artificial Sequence: Synthetic oligonucleotide
  Target: ATXN1; (+) strand; PAM type: NRG; PAM sequence: CAG
atatggattcaggcccagca

SEQ ID NO: 136855 - DNA, 20 bp, Artificial Sequence
  Description of Artificial Sequence: Synthetic oligonucleotide
  Target: ATXN1; (+) strand; PAM type: NRG; PAM sequence: AGG
tatggattcaggcccagcac

SEQ ID NO: 136856 - DNA, 20 bp, Artificial Sequence
  Description of Artificial Sequence: Synthetic oligonucleotide
  Target: ATXN1; (+) strand; PAM type: NRG; PAM sequence: GGG
atggattcaggcccagcaca

SEQ ID NO: 136857 - DNA, 20 bp, Artificial Sequence
  Description of Artificial Sequence: Synthetic oligonucleotide
  Target: ATXN1; (+) strand; PAM type: NRG; PAM sequence: GGG
tggattcaggcccagcacag

SEQ ID NO: 136858 - DNA, 20 bp, Artificial Sequence
  Description of Artificial Sequence: Synthetic oligonucleotide
  Target: ATXN1; (+) strand; PAM type: NRG; PAM sequence: CAG
ggggctcatccctgtaatcc

SEQ ID NO: 136859 - DNA, 20 bp, Artificial Sequence
  Description of Artificial Sequence: Synthetic oligonucleotide
  Target: ATXN1; (+) strand; PAM type: NRG; PAM sequence: TGG
tccctgtaatcccagaactt

SEQ ID NO: 136860 - DNA, 20 bp, Artificial Sequence
  Description of Artificial Sequence: Synthetic oligonucleotide
  Target: ATXN1; (+) strand; PAM type: NRG; PAM sequence: GGG
ccctgtaatcccagaacttt

SEQ ID NO: 136861 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagaactttgg

SEQ ID NO: 136862 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagaactttggg

SEQ ID NO: 136863 - DNA, 20 bp, Artificial Sequence
  Description of Artificial Sequence: Synthetic oligonucleotide
  Target: ATXN1; (+) strand; PAM type: NRG; PAM sequence: GAG
tcccagaactttgggaggcc

SEQ ID NO: 136864 - DNA, 20 bp, Artificial Sequence
  Description of Artificial Sequence: Synthetic oligonucleotide
  Target: ATXN1; (+) strand; PAM type: NRG; PAM sequence: AGG
cccagaactttgggaggccg

SEQ ID NO: 136865 - DNA, 20 bp, Artificial Sequence
  Description of Artificial Sequence: Synthetic oligonucleotide
  Target: ATXN1; (+) strand; PAM type: NRG; PAM sequence: TGG
agaactttgggaggccgagg

SEQ ID NO: 136866 - DNA, 20 bp, Artificial Sequence
  Description of Artificial Sequence: Synthetic oligonucleotide
  Target: ATXN1; (+) strand; PAM type: NRG; PAM sequence: GGG
gaactttgggaggccgaggt

SEQ ID NO: 136867 - DNA, 20 bp, Artificial Sequence
  Description of Artificial Sequence: Synthetic oligonucleotide
  Target: ATXN1; (+) strand; PAM type: NRG; PAM sequence: GAG
actttgggaggccgaggtgg

SEQ ID NO: 136868 - DNA, 20 bp, Artificial Sequence
  Description of Artificial Sequence: Synthetic oligonucleotide
  Target: ATXN1; (+) strand; PAM type: NRG; PAM sequence: AGG
ctttgggaggccgaggtggg

SEQ ID NO: 136869 - DNA, 20 bp, Artificial Sequence
  Description of Artificial Sequence: Synthetic oligonucleotide
  Target: ATXN1; (+) strand; PAM type: NRG; PAM sequence: GAG
ccgaggtgggaggattgctt

SEQ ID NO: 136870 - DNA, 20 bp, Artificial Sequence
  Description of Artificial Sequence: Synthetic oligonucleotide
  Target: ATXN1; (+) strand; PAM type: NRG; PAM sequence: AGG
cgaggtgggaggattgcttg

SEQ ID NO: 136871 - DNA, 20 bp, Artificial Sequence
  Description of Artificial Sequence: Synthetic oligonucleotide
  Target: ATXN1; (+) strand; PAM type: NRG; PAM sequence: AAG
tgggaggattgcttgaggcc

SEQ ID NO: 136872 - DNA, 20 bp, Artificial Sequence
  Description of Artificial Sequence: Synthetic oligonucleotide
  Target: ATXN1; (+) strand; PAM type: NRG; PAM sequence: GAG
ggaggattgcttgaggccaa

SEQ ID NO: 136873 - DNA, 20 bp, Artificial Sequence
  Description of Artificial Sequence: Synthetic oligonucleotide
  Target: ATXN1; (+) strand; PAM type: NRG; PAM sequence: CGG
gccaagagtttaaaaccacc

SEQ ID NO: 136874 - DNA, 20 bp, Artificial Sequence
  Description of Artificial Sequence: Synthetic oligonucleotide
  Target: ATXN1; (+) strand; PAM type: NRG; PAM sequence: GGG
ccaagagtttaaaaccaccc

SEQ ID NO: 136875 - DNA, 20 bp, Artificial Sequence
  Description of Artificial Sequence: Synthetic oligonucleotide
  Target: ATXN1; (+) strand; PAM type: NRG; PAM sequence: GAG
accacccgggacaacacatc

SEQ ID NO: 136876 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaaaaaaaaata

SEQ ID NO: 136877 - DNA, 20 bp, Artificial Sequence
  Description of Artificial Sequence: Synthetic oligonucleotide
  Target: ATXN1; (+) strand; PAM type: NRG; PAM sequence: TAG
aaaaaaaaaaaaaataaagt

SEQ ID NO: 136878 - DNA, 20 bp, Artificial Sequence
  Description of Artificial Sequence: Synthetic oligonucleotide
  Target: ATXN1; (+) strand; PAM type: NRG; PAM sequence: CAG
aaaaaaaaaataaagttagc

SEQ ID NO: 136879 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaataaagttagcc

SEQ ID NO: 136880 - DNA, 20 bp, Artificial Sequence
  Description of Artificial Sequence: Synthetic oligonucleotide
  Target: ATXN1; (+) strand; PAM type: NRG; PAM sequence: TGG
aaaataaagttagccaggcg

SEQ ID NO: 136881 - DNA, 20 bp, Artificial Sequence
  Description of Artificial Sequence: Synthetic oligonucleotide
  Target: ATXN1; (+) strand; PAM type: NRG; PAM sequence: GGG
aaataaagttagccaggcgt

SEQ ID NO: 136882 - DNA, 20 bp, Artificial Sequence
  Description of Artificial Sequence: Synthetic oligonucleotide
  Target: ATXN1; (+) strand; PAM type: NRG; PAM sequence: GGG
aataaagttagccaggcgtg

SEQ ID NO: 136883 - DNA, 20 bp, Artificial Sequence
  Description of Artificial Sequence: Synthetic oligonucleotide
  Target: ATXN1; (+) strand; PAM type: NRG; PAM sequence: TAG
ggcgtggggctgtgtgcctg

SEQ ID NO: 136884 - DNA, 20 bp, Artificial Sequence
  Description of Artificial Sequence: Synthetic oligonucleotide
  Target: ATXN1; (+) strand; PAM type: NRG; PAM sequence: CAG
gggctgtgtgcctgtagtcc

SEQ ID NO: 136885 - DNA, 20 bp, Artificial Sequence
  Description of Artificial Sequence: Synthetic oligonucleotide
  Target: ATXN1; (+) strand; PAM type: NRG; PAM sequence: TAG
tgcctgtagtcccagctact

SEQ ID NO: 136886 - DNA, 20 bp, Artificial Sequence
  Description of Artificial Sequence: Synthetic oligonucleotide
  Target: ATXN1; (+) strand; PAM type: NRG; PAM sequence: AGG
gcctgtagtcccagctactt

SEQ ID NO: 136887 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagctacttag

SEQ ID NO: 136888 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagctacttagg

SEQ ID NO: 136889 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttaggaggct

SEQ ID NO: 136890 - DNA, 20 bp, Artificial Sequence
  Description of Artificial Sequence: Synthetic oligonucleotide
  Target: ATXN1; (+) strand; PAM type: NRG; PAM sequence: AGG
cccagctacttaggaggctg

SEQ ID NO: 136891 - DNA, 20 bp, Artificial Sequence
  Description of Artificial Sequence: Synthetic oligonucleotide
  Target: ATXN1; (+) strand; PAM type: NRG; PAM sequence: TGG
agctacttaggaggctgagg

SEQ ID NO: 136892 - DNA, 20 bp, Artificial Sequence
  Description of Artificial Sequence: Synthetic oligonucleotide
  Target: ATXN1; (+) strand; PAM type: NRG; PAM sequence: GGG
gctacttaggaggctgaggt

SEQ ID NO: 136893 - DNA, 20 bp, Artificial Sequence
  Description of Artificial Sequence: Synthetic oligonucleotide
  Target: ATXN1; (+) strand; PAM type: NRG; PAM sequence: GGG
ctacttaggaggctgaggtg

SEQ ID NO: 136894 - DNA, 20 bp, Artificial Sequence
  Description of Artificial Sequence: Synthetic oligonucleotide
  Target: ATXN1; (+) strand; PAM type: NRG; PAM sequence: GGG
tacttaggaggctgaggtgg

SEQ ID NO: 136895 - DNA, 20 bp, Artificial Sequence
  Description of Artificial Sequence: Synthetic oligonucleotide
  Target: ATXN1; (+) strand; PAM type: NRG; PAM sequence: TAG
ggctgaggtgggggatcctt

SEQ ID NO: 136896 - DNA, 20 bp, Artificial Sequence
  Description of Artificial Sequence: Synthetic oligonucleotide
  Target: ATXN1; (+) strand; PAM type: NRG; PAM sequence: GAG
ctgaggtgggggatccttta

SEQ ID NO: 136897 - DNA, 20 bp, Artificial Sequence
  Description of Artificial Sequence: Synthetic oligonucleotide
  Target: ATXN1; (+) strand; PAM type: NRG; PAM sequence: CAG
ggtgggggatcctttagagc

SEQ ID NO: 136898 - DNA, 20 bp, Artificial Sequence
  Description of Artificial Sequence: Synthetic oligonucleotide
  Target: ATXN1; (+) strand; PAM type: NRG; PAM sequence: AGG
gtgggggatcctttagagcc

SEQ ID NO: 136899 - DNA, 20 bp, Artificial Sequence
  Description of Artificial Sequence: Synthetic oligonucleotide
  Target: ATXN1; (+) strand; PAM type: NRG; PAM sequence: GAG
gggggatcctttagagccag

SEQ ID NO: 136900 - DNA, 20 bp, Artificial Sequence
  Description of Artificial Sequence: Synthetic oligonucleotide
  Target: ATXN1; (+) strand; PAM type: NRG; PAM sequence: AGG
ggggatcctttagagccagg

SEQ ID NO: 136901 - DNA, 20 bp, Artificial Sequence
  Description of Artificial Sequence: Synthetic oligonucleotide
  Target: ATXN1; (+) strand; PAM type: NRG; PAM sequence: AAG
tcctttagagccaggaggtc

SEQ ID NO: 136902 - DNA, 20 bp, Artificial Sequence
  Description of Artificial Sequence: Synthetic oligonucleotide
  Target: ATXN1; (+) strand; PAM type: NRG; PAM sequence: AGG
cctttagagccaggaggtca

SEQ ID NO: 136903 - DNA, 20 bp, Artificial Sequence
  Description of Artificial Sequence: Synthetic oligonucleotide
  Target: ATXN1; (+) strand; PAM type: NRG; PAM sequence: CAG
gagccaggaggtcaaggctg

SEQ ID NO: 136904 - DNA, 20 bp, Artificial Sequence
  Description of Artificial Sequence: Synthetic oligonucleotide
  Target: ATXN1; (+) strand; PAM type: NRG; PAM sequence: GAG
caggaggtcaaggctgcagc

SEQ ID NO: 136905 - DNA, 20 bp, Artificial Sequence
  Description of Artificial Sequence: Synthetic oligonucleotide
  Target: ATXN1; (+) strand; PAM type: NRG; PAM sequence: CAG
gcagcgagttatgatcccac

SEQ ID NO: 136906 - DNA, 20 bp, Artificial Sequence
  Description of Artificial Sequence: Synthetic oligonucleotide
  Target: ATXN1; (+) strand; PAM type: NRG; PAM sequence: CAG
atgatcccaccagtgcactc

SEQ ID NO: 136907 - DNA, 20 bp, Artificial Sequence
  Description of Artificial Sequence: Synthetic oligonucleotide
  Target: ATXN1; (+) strand; PAM type: NRG; PAM sequence: AGG
tgatcccaccagtgcactcc

SEQ ID NO: 136908 - DNA, 20 bp, Artificial Sequence
  Description of Artificial Sequence: Synthetic oligonucleotide
  Target: ATXN1; (+) strand; PAM type: NRG; PAM sequence: CAG
gtgcactccaggctgcacca

SEQ ID NO: 136909 - DNA, 20 bp, Artificial Sequence
  Description of Artificial Sequence: Synthetic oligonucleotide
  Target: ATXN1; (+) strand; PAM type: NRG; PAM sequence: GAG
gcactccaggctgcaccaca

SEQ ID NO: 136910 - DNA, 20 bp, Artificial Sequence
  Description of Artificial Sequence: Synthetic oligonucleotide
  Target: ATXN1; (+) strand; PAM type: NRG; PAM sequence: AAG
tccaggctgcaccacagagc

SEQ ID NO: 136911 - DNA, 20 bp, Artificial Sequence
  Description of Artificial Sequence: Synthetic oligonucleotide
  Target: ATXN1; (+) strand; PAM type: NRG; PAM sequence: TAG
acagagcaagaccctgtctc

SEQ ID NO: 136912 - DNA, 20 bp, Artificial Sequence
  Description of Artificial Sequence: Synthetic oligonucleotide
  Target: ATXN1; (+) strand; PAM type: NRG; PAM sequence: GAG
agagcaagaccctgtctcta

SEQ ID NO: 136913 - DNA, 20 bp, Artificial Sequence
  Description of Artificial Sequence: Synthetic oligonucleotide
  Target: ATXN1; (+) strand; PAM type: NRG; PAM sequence: AAG
agaaaaatatatacacatat

SEQ ID NO: 136914 - DNA, 20 bp, Artificial Sequence
  Description of Artificial Sequence: Synthetic oligonucleotide
  Target: ATXN1; (+) strand; PAM type: NRG; PAM sequence: AGG
gaaaaatatatacacatata

SEQ ID NO: 136915 - DNA, 20 bp, Artificial Sequence
  Description of Artificial Sequence: Synthetic oligonucleotide
  Target: ATXN1; (+) strand; PAM type: NRG; PAM sequence: GAG
aaaatatatacacatataag

SEQ ID NO: 136916 - DNA, 20 bp, Artificial Sequence
  Description of Artificial Sequence: Synthetic oligonucleotide
  Target: ATXN1; (+) strand; PAM type: NRG; PAM sequence: GAG
aatatatacacatataagga

SEQ ID NO: 136917 - DNA, 20 bp, Artificial Sequence
  Description of Artificial Sequence: Synthetic oligonucleotide
  Target: ATXN1; (+) strand; PAM type: NRG; PAM sequence: AAG
caactgaatatcgttataaa

SEQ ID NO: 136918 - DNA, 20 bp, Artificial Sequence
  Description of Artificial Sequence: Synthetic oligonucleotide
  Target: ATXN1; (+) strand; PAM type: NRG; PAM sequence: AGG
aactgaatatcgttataaaa

SEQ ID NO: 136919 - DNA, 20 bp, Artificial Sequence
  Description of Artificial Sequence: Synthetic oligonucleotide
  Target: ATXN1; (+) strand; PAM type: NRG; PAM sequence: CAG
tatcgttataaaaaggaaca

SEQ ID NO: 136920 - DNA, 20 bp, Artificial Sequence
  Description of Artificial Sequence: Synthetic oligonucleotide
  Target: ATXN1; (+) strand; PAM type: NRG; PAM sequence: TAG
tataaaaaggaacacagata

SEQ ID NO: 136921 - DNA, 20 bp, Artificial Sequence
  Description of Artificial Sequence: Synthetic oligonucleotide
  Target: ATXN1; (+) strand; PAM type: NRG; PAM sequence: AAG
agatatagataatccttatt

SEQ ID NO: 136922 - DNA, 20 bp, Artificial Sequence
  Description of Artificial Sequence: Synthetic oligonucleotide
  Target: ATXN1; (+) strand; PAM type: NRG; PAM sequence: AAG
tagataatccttattaagaa

SEQ ID NO: 136923 - DNA, 20 bp, Artificial Sequence
  Description of Artificial Sequence: Synthetic oligonucleotide
  Target: ATXN1; (+) strand; PAM type: NRG; PAM sequence: AAG
aaaagttacataatatttaa

SEQ ID NO: 136924 - DNA, 20 bp, Artificial Sequence
  Description of Artificial Sequence: Synthetic oligonucleotide
  Target: ATXN1; (+) strand; PAM type: NRG; PAM sequence: TGG
atttaaaagtaatcataaac

SEQ ID NO: 136925 - DNA, 20 bp, Artificial Sequence
  Description of Artificial Sequence: Synthetic oligonucleotide
  Target: ATXN1; (+) strand; PAM type: NRG; PAM sequence: AAG
gtctatatctaactttaaaa

SEQ ID NO: 136926 - DNA, 20 bp, Artificial Sequence
  Description of Artificial Sequence: Synthetic oligonucleotide
  Target: ATXN1; (+) strand; PAM type: NRG; PAM sequence: AAG
tatctaactttaaaaaagaa

SEQ ID NO: 136927 - DNA, 20 bp, Artificial Sequence
  Description of Artificial Sequence: Synthetic oligonucleotide
  Target: ATXN1; (+) strand; PAM type: NRG; PAM sequence: AGG
atctaactttaaaaaagaaa

SEQ ID NO: 136928 - DNA, 20 bp, Artificial Sequence
  Description of Artificial Sequence: Synthetic oligonucleotide
  Target: ATXN1; (+) strand; PAM type: NRG; PAM sequence: GAG
ctaactttaaaaaagaaaag

SEQ ID NO: 136929 - DNA, 20 bp, Artificial Sequence
  Description of Artificial Sequence: Synthetic oligonucleotide
  Target: ATXN1; (+) strand; PAM type: NRG; PAM sequence: AAG
aaaagaaaaggagaattcca

SEQ ID NO: 136930 - DNA, 20 bp, Artificial Sequence
  Description of Artificial Sequence: Synthetic oligonucleotide
  Target: ATXN1; (+) strand; PAM type: NRG; PAM sequence: AGG
aaagaaaaggagaattccaa

SEQ ID NO: 136931 - DNA, 20 bp, Artificial Sequence
  Description of Artificial Sequence: Synthetic oligonucleotide
  Target: ATXN1; (+) strand; PAM type: NRG; PAM sequence: GAG
agaaaaggagaattccaaag

SEQ ID NO: 136932 - DNA, 20 bp, Artificial Sequence
  Description of Artificial Sequence: Synthetic oligonucleotide
  Target: ATXN1; (+) strand; PAM type: NRG; PAM sequence: CAG
tgtgttaatcttatcttata

SEQ ID NO: 136933 - DNA, 20 bp, Artificial Sequence
  Description of Artificial Sequence: Synthetic oligonucleotide
  Target: ATXN1; (+) strand; PAM type: NRG; PAM sequence: AGG
gtgttaatcttatcttatac

SEQ ID NO: 136934 - DNA, 20 bp, Artificial Sequence
  Description of Artificial Sequence: Synthetic oligonucleotide
  Target: ATXN1; (+) strand; PAM type: NRG; PAM sequence: GGG
tgttaatcttatcttataca

SEQ ID NO: 136935 - DNA, 20 bp, Artificial Sequence
  Description of Artificial Sequence: Synthetic oligonucleotide
  Target: ATXN1; (+) strand; PAM type: NRG; PAM sequence: GAG
ttaatcttatcttatacagg

SEQ ID NO: 136936 - DNA, 20 bp, Artificial Sequence
  Description of Artificial Sequence: Synthetic oligonucleotide
  Target: ATXN1; (+) strand; PAM type: NRG; PAM sequence: AGG
taatcttatcttatacaggg

SEQ ID NO: 136937 - DNA, 20 bp, Artificial Sequence
  Description of Artificial Sequence: Synthetic oligonucleotide
  Target: ATXN1; (+) strand; PAM type: NRG; PAM sequence: GAG
atcttatcttatacagggag

SEQ ID NO: 136938 - DNA, 20 bp, Artificial Sequence
  Description of Artificial Sequence: Synthetic oligonucleotide
  Target: ATXN1; (+) strand; PAM type: NRG; PAM sequence: AGG
tcttatcttatacagggagg

SEQ ID NO: 136939 - DNA, 20 bp, Artificial Sequence
  Description of Artificial Sequence: Synthetic oligonucleotide
  Target: ATXN1; (+) strand; PAM type: NRG; PAM sequence: TGG
tcttatacagggaggaggta

SEQ ID NO: 136940 - DNA, 20 bp, Artificial Sequence
  Description of Artificial Sequence: Synthetic oligonucleotide
  Target: ATXN1; (+) strand; PAM type: NRG; PAM sequence: CAG
atacagggaggaggtatggt

SEQ ID NO: 136941 - DNA, 20 bp, Artificial Sequence
  Description of Artificial Sequence: Synthetic oligonucleotide
  Target: ATXN1; (+) strand; PAM type: NRG; PAM sequence: CAG
agggaggaggtatggtcagc

SEQ ID NO: 136942 - DNA, 20 bp, Artificial Sequence
  Description of Artificial Sequence: Synthetic oligonucleotide
  Target: ATXN1; (+) strand; PAM type: NRG; PAM sequence: CAG
gcttcctcactttgctcata

SEQ ID NO: 136943 - DNA, 20 bp, Artificial Sequence
  Description of Artificial Sequence: Synthetic oligonucleotide
  Target: ATXN1; (+) strand; PAM type: NRG; PAM sequence: TAG
actttgctcatacagaaata

SEQ ID NO: 136944 - DNA, 20 bp, Artificial Sequence
  Description of Artificial Sequence: Synthetic oligonucleotide
  Target: ATXN1; (+) strand; PAM type: NRG; PAM sequence: AGG
ctttgctcatacagaaatat

SEQ ID NO: 136945 - DNA, 20 bp, Artificial Sequence
  Description of Artificial Sequence: Synthetic oligonucleotide
  Target: ATXN1; (+) strand; PAM type: NRG; PAM sequence: TAG
acagaaatataggtcatatt

SEQ ID NO: 136946 - DNA, 20 bp, Artificial Sequence
  Description of Artificial Sequence: Synthetic oligonucleotide
  Target: ATXN1; (+) strand; PAM type: NRG; PAM sequence: AAG
ggtcatatttagtcaaattt

SEQ ID NO: 136947 - DNA, 20 bp, Artificial Sequence
  Description of Artificial Sequence: Synthetic oligonucleotide
  Target: ATXN1; (+) strand; PAM type: NRG; PAM sequence: AAG
catatttagtcaaatttaag

SEQ ID NO: 136948 - DNA, 20 bp, Artificial Sequence
  Description of Artificial Sequence: Synthetic oligonucleotide
  Target: ATXN1; (+) strand; PAM type: NRG; PAM sequence: TAG
gtcaaatttaagaagacaac

SEQ ID NO: 136949 - DNA, 20 bp, Artificial Sequence
  Description of Artificial Sequence: Synthetic oligonucleotide
  Target: ATXN1; (+) strand; PAM type: NRG; PAM sequence: AAG
aaatttaagaagacaactag

SEQ ID NO: 136950 - DNA, 20 bp, Artificial Sequence
  Description of Artificial Sequence: Synthetic oligonucleotide
  Target: ATXN1; (+) strand; PAM type: NRG; PAM sequence: AAG
acaactagaagattaaatat

SEQ ID NO: 136951 - DNA, 20 bp, Artificial Sequence
  Description of Artificial Sequence: Synthetic oligonucleotide
  Target: ATXN1; (+) strand; PAM type: NRG; PAM sequence: AGG
caactagaagattaaatata

SEQ ID NO: 136952 - DNA, 20 bp, Artificial Sequence
  Description of Artificial Sequence: Synthetic oligonucleotide
  Target: ATXN1; (+) strand; PAM type: NRG; PAM sequence: GAG
gaagattaaatataaggtat

SEQ ID NO: 136953 - DNA, 20 bp, Artificial Sequence
  Description of Artificial Sequence: Synthetic oligonucleotide
  Target: ATXN1; (+) strand; PAM type: NRG; PAM sequence: CAG
aatataaggtatgagtatta

SEQ ID NO: 136954 - DNA, 20 bp, Artificial Sequence
  Description of Artificial Sequence: Synthetic oligonucleotide
  Target: ATXN1; (+) strand; PAM type: NRG; PAM sequence: CAG
taaggtatgagtattacaga

SEQ ID NO: 136955 - DNA, 20 bp, Artificial Sequence
  Description of Artificial Sequence: Synthetic oligonucleotide
  Target: ATXN1; (+) strand; PAM type: NRG; PAM sequence: TGG
gtaaatcatatcacacaaaa

SEQ ID NO: 136956 - DNA, 20 bp, Artificial Sequence
  Description of Artificial Sequence: Synthetic oligonucleotide
  Target: ATXN1; (+) strand; PAM type: NRG; PAM sequence: GAG
tatcacacaaaatggaaaat

SEQ ID NO: 136957 - DNA, 20 bp, Artificial Sequence
  Description of Artificial Sequence: Synthetic oligonucleotide
  Target: ATXN1; (+) strand; PAM type: NRG; PAM sequence: AGG
atcacacaaaatggaaaatg

SEQ ID NO: 136958 - DNA, 20 bp, Artificial Sequence
  Description of Artificial Sequence: Synthetic oligonucleotide
  Target: ATXN1; (+) strand; PAM type: NRG; PAM sequence: GGG
tcacacaaaatggaaaatga

SEQ ID NO: 136959 - DNA, 20 bp, Artificial Sequence
  Description of Artificial Sequence: Synthetic oligonucleotide
  Target: ATXN1; (+) strand; PAM type: NRG; PAM sequence: AAG
tggaaaatgagggaaatatc

SEQ ID NO: 136960 - DNA, 20 bp, Artificial Sequence
  Description of Artificial Sequence: Synthetic oligonucleotide
  Target: ATXN1; (+) strand; PAM type: NRG; PAM sequence: AGG
ggaaaatgagggaaatatca

SEQ ID NO: 136961 - DNA, 20 bp, Artificial Sequence
  Description of Artificial Sequence: Synthetic oligonucleotide
  Target: ATXN1; (+) strand; PAM type: NRG; PAM sequence: AAG
tcaaggaatcataaaaccaa

SEQ ID NO: 136962 - DNA, 20 bp, Artificial Sequence
  Description of Artificial Sequence: Synthetic oligonucleotide
  Target: ATXN1; (+) strand; PAM type: NRG; PAM sequence: AAG
cataaaaccaaaagaataaa

SEQ ID NO: 136963 - DNA, 20 bp, Artificial Sequence
  Description of Artificial Sequence: Synthetic oligonucleotide
  Target: ATXN1; (+) strand; PAM type: NRG; PAM sequence: TAG
aataaaaagatgacaaaaat

SEQ ID NO: 136964 - DNA, 20 bp, Artificial Sequence
  Description of Artificial Sequence: Synthetic oligonucleotide
  Target: ATXN1; (+) strand; PAM type: NRG; PAM sequence: AAG
aagatgacaaaaattagaat

SEQ ID NO: 136965 - DNA, 20 bp, Artificial Sequence
  Description of Artificial Sequence: Synthetic oligonucleotide
  Target: ATXN1; (+) strand; PAM type: NRG; PAM sequence: AAG
gaataagcgtatcaacattg

SEQ ID NO: 136966 - DNA, 20 bp, Artificial Sequence
  Description of Artificial Sequence: Synthetic oligonucleotide
  Target: ATXN1; (+) strand; PAM type: NRG; PAM sequence: CAG
aagcgtatcaacattgaaga

SEQ ID NO: 136967 - DNA, 20 bp, Artificial Sequence
  Description of Artificial Sequence: Synthetic oligonucleotide
  Target: ATXN1; (+) strand; PAM type: NRG; PAM sequence: AGG
agcgtatcaacattgaagac

SEQ ID NO: 136968 - DNA, 20 bp, Artificial Sequence
  Description of Artificial Sequence: Synthetic oligonucleotide
  Target: ATXN1; (+) strand; PAM type: NRG; PAM sequence: AAG
aggtattaattcgttttgaa

SEQ ID NO: 136969 - DNA, 20 bp, Artificial Sequence
  Description of Artificial Sequence: Synthetic oligonucleotide
  Target: ATXN1; (+) strand; PAM type: NRG; PAM sequence: AAG
taattcgttttgaaaagcaa

SEQ ID NO: 136970 - DNA, 20 bp, Artificial Sequence
  Description of Artificial Sequence: Synthetic oligonucleotide
  Target: ATXN1; (+) strand; PAM type: NRG; PAM sequence: CAG
tttgaaaagcaaaagaatct

SEQ ID NO: 136971 - DNA, 20 bp, Artificial Sequence
  Description of Artificial Sequence: Synthetic oligonucleotide
  Target: ATXN1; (+) strand; PAM type: NRG; PAM sequence: TGG
aaaagcaaaagaatctcaga

SEQ ID NO: 136972 - DNA, 20 bp, Artificial Sequence
  Description of Artificial Sequence: Synthetic oligonucleotide
  Target: ATXN1; (+) strand; PAM type: NRG; PAM sequence: AAG
ctcagatggtgtcataaatt

SEQ ID NO: 136973 - DNA, 20 bp, Artificial Sequence
  Description of Artificial Sequence: Synthetic oligonucleotide
  Target: ATXN1; (+) strand; PAM type: NRG; PAM sequence: TAG
tcataaattaagaatgccct

SEQ ID NO: 136974 - DNA, 20 bp, Artificial Sequence
  Description of Artificial Sequence: Synthetic oligonucleotide
  Target: ATXN1; (+) strand; PAM type: NRG; PAM sequence: AAG
aatgcccttagactatctgc

SEQ ID NO: 136975 - DNA, 20 bp, Artificial Sequence
  Description of Artificial Sequence: Synthetic oligonucleotide
  Target: ATXN1; (+) strand; PAM type: NRG; PAM sequence: AAG
tatctgcaagaaacccataa

SEQ ID NO: 136976 - DNA, 20 bp, Artificial Sequence
  Description of Artificial Sequence: Synthetic oligonucleotide
  Target: ATXN1; (+) strand; PAM type: NRG; PAM sequence: AAG
aagaaacccataaaagttac

SEQ ID NO: 136977 - DNA, 20 bp, Artificial Sequence
  Description of Artificial Sequence: Synthetic oligonucleotide
  Target: ATXN1; (+) strand; PAM type: NRG; PAM sequence: AAG
aaacccataaaagttacaag

SEQ ID NO: 136978 - DNA, 20 bp, Artificial Sequence
  Description of Artificial Sequence: Synthetic oligonucleotide
  Target: ATXN1; (+) strand; PAM type: NRG; PAM sequence: TGG
cataaaagttacaagaagat

SEQ ID NO: 136979 - DNA, 20 bp, Artificial Sequence
  Description of Artificial Sequence: Synthetic oligonucleotide
  Target: ATXN1; (+) strand; PAM type: NRG; PAM sequence: GGG
ataaaagttacaagaagatt

SEQ ID NO: 136980 - DNA, 20 bp, Artificial Sequence
  Description of Artificial Sequence: Synthetic oligonucleotide
  Target: ATXN1; (+) strand; PAM type: NRG; PAM sequence: GGG
taaaagttacaagaagattg

SEQ ID NO: 136981 - DNA, 20 bp, Artificial Sequence
  Description of Artificial Sequence: Synthetic oligonucleotide
  Target: ATXN1; (+) strand; PAM type: NRG; PAM sequence: AAG
gttacaagaagattggggca

SEQ ID NO: 136982 - DNA, 20 bp, Artificial Sequence
  Description of Artificial Sequence: Synthetic oligonucleotide
  Target: ATXN1; (+) strand; PAM type: NRG; PAM sequence: AGG
ttacaagaagattggggcaa

SEQ ID NO: 136983 - DNA, 20 bp, Artificial Sequence
  Description of Artificial Sequence: Synthetic oligonucleotide
  Target: ATXN1; (+) strand; PAM type: NRG; PAM sequence: CAG
agattggggcaaaggaatac

SEQ ID NO: 136984 - DNA, 20 bp, Artificial Sequence
  Description of Artificial Sequence: Synthetic oligonucleotide
  Target: ATXN1; (+) strand; PAM type: NRG; PAM sequence: AGG
gattggggcaaaggaatacc

SEQ ID NO: 136985 - DNA, 20 bp, Artificial Sequence
  Description of Artificial Sequence: Synthetic oligonucleotide
  Target: ATXN1; (+) strand; PAM type: NRG; PAM sequence: TAG
ataccaggaaactgcacatt

SEQ ID NO: 136986 - DNA, 20 bp, Artificial Sequence
  Description of Artificial Sequence: Synthetic oligonucleotide
  Target: ATXN1; (+) strand; PAM type: NRG; PAM sequence: AAG
ccaggaaactgcacatttag

SEQ ID NO: 136987 - DNA, 20 bp, Artificial Sequence
  Description of Artificial Sequence: Synthetic oligonucleotide
  Target: ATXN1; (+) strand; PAM type: NRG; PAM sequence: CAG
aactgcacatttagaagtga

SEQ ID NO: 136988 - DNA, 20 bp, Artificial Sequence
  Description of Artificial Sequence: Synthetic oligonucleotide
  Target: ATXN1; (+) strand; PAM type: NRG; PAM sequence: CAG
tacaactgttaatacaaaat

SEQ ID NO: 136989 - DNA, 20 bp, Artificial Sequence
  Description of Artificial Sequence: Synthetic oligonucleotide
  Target: ATXN1; (+) strand; PAM type: NRG; PAM sequence: AAG
aaatcagtattacatatcta

SEQ ID NO: 136990 - DNA, 20 bp, Artificial Sequence
  Description of Artificial Sequence: Synthetic oligonucleotide
  Target: ATXN1; (+) strand; PAM type: NRG; PAM sequence: CAG
tacatatctaaagcattcaa

SEQ ID NO: 136991 - DNA, 20 bp, Artificial Sequence
  Description of Artificial Sequence: Synthetic oligonucleotide
  Target: ATXN1; (+) strand; PAM type: NRG; PAM sequence: AGG
acatatctaaagcattcaac

SEQ ID NO: 136992 - DNA, 20 bp, Artificial Sequence
  Description of Artificial Sequence: Synthetic oligonucleotide
  Target: ATXN1; (+) strand; PAM type: NRG; PAM sequence: GGG
catatctaaagcattcaaca

SEQ ID NO: 136993 - DNA, 20 bp, Artificial Sequence
  Description of Artificial Sequence: Synthetic oligonucleotide
  Target: ATXN1; (+) strand; PAM type: NRG; PAM sequence: GGG
atatctaaagcattcaacag

SEQ ID NO: 136994 - DNA, 20 bp, Artificial Sequence
  Description of Artificial Sequence: Synthetic oligonucleotide
  Target: ATXN1; (+) strand; PAM type: NRG; PAM sequence: AAG
ggggtgaaatttttactgac

SEQ ID NO: 136995 - DNA, 20 bp, Artificial Sequence
  Description of Artificial Sequence: Synthetic oligonucleotide
  Target: ATXN1; (+) strand; PAM type: NRG; PAM sequence: GAG
ggtgaaatttttactgacaa

SEQ ID NO: 136996 - DNA, 20 bp, Artificial Sequence
  Description of Artificial Sequence: Synthetic oligonucleotide
  Target: ATXN1; (+) strand; PAM type: NRG; PAM sequence: AAG
ctgacaagagatacattcca

SEQ ID NO: 136997 - DNA, 20 bp, Artificial Sequence
  Description of Artificial Sequence: Synthetic oligonucleotide
  Target: ATXN1; (+) strand; PAM type: NRG; PAM sequence: AAG
gagatacattccaaagaatt

SEQ ID NO: 136998 - DNA, 20 bp, Artificial Sequence
  Description of Artificial Sequence: Synthetic oligonucleotide
  Target: ATXN1; (+) strand; PAM type: NRG; PAM sequence: AAG
aagtcaaaattgtatgtgtc

SEQ ID NO: 136999 - DNA, 20 bp, Artificial Sequence
  Description of Artificial Sequence: Synthetic oligonucleotide
  Target: ATXN1; (+) strand; PAM type: NRG; PAM sequence: TAG
caaaattgtatgtgtcaaga

SEQ ID NO: 137000 - DNA, 20 bp, Artificial Sequence
  Description of Artificial Sequence: Synthetic oligonucleotide
  Target: ATXN1; (+) strand; PAM type: NRG; PAM sequence: TAG
aattgtatgtgtcaagatag

SEQ ID NO: 137001 - DNA, 20 bp, Artificial Sequence
  Description of Artificial Sequence: Synthetic oligonucleotide
  Target: ATXN1; (+) strand; PAM type: NRG; PAM sequence: GAG
ttgtatgtgtcaagatagta

SEQ ID NO: 137002 - DNA, 20 bp, Artificial Sequence
  Description of Artificial Sequence: Synthetic oligonucleotide
  Target: ATXN1; (+) strand; PAM type: NRG; PAM sequence: TGG
tgtgtcaagatagtagagca

SEQ ID NO: 137003 - DNA, 20 bp, Artificial Sequence
  Description of Artificial Sequence: Synthetic oligonucleotide
  Target: ATXN1; (+) strand; PAM type: NRG; PAM sequence: AAG
gtagagcatggaaatatata

SEQ ID NO: 137004 - DNA, 20 bp, Artificial Sequence
  Description of Artificial Sequence: Synthetic oligonucleotide
  Target: ATXN1; (+) strand; PAM type: NRG; PAM sequence: CAG
aatatataaagaaaataaaa

SEQ ID NO: 137005 - DNA, 20 bp, Artificial Sequence
  Description of Artificial Sequence: Synthetic oligonucleotide
  Target: ATXN1; (+) strand; PAM type: NRG; PAM sequence: GAG
tatataaagaaaataaaaca

SEQ ID NO: 137006 - DNA, 20 bp, Artificial Sequence
  Description of Artificial Sequence: Synthetic oligonucleotide
  Target: ATXN1; (+) strand; PAM type: NRG; PAM sequence: GAG
aagaaaataaaacagagatt

SEQ ID NO: 137007 - DNA, 20 bp, Artificial Sequence
  Description of Artificial Sequence: Synthetic oligonucleotide
  Target: ATXN1; (+) strand; PAM type: NRG; PAM sequence: GAG
gaaaataaaacagagattga

SEQ ID NO: 137008 - DNA, 20 bp, Artificial Sequence
  Description of Artificial Sequence: Synthetic oligonucleotide
  Target: ATXN1; (+) strand; PAM type: NRG; PAM sequence: AAG
agagacatgcaataatgtta

SEQ ID NO: 137009 - DNA, 20 bp, Artificial Sequence
  Description of Artificial Sequence: Synthetic oligonucleotide
  Target: ATXN1; (+) strand; PAM type: NRG; PAM sequence: CAG
aaagtctaccccactgcatt

SEQ ID NO: 137010 - DNA, 20 bp, Artificial Sequence
  Description of Artificial Sequence: Synthetic oligonucleotide
  Target: ATXN1; (+) strand; PAM type: NRG; PAM sequence: TGG
accccactgcattcagtcct

SEQ ID NO: 137011 - DNA, 20 bp, Artificial Sequence
  Description of Artificial Sequence: Synthetic oligonucleotide
  Target: ATXN1; (+) strand; PAM type: NRG; PAM sequence: AAG
cattcagtccttggaaaaat

SEQ ID NO: 137012 - DNA, 20 bp, Artificial Sequence
  Description of Artificial Sequence: Synthetic oligonucleotide
  Target: ATXN1; (+) strand; PAM type: NRG; PAM sequence: CAG
tcagtccttggaaaaataag

SEQ ID NO: 137013 - DNA, 20 bp, Artificial Sequence
  Description of Artificial Sequence: Synthetic oligonucleotide
  Target: ATXN1; (+) strand; PAM type: NRG; PAM sequence: GAG
tttttttttttttttttttt

SEQ ID NO: 137014 - DNA, 20 bp, Artificial Sequence
  Description of Artificial Sequence: Synthetic oligonucleotide
  Target: ATXN1; (+) strand; PAM type: NRG; PAM sequence: CAG
ttttttttttttttttgaga

SEQ ID NO: 137015 - DNA, 20 bp, Artificial Sequence
  Description of Artificial Sequence: Synthetic oligonucleotide
  Target: ATXN1; (+) strand; PAM type: NRG; PAM sequence: GAG
ttttttttttttttgagaca

SEQ ID NO: 137016 - DNA, 20 bp, Artificial Sequence
  Description of Artificial Sequence: Synthetic oligonucleotide
  Target: ATXN1; (+) strand; PAM type: NRG; PAM sequence: TGG
tctcactctgttgcccattc

SEQ ID NO: 137017 - DNA, 20 bp, Artificial Sequence
  Description of Artificial Sequence: Synthetic oligonucleotide
  Target: ATXN1; (+) strand; PAM type: NRG; PAM sequence: GAG
tcactctgttgcccattctg

SEQ ID NO: 137018 - DNA, 20 bp, Artificial Sequence
  Description of Artificial Sequence: Synthetic oligonucleotide
  Target: ATXN1; (+) strand; PAM type: NRG; PAM sequence: CAG
ctgttgcccattctggagtg

SEQ ID NO: 137019 - DNA, 20 bp, Artificial Sequence
  Description of Artificial Sequence: Synthetic oligonucleotide
  Target: ATXN1; (+) strand; PAM type: NRG; PAM sequence: TGG
ttgcccattctggagtgcag

SEQ ID NO: 137020 - DNA, 20 bp, Artificial Sequence
  Description of Artificial Sequence: Synthetic oligonucleotide
  Target: ATXN1; (+) strand; PAM type: NRG; PAM sequence: CGG
ggagtgcagtggctccatct

SEQ ID NO: 137021 - DNA, 20 bp, Artificial Sequence
  Description of Artificial Sequence: Synthetic oligonucleotide
  Target: ATXN1; (+) strand; PAM type: NRG; PAM sequence: AAG
gctccatctcggctcactgc

SEQ ID NO: 137022 - DNA, 20 bp, Artificial Sequence
  Description of Artificial Sequence: Synthetic oligonucleotide
  Target: ATXN1; (+) strand; PAM type: NRG; PAM sequence: TGG
tcactgcaagctccgcctcc

SEQ ID NO: 137023 - DNA, 20 bp, Artificial Sequence
  Description of Artificial Sequence: Synthetic oligonucleotide
  Target: ATXN1; (+) strand; PAM type: NRG; PAM sequence: GGG
cactgcaagctccgcctcct

SEQ ID NO: 137024 - DNA, 20 bp, Artificial Sequence
  Description of Artificial Sequence: Synthetic oligonucleotide
  Target: ATXN1; (+) strand; PAM type: NRG; PAM sequence: CAG
ttcatgccattctcctgcct

SEQ ID NO: 137025 - DNA, 20 bp, Artificial Sequence
  Description of Artificial Sequence: Synthetic oligonucleotide
  Target: ATXN1; (+) strand; PAM type: NRG; PAM sequence: GAG
ttctcctgcctcagcctttc

SEQ ID NO: 137026 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctttcgag

SEQ ID NO: 137027 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctttcgagtagc

SEQ ID NO: 137028 - DNA, 20 bp, Artificial Sequence
  Description of Artificial Sequence: Synthetic oligonucleotide
  Target: ATXN1; (+) strand; PAM type: NRG; PAM sequence: GGG
cctcagcctttcgagtagct

SEQ ID NO: 137029 - DNA, 20 bp, Artificial Sequence
  Description of Artificial Sequence: Synthetic oligonucleotide
  Target: ATXN1; (+) strand; PAM type: NRG; PAM sequence: CAG
ctttcgagtagctgggacta

SEQ ID NO: 137030 - DNA, 20 bp, Artificial Sequence
  Description of Artificial Sequence: Synthetic oligonucleotide
  Target: ATXN1; (+) strand; PAM type: NRG; PAM sequence: AGG
tttcgagtagctgggactac

SEQ ID NO: 137031 - DNA, 20 bp, Artificial Sequence
  Description of Artificial Sequence: Synthetic oligonucleotide
  Target: ATXN1; (+) strand; PAM type: NRG; PAM sequence: CGG
caggtgcccgccaccacacc

SEQ ID NO: 137032 - DNA, 20 bp, Artificial Sequence
  Description of Artificial Sequence: Synthetic oligonucleotide
  Target: ATXN1; (+) strand; PAM type: NRG; PAM sequence: TAG
cggctaattttttgtatttt

SEQ ID NO: 137033 - DNA, 20 bp, Artificial Sequence
  Description of Artificial Sequence: Synthetic oligonucleotide
  Target: ATXN1; (+) strand; PAM type: NRG; PAM sequence: TAG
ctaattttttgtatttttag

SEQ ID NO: 137034 - DNA, 20 bp, Artificial Sequence
  Description of Artificial Sequence: Synthetic oligonucleotide
  Target: ATXN1; (+) strand; PAM type: NRG; PAM sequence: GAG
aattttttgtatttttagta

SEQ ID NO: 137035 - DNA, 20 bp, Artificial Sequence
  Description of Artificial Sequence: Synthetic oligonucleotide
  Target: ATXN1; (+) strand; PAM type: NRG; PAM sequence: CGG
ttttgtatttttagtagaga

SEQ ID NO: 137036 - DNA, 20 bp, Artificial Sequence
  Description of Artificial Sequence: Synthetic oligonucleotide
  Target: ATXN1; (+) strand; PAM type: NRG; PAM sequence: GGG
tttgtatttttagtagagac

SEQ ID NO: 137037 - DNA, 20 bp, Artificial Sequence
  Description of Artificial Sequence: Synthetic oligonucleotide
  Target: ATXN1; (+) strand; PAM type: NRG; PAM sequence: GGG
ttgtatttttagtagagacg

SEQ ID NO: 137038 - DNA, 20 bp, Artificial Sequence
  Description of Artificial Sequence: Synthetic oligonucleotide
  Target: ATXN1; (+) strand; PAM type: NRG; PAM sequence: TAG
gagacggggtttcaccatgt

SEQ ID NO: 137039 - DNA, 20 bp, Artificial Sequence
  Description of Artificial Sequence: Synthetic oligonucleotide
  Target: ATXN1; (+) strand; PAM type: NRG; PAM sequence: CAG
cggggtttcaccatgttagt

SEQ ID NO: 137040 - DNA, 20 bp, Artificial Sequence
  Description of Artificial Sequence: Synthetic oligonucleotide
  Target: ATXN1; (+) strand; PAM type: NRG; PAM sequence: AGG
ggggtttcaccatgttagtc

SEQ ID NO: 137041 - DNA, 20 bp, Artificial Sequence
  Description of Artificial Sequence: Synthetic oligonucleotide
  Target: ATXN1; (+) strand; PAM type: NRG; PAM sequence: CGG
tttcaccatgttagtcagga

SEQ ID NO: 137042 - DNA, 20 bp, Artificial Sequence
  Description of Artificial Sequence: Synthetic oligonucleotide
  Target: ATXN1; (+) strand; PAM type: NRG; PAM sequence: CAG
acctcatgatgcgcctgcct

SEQ ID NO: 137043 - DNA, 20 bp, Artificial Sequence
  Description of Artificial Sequence: Synthetic oligonucleotide
  Target: ATXN1; (+) strand; PAM type: NRG; PAM sequence: AAG
gcgcctgcctcagcctccca

SEQ ID NO: 137044 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaaagtgc

SEQ ID NO: 137045 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaaagtgct

SEQ ID NO: 137046 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtgctgggatta

SEQ ID NO: 137047 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtgctgggattac

SEQ ID NO: 137048 - DNA, 20 bp, Artificial Sequence
  Description of Artificial Sequence: Synthetic oligonucleotide
  Target: ATXN1; (+) strand; PAM type: NRG; PAM sequence: GAG
agtgctgggattacaggtgt

SEQ ID NO: 137049 - DNA, 20 bp, Artificial Sequence
  Description of Artificial Sequence: Synthetic oligonucleotide
  Target: ATXN1; (+) strand; PAM type: NRG; PAM sequence: CGG
caggtgtgagccaccgcgcc

SEQ ID NO: 137050 - DNA, 20 bp, Artificial Sequence
  Description of Artificial Sequence: Synthetic oligonucleotide
  Target: ATXN1; (+) strand; PAM type: NRG; PAM sequence: CAG
tgtgagccaccgcgcccggc

SEQ ID NO: 137051 - DNA, 20 bp, Artificial Sequence
  Description of Artificial Sequence: Synthetic oligonucleotide
  Target: ATXN1; (+) strand; PAM type: NRG; PAM sequence: CAG
gagccaccgcgcccggccag

SEQ ID NO: 137052 - DNA, 20 bp, Artificial Sequence
  Description of Artificial Sequence: Synthetic oligonucleotide
  Target: ATXN1; (+) strand; PAM type: NRG; PAM sequence: AAG
cagcagatgaaaatttaata

SEQ ID NO: 137053 - DNA, 20 bp, Artificial Sequence
  Description of Artificial Sequence: Synthetic oligonucleotide
  Target: ATXN1; (+) strand; PAM type: NRG; PAM sequence: TAG
atgaaaatttaataaagata

SEQ ID NO: 137054 - DNA, 20 bp, Artificial Sequence
  Description of Artificial Sequence: Synthetic oligonucleotide
  Target: ATXN1; (+) strand; PAM type: NRG; PAM sequence: GAG
gaaaatttaataaagatata

SEQ ID NO: 137055 - DNA, 20 bp, Artificial Sequence
  Description of Artificial Sequence: Synthetic oligonucleotide
  Target: ATXN1; (+) strand; PAM type: NRG; PAM sequence: AAG
aatttaataaagatatagag

SEQ ID NO: 137056 - DNA, 20 bp, Artificial Sequence
  Description of Artificial Sequence: Synthetic oligonucleotide
  Target: ATXN1; (+) strand; PAM type: NRG; PAM sequence: TAG
ttaataaagatatagagaag

SEQ ID NO: 137057 - DNA, 20 bp, Artificial Sequence
  Description of Artificial Sequence: Synthetic oligonucleotide
  Target: ATXN1; (+) strand; PAM type: NRG; PAM sequence: AGG
taataaagatatagagaagt

SEQ ID NO: 137058 - DNA, 20 bp, Artificial Sequence
  Description of Artificial Sequence: Synthetic oligonucleotide
  Target: ATXN1; (+) strand; PAM type: NRG; PAM sequence: TGG
gtaggataaaatcataaata

SEQ ID NO: 137059 - DNA, 20 bp, Artificial Sequence
  Description of Artificial Sequence: Synthetic oligonucleotide
  Target: ATXN1; (+) strand; PAM type: NRG; PAM sequence: CAG
ggataaaatcataaatatgg

SEQ ID NO: 137060 - DNA, 20 bp, Artificial Sequence
  Description of Artificial Sequence: Synthetic oligonucleotide
  Target: ATXN1; (+) strand; PAM type: NRG; PAM sequence: AAG
aatatggcagatctgatgac

SEQ ID NO: 137061 - DNA, 20 bp, Artificial Sequence
  Description of Artificial Sequence: Synthetic oligonucleotide
  Target: ATXN1; (+) strand; PAM type: NRG; PAM sequence: AAG
ggcagatctgatgacaagat

SEQ ID NO: 137062 - DNA, 20 bp, Artificial Sequence
  Description of Artificial Sequence: Synthetic oligonucleotide
  Target: ATXN1; (+) strand; PAM type: NRG; PAM sequence: TAG
gatgacaagataagcctgat

SEQ ID NO: 137063 - DNA, 20 bp, Artificial Sequence
  Description of Artificial Sequence: Synthetic oligonucleotide
  Target: ATXN1; (+) strand; PAM type: NRG; PAM sequence: TAG
taagcctgattagatttaat

SEQ ID NO: 137064 - DNA, 20 bp, Artificial Sequence
  Description of Artificial Sequence: Synthetic oligonucleotide
  Target: ATXN1; (+) strand; PAM type: NRG; PAM sequence: GAG
agcctgattagatttaatta

SEQ ID NO: 137065 - DNA, 20 bp, Artificial Sequence
  Description of Artificial Sequence: Synthetic oligonucleotide
  Target: ATXN1; (+) strand; PAM type: NRG; PAM sequence: CAG
tagagcatgcatcttctata

SEQ ID NO: 137066 - DNA, 20 bp, Artificial Sequence
  Description of Artificial Sequence: Synthetic oligonucleotide
  Target: ATXN1; (+) strand; PAM type: NRG; PAM sequence: AGG
agagcatgcatcttctatac

SEQ ID NO: 137067 - DNA, 20 bp, Artificial Sequence
  Description of Artificial Sequence: Synthetic oligonucleotide
  Target: ATXN1; (+) strand; PAM type: NRG; PAM sequence: GGG
gagcatgcatcttctataca

SEQ ID NO: 137068 - DNA, 20 bp, Artificial Sequence
  Description of Artificial Sequence: Synthetic oligonucleotide
  Target: ATXN1; (+) strand; PAM type: NRG; PAM sequence: GGG
agcatgcatcttctatacag

SEQ ID NO: 137069 - DNA, 20 bp, Artificial Sequence
  Description of Artificial Sequence: Synthetic oligonucleotide
  Target: ATXN1; (+) strand; PAM type: NRG; PAM sequence: TGG
atcttctatacaggggctca

SEQ ID NO: 137070 - DNA, 20 bp, Artificial Sequence
  Description of Artificial Sequence: Synthetic oligonucleotide
  Target: ATXN1; (+) strand; PAM type: NRG; PAM sequence: TGG
aacaaaaatgaatcctgtat

SEQ ID NO: 137071 - DNA, 20 bp, Artificial Sequence
  Description of Artificial Sequence: Synthetic oligonucleotide
  Target: ATXN1; (+) strand; PAM type: NRG; PAM sequence: TAG
aatgcaacaaaactcattaa

SEQ ID NO: 137072 - DNA, 20 bp, Artificial Sequence
  Description of Artificial Sequence: Synthetic oligonucleotide
  Target: ATXN1; (+) strand; PAM type: NRG; PAM sequence: CAG
caacaaaactcattaataga

SEQ ID NO: 137073 - DNA, 20 bp, Artificial Sequence
  Description of Artificial Sequence: Synthetic oligonucleotide
  Target: ATXN1; (+) strand; PAM type: NRG; PAM sequence: AAG
caaaactcattaatagacag

SEQ ID NO: 137074 - DNA, 20 bp, Artificial Sequence
  Description of Artificial Sequence: Synthetic oligonucleotide
  Target: ATXN1; (+) strand; PAM type: NRG; PAM sequence: AAG
aattaacttgtacattcaaa

SEQ ID NO: 137075 - DNA, 20 bp, Artificial Sequence
  Description of Artificial Sequence: Synthetic oligonucleotide
  Target: ATXN1; (+) strand; PAM type: NRG; PAM sequence: TAG
tcaaaaagaattcttctaaa

SEQ ID NO: 137076 - DNA, 20 bp, Artificial Sequence
  Description of Artificial Sequence: Synthetic oligonucleotide
  Target: ATXN1; (+) strand; PAM type: NRG; PAM sequence: AGG
caaaaagaattcttctaaat

SEQ ID NO: 137077 - DNA, 20 bp, Artificial Sequence
  Description of Artificial Sequence: Synthetic oligonucleotide
  Target: ATXN1; (+) strand; PAM type: NRG; PAM sequence: TAG
agaattcttctaaataggtg

SEQ ID NO: 137078 - DNA, 20 bp, Artificial Sequence
  Description of Artificial Sequence: Synthetic oligonucleotide
  Target: ATXN1; (+) strand; PAM type: NRG; PAM sequence: GAG
aattcttctaaataggtgta

SEQ ID NO: 137079 - DNA, 20 bp, Artificial Sequence
  Description of Artificial Sequence: Synthetic oligonucleotide
  Target: ATXN1; (+) strand; PAM type: NRG; PAM sequence: AAG
taaataggtgtagagtataa

SEQ ID NO: 137080 - DNA, 20 bp, Artificial Sequence
  Description of Artificial Sequence: Synthetic oligonucleotide
  Target: ATXN1; (+) strand; PAM type: NRG; PAM sequence: TGG
gtataaaagataataaatta

SEQ ID NO: 137081 - DNA, 20 bp, Artificial Sequence
  Description of Artificial Sequence: Synthetic oligonucleotide
  Target: ATXN1; (+) strand; PAM type: NRG; PAM sequence: CAG
gataataaattatggaatca

SEQ ID NO: 137082 - DNA, 20 bp, Artificial Sequence
  Description of Artificial Sequence: Synthetic oligonucleotide
  Target: ATXN1; (+) strand; PAM type: NRG; PAM sequence: GAG
aaattatggaatcacagact

SEQ ID NO: 137083 - DNA, 20 bp, Artificial Sequence
  Description of Artificial Sequence: Synthetic oligonucleotide
  Target: ATXN1; (+) strand; PAM type: NRG; PAM sequence: AAG
aatcacagactgagacaata

SEQ ID NO: 137084 - DNA, 20 bp, Artificial Sequence
  Description of Artificial Sequence: Synthetic oligonucleotide
  Target: ATXN1; (+) strand; PAM type: NRG; PAM sequence: GAG
actgagacaataaagataat

SEQ ID NO: 137085 - DNA, 20 bp, Artificial Sequence
  Description of Artificial Sequence: Synthetic oligonucleotide
  Target: ATXN1; (+) strand; PAM type: NRG; PAM sequence: AAG
aatgagaaaattatgtatca

SEQ ID NO: 137086 - DNA, 20 bp, Artificial Sequence
  Description of Artificial Sequence: Synthetic oligonucleotide
  Target: ATXN1; (+) strand; PAM type: NRG; PAM sequence: TAG
gaaaattatgtatcaaagtg

SEQ ID NO: 137087 - DNA, 20 bp, Artificial Sequence
  Description of Artificial Sequence: Synthetic oligonucleotide
  Target: ATXN1; (+) strand; PAM type: NRG; PAM sequence: AGG
aaaattatgtatcaaagtgt

SEQ ID NO: 137088 - DNA, 20 bp, Artificial Sequence
  Description of Artificial Sequence: Synthetic oligonucleotide
  Target: ATXN1; (+) strand; PAM type: NRG; PAM sequence: CAG
attatgtatcaaagtgtagg

SEQ ID NO: 137089 - DNA, 20 bp, Artificial Sequence
  Description of Artificial Sequence: Synthetic oligonucleotide
  Target: ATXN1; (+) strand; PAM type: NRG; PAM sequence: CAG
atcaaagtgtaggcagctta

SEQ ID NO: 137090 - DNA, 20 bp, Artificial Sequence
  Description of Artificial Sequence: Synthetic oligonucleotide
  Target: ATXN1; (+) strand; PAM type: NRG; PAM sequence: CAG
aagtgtaggcagcttacagt

SEQ ID NO: 137091 - DNA, 20 bp, Artificial Sequence
  Description of Artificial Sequence: Synthetic oligonucleotide
  Target: ATXN1; (+) strand; PAM type: NRG; PAM sequence: GAG
gtgtaggcagcttacagtca

SEQ ID NO: 137092 - DNA, 20 bp, Artificial Sequence
  Description of Artificial Sequence: Synthetic oligonucleotide
  Target: ATXN1; (+) strand; PAM type: NRG; PAM sequence: AGG
tgtaggcagcttacagtcag

SEQ ID NO: 137093 - DNA, 20 bp, Artificial Sequence
  Description of Artificial Sequence: Synthetic oligonucleotide
  Target: ATXN1; (+) strand; PAM type: NRG; PAM sequence: TAG
cagtcagaggcaaatatctt

SEQ ID NO: 137094 - DNA, 20 bp, Artificial Sequence
  Description of Artificial Sequence: Synthetic oligonucleotide
  Target: ATXN1; (+) strand; PAM type: NRG; PAM sequence: AAG
tctttagtatttttatcatt

SEQ ID NO: 137095 - DNA, 20 bp, Artificial Sequence
  Description of Artificial Sequence: Synthetic oligonucleotide
  Target: ATXN1; (+) strand; PAM type: NRG; PAM sequence: AAG
ttaagaaaaattaaaaataa

SEQ ID NO: 137096 - DNA, 20 bp, Artificial Sequence
  Description of Artificial Sequence: Synthetic oligonucleotide
  Target: ATXN1; (+) strand; PAM type: NRG; PAM sequence: TAG
aaaagatcaactcaataaat

SEQ ID NO: 137097 - DNA, 20 bp, Artificial Sequence
  Description of Artificial Sequence: Synthetic oligonucleotide
  Target: ATXN1; (+) strand; PAM type: NRG; PAM sequence: AAG
atcaactcaataaattagaa

SEQ ID NO: 137098 - DNA, 20 bp, Artificial Sequence
  Description of Artificial Sequence: Synthetic oligonucleotide
  Target: ATXN1; (+) strand; PAM type: NRG; PAM sequence: AGG
tcaactcaataaattagaaa

SEQ ID NO: 137099 - DNA, 20 bp, Artificial Sequence
  Description of Artificial Sequence: Synthetic oligonucleotide
  Target: ATXN1; (+) strand; PAM type: NRG; PAM sequence: GGG
caactcaataaattagaaaa

SEQ ID NO: 137100 - DNA, 20 bp, Artificial Sequence
  Description of Artificial Sequence: Synthetic oligonucleotide
  Target: ATXN1; (+) strand; PAM type: NRG; PAM sequence: GGG
aactcaataaattagaaaag

SEQ ID NO: 137101 - DNA, 20 bp, Artificial Sequence
  Description of Artificial Sequence: Synthetic oligonucleotide
  Target: ATXN1; (+) strand; PAM type: NRG; PAM sequence: GGG
actcaataaattagaaaagg

SEQ ID NO: 137102 - DNA, 20 bp, Artificial Sequence
  Description of Artificial Sequence: Synthetic oligonucleotide
  Target: ATXN1; (+) strand; PAM type: NRG; PAM sequence: TGG
caataaattagaaaaggggg

SEQ ID NO: 137103 - DNA, 20 bp, Artificial Sequence
  Description of Artificial Sequence: Synthetic oligonucleotide
  Target: ATXN1; (+) strand; PAM type: NRG; PAM sequence: GGG
aataaattagaaaagggggt

SEQ ID NO: 137104 - DNA, 20 bp, Artificial Sequence
  Description of Artificial Sequence: Synthetic oligonucleotide
  Target: ATXN1; (+) strand; PAM type: NRG; PAM sequence: CGG
ttagaaaagggggtgggaca

SEQ ID NO: 137105 - DNA, 20 bp, Artificial Sequence
  Description of Artificial Sequence: Synthetic oligonucleotide
  Target: ATXN1; (+) strand; PAM type: NRG; PAM sequence: TGG
gaaaagggggtgggacacgg

SEQ ID NO: 137106 - DNA, 20 bp, Artificial Sequence
  Description of Artificial Sequence: Synthetic oligonucleotide
  Target: ATXN1; (+) strand; PAM type: NRG; PAM sequence: CAG
ggctcacacctttgtaatcc

SEQ ID NO: 137107 - DNA, 20 bp, Artificial Sequence
  Description of Artificial Sequence: Synthetic oligonucleotide
  Target: ATXN1; (+) strand; PAM type: NRG; PAM sequence: TGG
cctttgtaatcccagcactt

SEQ ID NO: 137108 - DNA, 20 bp, Artificial Sequence
  Description of Artificial Sequence: Synthetic oligonucleotide
  Target: ATXN1; (+) strand; PAM type: NRG; PAM sequence: GGG
ctttgtaatcccagcacttt

SEQ ID NO: 137109 - DNA, 20 bp, Artificial Sequence
  Description of Artificial Sequence: Synthetic oligonucleotide
  Target: ATXN1; (+) strand; PAM type: NRG; PAM sequence: GAG
ttgtaatcccagcactttgg

SEQ ID NO: 137110 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 137111 - DNA, 20 bp, Artificial Sequence
  Description of Artificial Sequence: Synthetic oligonucleotide
  Target: ATXN1; (+) strand; PAM type: NRG; PAM sequence: CGG
atcccagcactttgggaggt

SEQ ID NO: 137112 - DNA, 20 bp, Artificial Sequence
  Description of Artificial Sequence: Synthetic oligonucleotide
  Target: ATXN1; (+) strand; PAM type: NRG; PAM sequence: GGG
tcccagcactttgggaggtc

SEQ ID NO: 137113 - DNA, 20 bp, Artificial Sequence
  Description of Artificial Sequence: Synthetic oligonucleotide
  Target: ATXN1; (+) strand; PAM type: NRG; PAM sequence: CAG
cagcactttgggaggtcggg

SEQ ID NO: 137114 - DNA, 20 bp, Artificial Sequence
  Description of Artificial Sequence: Synthetic oligonucleotide
  Target: ATXN1; (+) strand; PAM type: NRG; PAM sequence: AGG
agcactttgggaggtcgggc

SEQ ID NO: 137115 - DNA, 20 bp, Artificial Sequence
  Description of Artificial Sequence: Synthetic oligonucleotide
  Target: ATXN1; (+) strand; PAM type: NRG; PAM sequence: CAG
actttgggaggtcgggcagg

SEQ ID NO: 137116 - DNA, 20 bp, Artificial Sequence
  Description of Artificial Sequence: Synthetic oligonucleotide
  Target: ATXN1; (+) strand; PAM type: NRG; PAM sequence: GAG
aggtcgggcaggcagatcac

SEQ ID NO: 137117 - DNA, 20 bp, Artificial Sequence
  Description of Artificial Sequence: Synthetic oligonucleotide
  Target: ATXN1; (+) strand; PAM type: NRG; PAM sequence: AGG
ggtcgggcaggcagatcacg

SEQ ID NO: 137118 - DNA, 20 bp, Artificial Sequence
  Description of Artificial Sequence: Synthetic oligonucleotide
  Target: ATXN1; (+) strand; PAM type: NRG; PAM sequence: AAG
ggcaggcagatcacgaggtc

SEQ ID NO: 137119 - DNA, 20 bp, Artificial Sequence
  Description of Artificial Sequence: Synthetic oligonucleotide
  Target: ATXN1; (+) strand; PAM type: NRG; PAM sequence: GAG
caggcagatcacgaggtcaa

SEQ ID NO: 137120 - DNA, 20 bp, Artificial Sequence
  Description of Artificial Sequence: Synthetic oligonucleotide
  Target: ATXN1; (+) strand; PAM type: NRG; PAM sequence: GAG
gatcacgaggtcaagagatt

SEQ ID NO: 137121 - DNA, 20 bp, Artificial Sequence
  Description of Artificial Sequence: Synthetic oligonucleotide
  Target: ATXN1; (+) strand; PAM type: NRG; PAM sequence: TGG
tcaagagattgagaccatcc

SEQ ID NO: 137122 - DNA, 20 bp, Artificial Sequence
  Description of Artificial Sequence: Synthetic oligonucleotide
  Target: ATXN1; (+) strand; PAM type: NRG; PAM sequence: TGG
tgagaccatcctggccaaca

SEQ ID NO: 137123 - DNA, 20 bp, Artificial Sequence
  Description of Artificial Sequence: Synthetic oligonucleotide
  Target: ATXN1; (+) strand; PAM type: NRG; PAM sequence: TAG
tgtactaaaaatacaaaaat

SEQ ID NO: 137124 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatacaaaaattagc

SEQ ID NO: 137125 - DNA, 20 bp, Artificial Sequence
  Description of Artificial Sequence: Synthetic oligonucleotide
  Target: ATXN1; (+) strand; PAM type: NRG; PAM sequence: GGG
taaaaatacaaaaattagct

SEQ ID NO: 137126 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagctgggca

SEQ ID NO: 137127 - DNA, 20 bp, Artificial Sequence
  Description of Artificial Sequence: Synthetic oligonucleotide
  Target: ATXN1; (+) strand; PAM type: NRG; PAM sequence: TGG
caaaaattagctgggcatgg

SEQ ID NO: 137128 - DNA, 20 bp, Artificial Sequence
  Description of Artificial Sequence: Synthetic oligonucleotide
  Target: ATXN1; (+) strand; PAM type: NRG; PAM sequence: TAG
ggcatggtggcacgcacctg

SEQ ID NO: 137129 - DNA, 20 bp, Artificial Sequence
  Description of Artificial Sequence: Synthetic oligonucleotide
  Target: ATXN1; (+) strand; PAM type: NRG; PAM sequence: CAG
gtggcacgcacctgtagtcc

SEQ ID NO: 137130 - DNA, 20 bp, Artificial Sequence
  Description of Artificial Sequence: Synthetic oligonucleotide
  Target: ATXN1; (+) strand; PAM type: NRG; PAM sequence: TGG
cacctgtagtcccagctact

SEQ ID NO: 137131 - DNA, 20 bp, Artificial Sequence
  Description of Artificial Sequence: Synthetic oligonucleotide
  Target: ATXN1; (+) strand; PAM type: NRG; PAM sequence: GGG
acctgtagtcccagctactt

SEQ ID NO: 137132 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagctacttgg

SEQ ID NO: 137133 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagctacttggg

SEQ ID NO: 137134 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttgggaggct

SEQ ID NO: 137135 - DNA, 20 bp, Artificial Sequence
  Description of Artificial Sequence: Synthetic oligonucleotide
  Target: ATXN1; (+) strand; PAM type: NRG; PAM sequence: AGG
cccagctacttgggaggctg

SEQ ID NO: 137136 - DNA, 20 bp, Artificial Sequence
  Description of Artificial Sequence: Synthetic oligonucleotide
  Target: ATXN1; (+) strand; PAM type: NRG; PAM sequence: CAG
agctacttgggaggctgagg

SEQ ID NO: 137137 - DNA, 20 bp, Artificial Sequence
  Description of Artificial Sequence: Synthetic oligonucleotide
  Target: ATXN1; (+) strand; PAM type: NRG; PAM sequence: AGG
gctacttgggaggctgaggc

SEQ ID NO: 137138 - DNA, 20 bp, Artificial Sequence
  Description of Artificial Sequence: Synthetic oligonucleotide
  Target: ATXN1; (+) strand; PAM type: NRG; PAM sequence: GAG
tacttgggaggctgaggcag

SEQ ID NO: 137139 - DNA, 20 bp, Artificial Sequence
  Description of Artificial Sequence: Synthetic oligonucleotide
  Target: ATXN1; (+) strand; PAM type: NRG; PAM sequence: AAG
ggagaatcacttgaacccgt

SEQ ID NO: 137140 - DNA, 20 bp, Artificial Sequence
  Description of Artificial Sequence: Synthetic oligonucleotide
  Target: ATXN1; (+) strand; PAM type: NRG; PAM sequence: AGG
gagaatcacttgaacccgta

SEQ ID NO: 137141 - DNA, 20 bp, Artificial Sequence
  Description of Artificial Sequence: Synthetic oligonucleotide
  Target: ATXN1; (+) strand; PAM type: NRG; PAM sequence: TGG
aatcacttgaacccgtaagg

SEQ ID NO: 137142 - DNA, 20 bp, Artificial Sequence
  Description of Artificial Sequence: Synthetic oligonucleotide
  Target: ATXN1; (+) strand; PAM type: NRG; PAM sequence: GAG
tcacttgaacccgtaaggtg

SEQ ID NO: 137143 - DNA, 20 bp, Artificial Sequence
  Description of Artificial Sequence: Synthetic oligonucleotide
  Target: ATXN1; (+) strand; PAM type: NRG; PAM sequence: AGG
cacttgaacccgtaaggtgg

SEQ ID NO: 137144 - DNA, 20 bp, Artificial Sequence
  Description of Artificial Sequence: Synthetic oligonucleotide
  Target: ATXN1; (+) strand; PAM type: NRG; PAM sequence: CAG
aacccgtaaggtggaggttg

SEQ ID NO: 137145 - DNA, 20 bp, Artificial Sequence
  Description of Artificial Sequence: Synthetic oligonucleotide
  Target: ATXN1; (+) strand; PAM type: NRG; PAM sequence: GAG
cgtaaggtggaggttgcagt

SEQ ID NO: 137146 - DNA, 20 bp, Artificial Sequence
  Description of Artificial Sequence: Synthetic oligonucleotide
  Target: ATXN1; (+) strand; PAM type: NRG; PAM sequence: GAG
ggtggaggttgcagtgagcc

SEQ ID NO: 137147 - DNA, 20 bp, Artificial Sequence
  Description of Artificial Sequence: Synthetic oligonucleotide
  Target: ATXN1; (+) strand; PAM type: NRG; PAM sequence: GAG
tggaggttgcagtgagccga

SEQ ID NO: 137148 - DNA, 20 bp, Artificial Sequence
  Description of Artificial Sequence: Synthetic oligonucleotide
  Target: ATXN1; (+) strand; PAM type: NRG; PAM sequence: CAG
gagagtgcaccactgcactc

SEQ ID NO: 137149 - DNA, 20 bp, Artificial Sequence
  Description of Artificial Sequence: Synthetic oligonucleotide
  Target: ATXN1; (+) strand; PAM type: NRG; PAM sequence: TGG
tgcaccactgcactccagcc

SEQ ID NO: 137150 - DNA, 20 bp, Artificial Sequence
  Description of Artificial Sequence: Synthetic oligonucleotide
  Target: ATXN1; (+) strand; PAM type: NRG; PAM sequence: CAG
actgcactccagcctggtga

SEQ ID NO: 137151 - DNA, 20 bp, Artificial Sequence
  Description of Artificial Sequence: Synthetic oligonucleotide
  Target: ATXN1; (+) strand; PAM type: NRG; PAM sequence: GAG
tgcactccagcctggtgaca

SEQ ID NO: 137152 - DNA, 20 bp, Artificial Sequence
  Description of Artificial Sequence: Synthetic oligonucleotide
  Target: ATXN1; (+) strand; PAM type: NRG; PAM sequence: GAG
cactccagcctggtgacaga

SEQ ID NO: 137153 - DNA, 20 bp, Artificial Sequence
  Description of Artificial Sequence: Synthetic oligonucleotide
  Target: ATXN1; (+) strand; PAM type: NRG; PAM sequence: GAG
ctccagcctggtgacagaga

SEQ ID NO: 137154 - DNA, 20 bp, Artificial Sequence
  Description of Artificial Sequence: Synthetic oligonucleotide
  Target: ATXN1; (+) strand; PAM type: NRG; PAM sequence: AAG
ctgtcttaaaaaaaaaaaaa

SEQ ID NO: 137155 - DNA, 20 bp, Artificial Sequence
  Description of Artificial Sequence: Synthetic oligonucleotide
  Target: ATXN1; (+) strand; PAM type: NRG; PAM sequence: AAG
cttaaaaaaaaaaaaaaaga

SEQ ID NO: 137156 - DNA, 20 bp, Artificial Sequence
  Description of Artificial Sequence: Synthetic oligonucleotide
  Target: ATXN1; (+) strand; PAM type: NRG; PAM sequence: AGG
ttaaaaaaaaaaaaaaagaa

SEQ ID NO: 137157 - DNA, 20 bp, Artificial Sequence
  Description of Artificial Sequence: Synthetic oligonucleotide
  Target: ATXN1; (+) strand; PAM type: NRG; PAM sequence: GGG
taaaaaaaaaaaaaaagaaa

SEQ ID NO: 137158 - DNA, 20 bp, Artificial Sequence
  Description of Artificial Sequence: Synthetic oligonucleotide
  Target: ATXN1; (+) strand; PAM type: NRG; PAM sequence: AAG
aaagaaagggaaataaacct

SEQ ID NO: 137159 - DNA, 20 bp, Artificial Sequence
  Description of Artificial Sequence: Synthetic oligonucleotide
  Target: ATXN1; (+) strand; PAM type: NRG; PAM sequence: AAG
aagggaaataaacctaagaa

SEQ ID NO: 137160 - DNA, 20 bp, Artificial Sequence
  Description of Artificial Sequence: Synthetic oligonucleotide
  Target: ATXN1; (+) strand; PAM type: NRG; PAM sequence: AAG
aacctaagaaaagcaatata

SEQ ID NO: 137161 - DNA, 20 bp, Artificial Sequence
  Description of Artificial Sequence: Synthetic oligonucleotide
  Target: ATXN1; (+) strand; PAM type: NRG; PAM sequence: AGG
acctaagaaaagcaatataa

SEQ ID NO: 137162 - DNA, 20 bp, Artificial Sequence
  Description of Artificial Sequence: Synthetic oligonucleotide
  Target: ATXN1; (+) strand; PAM type: NRG; PAM sequence: AAG
agaaaagcaatataaaggaa

SEQ ID NO: 137163 - DNA, 20 bp, Artificial Sequence
  Description of Artificial Sequence: Synthetic oligonucleotide
  Target: ATXN1; (+) strand; PAM type: NRG; PAM sequence: GAG
acataaaactatccaaatgt

SEQ ID NO: 137164 - DNA, 20 bp, Artificial Sequence
  Description of Artificial Sequence: Synthetic oligonucleotide
  Target: ATXN1; (+) strand; PAM type: NRG; PAM sequence: TGG
atgtgagataaaaattattt

SEQ ID NO: 137165 - DNA, 20 bp, Artificial Sequence
  Description of Artificial Sequence: Synthetic oligonucleotide
  Target: ATXN1; (+) strand; PAM type: NRG; PAM sequence: CGG
gagataaaaattattttggc

SEQ ID NO: 137166 - DNA, 20 bp, Artificial Sequence
  Description of Artificial Sequence: Synthetic oligonucleotide
  Target: ATXN1; (+) strand; PAM type: NRG; PAM sequence: GGG
agataaaaattattttggcc

SEQ ID NO: 137167 - DNA, 20 bp, Artificial Sequence
  Description of Artificial Sequence: Synthetic oligonucleotide
  Target: ATXN1; (+) strand; PAM type: NRG; PAM sequence: CGG
aaaattattttggccgggcg

SEQ ID NO: 137168 - DNA, 20 bp, Artificial Sequence
  Description of Artificial Sequence: Synthetic oligonucleotide
  Target: ATXN1; (+) strand; PAM type: NRG; PAM sequence: TGG
attattttggccgggcgcgg

SEQ ID NO: 137169 - DNA, 20 bp, Artificial Sequence
  Description of Artificial Sequence: Synthetic oligonucleotide
  Target: ATXN1; (+) strand; PAM type: NRG; PAM sequence: CAG
gtggctcacgcctgtaatcc

SEQ ID NO: 137170 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagcactt

SEQ ID NO: 137171 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 137172 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 137173 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 137174 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggcc

SEQ ID NO: 137175 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggccg

SEQ ID NO: 137176 - DNA, 20 bp, Artificial Sequence
  Description of Artificial Sequence: Synthetic oligonucleotide
  Target: ATXN1; (+) strand; PAM type: NRG; PAM sequence: CGG
agcactttgggaggccgagg

SEQ ID NO: 137177 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccgaggc

SEQ ID NO: 137178 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccgaggcggg

SEQ ID NO: 137179 - DNA, 20 bp, Artificial Sequence
  Description of Artificial Sequence: Synthetic oligonucleotide
  Target: ATXN1; (+) strand; PAM type: NRG; PAM sequence: GAG
ggccgaggcgggtggatcat

SEQ ID NO: 137180 - DNA, 20 bp, Artificial Sequence
  Description of Artificial Sequence: Synthetic oligonucleotide
  Target: ATXN1; (+) strand; PAM type: NRG; PAM sequence: AGG
gccgaggcgggtggatcatg

SEQ ID NO: 137181 - DNA, 20 bp, Artificial Sequence
  Description of Artificial Sequence: Synthetic oligonucleotide
  Target: ATXN1; (+) strand; PAM type: NRG; PAM sequence: CAG
aggcgggtggatcatgaggt

SEQ ID NO: 137182 - DNA, 20 bp, Artificial Sequence
  Description of Artificial Sequence: Synthetic oligonucleotide
  Target: ATXN1; (+) strand; PAM type: NRG; PAM sequence: AGG
ggcgggtggatcatgaggtc

SEQ ID NO: 137183 - DNA, 20 bp, Artificial Sequence
  Description of Artificial Sequence: Synthetic oligonucleotide
  Target: ATXN1; (+) strand; PAM type: NRG; PAM sequence: GAG
cgggtggatcatgaggtcag

SEQ ID NO: 137184 - DNA, 20 bp, Artificial Sequence
  Description of Artificial Sequence: Synthetic oligonucleotide
  Target: ATXN1; (+) strand; PAM type: NRG; PAM sequence: GAG
gatcatgaggtcaggagatc

SEQ ID NO: 137185 - DNA, 20 bp, Artificial Sequence
  Description of Artificial Sequence: Synthetic oligonucleotide
  Target: ATXN1; (+) strand; PAM type: NRG; PAM sequence: TGG
tcaggagatcgagaccatcc

SEQ ID NO: 137186 - DNA, 20 bp, Artificial Sequence
  Description of Artificial Sequence: Synthetic oligonucleotide
  Target: ATXN1; (+) strand; PAM type: NRG; PAM sequence: AAG
tcgagaccatcctggctaac

SEQ ID NO: 137187 - DNA, 20 bp, Artificial Sequence
  Description of Artificial Sequence: Synthetic oligonucleotide
  Target: ATXN1; (+) strand; PAM type: NRG; PAM sequence: AGG
cgagaccatcctggctaaca

SEQ ID NO: 137188 - DNA, 20 bp, Artificial Sequence
  Description of Artificial Sequence: Synthetic oligonucleotide
  Target: ATXN1; (+) strand; PAM type: NRG; PAM sequence: TAG
ctactaaaaatacaaaaaat

SEQ ID NO: 137189 - DNA, 20 bp, Artificial Sequence
  Description of Artificial Sequence: Synthetic oligonucleotide
  Target: ATXN1; (+) strand; PAM type: NRG; PAM sequence: CGG
taaaaatacaaaaaattagc

SEQ ID NO: 137190 - DNA, 20 bp, Artificial Sequence
  Description of Artificial Sequence: Synthetic oligonucleotide
  Target: ATXN1; (+) strand; PAM type: NRG; PAM sequence: GGG
aaaaatacaaaaaattagcc

SEQ ID NO: 137191 - DNA, 20 bp, Artificial Sequence
  Description of Artificial Sequence: Synthetic oligonucleotide
  Target: ATXN1; (+) strand; PAM type: NRG; PAM sequence: CGG
tacaaaaaattagccgggcg

SEQ ID NO: 137192 - DNA, 20 bp, Artificial Sequence
  Description of Artificial Sequence: Synthetic oligonucleotide
  Target: ATXN1; (+) strand; PAM type: NRG; PAM sequence: TGG
aaaaaattagccgggcgcgg

SEQ ID NO: 137193 - DNA, 20 bp, Artificial Sequence
  Description of Artificial Sequence: Synthetic oligonucleotide
  Target: ATXN1; (+) strand; PAM type: NRG; PAM sequence: CGG
aaattagccgggcgcggtgg

SEQ ID NO: 137194 - DNA, 20 bp, Artificial Sequence
  Description of Artificial Sequence: Synthetic oligonucleotide
  Target: ATXN1; (+) strand; PAM type: NRG; PAM sequence: GGG
aattagccgggcgcggtggc

SEQ ID NO: 137195 - DNA, 20 bp, Artificial Sequence
  Description of Artificial Sequence: Synthetic oligonucleotide
  Target: ATXN1; (+) strand; PAM type: NRG; PAM sequence: TAG
ggcgcggtggcgggcgcctg

SEQ ID NO: 137196 - DNA, 20 bp, Artificial Sequence
  Description of Artificial Sequence: Synthetic oligonucleotide
  Target: ATXN1; (+) strand; PAM type: NRG; PAM sequence: CAG
gtggcgggcgcctgtagtcc

SEQ ID NO: 137197 - DNA, 20 bp, Artificial Sequence
  Description of Artificial Sequence: Synthetic oligonucleotide
  Target: ATXN1; (+) strand; PAM type: NRG; PAM sequence: CGG
cgcctgtagtcccagccact

SEQ ID NO: 137198 - DNA, 20 bp, Artificial Sequence
  Description of Artificial Sequence: Synthetic oligonucleotide
  Target: ATXN1; (+) strand; PAM type: NRG; PAM sequence: GGG
gcctgtagtcccagccactc

SEQ ID NO: 137199 - DNA, 20 bp, Artificial Sequence
  Description of Artificial Sequence: Synthetic oligonucleotide
  Target: ATXN1; (+) strand; PAM type: NRG; PAM sequence: GAG
ctgtagtcccagccactcgg

SEQ ID NO: 137200 - DNA, 20 bp, Artificial Sequence
  Description of Artificial Sequence: Synthetic oligonucleotide
  Target: ATXN1; (+) strand; PAM type: NRG; PAM sequence: AGG
tgtagtcccagccactcggg

SEQ ID NO: 137201 - DNA, 20 bp, Artificial Sequence
  Description of Artificial Sequence: Synthetic oligonucleotide
  Target: ATXN1; (+) strand; PAM type: NRG; PAM sequence: GAG
tcccagccactcgggaggct

SEQ ID NO: 137202 - DNA, 20 bp, Artificial Sequence
  Description of Artificial Sequence: Synthetic oligonucleotide
  Target: ATXN1; (+) strand; PAM type: NRG; PAM sequence: AGG
cccagccactcgggaggctg

SEQ ID NO: 137203 - DNA, 20 bp, Artificial Sequence
  Description of Artificial Sequence: Synthetic oligonucleotide
  Target: ATXN1; (+) strand; PAM type: NRG; PAM sequence: CAG
agccactcgggaggctgagg

SEQ ID NO: 137204 - DNA, 20 bp, Artificial Sequence
  Description of Artificial Sequence: Synthetic oligonucleotide
  Target: ATXN1; (+) strand; PAM type: NRG; PAM sequence: AGG
gccactcgggaggctgaggc

SEQ ID NO: 137205 - DNA, 20 bp, Artificial Sequence
  Description of Artificial Sequence: Synthetic oligonucleotide
  Target: ATXN1; (+) strand; PAM type: NRG; PAM sequence: GAG
cactcgggaggctgaggcag

SEQ ID NO: 137206 - DNA, 20 bp, Artificial Sequence
  Description of Artificial Sequence: Synthetic oligonucleotide
  Target: ATXN1; (+) strand; PAM type: NRG; PAM sequence: TGG
gggaggctgaggcaggagaa

SEQ ID NO: 137207 - DNA, 20 bp, Artificial Sequence
  Description of Artificial Sequence: Synthetic oligonucleotide
  Target: ATXN1; (+) strand; PAM type: NRG; PAM sequence: CGG
gcaggagaatggcgtgaacc

SEQ ID NO: 137208 - DNA, 20 bp, Artificial Sequence
  Description of Artificial Sequence: Synthetic oligonucleotide
  Target: ATXN1; (+) strand; PAM type: NRG; PAM sequence: GGG
caggagaatggcgtgaaccc

SEQ ID NO: 137209 - DNA, 20 bp, Artificial Sequence
  Description of Artificial Sequence: Synthetic oligonucleotide
  Target: ATXN1; (+) strand; PAM type: NRG; PAM sequence: AAG
gagaatggcgtgaacccggg

SEQ ID NO: 137210 - DNA, 20 bp, Artificial Sequence
  Description of Artificial Sequence: Synthetic oligonucleotide
  Target: ATXN1; (+) strand; PAM type: NRG; PAM sequence: CGG
aatggcgtgaacccgggaag

SEQ ID NO: 137211 - DNA, 20 bp, Artificial Sequence
  Description of Artificial Sequence: Synthetic oligonucleotide
  Target: ATXN1; (+) strand; PAM type: NRG; PAM sequence: GAG
tggcgtgaacccgggaagcg

SEQ ID NO: 137212 - DNA, 20 bp, Artificial Sequence
  Description of Artificial Sequence: Synthetic oligonucleotide
  Target: ATXN1; (+) strand; PAM type: NRG; PAM sequence: CAG
aacccgggaagcggagcttg

SEQ ID NO: 137213 - DNA, 20 bp, Artificial Sequence
  Description of Artificial Sequence: Synthetic oligonucleotide
  Target: ATXN1; (+) strand; PAM type: NRG; PAM sequence: GAG
cgggaagcggagcttgcagt

SEQ ID NO: 137214 - DNA, 20 bp, Artificial Sequence
  Description of Artificial Sequence: Synthetic oligonucleotide
  Target: ATXN1; (+) strand; PAM type: NRG; PAM sequence: GAG
agcggagcttgcagtgagcc

SEQ ID NO: 137215 - DNA, 20 bp, Artificial Sequence
  Description of Artificial Sequence: Synthetic oligonucleotide
  Target: ATXN1; (+) strand; PAM type: NRG; PAM sequence: CAG
gagccgagattgtgccactg

SEQ ID NO: 137216 - DNA, 20 bp, Artificial Sequence
  Description of Artificial Sequence: Synthetic oligonucleotide
  Target: ATXN1; (+) strand; PAM type: NRG; PAM sequence: CAG
gattgtgccactgcagtccg

SEQ ID NO: 137217 - DNA, 20 bp, Artificial Sequence
  Description of Artificial Sequence: Synthetic oligonucleotide
  Target: ATXN1; (+) strand; PAM type: NRG; PAM sequence: CGG
tgccactgcagtccgcagtc

SEQ ID NO: 137218 - DNA, 20 bp, Artificial Sequence
  Description of Artificial Sequence: Synthetic oligonucleotide
  Target: ATXN1; (+) strand; PAM type: NRG; PAM sequence: TGG
ctgcagtccgcagtccggcc

SEQ ID NO: 137219 - DNA, 20 bp, Artificial Sequence
  Description of Artificial Sequence: Synthetic oligonucleotide
  Target: ATXN1; (+) strand; PAM type: NRG; PAM sequence: GGG
tgcagtccgcagtccggcct

SEQ ID NO: 137220 - DNA, 20 bp, Artificial Sequence
  Description of Artificial Sequence: Synthetic oligonucleotide
  Target: ATXN1; (+) strand; PAM type: NRG; PAM sequence: CAG
ccgcagtccggcctgggcga

SEQ ID NO: 137221 - DNA, 20 bp, Artificial Sequence
  Description of Artificial Sequence: Synthetic oligonucleotide
  Target: ATXN1; (+) strand; PAM type: NRG; PAM sequence: GAG
gcagtccggcctgggcgaca

SEQ ID NO: 137222 - DNA, 20 bp, Artificial Sequence
  Description of Artificial Sequence: Synthetic oligonucleotide
  Target: ATXN1; (+) strand; PAM type: NRG; PAM sequence: GAG
tccggcctgggcgacagagc

SEQ ID NO: 137223 - DNA, 20 bp, Artificial Sequence
  Description of Artificial Sequence: Synthetic oligonucleotide
  Target: ATXN1; (+) strand; PAM type: NRG; PAM sequence: AAG
aaaaaaaaaaattattttaa

SEQ ID NO: 137224 - DNA, 20 bp, Artificial Sequence
  Description of Artificial Sequence: Synthetic oligonucleotide
  Target: ATXN1; (+) strand; PAM type: NRG; PAM sequence: AGG
aaaaaaaaaattattttaaa

SEQ ID NO: 137225 - DNA, 20 bp, Artificial Sequence
  Description of Artificial Sequence: Synthetic oligonucleotide
  Target: ATXN1; (+) strand; PAM type: NRG; PAM sequence: TAG
tattttaaaaggctattaat

SEQ ID NO: 137226 - DNA, 20 bp, Artificial Sequence
  Description of Artificial Sequence: Synthetic oligonucleotide
  Target: ATXN1; (+) strand; PAM type: NRG; PAM sequence: TAG
ttaaaaggctattaattagc

SEQ ID NO: 137227 - DNA, 20 bp, Artificial Sequence
  Description of Artificial Sequence: Synthetic oligonucleotide
  Target: ATXN1; (+) strand; PAM type: NRG; PAM sequence: CAG
aaaggctattaattagctag

SEQ ID NO: 137228 - DNA, 20 bp, Artificial Sequence
  Description of Artificial Sequence: Synthetic oligonucleotide
  Target: ATXN1; (+) strand; PAM type: NRG; PAM sequence: AAG
gctattaattagctagcagt

SEQ ID NO: 137229 - DNA, 20 bp, Artificial Sequence
  Description of Artificial Sequence: Synthetic oligonucleotide
  Target: ATXN1; (+) strand; PAM type: NRG; PAM sequence: AAG
tttaaaatatatacaaaaat

SEQ ID NO: 137230 - DNA, 20 bp, Artificial Sequence
  Description of Artificial Sequence: Synthetic oligonucleotide
  Target: ATXN1; (+) strand; PAM type: NRG; PAM sequence: TAG
aaataagattgacttactgc

SEQ ID NO: 137231 - DNA, 20 bp, Artificial Sequence
  Description of Artificial Sequence: Synthetic oligonucleotide
  Target: ATXN1; (+) strand; PAM type: NRG; PAM sequence: AAG
acttactgctagctaatctt

SEQ ID NO: 137232 - DNA, 20 bp, Artificial Sequence
  Description of Artificial Sequence: Synthetic oligonucleotide
  Target: ATXN1; (+) strand; PAM type: NRG; PAM sequence: CAG
tgctagctaatcttaagttt

SEQ ID NO: 137233 - DNA, 20 bp, Artificial Sequence
  Description of Artificial Sequence: Synthetic oligonucleotide
  Target: ATXN1; (+) strand; PAM type: NRG; PAM sequence: GAG
ctagctaatcttaagtttca

SEQ ID NO: 137234 - DNA, 20 bp, Artificial Sequence
  Description of Artificial Sequence: Synthetic oligonucleotide
  Target: ATXN1; (+) strand; PAM type: NRG; PAM sequence: AAG
gaacaaaccaaattaaaaat

SEQ ID NO: 137235 - DNA, 20 bp, Artificial Sequence
  Description of Artificial Sequence: Synthetic oligonucleotide
  Target: ATXN1; (+) strand; PAM type: NRG; PAM sequence: AAG
caaaccaaattaaaaataag

SEQ ID NO: 137236 - DNA, 20 bp, Artificial Sequence
  Description of Artificial Sequence: Synthetic oligonucleotide
  Target: ATXN1; (+) strand; PAM type: NRG; PAM sequence: TGG
accaaattaaaaataagaag

SEQ ID NO: 137237 - DNA, 20 bp, Artificial Sequence
  Description of Artificial Sequence: Synthetic oligonucleotide
  Target: ATXN1; (+) strand; PAM type: NRG; PAM sequence: GAG
ggaataaattcacaaatatt

SEQ ID NO: 137238 - DNA, 20 bp, Artificial Sequence
  Description of Artificial Sequence: Synthetic oligonucleotide
  Target: ATXN1; (+) strand; PAM type: NRG; PAM sequence: TAG
tgttaacaaaattttgaata

SEQ ID NO: 137239 - DNA, 20 bp, Artificial Sequence
  Description of Artificial Sequence: Synthetic oligonucleotide
  Target: ATXN1; (+) strand; PAM type: NRG; PAM sequence: TGG
caaaattttgaatatagaaa

SEQ ID NO: 137240 - DNA, 20 bp, Artificial Sequence
  Description of Artificial Sequence: Synthetic oligonucleotide
  Target: ATXN1; (+) strand; PAM type: NRG; PAM sequence: CAG
attttgaatatagaaatggt

SEQ ID NO: 137241 - DNA, 20 bp, Artificial Sequence
  Description of Artificial Sequence: Synthetic oligonucleotide
  Target: ATXN1; (+) strand; PAM type: NRG; PAM sequence: AGG
ttttgaatatagaaatggtc

SEQ ID NO: 137242 - DNA, 20 bp, Artificial Sequence
  Description of Artificial Sequence: Synthetic oligonucleotide
  Target: ATXN1; (+) strand; PAM type: NRG; PAM sequence: CGG
aatatagaaatggtcaggtc

SEQ ID NO: 137243 - DNA, 20 bp, Artificial Sequence
  Description of Artificial Sequence: Synthetic oligonucleotide
  Target: ATXN1; (+) strand; PAM type: NRG; PAM sequence: TGG
atagaaatggtcaggtccgg

SEQ ID NO: 137244 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatccccatgctt

SEQ ID NO: 137245 - DNA, 20 bp, Artificial Sequence
  Description of Artificial Sequence: Synthetic oligonucleotide
  Target: ATXN1; (+) strand; PAM type: NRG; PAM sequence: GGG
acctgtaatccccatgcttt

SEQ ID NO: 137246 - DNA, 20 bp, Artificial Sequence
  Description of Artificial Sequence: Synthetic oligonucleotide
  Target: ATXN1; (+) strand; PAM type: NRG; PAM sequence: GAG
ctgtaatccccatgctttgg

SEQ ID NO: 137247 - DNA, 20 bp, Artificial Sequence
  Description of Artificial Sequence: Synthetic oligonucleotide
  Target: ATXN1; (+) strand; PAM type: NRG; PAM sequence: AGG
tgtaatccccatgctttggg

SEQ ID NO: 137248 - DNA, 20 bp, Artificial Sequence
  Description of Artificial Sequence: Synthetic oligonucleotide
  Target: ATXN1; (+) strand; PAM type: NRG; PAM sequence: GAG
tccccatgctttgggaggct

SEQ ID NO: 137249 - DNA, 20 bp, Artificial Sequence
  Description of Artificial Sequence: Synthetic oligonucleotide
  Target: ATXN1; (+) strand; PAM type: NRG; PAM sequence: AGG
ccccatgctttgggaggctg

SEQ ID NO: 137250 - DNA, 20 bp, Artificial Sequence
  Description of Artificial Sequence: Synthetic oligonucleotide
  Target: ATXN1; (+) strand; PAM type: NRG; PAM sequence: CAG
catgctttgggaggctgagg

SEQ ID NO: 137251 - DNA, 20 bp, Artificial Sequence
  Description of Artificial Sequence: Synthetic oligonucleotide
  Target: ATXN1; (+) strand; PAM type: NRG; PAM sequence: AGG
atgctttgggaggctgaggc

SEQ ID NO: 137252 - DNA, 20 bp, Artificial Sequence
  Description of Artificial Sequence: Synthetic oligonucleotide
  Target: ATXN1; (+) strand; PAM type: NRG; PAM sequence: AAG
aggctgaggcaggattgctc

SEQ ID NO: 137253 - DNA, 20 bp, Artificial Sequence
  Description of Artificial Sequence: Synthetic oligonucleotide
  Target: ATXN1; (+) strand; PAM type: NRG; PAM sequence: AGG
ggctgaggcaggattgctca

SEQ ID NO: 137254 - DNA, 20 bp, Artificial Sequence
  Description of Artificial Sequence: Synthetic oligonucleotide
  Target: ATXN1; (+) strand; PAM type: NRG; PAM sequence: CAG
tgaggcaggattgctcaagg

SEQ ID NO: 137255 - DNA, 20 bp, Artificial Sequence
  Description of Artificial Sequence: Synthetic oligonucleotide
  Target: ATXN1; (+) strand; PAM type: NRG; PAM sequence: AGG
gaggcaggattgctcaaggc

SEQ ID NO: 137256 - DNA, 20 bp, Artificial Sequence
  Description of Artificial Sequence: Synthetic oligonucleotide
  Target: ATXN1; (+) strand; PAM type: NRG; PAM sequence: GAG
ggcaggattgctcaaggcag

SEQ ID NO: 137257 - DNA, 20 bp, Artificial Sequence
  Description of Artificial Sequence: Synthetic oligonucleotide
  Target: ATXN1; (+) strand; PAM type: NRG; PAM sequence: GAG
attgctcaaggcaggagttt

SEQ ID NO: 137258 - DNA, 20 bp, Artificial Sequence
  Description of Artificial Sequence: Synthetic oligonucleotide
  Target: ATXN1; (+) strand; PAM type: NRG; PAM sequence: CAG
tcaaggcaggagtttgagac

SEQ ID NO: 137259 - DNA, 20 bp, Artificial Sequence
  Description of Artificial Sequence: Synthetic oligonucleotide
  Target: ATXN1; (+) strand; PAM type: NRG; PAM sequence: GAG
caggagtttgagaccagcct

SEQ ID NO: 137260 - DNA, 20 bp, Artificial Sequence
  Description of Artificial Sequence: Synthetic oligonucleotide
  Target: ATXN1; (+) strand; PAM type: NRG; PAM sequence: TAG
tgagaccagcctgagcaata

SEQ ID NO: 137261 - DNA, 20 bp, Artificial Sequence
  Description of Artificial Sequence: Synthetic oligonucleotide
  Target: ATXN1; (+) strand; PAM type: NRG; PAM sequence: GAG
accagcctgagcaatatagt

SEQ ID NO: 137262 - DNA, 20 bp, Artificial Sequence
  Description of Artificial Sequence: Synthetic oligonucleotide
  Target: ATXN1; (+) strand; PAM type: NRG; PAM sequence: AAG
gagaccccatctctacaaaa

SEQ ID NO: 137263 - DNA, 20 bp, Artificial Sequence
  Description of Artificial Sequence: Synthetic oligonucleotide
  Target: ATXN1; (+) strand; PAM type: NRG; PAM sequence: AAG
tctctacaaaaaagttaaaa

SEQ ID NO: 137264 - DNA, 20 bp, Artificial Sequence
  Description of Artificial Sequence: Synthetic oligonucleotide
  Target: ATXN1; (+) strand; PAM type: NRG; PAM sequence: AAG
caaaaaagttaaaaaagaaa

SEQ ID NO: 137265 - DNA, 20 bp, Artificial Sequence
  Description of Artificial Sequence: Synthetic oligonucleotide
  Target: ATXN1; (+) strand; PAM type: NRG; PAM sequence: GAG
aaaaagttaaaaaagaaaaa

SEQ ID NO: 137266 - DNA, 20 bp, Artificial Sequence
  Description of Artificial Sequence: Synthetic oligonucleotide
  Target: ATXN1; (+) strand; PAM type: NRG; PAM sequence: CAG
agttaaaaaagaaaaagagc

SEQ ID NO: 137267 - DNA, 20 bp, Artificial Sequence
  Description of Artificial Sequence: Synthetic oligonucleotide
  Target: ATXN1; (+) strand; PAM type: NRG; PAM sequence: AGG
gttaaaaaagaaaaagagcc

SEQ ID NO: 137268 - DNA, 20 bp, Artificial Sequence
  Description of Artificial Sequence: Synthetic oligonucleotide
  Target: ATXN1; (+) strand; PAM type: NRG; PAM sequence: TAG
aaaagaaaaagagccaggca

SEQ ID NO: 137269 - DNA, 20 bp, Artificial Sequence
  Description of Artificial Sequence: Synthetic oligonucleotide
  Target: ATXN1; (+) strand; PAM type: NRG; PAM sequence: TGG
agaaaaagagccaggcatag

SEQ ID NO: 137270 - DNA, 20 bp, Artificial Sequence
  Description of Artificial Sequence: Synthetic oligonucleotide
  Target: ATXN1; (+) strand; PAM type: NRG; PAM sequence: CAG
ggcatagtggcatgcacctg

SEQ ID NO: 137271 - DNA, 20 bp, Artificial Sequence
  Description of Artificial Sequence: Synthetic oligonucleotide
  Target: ATXN1; (+) strand; PAM type: NRG; PAM sequence: CAG
gtggcatgcacctgcagtcc

SEQ ID NO: 137272 - DNA, 20 bp, Artificial Sequence
  Description of Artificial Sequence: Synthetic oligonucleotide
  Target: ATXN1; (+) strand; PAM type: NRG; PAM sequence: TGG
cacctgcagtcccagctact

SEQ ID NO: 137273 - DNA, 20 bp, Artificial Sequence
  Description of Artificial Sequence: Synthetic oligonucleotide
  Target: ATXN1; (+) strand; PAM type: NRG; PAM sequence: GGG
acctgcagtcccagctactt

SEQ ID NO: 137274 - DNA, 20 bp, Artificial Sequence
  Description of Artificial Sequence: Synthetic oligonucleotide
  Target: ATXN1; (+) strand; PAM type: NRG; PAM sequence: GAG
ctgcagtcccagctacttgg

SEQ ID NO: 137275 - DNA, 20 bp, Artificial Sequence
  Description of Artificial Sequence: Synthetic oligonucleotide
  Target: ATXN1; (+) strand; PAM type: NRG; PAM sequence: AGG
tgcagtcccagctacttggg

SEQ ID NO: 137276 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttgggaggct

SEQ ID NO: 137277 - DNA, 20 bp, Artificial Sequence
  Description of Artificial Sequence: Synthetic oligonucleotide
  Target: ATXN1; (+) strand; PAM type: NRG; PAM sequence: AGG
cccagctacttgggaggctg

SEQ ID NO: 137278 - DNA, 20 bp, Artificial Sequence
  Description of Artificial Sequence: Synthetic oligonucleotide
  Target: ATXN1; (+) strand; PAM type: NRG; PAM sequence: CGG
agctacttgggaggctgagg

SEQ ID NO: 137279 - DNA, 20 bp, Artificial Sequence
  Description of Artificial Sequence: Synthetic oligonucleotide
  Target: ATXN1; (+) strand; PAM type: NRG; PAM sequence: GGG
gctacttgggaggctgaggc

SEQ ID NO: 137280 - DNA, 20 bp, Artificial Sequence
  Description of Artificial Sequence: Synthetic oligonucleotide
  Target: ATXN1; (+) strand; PAM type: NRG; PAM sequence: GAG
tacttgggaggctgaggcgg

SEQ ID NO: 137281 - DNA, 20 bp, Artificial Sequence
  Description of Artificial Sequence: Synthetic oligonucleotide
  Target: ATXN1; (+) strand; PAM type: NRG; PAM sequence: AGG
acttgggaggctgaggcggg

SEQ ID NO: 137282 - DNA, 20 bp, Artificial Sequence
  Description of Artificial Sequence: Synthetic oligonucleotide
  Target: ATXN1; (+) strand; PAM type: NRG; PAM sequence: GAG
ctgaggcgggaggattgctt

SEQ ID NO: 137283 - DNA, 20 bp, Artificial Sequence
  Description of Artificial Sequence: Synthetic oligonucleotide
  Target: ATXN1; (+) strand; PAM type: NRG; PAM sequence: CAG
gcgggaggattgcttgagcc

SEQ ID NO: 137284 - DNA, 20 bp, Artificial Sequence
  Description of Artificial Sequence: Synthetic oligonucleotide
  Target: ATXN1; (+) strand; PAM type: NRG; PAM sequence: AGG
cgggaggattgcttgagccc

SEQ ID NO: 137285 - DNA, 20 bp, Artificial Sequence
  Description of Artificial Sequence: Synthetic oligonucleotide
  Target: ATXN1; (+) strand; PAM type: NRG; PAM sequence: GGG
gggaggattgcttgagccca

SEQ ID NO: 137286 - DNA, 20 bp, Artificial Sequence
  Description of Artificial Sequence: Synthetic oligonucleotide
  Target: ATXN1; (+) strand; PAM type: NRG; PAM sequence: GGG
ggaggattgcttgagcccag

SEQ ID NO: 137287 - DNA, 20 bp, Artificial Sequence
  Description of Artificial Sequence: Synthetic oligonucleotide
  Target: ATXN1; (+) strand; PAM type: NRG; PAM sequence: AAG
ttgcttgagcccaggggttc

SEQ ID NO: 137288 - DNA, 20 bp, Artificial Sequence
  Description of Artificial Sequence: Synthetic oligonucleotide
  Target: ATXN1; (+) strand; PAM type: NRG; PAM sequence: AGG
tgcttgagcccaggggttca

SEQ ID NO: 137289 - DNA, 20 bp, Artificial Sequence
  Description of Artificial Sequence: Synthetic oligonucleotide
  Target: ATXN1; (+) strand; PAM type: NRG; PAM sequence: CAG
agcccaggggttcaaggttg

SEQ ID NO: 137290 - DNA, 20 bp, Artificial Sequence
  Description of Artificial Sequence: Synthetic oligonucleotide
  Target: ATXN1; (+) strand; PAM type: NRG; PAM sequence: GAG
caggggttcaaggttgcagt

SEQ ID NO: 137291 - DNA, 20 bp, Artificial Sequence
  Description of Artificial Sequence: Synthetic oligonucleotide
  Target: ATXN1; (+) strand; PAM type: NRG; PAM sequence: CAG
atgactgcaccactgcactc

SEQ ID NO: 137292 - DNA, 20 bp, Artificial Sequence
  Description of Artificial Sequence: Synthetic oligonucleotide
  Target: ATXN1; (+) strand; PAM type: NRG; PAM sequence: TGG
tgcaccactgcactccagcc

SEQ ID NO: 137293 - DNA, 20 bp, Artificial Sequence
  Description of Artificial Sequence: Synthetic oligonucleotide
  Target: ATXN1; (+) strand; PAM type: NRG; PAM sequence: GGG
gcaccactgcactccagcct

SEQ ID NO: 137294 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggcaa

SEQ ID NO: 137295 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggcaaca

SEQ ID NO: 137296 - DNA, 20 bp, Artificial Sequence
  Description of Artificial Sequence: Synthetic oligonucleotide
  Target: ATXN1; (+) strand; PAM type: NRG; PAM sequence: AAG
tccagcctgggcaacagagc

SEQ ID NO: 137297 - DNA, 20 bp, Artificial Sequence
  Description of Artificial Sequence: Synthetic oligonucleotide
  Target: ATXN1; (+) strand; PAM type: NRG; PAM sequence: TAG
ataaaataaaataatataaa

SEQ ID NO: 137298 - DNA, 20 bp, Artificial Sequence
  Description of Artificial Sequence: Synthetic oligonucleotide
  Target: ATXN1; (+) strand; PAM type: NRG; PAM sequence: TAG
aatagaaatgacaaattttc

SEQ ID NO: 137299 - DNA, 20 bp, Artificial Sequence
  Description of Artificial Sequence: Synthetic oligonucleotide
  Target: ATXN1; (+) strand; PAM type: NRG; PAM sequence: AAG
aaatgctttaatattaattt

SEQ ID NO: 137300 - DNA, 20 bp, Artificial Sequence
  Description of Artificial Sequence: Synthetic oligonucleotide
  Target: ATXN1; (+) strand; PAM type: NRG; PAM sequence: AAG
tgctttaatattaatttaag

SEQ ID NO: 137301 - DNA, 20 bp, Artificial Sequence
  Description of Artificial Sequence: Synthetic oligonucleotide
  Target: ATXN1; (+) strand; PAM type: NRG; PAM sequence: TAG
cctgatcaaaaaaattatta

SEQ ID NO: 137302 - DNA, 20 bp, Artificial Sequence
  Description of Artificial Sequence: Synthetic oligonucleotide
  Target: ATXN1; (+) strand; PAM type: NRG; PAM sequence: TAG
aattattatagacaaacttt

SEQ ID NO: 137303 - DNA, 20 bp, Artificial Sequence
  Description of Artificial Sequence: Synthetic oligonucleotide
  Target: ATXN1; (+) strand; PAM type: NRG; PAM sequence: AGG
attattatagacaaactttt

SEQ ID NO: 137304 - DNA, 20 bp, Artificial Sequence
  Description of Artificial Sequence: Synthetic oligonucleotide
  Target: ATXN1; (+) strand; PAM type: NRG; PAM sequence: GGG
ttattatagacaaactttta

SEQ ID NO: 137305 - DNA, 20 bp, Artificial Sequence
  Description of Artificial Sequence: Synthetic oligonucleotide
  Target: ATXN1; (+) strand; PAM type: NRG; PAM sequence: GGG
tattatagacaaacttttag

SEQ ID NO: 137306 - DNA, 20 bp, Artificial Sequence
  Description of Artificial Sequence: Synthetic oligonucleotide
  Target: ATXN1; (+) strand; PAM type: NRG; PAM sequence: TGG
tatagacaaacttttagggg

SEQ ID NO: 137307 - DNA, 20 bp, Artificial Sequence
  Description of Artificial Sequence: Synthetic oligonucleotide
  Target: ATXN1; (+) strand; PAM type: NRG; PAM sequence: GGG
atagacaaacttttaggggt

SEQ ID NO: 137308 - DNA, 20 bp, Artificial Sequence
  Description of Artificial Sequence: Synthetic oligonucleotide
  Target: ATXN1; (+) strand; PAM type: NRG; PAM sequence: GGG
tagacaaacttttaggggtg

SEQ ID NO: 137309 - DNA, 20 bp, Artificial Sequence
  Description of Artificial Sequence: Synthetic oligonucleotide
  Target: ATXN1; (+) strand; PAM type: NRG; PAM sequence: GAG
gacaaacttttaggggtggg

SEQ ID NO: 137310 - DNA, 20 bp, Artificial Sequence
  Description of Artificial Sequence: Synthetic oligonucleotide
  Target: ATXN1; (+) strand; PAM type: NRG; PAM sequence: AGG
acaaacttttaggggtgggg

SEQ ID NO: 137311 - DNA, 20 bp, Artificial Sequence
  Description of Artificial Sequence: Synthetic oligonucleotide
  Target: ATXN1; (+) strand; PAM type: NRG; PAM sequence: TGG
tgacataattctaataactt

SEQ ID NO: 137312 - DNA, 20 bp, Artificial Sequence
  Description of Artificial Sequence: Synthetic oligonucleotide
  Target: ATXN1; (+) strand; PAM type: NRG; PAM sequence: GGG
gacataattctaataacttt

SEQ ID NO: 137313 - DNA, 20 bp, Artificial Sequence
  Description of Artificial Sequence: Synthetic oligonucleotide
  Target: ATXN1; (+) strand; PAM type: NRG; PAM sequence: GGG
acataattctaataactttg

SEQ ID NO: 137314 - DNA, 20 bp, Artificial Sequence
  Description of Artificial Sequence: Synthetic oligonucleotide
  Target: ATXN1; (+) strand; PAM type: NRG; PAM sequence: CAG
aattctaataactttgggga

SEQ ID NO: 137315 - DNA, 20 bp, Artificial Sequence
  Description of Artificial Sequence: Synthetic oligonucleotide
  Target: ATXN1; (+) strand; PAM type: NRG; PAM sequence: AGG
attctaataactttggggac

SEQ ID NO: 137316 - DNA, 20 bp, Artificial Sequence
  Description of Artificial Sequence: Synthetic oligonucleotide
  Target: ATXN1; (+) strand; PAM type: NRG; PAM sequence: AAG
tttggggacaggtaatttca

SEQ ID NO: 137317 - DNA, 20 bp, Artificial Sequence
  Description of Artificial Sequence: Synthetic oligonucleotide
  Target: ATXN1; (+) strand; PAM type: NRG; PAM sequence: CAG
acaggtaatttcaaagcttc

SEQ ID NO: 137318 - DNA, 20 bp, Artificial Sequence
  Description of Artificial Sequence: Synthetic oligonucleotide
  Target: ATXN1; (+) strand; PAM type: NRG; PAM sequence: AGG
caggtaatttcaaagcttcc

SEQ ID NO: 137319 - DNA, 20 bp, Artificial Sequence
  Description of Artificial Sequence: Synthetic oligonucleotide
  Target: ATXN1; (+) strand; PAM type: NRG; PAM sequence: TGG
ggatgctacatgtgccttaa

SEQ ID NO: 137320 - DNA, 20 bp, Artificial Sequence
  Description of Artificial Sequence: Synthetic oligonucleotide
  Target: ATXN1; (+) strand; PAM type: NRG; PAM sequence: GGG
gatgctacatgtgccttaat

SEQ ID NO: 137321 - DNA, 20 bp, Artificial Sequence
  Description of Artificial Sequence: Synthetic oligonucleotide
  Target: ATXN1; (+) strand; PAM type: NRG; PAM sequence: GGG
atgctacatgtgccttaatg

SEQ ID NO: 137322 - DNA, 20 bp, Artificial Sequence
  Description of Artificial Sequence: Synthetic oligonucleotide
  Target: ATXN1; (+) strand; PAM type: NRG; PAM sequence: GGG
tgctacatgtgccttaatgg

SEQ ID NO: 137323 - DNA, 20 bp, Artificial Sequence
  Description of Artificial Sequence: Synthetic oligonucleotide
  Target: ATXN1; (+) strand; PAM type: NRG; PAM sequence: AAG
catgtgccttaatgggggca

SEQ ID NO: 137324 - DNA, 20 bp, Artificial Sequence
  Description of Artificial Sequence: Synthetic oligonucleotide
  Target: ATXN1; (+) strand; PAM type: NRG; PAM sequence: AGG
atgtgccttaatgggggcaa

SEQ ID NO: 137325 - DNA, 20 bp, Artificial Sequence
  Description of Artificial Sequence: Synthetic oligonucleotide
  Target: ATXN1; (+) strand; PAM type: NRG; PAM sequence: GAG
ctctcacttttcttctcctt

SEQ ID NO: 137326 - DNA, 20 bp, Artificial Sequence
  Description of Artificial Sequence: Synthetic oligonucleotide
  Target: ATXN1; (+) strand; PAM type: NRG; PAM sequence: AGG
tctcacttttcttctccttg

SEQ ID NO: 137327 - DNA, 20 bp, Artificial Sequence
  Description of Artificial Sequence: Synthetic oligonucleotide
  Target: ATXN1; (+) strand; PAM type: NRG; PAM sequence: CAG
ttcttctccttgaggcaact

SEQ ID NO: 137328 - DNA, 20 bp, Artificial Sequence
  Description of Artificial Sequence: Synthetic oligonucleotide
  Target: ATXN1; (+) strand; PAM type: NRG; PAM sequence: GAG
cttctccttgaggcaactca

SEQ ID NO: 137329 - DNA, 20 bp, Artificial Sequence
  Description of Artificial Sequence: Synthetic oligonucleotide
  Target: ATXN1; (+) strand; PAM type: NRG; PAM sequence: AGG
ttctccttgaggcaactcag

SEQ ID NO: 137330 - DNA, 20 bp, Artificial Sequence
  Description of Artificial Sequence: Synthetic oligonucleotide
  Target: ATXN1; (+) strand; PAM type: NRG; PAM sequence: GAG
ctccttgaggcaactcagag

SEQ ID NO: 137331 - DNA, 20 bp, Artificial Sequence
  Description of Artificial Sequence: Synthetic oligonucleotide
  Target: ATXN1; (+) strand; PAM type: NRG; PAM sequence: TGG
gcaactcagaggagcgattg

SEQ ID NO: 137332 - DNA, 20 bp, Artificial Sequence
  Description of Artificial Sequence: Synthetic oligonucleotide
  Target: ATXN1; (+) strand; PAM type: NRG; PAM sequence: AAG
agcgattgtggaaatttccg

SEQ ID NO: 137333 - DNA, 20 bp, Artificial Sequence
  Description of Artificial Sequence: Synthetic oligonucleotide
  Target: ATXN1; (+) strand; PAM type: NRG; PAM sequence: CAG
tttccgaagctgctatatgt

SEQ ID NO: 137334 - DNA, 20 bp, Artificial Sequence
  Description of Artificial Sequence: Synthetic oligonucleotide
  Target: ATXN1; (+) strand; PAM type: NRG; PAM sequence: TGG
tgtcagcttgcccatttgta

SEQ ID NO: 137335 - DNA, 20 bp, Artificial Sequence
  Description of Artificial Sequence: Synthetic oligonucleotide
  Target: ATXN1; (+) strand; PAM type: NRG; PAM sequence: TGG
cccatttgtatggaatttca

SEQ ID NO: 137336 - DNA, 20 bp, Artificial Sequence
  Description of Artificial Sequence: Synthetic oligonucleotide
  Target: ATXN1; (+) strand; PAM type: NRG; PAM sequence: AAG
aatttcatggtttttttgac

SEQ ID NO: 137337 - DNA, 20 bp, Artificial Sequence
  Description of Artificial Sequence: Synthetic oligonucleotide
  Target: ATXN1; (+) strand; PAM type: NRG; PAM sequence: CAG
tcatggtttttttgacaagt

SEQ ID NO: 137338 - DNA, 20 bp, Artificial Sequence
  Description of Artificial Sequence: Synthetic oligonucleotide
  Target: ATXN1; (+) strand; PAM type: NRG; PAM sequence: GAG
ttttgtcatcatcgcatctt

SEQ ID NO: 137339 - DNA, 20 bp, Artificial Sequence
  Description of Artificial Sequence: Synthetic oligonucleotide
  Target: ATXN1; (+) strand; PAM type: NRG; PAM sequence: GAG
ttgtcatcatcgcatcttga

SEQ ID NO: 137340 - DNA, 20 bp, Artificial Sequence
  Description of Artificial Sequence: Synthetic oligonucleotide
  Target: ATXN1; (+) strand; PAM type: NRG; PAM sequence: TAG
tcatcatcgcatcttgagag

SEQ ID NO: 137341 - DNA, 20 bp, Artificial Sequence
  Description of Artificial Sequence: Synthetic oligonucleotide
  Target: ATXN1; (+) strand; PAM type: NRG; PAM sequence: GAG
atcatcgcatcttgagagta

SEQ ID NO: 137342 - DNA, 20 bp, Artificial Sequence
  Description of Artificial Sequence: Synthetic oligonucleotide
  Target: ATXN1; (+) strand; PAM type: NRG; PAM sequence: GAG
catcgcatcttgagagtaga

SEQ ID NO: 137343 - DNA, 20 bp, Artificial Sequence
  Description of Artificial Sequence: Synthetic oligonucleotide
  Target: ATXN1; (+) strand; PAM type: NRG; PAM sequence: AGG
atcgcatcttgagagtagag

SEQ ID NO: 137344 - DNA, 20 bp, Artificial Sequence
  Description of Artificial Sequence: Synthetic oligonucleotide
  Target: ATXN1; (+) strand; PAM type: NRG; PAM sequence: AAG
gcatcttgagagtagagagg

SEQ ID NO: 137345 - DNA, 20 bp, Artificial Sequence
  Description of Artificial Sequence: Synthetic oligonucleotide
  Target: ATXN1; (+) strand; PAM type: NRG; PAM sequence: AGG
catcttgagagtagagagga

SEQ ID NO: 137346 - DNA, 20 bp, Artificial Sequence
  Description of Artificial Sequence: Synthetic oligonucleotide
  Target: ATXN1; (+) strand; PAM type: NRG; PAM sequence: GGG
atcttgagagtagagaggaa

SEQ ID NO: 137347 - DNA, 20 bp, Artificial Sequence
  Description of Artificial Sequence: Synthetic oligonucleotide
  Target: ATXN1; (+) strand; PAM type: NRG; PAM sequence: TGG
gagagtagagaggaagggaa

SEQ ID NO: 137348 - DNA, 20 bp, Artificial Sequence
  Description of Artificial Sequence: Synthetic oligonucleotide
  Target: ATXN1; (+) strand; PAM type: NRG; PAM sequence: AAG
agtagagaggaagggaatgg

SEQ ID NO: 137349 - DNA, 20 bp, Artificial Sequence
  Description of Artificial Sequence: Synthetic oligonucleotide
  Target: ATXN1; (+) strand; PAM type: NRG; PAM sequence: AGG
gtagagaggaagggaatgga

SEQ ID NO: 137350 - DNA, 20 bp, Artificial Sequence
  Description of Artificial Sequence: Synthetic oligonucleotide
  Target: ATXN1; (+) strand; PAM type: NRG; PAM sequence: GGG
tagagaggaagggaatggaa

SEQ ID NO: 137351 - DNA, 20 bp, Artificial Sequence
  Description of Artificial Sequence: Synthetic oligonucleotide
  Target: ATXN1; (+) strand; PAM type: NRG; PAM sequence: GAG
gagaggaagggaatggaagg

SEQ ID NO: 137352 - DNA, 20 bp, Artificial Sequence
  Description of Artificial Sequence: Synthetic oligonucleotide
  Target: ATXN1; (+) strand; PAM type: NRG; PAM sequence: CAG
gaagggagaactgttactat

SEQ ID NO: 137353 - DNA, 20 bp, Artificial Sequence
  Description of Artificial Sequence: Synthetic oligonucleotide
  Target: ATXN1; (+) strand; PAM type: NRG; PAM sequence: GAG
agggagaactgttactatca

SEQ ID NO: 137354 - DNA, 20 bp, Artificial Sequence
  Description of Artificial Sequence: Synthetic oligonucleotide
  Target: ATXN1; (+) strand; PAM type: NRG; PAM sequence: AGG
gggagaactgttactatcag

SEQ ID NO: 137355 - DNA, 20 bp, Artificial Sequence
  Description of Artificial Sequence: Synthetic oligonucleotide
  Target: ATXN1; (+) strand; PAM type: NRG; PAM sequence: TGG
ctgttactatcagaggcttc

SEQ ID NO: 137356 - DNA, 20 bp, Artificial Sequence
  Description of Artificial Sequence: Synthetic oligonucleotide
  Target: ATXN1; (+) strand; PAM type: NRG; PAM sequence: TGG
ttctggaaatccccgcttga

SEQ ID NO: 137357 - DNA, 20 bp, Artificial Sequence
  Description of Artificial Sequence: Synthetic oligonucleotide
  Target: ATXN1; (+) strand; PAM type: NRG; PAM sequence: AAG
atggtacatgactctttctt

SEQ ID NO: 137358 - DNA, 20 bp, Artificial Sequence
  Description of Artificial Sequence: Synthetic oligonucleotide
  Target: ATXN1; (+) strand; PAM type: NRG; PAM sequence: TGG
acatgactctttcttaagaa

SEQ ID NO: 137359 - DNA, 20 bp, Artificial Sequence
  Description of Artificial Sequence: Synthetic oligonucleotide
  Target: ATXN1; (+) strand; PAM type: NRG; PAM sequence: TGG
ttaagaatggttctctttta

SEQ ID NO: 137360 - DNA, 20 bp, Artificial Sequence
  Description of Artificial Sequence: Synthetic oligonucleotide
  Target: ATXN1; (+) strand; PAM type: NRG; PAM sequence: GGG
taagaatggttctcttttat

SEQ ID NO: 137361 - DNA, 20 bp, Artificial Sequence
  Description of Artificial Sequence: Synthetic oligonucleotide
  Target: ATXN1; (+) strand; PAM type: NRG; PAM sequence: TGG
tcttttatgggttgccattt

SEQ ID NO: 137362 - DNA, 20 bp, Artificial Sequence
  Description of Artificial Sequence: Synthetic oligonucleotide
  Target: ATXN1; (+) strand; PAM type: NRG; PAM sequence: TGG
gttgccattttggtgacaat

SEQ ID NO: 137363 - DNA, 20 bp, Artificial Sequence
  Description of Artificial Sequence: Synthetic oligonucleotide
  Target: ATXN1; (+) strand; PAM type: NRG; PAM sequence: CAG
ttggtgacaattggtgcact

SEQ ID NO: 137364 - DNA, 20 bp, Artificial Sequence
  Description of Artificial Sequence: Synthetic oligonucleotide
  Target: ATXN1; (+) strand; PAM type: NRG; PAM sequence: TGG
gtgcactcagctctacctct

SEQ ID NO: 137365 - DNA, 20 bp, Artificial Sequence
  Description of Artificial Sequence: Synthetic oligonucleotide
  Target: ATXN1; (+) strand; PAM type: NRG; PAM sequence: TGG
cactcagctctacctcttgg

SEQ ID NO: 137366 - DNA, 20 bp, Artificial Sequence
  Description of Artificial Sequence: Synthetic oligonucleotide
  Target: ATXN1; (+) strand; PAM type: NRG; PAM sequence: GGG
actcagctctacctcttggt

SEQ ID NO: 137367 - DNA, 20 bp, Artificial Sequence
  Description of Artificial Sequence: Synthetic oligonucleotide
  Target: ATXN1; (+) strand; PAM type: NRG; PAM sequence: CAG
ctctacctcttggtgggccc

SEQ ID NO: 137368 - DNA, 20 bp, Artificial Sequence
  Description of Artificial Sequence: Synthetic oligonucleotide
  Target: ATXN1; (+) strand; PAM type: NRG; PAM sequence: CAG
tggtgggccccagtgtactt

SEQ ID NO: 137369 - DNA, 20 bp, Artificial Sequence
  Description of Artificial Sequence: Synthetic oligonucleotide
  Target: ATXN1; (+) strand; PAM type: NRG; PAM sequence: CAG
agtgtacttcagcatgatct

SEQ ID NO: 137370 - DNA, 20 bp, Artificial Sequence
  Description of Artificial Sequence: Synthetic oligonucleotide
  Target: ATXN1; (+) strand; PAM type: NRG; PAM sequence: CAG
tcagttctttctttctctac

SEQ ID NO: 137371 - DNA, 20 bp, Artificial Sequence
  Description of Artificial Sequence: Synthetic oligonucleotide
  Target: ATXN1; (+) strand; PAM type: NRG; PAM sequence: CAG
tacatacatcctgaaaatca

SEQ ID NO: 137372 - DNA, 20 bp, Artificial Sequence
  Description of Artificial Sequence: Synthetic oligonucleotide
  Target: ATXN1; (+) strand; PAM type: NRG; PAM sequence: TAG
atcacagcatcaccattcaa

SEQ ID NO: 137373 - DNA, 20 bp, Artificial Sequence
  Description of Artificial Sequence: Synthetic oligonucleotide
  Target: ATXN1; (+) strand; PAM type: NRG; PAM sequence: AAG
gacaaaaattatcattatca

SEQ ID NO: 137374 - DNA, 20 bp, Artificial Sequence
  Description of Artificial Sequence: Synthetic oligonucleotide
  Target: ATXN1; (+) strand; PAM type: NRG; PAM sequence: CGG
aaaaattatcattatcaaag

SEQ ID NO: 137375 - DNA, 20 bp, Artificial Sequence
  Description of Artificial Sequence: Synthetic oligonucleotide
  Target: ATXN1; (+) strand; PAM type: NRG; PAM sequence: AAG
tcattatcaaagcggccaaa

SEQ ID NO: 137376 - DNA, 20 bp, Artificial Sequence
  Description of Artificial Sequence: Synthetic oligonucleotide
  Target: ATXN1; (+) strand; PAM type: NRG; PAM sequence: AGG
cattatcaaagcggccaaaa

SEQ ID NO: 137377 - DNA, 20 bp, Artificial Sequence
  Description of Artificial Sequence: Synthetic oligonucleotide
  Target: ATXN1; (+) strand; PAM type: NRG; PAM sequence: TGG
gttttctcttaaatattctg

SEQ ID NO: 137378 - DNA, 20 bp, Artificial Sequence
  Description of Artificial Sequence: Synthetic oligonucleotide
  Target: ATXN1; (+) strand; PAM type: NRG; PAM sequence: GGG
ttttctcttaaatattctgt

SEQ ID NO: 137379 - DNA, 20 bp, Artificial Sequence
  Description of Artificial Sequence: Synthetic oligonucleotide
  Target: ATXN1; (+) strand; PAM type: NRG; PAM sequence: AAG
ctcttaaatattctgtggga

SEQ ID NO: 137380 - DNA, 20 bp, Artificial Sequence
  Description of Artificial Sequence: Synthetic oligonucleotide
  Target: ATXN1; (+) strand; PAM type: NRG; PAM sequence: GAG
cttaaatattctgtgggaaa

SEQ ID NO: 137381 - DNA, 20 bp, Artificial Sequence
  Description of Artificial Sequence: Synthetic oligonucleotide
  Target: ATXN1; (+) strand; PAM type: NRG; PAM sequence: AGG
ttaaatattctgtgggaaag

SEQ ID NO: 137382 - DNA, 20 bp, Artificial Sequence
  Description of Artificial Sequence: Synthetic oligonucleotide
  Target: ATXN1; (+) strand; PAM type: NRG; PAM sequence: GGG
taaatattctgtgggaaaga

SEQ ID NO: 137383 - DNA, 20 bp, Artificial Sequence
  Description of Artificial Sequence: Synthetic oligonucleotide
  Target: ATXN1; (+) strand; PAM type: NRG; PAM sequence: TAG
tgggaaagagggttgaaaat

SEQ ID NO: 137384 - DNA, 20 bp, Artificial Sequence
  Description of Artificial Sequence: Synthetic oligonucleotide
  Target: ATXN1; (+) strand; PAM type: NRG; PAM sequence: TAG
aagagggttgaaaattagaa

SEQ ID NO: 137385 - DNA, 20 bp, Artificial Sequence
  Description of Artificial Sequence: Synthetic oligonucleotide
  Target: ATXN1; (+) strand; PAM type: NRG; PAM sequence: CAG
agaatactatgtatttgcca

SEQ ID NO: 137386 - DNA, 20 bp, Artificial Sequence
  Description of Artificial Sequence: Synthetic oligonucleotide
  Target: ATXN1; (+) strand; PAM type: NRG; PAM sequence: AAG
ctatgtatttgccacagtaa

SEQ ID NO: 137387 - DNA, 20 bp, Artificial Sequence
  Description of Artificial Sequence: Synthetic oligonucleotide
  Target: ATXN1; (+) strand; PAM type: NRG; PAM sequence: CAG
aaaagatatctaccacaaac

SEQ ID NO: 137388 - DNA, 20 bp, Artificial Sequence
  Description of Artificial Sequence: Synthetic oligonucleotide
  Target: ATXN1; (+) strand; PAM type: NRG; PAM sequence: TAG
agatatctaccacaaaccag

SEQ ID NO: 137389 - DNA, 20 bp, Artificial Sequence
  Description of Artificial Sequence: Synthetic oligonucleotide
  Target: ATXN1; (+) strand; PAM type: NRG; PAM sequence: AAG
agtagccaatattatattaa

SEQ ID NO: 137390 - DNA, 20 bp, Artificial Sequence
  Description of Artificial Sequence: Synthetic oligonucleotide
  Target: ATXN1; (+) strand; PAM type: NRG; PAM sequence: AAG
ttatattaaaagttaaaaac

SEQ ID NO: 137391 - DNA, 20 bp, Artificial Sequence
  Description of Artificial Sequence: Synthetic oligonucleotide
  Target: ATXN1; (+) strand; PAM type: NRG; PAM sequence: GAG
atattaaaagttaaaaacaa

SEQ ID NO: 137392 - DNA, 20 bp, Artificial Sequence
  Description of Artificial Sequence: Synthetic oligonucleotide
  Target: ATXN1; (+) strand; PAM type: NRG; PAM sequence: CAG
caagagtcaatgattaaatt

SEQ ID NO: 137393 - DNA, 20 bp, Artificial Sequence
  Description of Artificial Sequence: Synthetic oligonucleotide
  Target: ATXN1; (+) strand; PAM type: NRG; PAM sequence: AGG
aagagtcaatgattaaattc

SEQ ID NO: 137394 - DNA, 20 bp, Artificial Sequence
  Description of Artificial Sequence: Synthetic oligonucleotide
  Target: ATXN1; (+) strand; PAM type: NRG; PAM sequence: CGG
gattaaattcaggccacatg

SEQ ID NO: 137395 - DNA, 20 bp, Artificial Sequence
  Description of Artificial Sequence: Synthetic oligonucleotide
  Target: ATXN1; (+) strand; PAM type: NRG; PAM sequence: TGG
taaattcaggccacatgcgg

SEQ ID NO: 137396 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgtaaccc

SEQ ID NO: 137397 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaaccccagcactt

SEQ ID NO: 137398 - DNA, 20 bp, Artificial Sequence
  Description of Artificial Sequence: Synthetic oligonucleotide
  Target: ATXN1; (+) strand; PAM type: NRG; PAM sequence: GGG
gcctgtaaccccagcacttt

SEQ ID NO: 137399 - DNA, 20 bp, Artificial Sequence
  Description of Artificial Sequence: Synthetic oligonucleotide
  Target: ATXN1; (+) strand; PAM type: NRG; PAM sequence: GAG
ctgtaaccccagcactttgg

SEQ ID NO: 137400 - DNA, 20 bp, Artificial Sequence
  Description of Artificial Sequence: Synthetic oligonucleotide
  Target: ATXN1; (+) strand; PAM type: NRG; PAM sequence: AGG
tgtaaccccagcactttggg

SEQ ID NO: 137401 - DNA, 20 bp, Artificial Sequence
  Description of Artificial Sequence: Synthetic oligonucleotide
  Target: ATXN1; (+) strand; PAM type: NRG; PAM sequence: AAG
cccagcactttgggaggctg

SEQ ID NO: 137402 - DNA, 20 bp, Artificial Sequence
  Description of Artificial Sequence: Synthetic oligonucleotide
  Target: ATXN1; (+) strand; PAM type: NRG; PAM sequence: CGG
agcactttgggaggctgaag

SEQ ID NO: 137403 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggctgaagc

SEQ ID NO: 137404 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggctgaagcggg

SEQ ID NO: 137405 - DNA, 20 bp, Artificial Sequence
  Description of Artificial Sequence: Synthetic oligonucleotide
  Target: ATXN1; (+) strand; PAM type: NRG; PAM sequence: GAG
ctgaagcgggtggatcactt

SEQ ID NO: 137406 - DNA, 20 bp, Artificial Sequence
  Description of Artificial Sequence: Synthetic oligonucleotide
  Target: ATXN1; (+) strand; PAM type: NRG; PAM sequence: AGG
tgaagcgggtggatcacttg

SEQ ID NO: 137407 - DNA, 20 bp, Artificial Sequence
  Description of Artificial Sequence: Synthetic oligonucleotide
  Target: ATXN1; (+) strand; PAM type: NRG; PAM sequence: CAG
gcgggtggatcacttgaggt

SEQ ID NO: 137408 - DNA, 20 bp, Artificial Sequence
  Description of Artificial Sequence: Synthetic oligonucleotide
  Target: ATXN1; (+) strand; PAM type: NRG; PAM sequence: AGG
cgggtggatcacttgaggtc

SEQ ID NO: 137409 - DNA, 20 bp, Artificial Sequence
  Description of Artificial Sequence: Synthetic oligonucleotide
  Target: ATXN1; (+) strand; PAM type: NRG; PAM sequence: GAG
ggtggatcacttgaggtcag

SEQ ID NO: 137410 - DNA, 20 bp, Artificial Sequence
  Description of Artificial Sequence: Synthetic oligonucleotide
  Target: ATXN1; (+) strand; PAM type: NRG; PAM sequence: GAG
tcacttgaggtcaggagttt

SEQ ID NO: 137411 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagtttgagac

SEQ ID NO: 137412 - DNA, 20 bp, Artificial Sequence
  Description of Artificial Sequence: Synthetic oligonucleotide
  Target: ATXN1; (+) strand; PAM type: NRG; PAM sequence: TGG
tcaggagtttgagaccagcc

SEQ ID NO: 137413 - DNA, 20 bp, Artificial Sequence
  Description of Artificial Sequence: Synthetic oligonucleotide
  Target: ATXN1; (+) strand; PAM type: NRG; PAM sequence: TGG
tgagaccagcctggcgaaca

SEQ ID NO: 137414 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 137415 - DNA, 20 bp, Artificial Sequence
  Description of Artificial Sequence: Synthetic oligonucleotide
  Target: ATXN1; (+) strand; PAM type: NRG; PAM sequence: CAG
ctaaaaatacaaaaattagc

SEQ ID NO: 137416 - DNA, 20 bp, Artificial Sequence
  Description of Artificial Sequence: Synthetic oligonucleotide
  Target: ATXN1; (+) strand; PAM type: NRG; PAM sequence: AGG
taaaaatacaaaaattagcc

SEQ ID NO: 137417 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagccaggcg

SEQ ID NO: 137418 - DNA, 20 bp, Artificial Sequence
  Description of Artificial Sequence: Synthetic oligonucleotide
  Target: ATXN1; (+) strand; PAM type: NRG; PAM sequence: CAG
gtgttgcatgcctgtaatcc

SEQ ID NO: 137419 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagatact

SEQ ID NO: 137420 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagatactt

SEQ ID NO: 137421 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagatacttgg

SEQ ID NO: 137422 - DNA, 20 bp, Artificial Sequence
  Description of Artificial Sequence: Synthetic oligonucleotide
  Target: ATXN1; (+) strand; PAM type: NRG; PAM sequence: GAG
tcccagatacttgggagtct

SEQ ID NO: 137423 - DNA, 20 bp, Artificial Sequence
  Description of Artificial Sequence: Synthetic oligonucleotide
  Target: ATXN1; (+) strand; PAM type: NRG; PAM sequence: AGG
cccagatacttgggagtctg

SEQ ID NO: 137424 - DNA, 20 bp, Artificial Sequence
  Description of Artificial Sequence: Synthetic oligonucleotide
  Target: ATXN1; (+) strand; PAM type: NRG; PAM sequence: CGG
gatacttgggagtctgaggc

SEQ ID NO: 137425 - DNA, 20 bp, Artificial Sequence
  Description of Artificial Sequence: Synthetic oligonucleotide
  Target: ATXN1; (+) strand; PAM type: NRG; PAM sequence: GAG
tacttgggagtctgaggccg

SEQ ID NO: 137426 - DNA, 20 bp, Artificial Sequence
  Description of Artificial Sequence: Synthetic oligonucleotide
  Target: ATXN1; (+) strand; PAM type: NRG; PAM sequence: GAG
ctgaggccggagaatcactt

SEQ ID NO: 137427 - DNA, 20 bp, Artificial Sequence
  Description of Artificial Sequence: Synthetic oligonucleotide
  Target: ATXN1; (+) strand; PAM type: NRG; PAM sequence: TGG
gccggagaatcacttgagcc

SEQ ID NO: 137428 - DNA, 20 bp, Artificial Sequence
  Description of Artificial Sequence: Synthetic oligonucleotide
  Target: ATXN1; (+) strand; PAM type: NRG; PAM sequence: GGG
ccggagaatcacttgagcct

SEQ ID NO: 137429 - DNA, 20 bp, Artificial Sequence
  Description of Artificial Sequence: Synthetic oligonucleotide
  Target: ATXN1; (+) strand; PAM type: NRG; PAM sequence: GAG
ggagaatcacttgagcctgg

SEQ ID NO: 137430 - DNA, 20 bp, Artificial Sequence
  Description of Artificial Sequence: Synthetic oligonucleotide
  Target: ATXN1; (+) strand; PAM type: NRG; PAM sequence: AGG
gagaatcacttgagcctggg

SEQ ID NO: 137431 - DNA, 20 bp, Artificial Sequence
  Description of Artificial Sequence: Synthetic oligonucleotide
  Target: ATXN1; (+) strand; PAM type: NRG; PAM sequence: CAG
aatcacttgagcctgggagg

SEQ ID NO: 137432 - DNA, 20 bp, Artificial Sequence
  Description of Artificial Sequence: Synthetic oligonucleotide
  Target: ATXN1; (+) strand; PAM type: NRG; PAM sequence: GAG
tcacttgagcctgggaggca

SEQ ID NO: 137433 - DNA, 20 bp, Artificial Sequence
  Description of Artificial Sequence: Synthetic oligonucleotide
  Target: ATXN1; (+) strand; PAM type: NRG; PAM sequence: AGG
cacttgagcctgggaggcag

SEQ ID NO: 137434 - DNA, 20 bp, Artificial Sequence
  Description of Artificial Sequence: Synthetic oligonucleotide
  Target: ATXN1; (+) strand; PAM type: NRG; PAM sequence: GAG
tgggaggcagaggttgcaat

SEQ ID NO: 137435 - DNA, 20 bp, Artificial Sequence
  Description of Artificial Sequence: Synthetic oligonucleotide
  Target: ATXN1; (+) strand; PAM type: NRG; PAM sequence: AAG
ggcagaggttgcaatgagcc

SEQ ID NO: 137436 - DNA, 20 bp, Artificial Sequence
  Description of Artificial Sequence: Synthetic oligonucleotide
  Target: ATXN1; (+) strand; PAM type: NRG; PAM sequence: CAG
gatcgtgtgccactgcactc

SEQ ID NO: 137437 - DNA, 20 bp, Artificial Sequence
  Description of Artificial Sequence: Synthetic oligonucleotide
  Target: ATXN1; (+) strand; PAM type: NRG; PAM sequence: TGG
tgtgccactgcactccagcc

SEQ ID NO: 137438 - DNA, 20 bp, Artificial Sequence
  Description of Artificial Sequence: Synthetic oligonucleotide
  Target: ATXN1; (+) strand; PAM type: NRG; PAM sequence: GGG
gtgccactgcactccagcct

SEQ ID NO: 137439 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggcaa

SEQ ID NO: 137440 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggcaaca

SEQ ID NO: 137441 - DNA, 20 bp, Artificial Sequence
  Description of Artificial Sequence: Synthetic oligonucleotide
  Target: ATXN1; (+) strand; PAM type: NRG; PAM sequence: AAG
tccagcctgggcaacagagc

SEQ ID NO: 137442 - DNA, 20 bp, Artificial Sequence
  Description of Artificial Sequence: Synthetic oligonucleotide
  Target: ATXN1; (+) strand; PAM type: NRG; PAM sequence: TAG
aatacaaatgacaaattttc

SEQ ID NO: 137443 - DNA, 20 bp, Artificial Sequence
  Description of Artificial Sequence: Synthetic oligonucleotide
  Target: ATXN1; (+) strand; PAM type: NRG; PAM sequence: AAG
aaatgctttaatattaattt

SEQ ID NO: 137444 - DNA, 20 bp, Artificial Sequence
  Description of Artificial Sequence: Synthetic oligonucleotide
  Target: ATXN1; (+) strand; PAM type: NRG; PAM sequence: AAG
tgctttaatattaatttaag

SEQ ID NO: 137445 - DNA, 20 bp, Artificial Sequence
  Description of Artificial Sequence: Synthetic oligonucleotide
  Target: ATXN1; (+) strand; PAM type: NRG; PAM sequence: TAG
cctgatcaaaaaaattatta

SEQ ID NO: 137446 - DNA, 20 bp, Artificial Sequence
  Description of Artificial Sequence: Synthetic oligonucleotide
  Target: ATXN1; (+) strand; PAM type: NRG; PAM sequence: TAG
aattattatagacaaacttt

SEQ ID NO: 137447 - DNA, 20 bp, Artificial Sequence
  Description of Artificial Sequence: Synthetic oligonucleotide
  Target: ATXN1; (+) strand; PAM type: NRG; PAM sequence: AGG
attattatagacaaactttt

SEQ ID NO: 137448 - DNA, 20 bp, Artificial Sequence
  Description of Artificial Sequence: Synthetic oligonucleotide
  Target: ATXN1; (+) strand; PAM type: NRG; PAM sequence: GGG
ttattatagacaaactttta

SEQ ID NO: 137449 - DNA, 20 bp, Artificial Sequence
  Description of Artificial Sequence: Synthetic oligonucleotide
  Target: ATXN1; (+) strand; PAM type: NRG; PAM sequence: GGG
tattatagacaaacttttag

SEQ ID NO: 137450 - DNA, 20 bp, Artificial Sequence
  Description of Artificial Sequence: Synthetic oligonucleotide
  Target: ATXN1; (+) strand; PAM type: NRG; PAM sequence: TGG
tatagacaaacttttagggg

SEQ ID NO: 137451 - DNA, 20 bp, Artificial Sequence
  Description of Artificial Sequence: Synthetic oligonucleotide
  Target: ATXN1; (+) strand; PAM type: NRG; PAM sequence: GGG
atagacaaacttttaggggt

SEQ ID NO: 137452 - DNA, 20 bp, Artificial Sequence
  Description of Artificial Sequence: Synthetic oligonucleotide
  Target: ATXN1; (+) strand; PAM type: NRG; PAM sequence: GGG
tagacaaacttttaggggtg

SEQ ID NO: 137453 - DNA, 20 bp, Artificial Sequence
  Description of Artificial Sequence: Synthetic oligonucleotide
  Target: ATXN1; (+) strand; PAM type: NRG; PAM sequence: GAG
gacaaacttttaggggtggg

SEQ ID NO: 137454 - DNA, 20 bp, Artificial Sequence
  Description of Artificial Sequence: Synthetic oligonucleotide
  Target: ATXN1; (+) strand; PAM type: NRG; PAM sequence: AGG
acaaacttttaggggtgggg

SEQ ID NO: 137455 - DNA, 20 bp, Artificial Sequence
  Description of Artificial Sequence: Synthetic oligonucleotide
  Target: ATXN1; (+) strand; PAM type: NRG; PAM sequence: TGG
tgacataattctaataactt

SEQ ID NO: 137456 - DNA, 20 bp, Artificial Sequence
  Description of Artificial Sequence: Synthetic oligonucleotide
  Target: ATXN1; (+) strand; PAM type: NRG; PAM sequence: GGG
gacataattctaataacttt

SEQ ID NO: 137457 - DNA, 20 bp, Artificial Sequence
  Description of Artificial Sequence: Synthetic oligonucleotide
  Target: ATXN1; (+) strand; PAM type: NRG; PAM sequence: GGG
acataattctaataactttg

SEQ ID NO: 137458 - DNA, 20 bp, Artificial Sequence
  Description of Artificial Sequence: Synthetic oligonucleotide
  Target: ATXN1; (+) strand; PAM type: NRG; PAM sequence: CAG
aattctaataactttgggga

SEQ ID NO: 137459 - DNA, 20 bp, Artificial Sequence
  Description of Artificial Sequence: Synthetic oligonucleotide
  Target: ATXN1; (+) strand; PAM type: NRG; PAM sequence: AGG
attctaataactttggggac

SEQ ID NO: 137460 - DNA, 20 bp, Artificial Sequence
  Description of Artificial Sequence: Synthetic oligonucleotide
  Target: ATXN1; (+) strand; PAM type: NRG; PAM sequence: AAG
tttggggacaggtaatttca

SEQ ID NO: 137461 - DNA, 20 bp, Artificial Sequence
  Description of Artificial Sequence: Synthetic oligonucleotide
  Target: ATXN1; (+) strand; PAM type: NRG; PAM sequence: CAG
acaggtaatttcaaagcttc

SEQ ID NO: 137462 - DNA, 20 bp, Artificial Sequence
  Description of Artificial Sequence: Synthetic oligonucleotide
  Target: ATXN1; (+) strand; PAM type: NRG; PAM sequence: AGG
caggtaatttcaaagcttcc

SEQ ID NO: 137463 - DNA, 20 bp, Artificial Sequence
  Description of Artificial Sequence: Synthetic oligonucleotide
  Target: ATXN1; (+) strand; PAM type: NRG; PAM sequence: TGG
ggatgctacatgtgccttaa

SEQ ID NO: 137464 - DNA, 20 bp, Artificial Sequence
  Description of Artificial Sequence: Synthetic oligonucleotide
  Target: ATXN1; (+) strand; PAM type: NRG; PAM sequence: GGG
gatgctacatgtgccttaat

SEQ ID NO: 137465 - DNA, 20 bp, Artificial Sequence
  Description of Artificial Sequence: Synthetic oligonucleotide
  Target: ATXN1; (+) strand; PAM type: NRG; PAM sequence: GGG
atgctacatgtgccttaatg

SEQ ID NO: 137466 - DNA, 20 bp, Artificial Sequence
  Description of Artificial Sequence: Synthetic oligonucleotide
  Target: ATXN1; (+) strand; PAM type: NRG; PAM sequence: GGG
tgctacatgtgccttaatgg

SEQ ID NO: 137467 - DNA, 20 bp, Artificial Sequence
  Description of Artificial Sequence: Synthetic oligonucleotide
  Target: ATXN1; (+) strand; PAM type: NRG; PAM sequence: AAG
catgtgccttaatgggggca

SEQ ID NO: 137468 - DNA, 20 bp, Artificial Sequence
  Description of Artificial Sequence: Synthetic oligonucleotide
  Target: ATXN1; (+) strand; PAM type: NRG; PAM sequence: AGG
atgtgccttaatgggggcaa

SEQ ID NO: 137469 - DNA, 20 bp, Artificial Sequence
  Description of Artificial Sequence: Synthetic oligonucleotide
  Target: ATXN1; (+) strand; PAM type: NRG; PAM sequence: GAG
ctctcacttttcttctcctt

SEQ ID NO: 137470 - DNA, 20 bp, Artificial Sequence
  Description of Artificial Sequence: Synthetic oligonucleotide
  Target: ATXN1; (+) strand; PAM type: NRG; PAM sequence: AGG
tctcacttttcttctccttg

SEQ ID NO: 137471 - DNA, 20 bp, Artificial Sequence
  Description of Artificial Sequence: Synthetic oligonucleotide
  Target: ATXN1; (+) strand; PAM type: NRG; PAM sequence: CAG
ttcttctccttgaggcaact

SEQ ID NO: 137472 - DNA, 20 bp, Artificial Sequence
  Description of Artificial Sequence: Synthetic oligonucleotide
  Target: ATXN1; (+) strand; PAM type: NRG; PAM sequence: GAG
cttctccttgaggcaactca

SEQ ID NO: 137473 - DNA, 20 bp, Artificial Sequence
  Description of Artificial Sequence: Synthetic oligonucleotide
  Target: ATXN1; (+) strand; PAM type: NRG; PAM sequence: AGG
ttctccttgaggcaactcag

SEQ ID NO: 137474 - DNA, 20 bp, Artificial Sequence
  Description of Artificial Sequence: Synthetic oligonucleotide
  Target: ATXN1; (+) strand; PAM type: NRG; PAM sequence: GAG
ctccttgaggcaactcagag

SEQ ID NO: 137475 - DNA, 20 bp, Artificial Sequence
  Description of Artificial Sequence: Synthetic oligonucleotide
  Target: ATXN1; (+) strand; PAM type: NRG; PAM sequence: TGG
gcaactcagaggagcgattg

SEQ ID NO: 137476 - DNA, 20 bp, Artificial Sequence
  Description of Artificial Sequence: Synthetic oligonucleotide
  Target: ATXN1; (+) strand; PAM type: NRG; PAM sequence: AAG
agcgattgtggaaatttccg

SEQ ID NO: 137477 - DNA, 20 bp, Artificial Sequence
  Description of Artificial Sequence: Synthetic oligonucleotide
  Target: ATXN1; (+) strand; PAM type: NRG; PAM sequence: CAG
tttccgaagctgctatatgt

SEQ ID NO: 137478 - DNA, 20 bp, Artificial Sequence
  Description of Artificial Sequence: Synthetic oligonucleotide
  Target: ATXN1; (+) strand; PAM type: NRG; PAM sequence: TGG
tgtcagcttgcccatttgta

SEQ ID NO: 137479 - DNA, 20 bp, Artificial Sequence
  Description of Artificial Sequence: Synthetic oligonucleotide
  Target: ATXN1; (+) strand; PAM type: NRG; PAM sequence: TGG
cccatttgtatggaatttca

SEQ ID NO: 137480 - DNA, 20 bp, Artificial Sequence
  Description of Artificial Sequence: Synthetic oligonucleotide
  Target: ATXN1; (+) strand; PAM type: NRG; PAM sequence: AAG
aatttcatggtttttttgac

SEQ ID NO: 137481 - DNA, 20 bp, Artificial Sequence
  Description of Artificial Sequence: Synthetic oligonucleotide
  Target: ATXN1; (+) strand; PAM type: NRG; PAM sequence: CAG
tcatggtttttttgacaagt

SEQ ID NO: 137482 - DNA, 20 bp, Artificial Sequence
  Description of Artificial Sequence: Synthetic oligonucleotide
  Target: ATXN1; (+) strand; PAM type: NRG; PAM sequence: AAG
ttgtcatcatcgcatcttga

SEQ ID NO: 137483 - DNA, 20 bp, Artificial Sequence
  Description of Artificial Sequence: Synthetic oligonucleotide
  Target: ATXN1; (+) strand; PAM type: NRG; PAM sequence: TAG
tcatcatcgcatcttgaaag

SEQ ID NO: 137484 - DNA, 20 bp, Artificial Sequence
  Description of Artificial Sequence: Synthetic oligonucleotide
  Target: ATXN1; (+) strand; PAM type: NRG; PAM sequence: GAG
atcatcgcatcttgaaagta

SEQ ID NO: 137485 - DNA, 20 bp, Artificial Sequence
  Description of Artificial Sequence: Synthetic oligonucleotide
  Target: ATXN1; (+) strand; PAM type: NRG; PAM sequence: GAG
catcgcatcttgaaagtaga

SEQ ID NO: 137486 - DNA, 20 bp, Artificial Sequence
  Description of Artificial Sequence: Synthetic oligonucleotide
  Target: ATXN1; (+) strand; PAM type: NRG; PAM sequence: AGG
atcgcatcttgaaagtagag

SEQ ID NO: 137487 - DNA, 20 bp, Artificial Sequence
  Description of Artificial Sequence: Synthetic oligonucleotide
  Target: ATXN1; (+) strand; PAM type: NRG; PAM sequence: AAG
catcttgaaagtagagagga

SEQ ID NO: 137488 - DNA, 20 bp, Artificial Sequence
  Description of Artificial Sequence: Synthetic oligonucleotide
  Target: ATXN1; (+) strand; PAM type: NRG; PAM sequence: AGG
atcttgaaagtagagaggaa

SEQ ID NO: 137489 - DNA, 20 bp, Artificial Sequence
  Description of Artificial Sequence: Synthetic oligonucleotide
  Target: ATXN1; (+) strand; PAM type: NRG; PAM sequence: TGG
gaaagtagagaggaaaggaa

SEQ ID NO: 137490 - DNA, 20 bp, Artificial Sequence
  Description of Artificial Sequence: Synthetic oligonucleotide
  Target: ATXN1; (+) strand; PAM type: NRG; PAM sequence: AAG
agtagagaggaaaggaatgg

SEQ ID NO: 137491 - DNA, 20 bp, Artificial Sequence
  Description of Artificial Sequence: Synthetic oligonucleotide
  Target: ATXN1; (+) strand; PAM type: NRG; PAM sequence: AGG
gtagagaggaaaggaatgga

SEQ ID NO: 137492 - DNA, 20 bp, Artificial Sequence
  Description of Artificial Sequence: Synthetic oligonucleotide
  Target: ATXN1; (+) strand; PAM type: NRG; PAM sequence: GGG
tagagaggaaaggaatggaa

SEQ ID NO: 137493 - DNA, 20 bp, Artificial Sequence
  Description of Artificial Sequence: Synthetic oligonucleotide
  Target: ATXN1; (+) strand; PAM type: NRG; PAM sequence: GAG
gagaggaaaggaatggaagg

SEQ ID NO: 137494 - DNA, 20 bp, Artificial Sequence
  Description of Artificial Sequence: Synthetic oligonucleotide
  Target: ATXN1; (+) strand; PAM type: NRG; PAM sequence: CAG
gaagggagaactgttactat

SEQ ID NO: 137495 - DNA, 20 bp, Artificial Sequence
  Description of Artificial Sequence: Synthetic oligonucleotide
  Target: ATXN1; (+) strand; PAM type: NRG; PAM sequence: GAG
agggagaactgttactatca

SEQ ID NO: 137496 - DNA, 20 bp, Artificial Sequence
  Description of Artificial Sequence: Synthetic oligonucleotide
  Target: ATXN1; (+) strand; PAM type: NRG; PAM sequence: AGG
gggagaactgttactatcag

SEQ ID NO: 137497 - DNA, 20 bp, Artificial Sequence
  Description of Artificial Sequence: Synthetic oligonucleotide
  Target: ATXN1; (+) strand; PAM type: NRG; PAM sequence: TGG
ctgttactatcagaggcttc

SEQ ID NO: 137498 - DNA, 20 bp, Artificial Sequence
  Description of Artificial Sequence: Synthetic oligonucleotide
  Target: ATXN1; (+) strand; PAM type: NRG; PAM sequence: TGG
ttctggaaatccccgcttga

SEQ ID NO: 137499 - DNA, 20 bp, Artificial Sequence
  Description of Artificial Sequence: Synthetic oligonucleotide
  Target: ATXN1; (+) strand; PAM type: NRG; PAM sequence: AAG
atggtacatgactctttctt

SEQ ID NO: 137500 - DNA, 20 bp, Artificial Sequence
  Description of Artificial Sequence: Synthetic oligonucleotide
  Target: ATXN1; (+) strand; PAM type: NRG; PAM sequence: TGG
acatgactctttcttaagaa

SEQ ID NO: 137501 - DNA, 20 bp, Artificial Sequence
  Description of Artificial Sequence: Synthetic oligonucleotide
  Target: ATXN1; (+) strand; PAM type: NRG; PAM sequence: CGG
ttaagaatggttctctttta

SEQ ID NO: 137502 - DNA, 20 bp, Artificial Sequence
  Description of Artificial Sequence: Synthetic oligonucleotide
  Target: ATXN1; (+) strand; PAM type: NRG; PAM sequence: GGG
taagaatggttctcttttac

SEQ ID NO: 137503 - DNA, 20 bp, Artificial Sequence
  Description of Artificial Sequence: Synthetic oligonucleotide
  Target: ATXN1; (+) strand; PAM type: NRG; PAM sequence: TGG
tcttttacgggttgccattt

SEQ ID NO: 137504 - DNA, 20 bp, Artificial Sequence
  Description of Artificial Sequence: Synthetic oligonucleotide
  Target: ATXN1; (+) strand; PAM type: NRG; PAM sequence: TGG
gttgccattttggtgacaat

SEQ ID NO: 137505 - DNA, 20 bp, Artificial Sequence
  Description of Artificial Sequence: Synthetic oligonucleotide
  Target: ATXN1; (+) strand; PAM type: NRG; PAM sequence: CAG
ttggtgacaattggtgcact

SEQ ID NO: 137506 - DNA, 20 bp, Artificial Sequence
  Description of Artificial Sequence: Synthetic oligonucleotide
  Target: ATXN1; (+) strand; PAM type: NRG; PAM sequence: TGG
gtgcactcagctctacctct

SEQ ID NO: 137507 - DNA, 20 bp, Artificial Sequence
  Description of Artificial Sequence: Synthetic oligonucleotide
  Target: ATXN1; (+) strand; PAM type: NRG; PAM sequence: TGG
cactcagctctacctcttgg

SEQ ID NO: 137508 - DNA, 20 bp, Artificial Sequence
  Description of Artificial Sequence: Synthetic oligonucleotide
  Target: ATXN1; (+) strand; PAM type: NRG; PAM sequence: GGG
actcagctctacctcttggt

SEQ ID NO: 137509 - DNA, 20 bp, Artificial Sequence
  Description of Artificial Sequence: Synthetic oligonucleotide
  Target: ATXN1; (+) strand; PAM type: NRG; PAM sequence: CAG
ctctacctcttggtgggccc

SEQ ID NO: 137510 - DNA, 20 bp, Artificial Sequence
  Description of Artificial Sequence: Synthetic oligonucleotide
  Target: ATXN1; (+) strand; PAM type: NRG; PAM sequence: CAG
tggtgggccccagtatactt

SEQ ID NO: 137511 - DNA, 20 bp, Artificial Sequence
  Description of Artificial Sequence: Synthetic oligonucleotide
  Target: ATXN1; (+) strand; PAM type: NRG; PAM sequence: CAG
agtatacttcagcatgatct

SEQ ID NO: 137512 - DNA, 20 bp, Artificial Sequence
  Description of Artificial Sequence: Synthetic oligonucleotide
  Target: ATXN1; (+) strand; PAM type: NRG; PAM sequence: CAG
tcagttctttctttctctac

SEQ ID NO: 137513 - DNA, 20 bp, Artificial Sequence
  Description of Artificial Sequence: Synthetic oligonucleotide
  Target: ATXN1; (+) strand; PAM type: NRG; PAM sequence: CAG
tacatacatcctgaaaatca

SEQ ID NO: 137514 - DNA, 20 bp, Artificial Sequence
  Description of Artificial Sequence: Synthetic oligonucleotide
  Target: ATXN1; (+) strand; PAM type: NRG; PAM sequence: TAG
atcacagcatcaccattcaa

SEQ ID NO: 137515 - DNA, 20 bp, Artificial Sequence
  Description of Artificial Sequence: Synthetic oligonucleotide
  Target: ATXN1; (+) strand; PAM type: NRG; PAM sequence: AAG
gacaaaaattatcattatca

SEQ ID NO: 137516 - DNA, 20 bp, Artificial Sequence
  Description of Artificial Sequence: Synthetic oligonucleotide
  Target: ATXN1; (+) strand; PAM type: NRG; PAM sequence: CGG
aaaaattatcattatcaaag

SEQ ID NO: 137517 - DNA, 20 bp, Artificial Sequence
  Description of Artificial Sequence: Synthetic oligonucleotide
  Target: ATXN1; (+) strand; PAM type: NRG; PAM sequence: AAG
tcattatcaaagcggccaaa

SEQ ID NO: 137518 - DNA, 20 bp, Artificial Sequence
  Description of Artificial Sequence: Synthetic oligonucleotide
  Target: ATXN1; (+) strand; PAM type: NRG; PAM sequence: AGG
cattatcaaagcggccaaaa

SEQ ID NO: 137519 - DNA, 20 bp, Artificial Sequence
  Description of Artificial Sequence: Synthetic oligonucleotide
  Target: ATXN1; (+) strand; PAM type: NRG; PAM sequence: TGG
gttttctcttaaatattctg

SEQ ID NO: 137520 - DNA, 20 bp, Artificial Sequence
  Description of Artificial Sequence: Synthetic oligonucleotide
  Target: ATXN1; (+) strand; PAM type: NRG; PAM sequence: GGG
ttttctcttaaatattctgt

SEQ ID NO: 137521 - DNA, 20 bp, Artificial Sequence
  Description of Artificial Sequence: Synthetic oligonucleotide
  Target: ATXN1; (+) strand; PAM type: NRG; PAM sequence: AAG
ctcttaaatattctgtggga

SEQ ID NO: 137522 - DNA, 20 bp, Artificial Sequence
  Description of Artificial Sequence: Synthetic oligonucleotide
  Target: ATXN1; (+) strand; PAM type: NRG; PAM sequence: GAG
cttaaatattctgtgggaaa

SEQ ID NO: 137523 - DNA, 20 bp, Artificial Sequence
  Description of Artificial Sequence: Synthetic oligonucleotide
  Target: ATXN1; (+) strand; PAM type: NRG; PAM sequence: AGG
ttaaatattctgtgggaaag

SEQ ID NO: 137524 - DNA, 20 bp, Artificial Sequence
  Description of Artificial Sequence: Synthetic oligonucleotide
  Target: ATXN1; (+) strand; PAM type: NRG; PAM sequence: GGG
taaatattctgtgggaaaga

SEQ ID NO: 137525 - DNA, 20 bp, Artificial Sequence
  Description of Artificial Sequence: Synthetic oligonucleotide
  Target: ATXN1; (+) strand; PAM type: NRG; PAM sequence: TAG
tgggaaagagggttgaaaat

SEQ ID NO: 137526 - DNA, 20 bp, Artificial Sequence
  Description of Artificial Sequence: Synthetic oligonucleotide
  Target: ATXN1; (+) strand; PAM type: NRG; PAM sequence: TAG
aagagggttgaaaattagaa

SEQ ID NO: 137527 - DNA, 20 bp, Artificial Sequence
  Description of Artificial Sequence: Synthetic oligonucleotide
  Target: ATXN1; (+) strand; PAM type: NRG; PAM sequence: CAG
agaatactatgtatttgcca

SEQ ID NO: 137528 - DNA, 20 bp, Artificial Sequence
  Description of Artificial Sequence: Synthetic oligonucleotide
  Target: ATXN1; (+) strand; PAM type: NRG; PAM sequence: AAG
ctatgtatttgccacagtaa

SEQ ID NO: 137529 - DNA, 20 bp, Artificial Sequence
  Description of Artificial Sequence: Synthetic oligonucleotide
  Target: ATXN1; (+) strand; PAM type: NRG; PAM sequence: CAG
aaaagatacctaccacaaac

SEQ ID NO: 137530 - DNA, 20 bp, Artificial Sequence
  Description of Artificial Sequence: Synthetic oligonucleotide
  Target: ATXN1; (+) strand; PAM type: NRG; PAM sequence: TAG
agatacctaccacaaaccag

SEQ ID NO: 137531 - DNA, 20 bp, Artificial Sequence
  Description of Artificial Sequence: Synthetic oligonucleotide
  Target: ATXN1; (+) strand; PAM type: NRG; PAM sequence: AAG
agtagccaatattatattaa

SEQ ID NO: 137532 - DNA, 20 bp, Artificial Sequence
  Description of Artificial Sequence: Synthetic oligonucleotide
  Target: ATXN1; (+) strand; PAM type: NRG; PAM sequence: AAG
ttatattaaaagttaaaaac

SEQ ID NO: 137533 - DNA, 20 bp, Artificial Sequence
  Description of Artificial Sequence: Synthetic oligonucleotide
  Target: ATXN1; (+) strand; PAM type: NRG; PAM sequence: GAG
atattaaaagttaaaaacaa

SEQ ID NO: 137534 - DNA, 20 bp, Artificial Sequence
  Description of Artificial Sequence: Synthetic oligonucleotide
  Target: ATXN1; (+) strand; PAM type: NRG; PAM sequence: CAG
caagagtcaatgattaaatt

SEQ ID NO: 137535 - DNA, 20 bp, Artificial Sequence
  Description of Artificial Sequence: Synthetic oligonucleotide
  Target: ATXN1; (+) strand; PAM type: NRG; PAM sequence: AGG
aagagtcaatgattaaattc

SEQ ID NO: 137536 - DNA, 20 bp, Artificial Sequence
  Description of Artificial Sequence: Synthetic oligonucleotide
  Target: ATXN1; (+) strand; PAM type: NRG; PAM sequence: CGG
gattaaattcaggctgcatg

SEQ ID NO: 137537 - DNA, 20 bp, Artificial Sequence
  Description of Artificial Sequence: Synthetic oligonucleotide
  Target: ATXN1; (+) strand; PAM type: NRG; PAM sequence: TGG
taaattcaggctgcatgcgg

SEQ ID NO: 137538 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgtaaccc

SEQ ID NO: 137539 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaaccccagcactt

SEQ ID NO: 137540 - DNA, 20 bp, Artificial Sequence
  Description of Artificial Sequence: Synthetic oligonucleotide
  Target: ATXN1; (+) strand; PAM type: NRG; PAM sequence: GGG
gcctgtaaccccagcacttt

SEQ ID NO: 137541 - DNA, 20 bp, Artificial Sequence
  Description of Artificial Sequence: Synthetic oligonucleotide
  Target: ATXN1; (+) strand; PAM type: NRG; PAM sequence: GAG
ctgtaaccccagcactttgg

SEQ ID NO: 137542 - DNA, 20 bp, Artificial Sequence
  Description of Artificial Sequence: Synthetic oligonucleotide
  Target: ATXN1; (+) strand; PAM type: NRG; PAM sequence: AGG
tgtaaccccagcactttggg

SEQ ID NO: 137543 - DNA, 20 bp, Artificial Sequence
  Description of Artificial Sequence: Synthetic oligonucleotide
  Target: ATXN1; (+) strand; PAM type: NRG; PAM sequence: GAG
ccccagcactttgggaggct

SEQ ID NO: 137544 - DNA, 20 bp, Artificial Sequence
  Description of Artificial Sequence: Synthetic oligonucleotide
  Target: ATXN1; (+) strand; PAM type: NRG; PAM sequence: CGG
cagcactttgggaggctgag

SEQ ID NO: 137545 - DNA, 20 bp, Artificial Sequence
  Description of Artificial Sequence: Synthetic oligonucleotide
  Target: ATXN1; (+) strand; PAM type: NRG; PAM sequence: GGG
agcactttgggaggctgagc

SEQ ID NO: 137546 - DNA, 20 bp, Artificial Sequence
  Description of Artificial Sequence: Synthetic oligonucleotide
  Target: ATXN1; (+) strand; PAM type: NRG; PAM sequence: TGG
actttgggaggctgagcggg

SEQ ID NO: 137547 - DNA, 20 bp, Artificial Sequence
  Description of Artificial Sequence: Synthetic oligonucleotide
  Target: ATXN1; (+) strand; PAM type: NRG; PAM sequence: GAG
gctgagcgggtggatcactt

SEQ ID NO: 137548 - DNA, 20 bp, Artificial Sequence
  Description of Artificial Sequence: Synthetic oligonucleotide
  Target: ATXN1; (+) strand; PAM type: NRG; PAM sequence: AGG
ctgagcgggtggatcacttg

SEQ ID NO: 137549 - DNA, 20 bp, Artificial Sequence
  Description of Artificial Sequence: Synthetic oligonucleotide
  Target: ATXN1; (+) strand; PAM type: NRG; PAM sequence: CAG
gcgggtggatcacttgaggt

SEQ ID NO: 137550 - DNA, 20 bp, Artificial Sequence
  Description of Artificial Sequence: Synthetic oligonucleotide
  Target: ATXN1; (+) strand; PAM type: NRG; PAM sequence: AGG
cgggtggatcacttgaggtc

SEQ ID NO: 137551 - DNA, 20 bp, Artificial Sequence
  Description of Artificial Sequence: Synthetic oligonucleotide
  Target: ATXN1; (+) strand; PAM type: NRG; PAM sequence: GAG
ggtggatcacttgaggtcag

SEQ ID NO: 137552 - DNA, 20 bp, Artificial Sequence
  Description of Artificial Sequence: Synthetic oligonucleotide
  Target: ATXN1; (+) strand; PAM type: NRG; PAM sequence: GAG
tcacttgaggtcaggagttt

SEQ ID NO: 137553 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggagtttgagac

SEQ ID NO: 137554 - DNA, 20 bp, Artificial Sequence
  Description of Artificial Sequence: Synthetic oligonucleotide
  Target: ATXN1; (+) strand; PAM type: NRG; PAM sequence: TGG
tcaggagtttgagaccagcc

SEQ ID NO: 137555 - DNA, 20 bp, Artificial Sequence
  Description of Artificial Sequence: Synthetic oligonucleotide
  Target: ATXN1; (+) strand; PAM type: NRG; PAM sequence: TGG
tgagaccagcctggtgaaca

SEQ ID NO: 137556 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 137557 - DNA, 20 bp, Artificial Sequence
  Description of Artificial Sequence: Synthetic oligonucleotide
  Target: ATXN1; (+) strand; PAM type: NRG; PAM sequence: CAG
ctaaaaatacaaaaattagc

SEQ ID NO: 137558 - DNA, 20 bp, Artificial Sequence
  Description of Artificial Sequence: Synthetic oligonucleotide
  Target: ATXN1; (+) strand; PAM type: NRG; PAM sequence: AGG
taaaaatacaaaaattagcc

SEQ ID NO: 137559 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagccaggca

SEQ ID NO: 137560 - DNA, 20 bp, Artificial Sequence
  Description of Artificial Sequence: Synthetic oligonucleotide
  Target: ATXN1; (+) strand; PAM type: NRG; PAM sequence: CAG
gtgttgcatgcctgtaatcc

SEQ ID NO: 137561 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagatatt

SEQ ID NO: 137562 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagatattt

SEQ ID NO: 137563 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagatatttgg

SEQ ID NO: 137564 - DNA, 20 bp, Artificial Sequence
  Description of Artificial Sequence: Synthetic oligonucleotide
  Target: ATXN1; (+) strand; PAM type: NRG; PAM sequence: TGG
cccagatatttgggagtctg

SEQ ID NO: 137565 - DNA, 20 bp, Artificial Sequence
  Description of Artificial Sequence: Synthetic oligonucleotide
  Target: ATXN1; (+) strand; PAM type: NRG; PAM sequence: CGG
gatatttgggagtctgtggc

SEQ ID NO: 137566 - DNA, 20 bp, Artificial Sequence
  Description of Artificial Sequence: Synthetic oligonucleotide
  Target: ATXN1; (+) strand; PAM type: NRG; PAM sequence: GAG
tatttgggagtctgtggccg

SEQ ID NO: 137567 - DNA, 20 bp, Artificial Sequence
  Description of Artificial Sequence: Synthetic oligonucleotide
  Target: ATXN1; (+) strand; PAM type: NRG; PAM sequence: GAG
ctgtggccggagaatcactt

SEQ ID NO: 137568 - DNA, 20 bp, Artificial Sequence
  Description of Artificial Sequence: Synthetic oligonucleotide
  Target: ATXN1; (+) strand; PAM type: NRG; PAM sequence: TGG
gccggagaatcacttgagcc

SEQ ID NO: 137569 - DNA, 20 bp, Artificial Sequence
  Description of Artificial Sequence: Synthetic oligonucleotide
  Target: ATXN1; (+) strand; PAM type: NRG; PAM sequence: GGG
ccggagaatcacttgagcct

SEQ ID NO: 137570 - DNA, 20 bp, Artificial Sequence
  Description of Artificial Sequence: Synthetic oligonucleotide
  Target: ATXN1; (+) strand; PAM type: NRG; PAM sequence: GAG
ggagaatcacttgagcctgg

SEQ ID NO: 137571 - DNA, 20 bp, Artificial Sequence
  Description of Artificial Sequence: Synthetic oligonucleotide
  Target: ATXN1; (+) strand; PAM type: NRG; PAM sequence: AGG
gagaatcacttgagcctggg

SEQ ID NO: 137572 - DNA, 20 bp, Artificial Sequence
  Description of Artificial Sequence: Synthetic oligonucleotide
  Target: ATXN1; (+) strand; PAM type: NRG; PAM sequence: CAG
aatcacttgagcctgggagg

SEQ ID NO: 137573 - DNA, 20 bp, Artificial Sequence
  Description of Artificial Sequence: Synthetic oligonucleotide
  Target: ATXN1; (+) strand; PAM type: NRG; PAM sequence: GAG
tcacttgagcctgggaggca

SEQ ID NO: 137574 - DNA, 20 bp, Artificial Sequence
  Description of Artificial Sequence: Synthetic oligonucleotide
  Target: ATXN1; (+) strand; PAM type: NRG; PAM sequence: AGG
cacttgagcctgggaggcag

SEQ ID NO: 137575 - DNA, 20 bp, Artificial Sequence
  Description of Artificial Sequence: Synthetic oligonucleotide
  Target: ATXN1; (+) strand; PAM type: NRG; PAM sequence: GAG
tgggaggcagaggttgcaat

SEQ ID NO: 137576 - DNA, 20 bp, Artificial Sequence
  Description of Artificial Sequence: Synthetic oligonucleotide
  Target: ATXN1; (+) strand; PAM type: NRG; PAM sequence: AAG
ggcagaggttgcaatgagcc

SEQ ID NO: 137577 - DNA, 20 bp, Artificial Sequence
  Description of Artificial Sequence: Synthetic oligonucleotide
  Target: ATXN1; (+) strand; PAM type: NRG; PAM sequence: CAG
gatcgtgcgccactgcactc

SEQ ID NO: 137578 - DNA, 20 bp, Artificial Sequence
  Description of Artificial Sequence: Synthetic oligonucleotide
  Target: ATXN1; (+) strand; PAM type: NRG; PAM sequence: TGG
tgcgccactgcactccagcc

SEQ ID NO: 137579 - DNA, 20 bp, Artificial Sequence
  Description of Artificial Sequence: Synthetic oligonucleotide
  Target: ATXN1; (+) strand; PAM type: NRG; PAM sequence: GGG
gcgccactgcactccagcct

SEQ ID NO: 137580 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggtga

SEQ ID NO: 137581 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggtgaca

SEQ ID NO: 137582 - DNA, 20 bp, Artificial Sequence
  Description of Artificial Sequence: Synthetic oligonucleotide
  Target: ATXN1; (+) strand; PAM type: NRG; PAM sequence: AAG
tccagcctgggtgacagagc

SEQ ID NO: 137583 - DNA, 20 bp, Artificial Sequence
  Description of Artificial Sequence: Synthetic oligonucleotide
  Target: ATXN1; (+) strand; PAM type: NRG; PAM sequence: AAG
acagagcaagactctgtctc

SEQ ID NO: 137584 - DNA, 20 bp, Artificial Sequence
  Description of Artificial Sequence: Synthetic oligonucleotide
  Target: ATXN1; (+) strand; PAM type: NRG; PAM sequence: CAG
agaaaaaaaaaaattaaatt

SEQ ID NO: 137585 - DNA, 20 bp, Artificial Sequence
  Description of Artificial Sequence: Synthetic oligonucleotide
  Target: ATXN1; (+) strand; PAM type: NRG; PAM sequence: AGG
gaaaaaaaaaaattaaattc

SEQ ID NO: 137586 - DNA, 20 bp, Artificial Sequence
  Description of Artificial Sequence: Synthetic oligonucleotide
  Target: ATXN1; (+) strand; PAM type: NRG; PAM sequence: AAG
aaaaattaaattcaggaata

SEQ ID NO: 137587 - DNA, 20 bp, Artificial Sequence
  Description of Artificial Sequence: Synthetic oligonucleotide
  Target: ATXN1; (+) strand; PAM type: NRG; PAM sequence: AAG
ttaaattcaggaataaagtc

SEQ ID NO: 137588 - DNA, 20 bp, Artificial Sequence
  Description of Artificial Sequence: Synthetic oligonucleotide
  Target: ATXN1; (+) strand; PAM type: NRG; PAM sequence: TGG
tctgctcttccattattatt

SEQ ID NO: 137589 - DNA, 20 bp, Artificial Sequence
  Description of Artificial Sequence: Synthetic oligonucleotide
  Target: ATXN1; (+) strand; PAM type: NRG; PAM sequence: CAG
attattatttggcataccat

SEQ ID NO: 137590 - DNA, 20 bp, Artificial Sequence
  Description of Artificial Sequence: Synthetic oligonucleotide
  Target: ATXN1; (+) strand; PAM type: NRG; PAM sequence: AGG
ttattatttggcataccatc

SEQ ID NO: 137591 - DNA, 20 bp, Artificial Sequence
  Description of Artificial Sequence: Synthetic oligonucleotide
  Target: ATXN1; (+) strand; PAM type: NRG; PAM sequence: TAG
ggcataccatcaggatgctg

SEQ ID NO: 137592 - DNA, 20 bp, Artificial Sequence
  Description of Artificial Sequence: Synthetic oligonucleotide
  Target: ATXN1; (+) strand; PAM type: NRG; PAM sequence: AAG
ataccatcaggatgctgtag

SEQ ID NO: 137593 - DNA, 20 bp, Artificial Sequence
  Description of Artificial Sequence: Synthetic oligonucleotide
  Target: ATXN1; (+) strand; PAM type: NRG; PAM sequence: AAG
ggatgctgtagaagaaataa

SEQ ID NO: 137594 - DNA, 20 bp, Artificial Sequence
  Description of Artificial Sequence: Synthetic oligonucleotide
  Target: ATXN1; (+) strand; PAM type: NRG; PAM sequence: CAG
aagttaaaaatattaaaata

SEQ ID NO: 137595 - DNA, 20 bp, Artificial Sequence
  Description of Artificial Sequence: Synthetic oligonucleotide
  Target: ATXN1; (+) strand; PAM type: NRG; PAM sequence: AGG
agttaaaaatattaaaatac

SEQ ID NO: 137596 - DNA, 20 bp, Artificial Sequence
  Description of Artificial Sequence: Synthetic oligonucleotide
  Target: ATXN1; (+) strand; PAM type: NRG; PAM sequence: GAG
ttaaaaatattaaaatacag

SEQ ID NO: 137597 - DNA, 20 bp, Artificial Sequence
  Description of Artificial Sequence: Synthetic oligonucleotide
  Target: ATXN1; (+) strand; PAM type: NRG; PAM sequence: TGG
ggagacaaaattatcattat

SEQ ID NO: 137598 - DNA, 20 bp, Artificial Sequence
  Description of Artificial Sequence: Synthetic oligonucleotide
  Target: ATXN1; (+) strand; PAM type: NRG; PAM sequence: TAG
tggaaatgttattgtctact

SEQ ID NO: 137599 - DNA, 20 bp, Artificial Sequence
  Description of Artificial Sequence: Synthetic oligonucleotide
  Target: ATXN1; (+) strand; PAM type: NRG; PAM sequence: AAG
attgtctacttagaatatct

SEQ ID NO: 137600 - DNA, 20 bp, Artificial Sequence
  Description of Artificial Sequence: Synthetic oligonucleotide
  Target: ATXN1; (+) strand; PAM type: NRG; PAM sequence: AGG
ttgtctacttagaatatcta

SEQ ID NO: 137601 - DNA, 20 bp, Artificial Sequence
  Description of Artificial Sequence: Synthetic oligonucleotide
  Target: ATXN1; (+) strand; PAM type: NRG; PAM sequence: GGG
tgtctacttagaatatctaa

SEQ ID NO: 137602 - DNA, 20 bp, Artificial Sequence
  Description of Artificial Sequence: Synthetic oligonucleotide
  Target: ATXN1; (+) strand; PAM type: NRG; PAM sequence: TAG
cttagaatatctaagggaat

SEQ ID NO: 137603 - DNA, 20 bp, Artificial Sequence
  Description of Artificial Sequence: Synthetic oligonucleotide
  Target: ATXN1; (+) strand; PAM type: NRG; PAM sequence: AAG
tatctaagggaattagctga

SEQ ID NO: 137604 - DNA, 20 bp, Artificial Sequence
  Description of Artificial Sequence: Synthetic oligonucleotide
  Target: ATXN1; (+) strand; PAM type: NRG; PAM sequence: TAG
gggaattagctgaaagactc

SEQ ID NO: 137605 - DNA, 20 bp, Artificial Sequence
  Description of Artificial Sequence: Synthetic oligonucleotide
  Target: ATXN1; (+) strand; PAM type: NRG; PAM sequence: GAG
agctgaaagactctagaact

SEQ ID NO: 137606 - DNA, 20 bp, Artificial Sequence
  Description of Artificial Sequence: Synthetic oligonucleotide
  Target: ATXN1; (+) strand; PAM type: NRG; PAM sequence: TGG
tagaactgagatcaatatta

SEQ ID NO: 137607 - DNA, 20 bp, Artificial Sequence
  Description of Artificial Sequence: Synthetic oligonucleotide
  Target: ATXN1; (+) strand; PAM type: NRG; PAM sequence: CAG
actgagatcaatattatggt

SEQ ID NO: 137608 - DNA, 20 bp, Artificial Sequence
  Description of Artificial Sequence: Synthetic oligonucleotide
  Target: ATXN1; (+) strand; PAM type: NRG; PAM sequence: CAG
caatattatggtcagttgac

SEQ ID NO: 137609 - DNA, 20 bp, Artificial Sequence
  Description of Artificial Sequence: Synthetic oligonucleotide
  Target: ATXN1; (+) strand; PAM type: NRG; PAM sequence: AGG
aatattatggtcagttgacc

SEQ ID NO: 137610 - DNA, 20 bp, Artificial Sequence
  Description of Artificial Sequence: Synthetic oligonucleotide
  Target: ATXN1; (+) strand; PAM type: NRG; PAM sequence: CAG
tatggtcagttgaccaggca

SEQ ID NO: 137611 - DNA, 20 bp, Artificial Sequence
  Description of Artificial Sequence: Synthetic oligonucleotide
  Target: ATXN1; (+) strand; PAM type: NRG; PAM sequence: TGG
ggtcagttgaccaggcacag

SEQ ID NO: 137612 - DNA, 20 bp, Artificial Sequence
  Description of Artificial Sequence: Synthetic oligonucleotide
  Target: ATXN1; (+) strand; PAM type: NRG; PAM sequence: CAG
gtggctcatatctgtaatcc

SEQ ID NO: 137613 - DNA, 20 bp, Artificial Sequence
  Description of Artificial Sequence: Synthetic oligonucleotide
  Target: ATXN1; (+) strand; PAM type: NRG; PAM sequence: TGG
tatctgtaatcccagcattt

SEQ ID NO: 137614 - DNA, 20 bp, Artificial Sequence
  Description of Artificial Sequence: Synthetic oligonucleotide
  Target: ATXN1; (+) strand; PAM type: NRG; PAM sequence: GGG
atctgtaatcccagcatttt

SEQ ID NO: 137615 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcattttgg

SEQ ID NO: 137616 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcattttggg

SEQ ID NO: 137617 - DNA, 20 bp, Artificial Sequence
  Description of Artificial Sequence: Synthetic oligonucleotide
  Target: ATXN1; (+) strand; PAM type: NRG; PAM sequence: AAG
tcccagcattttgggaggcc

SEQ ID NO: 137618 - DNA, 20 bp, Artificial Sequence
  Description of Artificial Sequence: Synthetic oligonucleotide
  Target: ATXN1; (+) strand; PAM type: NRG; PAM sequence: AGG
cccagcattttgggaggcca

SEQ ID NO: 137619 - DNA, 20 bp, Artificial Sequence
  Description of Artificial Sequence: Synthetic oligonucleotide
  Target: ATXN1; (+) strand; PAM type: NRG; PAM sequence: TGG
agcattttgggaggccaagg

SEQ ID NO: 137620 - DNA, 20 bp, Artificial Sequence
  Description of Artificial Sequence: Synthetic oligonucleotide
  Target: ATXN1; (+) strand; PAM type: NRG; PAM sequence: GGG
gcattttgggaggccaaggt

SEQ ID NO: 137621 - DNA, 20 bp, Artificial Sequence
  Description of Artificial Sequence: Synthetic oligonucleotide
  Target: ATXN1; (+) strand; PAM type: NRG; PAM sequence: TGG
ttttgggaggccaaggtggg

SEQ ID NO: 137622 - DNA, 20 bp, Artificial Sequence
  Description of Artificial Sequence: Synthetic oligonucleotide
  Target: ATXN1; (+) strand; PAM type: NRG; PAM sequence: GAG
ccaaggtgggtggctcacct

SEQ ID NO: 137623 - DNA, 20 bp, Artificial Sequence
  Description of Artificial Sequence: Synthetic oligonucleotide
  Target: ATXN1; (+) strand; PAM type: NRG; PAM sequence: AGG
caaggtgggtggctcacctg

SEQ ID NO: 137624 - DNA, 20 bp, Artificial Sequence
  Description of Artificial Sequence: Synthetic oligonucleotide
  Target: ATXN1; (+) strand; PAM type: NRG; PAM sequence: CAG
gtgggtggctcacctgaggt

SEQ ID NO: 137625 - DNA, 20 bp, Artificial Sequence
  Description of Artificial Sequence: Synthetic oligonucleotide
  Target: ATXN1; (+) strand; PAM type: NRG; PAM sequence: AGG
tgggtggctcacctgaggtc

SEQ ID NO: 137626 - DNA, 20 bp, Artificial Sequence
  Description of Artificial Sequence: Synthetic oligonucleotide
  Target: ATXN1; (+) strand; PAM type: NRG; PAM sequence: GGG
gggtggctcacctgaggtca

SEQ ID NO: 137627 - DNA, 20 bp, Artificial Sequence
  Description of Artificial Sequence: Synthetic oligonucleotide
  Target: ATXN1; (+) strand; PAM type: NRG; PAM sequence: GGG
ggtggctcacctgaggtcag

SEQ ID NO: 137628 - DNA, 20 bp, Artificial Sequence
  Description of Artificial Sequence: Synthetic oligonucleotide
  Target: ATXN1; (+) strand; PAM type: NRG; PAM sequence: GAG
tcacctgaggtcaggggttt

SEQ ID NO: 137629 - DNA, 20 bp, Artificial Sequence
  Description of Artificial Sequence: Synthetic oligonucleotide
  Target: ATXN1; (+) strand; PAM type: NRG; PAM sequence: CAG
tgaggtcaggggtttgagac

SEQ ID NO: 137630 - DNA, 20 bp, Artificial Sequence
  Description of Artificial Sequence: Synthetic oligonucleotide
  Target: ATXN1; (+) strand; PAM type: NRG; PAM sequence: TGG
tcaggggtttgagaccagcc

SEQ ID NO: 137631 - DNA, 20 bp, Artificial Sequence
  Description of Artificial Sequence: Synthetic oligonucleotide
  Target: ATXN1; (+) strand; PAM type: NRG; PAM sequence: TGG
tgagaccagcctggctaaca

SEQ ID NO: 137632 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 137633 - DNA, 20 bp, Artificial Sequence
  Description of Artificial Sequence: Synthetic oligonucleotide
  Target: ATXN1; (+) strand; PAM type: NRG; PAM sequence: CAG
ctaaaaatacaaaaattagc

SEQ ID NO: 137634 - DNA, 20 bp, Artificial Sequence
  Description of Artificial Sequence: Synthetic oligonucleotide
  Target: ATXN1; (+) strand; PAM type: NRG; PAM sequence: AGG
taaaaatacaaaaattagcc

SEQ ID NO: 137635 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagccaggtg

SEQ ID NO: 137636 - DNA, 20 bp, Artificial Sequence
  Description of Artificial Sequence: Synthetic oligonucleotide
  Target: ATXN1; (+) strand; PAM type: NRG; PAM sequence: TGG
caaaaattagccaggtgtgg

SEQ ID NO: 137637 - DNA, 20 bp, Artificial Sequence
  Description of Artificial Sequence: Synthetic oligonucleotide
  Target: ATXN1; (+) strand; PAM type: NRG; PAM sequence: CAG
gtggtacacacctgtaatcc

SEQ ID NO: 137638 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatcccagatact

SEQ ID NO: 137639 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccagatactt

SEQ ID NO: 137640 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagatacttgg

SEQ ID NO: 137641 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagatacttggg

SEQ ID NO: 137642 - DNA, 20 bp, Artificial Sequence
  Description of Artificial Sequence: Synthetic oligonucleotide
  Target: ATXN1; (+) strand; PAM type: NRG; PAM sequence: GAG
tcccagatacttgggaggct

SEQ ID NO: 137643 - DNA, 20 bp, Artificial Sequence
  Description of Artificial Sequence: Synthetic oligonucleotide
  Target: ATXN1; (+) strand; PAM type: NRG; PAM sequence: CAG
agatacttgggaggctgaga

SEQ ID NO: 137644 - DNA, 20 bp, Artificial Sequence
  Description of Artificial Sequence: Synthetic oligonucleotide
  Target: ATXN1; (+) strand; PAM type: NRG; PAM sequence: AAG
tacttgggaggctgagacag

SEQ ID NO: 137645 - DNA, 20 bp, Artificial Sequence
  Description of Artificial Sequence: Synthetic oligonucleotide
  Target: ATXN1; (+) strand; PAM type: NRG; PAM sequence: TGG
acagaagaatcacttgaacc

SEQ ID NO: 137646 - DNA, 20 bp, Artificial Sequence
  Description of Artificial Sequence: Synthetic oligonucleotide
  Target: ATXN1; (+) strand; PAM type: NRG; PAM sequence: GGG
cagaagaatcacttgaacct

SEQ ID NO: 137647 - DNA, 20 bp, Artificial Sequence
  Description of Artificial Sequence: Synthetic oligonucleotide
  Target: ATXN1; (+) strand; PAM type: NRG; PAM sequence: GAG
gaagaatcacttgaacctgg

SEQ ID NO: 137648 - DNA, 20 bp, Artificial Sequence
  Description of Artificial Sequence: Synthetic oligonucleotide
  Target: ATXN1; (+) strand; PAM type: NRG; PAM sequence: AGG
aagaatcacttgaacctggg

SEQ ID NO: 137649 - DNA, 20 bp, Artificial Sequence
  Description of Artificial Sequence: Synthetic oligonucleotide
  Target: ATXN1; (+) strand; PAM type: NRG; PAM sequence: CAG
aatcacttgaacctgggagg

SEQ ID NO: 137650 - DNA, 20 bp, Artificial Sequence
  Description of Artificial Sequence: Synthetic oligonucleotide
  Target: ATXN1; (+) strand; PAM type: NRG; PAM sequence: GAG
tcacttgaacctgggaggca

SEQ ID NO: 137651 - DNA, 20 bp, Artificial Sequence
  Description of Artificial Sequence: Synthetic oligonucleotide
  Target: ATXN1; (+) strand; PAM type: NRG; PAM sequence: AGG
cacttgaacctgggaggcag

SEQ ID NO: 137652 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggcagaggctg

SEQ ID NO: 137653 - DNA, 20 bp, Artificial Sequence
  Description of Artificial Sequence: Synthetic oligonucleotide
  Target: ATXN1; (+) strand; PAM type: NRG; PAM sequence: AGG
acctgggaggcagaggctgc

SEQ ID NO: 137654 - DNA, 20 bp, Artificial Sequence
  Description of Artificial Sequence: Synthetic oligonucleotide
  Target: ATXN1; (+) strand; PAM type: NRG; PAM sequence: GGG
cctgggaggcagaggctgca

SEQ ID NO: 137655 - DNA, 20 bp, Artificial Sequence
  Description of Artificial Sequence: Synthetic oligonucleotide
  Target: ATXN1; (+) strand; PAM type: NRG; PAM sequence: GAG
tgggaggcagaggctgcagg

SEQ ID NO: 137656 - DNA, 20 bp, Artificial Sequence
  Description of Artificial Sequence: Synthetic oligonucleotide
  Target: ATXN1; (+) strand; PAM type: NRG; PAM sequence: GAG
ggcagaggctgcagggagct

SEQ ID NO: 137657 - DNA, 20 bp, Artificial Sequence
  Description of Artificial Sequence: Synthetic oligonucleotide
  Target: ATXN1; (+) strand; PAM type: NRG; PAM sequence: CAG
gagatcatgccactgcactc

SEQ ID NO: 137658 - DNA, 20 bp, Artificial Sequence
  Description of Artificial Sequence: Synthetic oligonucleotide
  Target: ATXN1; (+) strand; PAM type: NRG; PAM sequence: TGG
catgccactgcactccagcc

SEQ ID NO: 137659 - DNA, 20 bp, Artificial Sequence
  Description of Artificial Sequence: Synthetic oligonucleotide
  Target: ATXN1; (+) strand; PAM type: NRG; PAM sequence: GGG
atgccactgcactccagcct

SEQ ID NO: 137660 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggtga

SEQ ID NO: 137661 - DNA, 20 bp, Artificial Sequence
  Description of Artificial Sequence: Synthetic oligonucleotide
  Target: ATXN1; (+) strand; PAM type: NRG; PAM sequence: AAG
cactccagcctgggtgacag

SEQ ID NO: 137662 - DNA, 20 bp, Artificial Sequence
  Description of Artificial Sequence: Synthetic oligonucleotide
  Target: ATXN1; (+) strand; PAM type: NRG; PAM sequence: AGG
actccagcctgggtgacaga

SEQ ID NO: 137663 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggtgacagaag

SEQ ID NO: 137664 - DNA, 20 bp, Artificial Sequence
  Description of Artificial Sequence: Synthetic oligonucleotide
  Target: ATXN1; (+) strand; PAM type: NRG; PAM sequence: TAG
tatataatatattttatata

SEQ ID NO: 137665 - DNA, 20 bp, Artificial Sequence
  Description of Artificial Sequence: Synthetic oligonucleotide
  Target: ATXN1; (+) strand; PAM type: NRG; PAM sequence: TGG
atattaataattatatataa

SEQ ID NO: 137666 - DNA, 20 bp, Artificial Sequence
  Description of Artificial Sequence: Synthetic oligonucleotide
  Target: ATXN1; (+) strand; PAM type: NRG; PAM sequence: CAG
taataattatatataatggt

SEQ ID NO: 137667 - DNA, 20 bp, Artificial Sequence
  Description of Artificial Sequence: Synthetic oligonucleotide
  Target: ATXN1; (+) strand; PAM type: NRG; PAM sequence: TAG
tatatataatggtcagttac

SEQ ID NO: 137668 - DNA, 20 bp, Artificial Sequence
  Description of Artificial Sequence: Synthetic oligonucleotide
  Target: ATXN1; (+) strand; PAM type: NRG; PAM sequence: AAG
atataatggtcagttactag

SEQ ID NO: 137669 - DNA, 20 bp, Artificial Sequence
  Description of Artificial Sequence: Synthetic oligonucleotide
  Target: ATXN1; (+) strand; PAM type: NRG; PAM sequence: TAG
cccctccacacacacttaca

SEQ ID NO: 137670 - DNA, 20 bp, Artificial Sequence
  Description of Artificial Sequence: Synthetic oligonucleotide
  Target: ATXN1; (+) strand; PAM type: NRG; PAM sequence: TAG
cacttacatagacatactaa

SEQ ID NO: 137671 - DNA, 20 bp, Artificial Sequence
  Description of Artificial Sequence: Synthetic oligonucleotide
  Target: ATXN1; (+) strand; PAM type: NRG; PAM sequence: CAG
tcctaaaacgcaatgataat

SEQ ID NO: 137672 - DNA, 20 bp, Artificial Sequence
  Description of Artificial Sequence: Synthetic oligonucleotide
  Target: ATXN1; (+) strand; PAM type: NRG; PAM sequence: AGG
cctaaaacgcaatgataatc

SEQ ID NO: 137673 - DNA, 20 bp, Artificial Sequence
  Description of Artificial Sequence: Synthetic oligonucleotide
  Target: ATXN1; (+) strand; PAM type: NRG; PAM sequence: CAG
aggtgaaaatttcccttata

SEQ ID NO: 137674 - DNA, 20 bp, Artificial Sequence
  Description of Artificial Sequence: Synthetic oligonucleotide
  Target: ATXN1; (+) strand; PAM type: NRG; PAM sequence: TAG
tgaaaatttcccttatacag

SEQ ID NO: 137675 - DNA, 20 bp, Artificial Sequence
  Description of Artificial Sequence: Synthetic oligonucleotide
  Target: ATXN1; (+) strand; PAM type: NRG; PAM sequence: TAG
cttatacagtagtctcccca

SEQ ID NO: 137676 - DNA, 20 bp, Artificial Sequence
  Description of Artificial Sequence: Synthetic oligonucleotide
  Target: ATXN1; (+) strand; PAM type: NRG; PAM sequence: CGG
cagtagtctccccatagcca

SEQ ID NO: 137677 - DNA, 20 bp, Artificial Sequence
  Description of Artificial Sequence: Synthetic oligonucleotide
  Target: ATXN1; (+) strand; PAM type: NRG; PAM sequence: TGG
agccacggttttgctttcca

SEQ ID NO: 137678 - DNA, 20 bp, Artificial Sequence
  Description of Artificial Sequence: Synthetic oligonucleotide
  Target: ATXN1; (+) strand; PAM type: NRG; PAM sequence: TGG
ctttccatggttttatttat

SEQ ID NO: 137679 - DNA, 20 bp, Artificial Sequence
  Description of Artificial Sequence: Synthetic oligonucleotide
  Target: ATXN1; (+) strand; PAM type: NRG; PAM sequence: TAG
gtcaatttgctgtctgaaaa

SEQ ID NO: 137680 - DNA, 20 bp, Artificial Sequence
  Description of Artificial Sequence: Synthetic oligonucleotide
  Target: ATXN1; (+) strand; PAM type: NRG; PAM sequence: AGG
tcaatttgctgtctgaaaat

SEQ ID NO: 137681 - DNA, 20 bp, Artificial Sequence
  Description of Artificial Sequence: Synthetic oligonucleotide
  Target: ATXN1; (+) strand; PAM type: NRG; PAM sequence: GAG
tttgctgtctgaaaataggc

SEQ ID NO: 137682 - DNA, 20 bp, Artificial Sequence
  Description of Artificial Sequence: Synthetic oligonucleotide
  Target: ATXN1; (+) strand; PAM type: NRG; PAM sequence: CAG
tgtctgaaaataggcgagta

SEQ ID NO: 137683 - DNA, 20 bp, Artificial Sequence
  Description of Artificial Sequence: Synthetic oligonucleotide
  Target: ATXN1; (+) strand; PAM type: NRG; PAM sequence: AAG
aaaataggcgagtacagtac

SEQ ID NO: 137684 - DNA, 20 bp, Artificial Sequence
  Description of Artificial Sequence: Synthetic oligonucleotide
  Target: ATXN1; (+) strand; PAM type: NRG; PAM sequence: AAG
ataggcgagtacagtacaag

SEQ ID NO: 137685 - DNA, 20 bp, Artificial Sequence
  Description of Artificial Sequence: Synthetic oligonucleotide
  Target: ATXN1; (+) strand; PAM type: NRG; PAM sequence: TGG
gtacagtacaagaagatatt

SEQ ID NO: 137686 - DNA, 20 bp, Artificial Sequence
  Description of Artificial Sequence: Synthetic oligonucleotide
  Target: ATXN1; (+) strand; PAM type: NRG; PAM sequence: GAG
acagtacaagaagatatttg

SEQ ID NO: 137687 - DNA, 20 bp, Artificial Sequence
  Description of Artificial Sequence: Synthetic oligonucleotide
  Target: ATXN1; (+) strand; PAM type: NRG; PAM sequence: GAG
caagaagatatttggagact

SEQ ID NO: 137688 - DNA, 20 bp, Artificial Sequence
  Description of Artificial Sequence: Synthetic oligonucleotide
  Target: ATXN1; (+) strand; PAM type: NRG; PAM sequence: GAG
agaagatatttggagactga

SEQ ID NO: 137689 - DNA, 20 bp, Artificial Sequence
  Description of Artificial Sequence: Synthetic oligonucleotide
  Target: ATXN1; (+) strand; PAM type: NRG; PAM sequence: GAG
aagatatttggagactgaga

SEQ ID NO: 137690 - DNA, 20 bp, Artificial Sequence
  Description of Artificial Sequence: Synthetic oligonucleotide
  Target: ATXN1; (+) strand; PAM type: NRG; PAM sequence: TAG
catccacataacttttatta

SEQ ID NO: 137691 - DNA, 20 bp, Artificial Sequence
  Description of Artificial Sequence: Synthetic oligonucleotide
  Target: ATXN1; (+) strand; PAM type: NRG; PAM sequence: AAG
attatagtatatttttatat

SEQ ID NO: 137692 - DNA, 20 bp, Artificial Sequence
  Description of Artificial Sequence: Synthetic oligonucleotide
  Target: ATXN1; (+) strand; PAM type: NRG; PAM sequence: TAG
taagtattttatttgattat

SEQ ID NO: 137693 - DNA, 20 bp, Artificial Sequence
  Description of Artificial Sequence: Synthetic oligonucleotide
  Target: ATXN1; (+) strand; PAM type: NRG; PAM sequence: TGG
ttatacattgaattttatca

SEQ ID NO: 137694 - DNA, 20 bp, Artificial Sequence
  Description of Artificial Sequence: Synthetic oligonucleotide
  Target: ATXN1; (+) strand; PAM type: NRG; PAM sequence: CAG
tttatcatggtgtgtacgta

SEQ ID NO: 137695 - DNA, 20 bp, Artificial Sequence
  Description of Artificial Sequence: Synthetic oligonucleotide
  Target: ATXN1; (+) strand; PAM type: NRG; PAM sequence: AGG
ttatcatggtgtgtacgtac

SEQ ID NO: 137696 - DNA, 20 bp, Artificial Sequence
  Description of Artificial Sequence: Synthetic oligonucleotide
  Target: ATXN1; (+) strand; PAM type: NRG; PAM sequence: TAG
aggaaaaaacacaatctata

SEQ ID NO: 137697 - DNA, 20 bp, Artificial Sequence
  Description of Artificial Sequence: Synthetic oligonucleotide
  Target: ATXN1; (+) strand; PAM type: NRG; PAM sequence: AGG
ggaaaaaacacaatctatat

SEQ ID NO: 137698 - DNA, 20 bp, Artificial Sequence
  Description of Artificial Sequence: Synthetic oligonucleotide
  Target: ATXN1; (+) strand; PAM type: NRG; PAM sequence: GGG
gaaaaaacacaatctatata

SEQ ID NO: 137699 - DNA, 20 bp, Artificial Sequence
  Description of Artificial Sequence: Synthetic oligonucleotide
  Target: ATXN1; (+) strand; PAM type: NRG; PAM sequence: TGG
aacacaatctatatagggtt

SEQ ID NO: 137700 - DNA, 20 bp, Artificial Sequence
  Description of Artificial Sequence: Synthetic oligonucleotide
  Target: ATXN1; (+) strand; PAM type: NRG; PAM sequence: TGG
atatagggtttggtactaac

SEQ ID NO: 137701 - DNA, 20 bp, Artificial Sequence
  Description of Artificial Sequence: Synthetic oligonucleotide
  Target: ATXN1; (+) strand; PAM type: NRG; PAM sequence: CAG
tagggtttggtactaactgg

SEQ ID NO: 137702 - DNA, 20 bp, Artificial Sequence
  Description of Artificial Sequence: Synthetic oligonucleotide
  Target: ATXN1; (+) strand; PAM type: NRG; PAM sequence: CAG
ttggtactaactggcagttt

SEQ ID NO: 137703 - DNA, 20 bp, Artificial Sequence
  Description of Artificial Sequence: Synthetic oligonucleotide
  Target: ATXN1; (+) strand; PAM type: NRG; PAM sequence: AGG
tggtactaactggcagtttc

SEQ ID NO: 137704 - DNA, 20 bp, Artificial Sequence
  Description of Artificial Sequence: Synthetic oligonucleotide
  Target: ATXN1; (+) strand; PAM type: NRG; PAM sequence: CAG
tggcagtttcaggaatccac

SEQ ID NO: 137705 - DNA, 20 bp, Artificial Sequence
  Description of Artificial Sequence: Synthetic oligonucleotide
  Target: ATXN1; (+) strand; PAM type: NRG; PAM sequence: AGG
ggcagtttcaggaatccacc

SEQ ID NO: 137706 - DNA, 20 bp, Artificial Sequence
  Description of Artificial Sequence: Synthetic oligonucleotide
  Target: ATXN1; (+) strand; PAM type: NRG; PAM sequence: GGG
gcagtttcaggaatccacca

SEQ ID NO: 137707 - DNA, 20 bp, Artificial Sequence
  Description of Artificial Sequence: Synthetic oligonucleotide
  Target: ATXN1; (+) strand; PAM type: NRG; PAM sequence: GGG
cagtttcaggaatccaccag

SEQ ID NO: 137708 - DNA, 20 bp, Artificial Sequence
  Description of Artificial Sequence: Synthetic oligonucleotide
  Target: ATXN1; (+) strand; PAM type: NRG; PAM sequence: TGG
tcaggaatccaccaggggta

SEQ ID NO: 137709 - DNA, 20 bp, Artificial Sequence
  Description of Artificial Sequence: Synthetic oligonucleotide
  Target: ATXN1; (+) strand; PAM type: NRG; PAM sequence: CAG
aggggtatggaacatgcccc

SEQ ID NO: 137710 - DNA, 20 bp, Artificial Sequence
  Description of Artificial Sequence: Synthetic oligonucleotide
  Target: ATXN1; (+) strand; PAM type: NRG; PAM sequence: CGG
ggaacatgcccccagttgat

SEQ ID NO: 137711 - DNA, 20 bp, Artificial Sequence
  Description of Artificial Sequence: Synthetic oligonucleotide
  Target: ATXN1; (+) strand; PAM type: NRG; PAM sequence: GGG
gaacatgcccccagttgatc

SEQ ID NO: 137712 - DNA, 20 bp, Artificial Sequence
  Description of Artificial Sequence: Synthetic oligonucleotide
  Target: ATXN1; (+) strand; PAM type: NRG; PAM sequence: GGG
aacatgcccccagttgatcg

SEQ ID NO: 137713 - DNA, 20 bp, Artificial Sequence
  Description of Artificial Sequence: Synthetic oligonucleotide
  Target: ATXN1; (+) strand; PAM type: NRG; PAM sequence: GGG
acatgcccccagttgatcgg

SEQ ID NO: 137714 - DNA, 20 bp, Artificial Sequence
  Description of Artificial Sequence: Synthetic oligonucleotide
  Target: ATXN1; (+) strand; PAM type: NRG; PAM sequence: GGG
catgcccccagttgatcggg

SEQ ID NO: 137715 - DNA, 20 bp, Artificial Sequence
  Description of Artificial Sequence: Synthetic oligonucleotide
  Target: ATXN1; (+) strand; PAM type: NRG; PAM sequence: AAG
gatcggggggactactgtat

SEQ ID NO: 137716 - DNA, 20 bp, Artificial Sequence
  Description of Artificial Sequence: Synthetic oligonucleotide
  Target: ATXN1; (+) strand; PAM type: NRG; PAM sequence: AGG
atcggggggactactgtata

SEQ ID NO: 137717 - DNA, 20 bp, Artificial Sequence
  Description of Artificial Sequence: Synthetic oligonucleotide
  Target: ATXN1; (+) strand; PAM type: NRG; PAM sequence: AAG
actactgtataaggaaaata

SEQ ID NO: 137718 - DNA, 20 bp, Artificial Sequence
  Description of Artificial Sequence: Synthetic oligonucleotide
  Target: ATXN1; (+) strand; PAM type: NRG; PAM sequence: AAG
gtataaggaaaataaagatt

SEQ ID NO: 137719 - DNA, 20 bp, Artificial Sequence
  Description of Artificial Sequence: Synthetic oligonucleotide
  Target: ATXN1; (+) strand; PAM type: NRG; PAM sequence: AAG
ccaacactgtaaaatctcta

SEQ ID NO: 137720 - DNA, 20 bp, Artificial Sequence
  Description of Artificial Sequence: Synthetic oligonucleotide
  Target: ATXN1; (+) strand; PAM type: NRG; PAM sequence: AAG
gtaaaatctctaaagaaaac

SEQ ID NO: 137721 - DNA, 20 bp, Artificial Sequence
  Description of Artificial Sequence: Synthetic oligonucleotide
  Target: ATXN1; (+) strand; PAM type: NRG; PAM sequence: CAG
taaagaaaacaagaactgct

SEQ ID NO: 137722 - DNA, 20 bp, Artificial Sequence
  Description of Artificial Sequence: Synthetic oligonucleotide
  Target: ATXN1; (+) strand; PAM type: NRG; PAM sequence: CAG
ctgctcagattctataaaaa

SEQ ID NO: 137723 - DNA, 20 bp, Artificial Sequence
  Description of Artificial Sequence: Synthetic oligonucleotide
  Target: ATXN1; (+) strand; PAM type: NRG; PAM sequence: AAG
aatgcattactaaaaaacta

SEQ ID NO: 137724 - DNA, 20 bp, Artificial Sequence
  Description of Artificial Sequence: Synthetic oligonucleotide
  Target: ATXN1; (+) strand; PAM type: NRG; PAM sequence: AGG
atgcattactaaaaaactaa

SEQ ID NO: 137725 - DNA, 20 bp, Artificial Sequence
  Description of Artificial Sequence: Synthetic oligonucleotide
  Target: ATXN1; (+) strand; PAM type: NRG; PAM sequence: TGG
taaaggaaaaacattgtgca

SEQ ID NO: 137726 - DNA, 20 bp, Artificial Sequence
  Description of Artificial Sequence: Synthetic oligonucleotide
  Target: ATXN1; (+) strand; PAM type: NRG; PAM sequence: AAG
gtgcatggatcaaaaattac

SEQ ID NO: 137727 - DNA, 20 bp, Artificial Sequence
  Description of Artificial Sequence: Synthetic oligonucleotide
  Target: ATXN1; (+) strand; PAM type: NRG; PAM sequence: GAG
gcatggatcaaaaattacaa

SEQ ID NO: 137728 - DNA, 20 bp, Artificial Sequence
  Description of Artificial Sequence: Synthetic oligonucleotide
  Target: ATXN1; (+) strand; PAM type: NRG; PAM sequence: CAG
gatcaaaaattacaagagtt

SEQ ID NO: 137729 - DNA, 20 bp, Artificial Sequence
  Description of Artificial Sequence: Synthetic oligonucleotide
  Target: ATXN1; (+) strand; PAM type: NRG; PAM sequence: AAG
aaaattacaagagttcagta

SEQ ID NO: 137730 - DNA, 20 bp, Artificial Sequence
  Description of Artificial Sequence: Synthetic oligonucleotide
  Target: ATXN1; (+) strand; PAM type: NRG; PAM sequence: AAG
aaattaaattttattttgaa

SEQ ID NO: 137731 - DNA, 20 bp, Artificial Sequence
  Description of Artificial Sequence: Synthetic oligonucleotide
  Target: ATXN1; (+) strand; PAM type: NRG; PAM sequence: TAG
gttttaaaatctgactaaat

SEQ ID NO: 137732 - DNA, 20 bp, Artificial Sequence
  Description of Artificial Sequence: Synthetic oligonucleotide
  Target: ATXN1; (+) strand; PAM type: NRG; PAM sequence: AAG
attagtctatgtacacatga

SEQ ID NO: 137733 - DNA, 20 bp, Artificial Sequence
  Description of Artificial Sequence: Synthetic oligonucleotide
  Target: ATXN1; (+) strand; PAM type: NRG; PAM sequence: TAG
tgtacacatgaaagaataaa

SEQ ID NO: 137734 - DNA, 20 bp, Artificial Sequence
  Description of Artificial Sequence: Synthetic oligonucleotide
  Target: ATXN1; (+) strand; PAM type: NRG; PAM sequence: TAG
aagaataaatagactaaaaa

SEQ ID NO: 137735 - DNA, 20 bp, Artificial Sequence
  Description of Artificial Sequence: Synthetic oligonucleotide
  Target: ATXN1; (+) strand; PAM type: NRG; PAM sequence: AAG
tgctgaaaaaaaatatatga

SEQ ID NO: 137736 - DNA, 20 bp, Artificial Sequence
  Description of Artificial Sequence: Synthetic oligonucleotide
  Target: ATXN1; (+) strand; PAM type: NRG; PAM sequence: TAG
attaaaatcttctaaactca

SEQ ID NO: 137737 - DNA, 20 bp, Artificial Sequence
  Description of Artificial Sequence: Synthetic oligonucleotide
  Target: ATXN1; (+) strand; PAM type: NRG; PAM sequence: AAG
ttctaaactcatagaatcaa

SEQ ID NO: 137738 - DNA, 20 bp, Artificial Sequence
  Description of Artificial Sequence: Synthetic oligonucleotide
  Target: ATXN1; (+) strand; PAM type: NRG; PAM sequence: TAG
tcatagaatcaaaagcaaaa

SEQ ID NO: 137739 - DNA, 20 bp, Artificial Sequence
  Description of Artificial Sequence: Synthetic oligonucleotide
  Target: ATXN1; (+) strand; PAM type: NRG; PAM sequence: AAG
atagaaaaaaaacaaatatc

SEQ ID NO: 137740 - DNA, 20 bp, Artificial Sequence
  Description of Artificial Sequence: Synthetic oligonucleotide
  Target: ATXN1; (+) strand; PAM type: NRG; PAM sequence: CAG
aaaaacaaatatcaagataa

SEQ ID NO: 137741 - DNA, 20 bp, Artificial Sequence
  Description of Artificial Sequence: Synthetic oligonucleotide
  Target: ATXN1; (+) strand; PAM type: NRG; PAM sequence: AAG
atatcaagataacagaatat

SEQ ID NO: 137742 - DNA, 20 bp, Artificial Sequence
  Description of Artificial Sequence: Synthetic oligonucleotide
  Target: ATXN1; (+) strand; PAM type: NRG; PAM sequence: AGG
tatcaagataacagaatata

SEQ ID NO: 137743 - DNA, 20 bp, Artificial Sequence
  Description of Artificial Sequence: Synthetic oligonucleotide
  Target: ATXN1; (+) strand; PAM type: NRG; PAM sequence: TAG
agataacagaatataaggct

SEQ ID NO: 137744 - DNA, 20 bp, Artificial Sequence
  Description of Artificial Sequence: Synthetic oligonucleotide
  Target: ATXN1; (+) strand; PAM type: NRG; PAM sequence: CGG
gaatataaggcttagaaatg

SEQ ID NO: 137745 - DNA, 20 bp, Artificial Sequence
  Description of Artificial Sequence: Synthetic oligonucleotide
  Target: ATXN1; (+) strand; PAM type: NRG; PAM sequence: GAG
ggcttagaaatgcggatcac

SEQ ID NO: 137746 - DNA, 20 bp, Artificial Sequence
  Description of Artificial Sequence: Synthetic oligonucleotide
  Target: ATXN1; (+) strand; PAM type: NRG; PAM sequence: AGG
gcttagaaatgcggatcacg

SEQ ID NO: 137747 - DNA, 20 bp, Artificial Sequence
  Description of Artificial Sequence: Synthetic oligonucleotide
  Target: ATXN1; (+) strand; PAM type: NRG; PAM sequence: CAG
agaaatgcggatcacgaggt

SEQ ID NO: 137748 - DNA, 20 bp, Artificial Sequence
  Description of Artificial Sequence: Synthetic oligonucleotide
  Target: ATXN1; (+) strand; PAM type: NRG; PAM sequence: AGG
gaaatgcggatcacgaggtc

SEQ ID NO: 137749 - DNA, 20 bp, Artificial Sequence
  Description of Artificial Sequence: Synthetic oligonucleotide
  Target: ATXN1; (+) strand; PAM type: NRG; PAM sequence: GAG
aatgcggatcacgaggtcag

SEQ ID NO: 137750 - DNA, 20 bp, Artificial Sequence
  Description of Artificial Sequence: Synthetic oligonucleotide
  Target: ATXN1; (+) strand; PAM type: NRG; PAM sequence: GAG
gatcacgaggtcaggagatc

SEQ ID NO: 137751 - DNA, 20 bp, Artificial Sequence
  Description of Artificial Sequence: Synthetic oligonucleotide
  Target: ATXN1; (+) strand; PAM type: NRG; PAM sequence: TGG
tcaggagatcgagaccatcc

SEQ ID NO: 137752 - DNA, 20 bp, Artificial Sequence
  Description of Artificial Sequence: Synthetic oligonucleotide
  Target: ATXN1; (+) strand; PAM type: NRG; PAM sequence: CAG
cgagaccatcctggctaaca

SEQ ID NO: 137753 - DNA, 20 bp, Artificial Sequence
  Description of Artificial Sequence: Synthetic oligonucleotide
  Target: ATXN1; (+) strand; PAM type: NRG; PAM sequence: TAG
ctaaaaacacacacaaaaat

SEQ ID NO: 137754 - DNA, 20 bp, Artificial Sequence
  Description of Artificial Sequence: Synthetic oligonucleotide
  Target: ATXN1; (+) strand; PAM type: NRG; PAM sequence: CGG
aaacacacacaaaaattagc

SEQ ID NO: 137755 - DNA, 20 bp, Artificial Sequence
  Description of Artificial Sequence: Synthetic oligonucleotide
  Target: ATXN1; (+) strand; PAM type: NRG; PAM sequence: GGG
aacacacacaaaaattagcc

SEQ ID NO: 137756 - DNA, 20 bp, Artificial Sequence
  Description of Artificial Sequence: Synthetic oligonucleotide
  Target: ATXN1; (+) strand; PAM type: NRG; PAM sequence: TGG
acacaaaaattagccgggcg

SEQ ID NO: 137757 - DNA, 20 bp, Artificial Sequence
  Description of Artificial Sequence: Synthetic oligonucleotide
  Target: ATXN1; (+) strand; PAM type: NRG; PAM sequence: TGG
caaaaattagccgggcgtgg

SEQ ID NO: 137758 - DNA, 20 bp, Artificial Sequence
  Description of Artificial Sequence: Synthetic oligonucleotide
  Target: ATXN1; (+) strand; PAM type: NRG; PAM sequence: CGG
aaattagccgggcgtggtgg

SEQ ID NO: 137759 - DNA, 20 bp, Artificial Sequence
  Description of Artificial Sequence: Synthetic oligonucleotide
  Target: ATXN1; (+) strand; PAM type: NRG; PAM sequence: GGG
aattagccgggcgtggtggc

SEQ ID NO: 137760 - DNA, 20 bp, Artificial Sequence
  Description of Artificial Sequence: Synthetic oligonucleotide
  Target: ATXN1; (+) strand; PAM type: NRG; PAM sequence: CAG
ggcgtggtggcgggcgcctg

SEQ ID NO: 137761 - DNA, 20 bp, Artificial Sequence
  Description of Artificial Sequence: Synthetic oligonucleotide
  Target: ATXN1; (+) strand; PAM type: NRG; PAM sequence: CAG
gtggcgggcgcctgcagtcc

SEQ ID NO: 137762 - DNA, 20 bp, Artificial Sequence
  Description of Artificial Sequence: Synthetic oligonucleotide
  Target: ATXN1; (+) strand; PAM type: NRG; PAM sequence: CGG
cgcctgcagtcccagctact

SEQ ID NO: 137763 - DNA, 20 bp, Artificial Sequence
  Description of Artificial Sequence: Synthetic oligonucleotide
  Target: ATXN1; (+) strand; PAM type: NRG; PAM sequence: GGG
gcctgcagtcccagctactc

SEQ ID NO: 137764 - DNA, 20 bp, Artificial Sequence
  Description of Artificial Sequence: Synthetic oligonucleotide
  Target: ATXN1; (+) strand; PAM type: NRG; PAM sequence: GAG
ctgcagtcccagctactcgg

SEQ ID NO: 137765 - DNA, 20 bp, Artificial Sequence
  Description of Artificial Sequence: Synthetic oligonucleotide
  Target: ATXN1; (+) strand; PAM type: NRG; PAM sequence: AGG
tgcagtcccagctactcggg

SEQ ID NO: 137766 - DNA, 20 bp, Artificial Sequence
  Description of Artificial Sequence: Synthetic oligonucleotide
  Target: ATXN1; (+) strand; PAM type: NRG; PAM sequence: GAG
tcccagctactcgggaggct

SEQ ID NO: 137767 - DNA, 20 bp, Artificial Sequence
  Description of Artificial Sequence: Synthetic oligonucleotide
  Target: ATXN1; (+) strand; PAM type: NRG; PAM sequence: AGG
cccagctactcgggaggctg

SEQ ID NO: 137768 - DNA, 20 bp, Artificial Sequence
  Description of Artificial Sequence: Synthetic oligonucleotide
  Target: ATXN1; (+) strand; PAM type: NRG; PAM sequence: CAG
agctactcgggaggctgagg

SEQ ID NO: 137769 - DNA, 20 bp, Artificial Sequence
  Description of Artificial Sequence: Synthetic oligonucleotide
  Target: ATXN1; (+) strand; PAM type: NRG; PAM sequence: AGG
gctactcgggaggctgaggc

SEQ ID NO: 137770 - DNA, 20 bp, Artificial Sequence
  Description of Artificial Sequence: Synthetic oligonucleotide
  Target: ATXN1; (+) strand; PAM type: NRG; PAM sequence: GAG
tactcgggaggctgaggcag

SEQ ID NO: 137771 - DNA, 20 bp, Artificial Sequence
  Description of Artificial Sequence: Synthetic oligonucleotide
  Target: ATXN1; (+) strand; PAM type: NRG; PAM sequence: TGG
gggaggctgaggcaggagaa

SEQ ID NO: 137772 - DNA, 20 bp, Artificial Sequence
  Description of Artificial Sequence: Synthetic oligonucleotide
  Target: ATXN1; (+) strand; PAM type: NRG; PAM sequence: GAG
ggagaatggcctgaacccgt

SEQ ID NO: 137773 - DNA, 20 bp, Artificial Sequence
  Description of Artificial Sequence: Synthetic oligonucleotide
  Target: ATXN1; (+) strand; PAM type: NRG; PAM sequence: AGG
gagaatggcctgaacccgtg

SEQ ID NO: 137774 - DNA, 20 bp, Artificial Sequence
  Description of Artificial Sequence: Synthetic oligonucleotide
  Target: ATXN1; (+) strand; PAM type: NRG; PAM sequence: CGG
aatggcctgaacccgtgagg

SEQ ID NO: 137775 - DNA, 20 bp, Artificial Sequence
  Description of Artificial Sequence: Synthetic oligonucleotide
  Target: ATXN1; (+) strand; PAM type: NRG; PAM sequence: GAG
tggcctgaacccgtgaggcg

SEQ ID NO: 137776 - DNA, 20 bp, Artificial Sequence
  Description of Artificial Sequence: Synthetic oligonucleotide
  Target: ATXN1; (+) strand; PAM type: NRG; PAM sequence: CAG
aacccgtgaggcggagcttg

SEQ ID NO: 137777 - DNA, 20 bp, Artificial Sequence
  Description of Artificial Sequence: Synthetic oligonucleotide
  Target: ATXN1; (+) strand; PAM type: NRG; PAM sequence: GAG
cgtgaggcggagcttgcagt

SEQ ID NO: 137778 - DNA, 20 bp, Artificial Sequence
  Description of Artificial Sequence: Synthetic oligonucleotide
  Target: ATXN1; (+) strand; PAM type: NRG; PAM sequence: GAG
ggcggagcttgcagtgagcc

SEQ ID NO: 137779 - DNA, 20 bp, Artificial Sequence
  Description of Artificial Sequence: Synthetic oligonucleotide
  Target: ATXN1; (+) strand; PAM type: NRG; PAM sequence: TGG
cacgccgctgcactcctgcc

SEQ ID NO: 137780 - DNA, 20 bp, Artificial Sequence
  Description of Artificial Sequence: Synthetic oligonucleotide
  Target: ATXN1; (+) strand; PAM type: NRG; PAM sequence: GGG
acgccgctgcactcctgcct

SEQ ID NO: 137781 - DNA, 20 bp, Artificial Sequence
  Description of Artificial Sequence: Synthetic oligonucleotide
  Target: ATXN1; (+) strand; PAM type: NRG; PAM sequence: TAG
ctgcactcctgcctgggcaa

SEQ ID NO: 137782 - DNA, 20 bp, Artificial Sequence
  Description of Artificial Sequence: Synthetic oligonucleotide
  Target: ATXN1; (+) strand; PAM type: NRG; PAM sequence: GAG
gcactcctgcctgggcaata

SEQ ID NO: 137783 - DNA, 20 bp, Artificial Sequence
  Description of Artificial Sequence: Synthetic oligonucleotide
  Target: ATXN1; (+) strand; PAM type: NRG; PAM sequence: GAG
actcctgcctgggcaataga

SEQ ID NO: 137784 - DNA, 20 bp, Artificial Sequence
  Description of Artificial Sequence: Synthetic oligonucleotide
  Target: ATXN1; (+) strand; PAM type: NRG; PAM sequence: AAG
tgtctcaaaaaaaaaaaaaa

SEQ ID NO: 137785 - DNA, 20 bp, Artificial Sequence
  Description of Artificial Sequence: Synthetic oligonucleotide
  Target: ATXN1; (+) strand; PAM type: NRG; PAM sequence: TAG
ctcatgtttctaaaaacatt

SEQ ID NO: 137786 - DNA, 20 bp, Artificial Sequence
  Description of Artificial Sequence: Synthetic oligonucleotide
  Target: ATXN1; (+) strand; PAM type: NRG; PAM sequence: TAG
taaaaacatttagtttttat

SEQ ID NO: 137787 - DNA, 20 bp, Artificial Sequence
  Description of Artificial Sequence: Synthetic oligonucleotide
  Target: ATXN1; (+) strand; PAM type: NRG; PAM sequence: AAG
gtttttattagtacttaata

SEQ ID NO: 137788 - DNA, 20 bp, Artificial Sequence
  Description of Artificial Sequence: Synthetic oligonucleotide
  Target: ATXN1; (+) strand; PAM type: NRG; PAM sequence: CAG
ataaagatgatgtctcctct

SEQ ID NO: 137789 - DNA, 20 bp, Artificial Sequence
  Description of Artificial Sequence: Synthetic oligonucleotide
  Target: ATXN1; (+) strand; PAM type: NRG; PAM sequence: TGG
aagatgatgtctcctctcag

SEQ ID NO: 137790 - DNA, 20 bp, Artificial Sequence
  Description of Artificial Sequence: Synthetic oligonucleotide
  Target: ATXN1; (+) strand; PAM type: NRG; PAM sequence: GGG
agatgatgtctcctctcagt

SEQ ID NO: 137791 - DNA, 20 bp, Artificial Sequence
  Description of Artificial Sequence: Synthetic oligonucleotide
  Target: ATXN1; (+) strand; PAM type: NRG; PAM sequence: GGG
gatgatgtctcctctcagtg

SEQ ID NO: 137792 - DNA, 20 bp, Artificial Sequence
  Description of Artificial Sequence: Synthetic oligonucleotide
  Target: ATXN1; (+) strand; PAM type: NRG; PAM sequence: AAG
gtctcctctcagtggggcaa

SEQ ID NO: 137793 - DNA, 20 bp, Artificial Sequence
  Description of Artificial Sequence: Synthetic oligonucleotide
  Target: ATXN1; (+) strand; PAM type: NRG; PAM sequence: GAG
gactaataaatacataatgt

SEQ ID NO: 137794 - DNA, 20 bp, Artificial Sequence
  Description of Artificial Sequence: Synthetic oligonucleotide
  Target: ATXN1; (+) strand; PAM type: NRG; PAM sequence: AAG
actgatctaatatttgacaa

SEQ ID NO: 137795 - DNA, 20 bp, Artificial Sequence
  Description of Artificial Sequence: Synthetic oligonucleotide
  Target: ATXN1; (+) strand; PAM type: NRG; PAM sequence: AAG
ttcattgaatcctcatgtct

SEQ ID NO: 137796 - DNA, 20 bp, Artificial Sequence
  Description of Artificial Sequence: Synthetic oligonucleotide
  Target: ATXN1; (+) strand; PAM type: NRG; PAM sequence: GAG
aaacgataaatataaactat

SEQ ID NO: 137797 - DNA, 20 bp, Artificial Sequence
  Description of Artificial Sequence: Synthetic oligonucleotide
  Target: ATXN1; (+) strand; PAM type: NRG; PAM sequence: AAG
atataaactatgagataata

SEQ ID NO: 137798 - DNA, 20 bp, Artificial Sequence
  Description of Artificial Sequence: Synthetic oligonucleotide
  Target: ATXN1; (+) strand; PAM type: NRG; PAM sequence: TGG
taaagaactacaataaattg

SEQ ID NO: 137799 - DNA, 20 bp, Artificial Sequence
  Description of Artificial Sequence: Synthetic oligonucleotide
  Target: ATXN1; (+) strand; PAM type: NRG; PAM sequence: GGG
aaagaactacaataaattgt

SEQ ID NO: 137800 - DNA, 20 bp, Artificial Sequence
  Description of Artificial Sequence: Synthetic oligonucleotide
  Target: ATXN1; (+) strand; PAM type: NRG; PAM sequence: TAG
tacaataaattgtgggtaaa

SEQ ID NO: 137801 - DNA, 20 bp, Artificial Sequence
  Description of Artificial Sequence: Synthetic oligonucleotide
  Target: ATXN1; (+) strand; PAM type: NRG; PAM sequence: TAG
ggtaaatagttatctgaccc

SEQ ID NO: 137802 - DNA, 20 bp, Artificial Sequence
  Description of Artificial Sequence: Synthetic oligonucleotide
  Target: ATXN1; (+) strand; PAM type: NRG; PAM sequence: TGG
agttatctgaccctagtgaa

SEQ ID NO: 137803 - DNA, 20 bp, Artificial Sequence
  Description of Artificial Sequence: Synthetic oligonucleotide
  Target: ATXN1; (+) strand; PAM type: NRG; PAM sequence: AAG
tatctgaccctagtgaatgg

SEQ ID NO: 137804 - DNA, 20 bp, Artificial Sequence
  Description of Artificial Sequence: Synthetic oligonucleotide
  Target: ATXN1; (+) strand; PAM type: NRG; PAM sequence: AGG
atctgaccctagtgaatgga

SEQ ID NO: 137805 - DNA, 20 bp, Artificial Sequence
  Description of Artificial Sequence: Synthetic oligonucleotide
  Target: ATXN1; (+) strand; PAM type: NRG; PAM sequence: TAG
tagtgaatggaaggcttttc

SEQ ID NO: 137806 - DNA, 20 bp, Artificial Sequence
  Description of Artificial Sequence: Synthetic oligonucleotide
  Target: ATXN1; (+) strand; PAM type: NRG; PAM sequence: AGG
agtgaatggaaggcttttct

SEQ ID NO: 137807 - DNA, 20 bp, Artificial Sequence
  Description of Artificial Sequence: Synthetic oligonucleotide
  Target: ATXN1; (+) strand; PAM type: NRG; PAM sequence: AAG
gaaggcttttctaggtataa

SEQ ID NO: 137808 - DNA, 20 bp, Artificial Sequence
  Description of Artificial Sequence: Synthetic oligonucleotide
  Target: ATXN1; (+) strand; PAM type: NRG; PAM sequence: CAG
aaaaaattaaaaaaaaattg

SEQ ID NO: 137809 - DNA, 20 bp, Artificial Sequence
  Description of Artificial Sequence: Synthetic oligonucleotide
  Target: ATXN1; (+) strand; PAM type: NRG; PAM sequence: AAG
aaaaaattgcagccataaaa

SEQ ID NO: 137810 - DNA, 20 bp, Artificial Sequence
  Description of Artificial Sequence: Synthetic oligonucleotide
  Target: ATXN1; (+) strand; PAM type: NRG; PAM sequence: GAG
ttgcagccataaaaaagaat

SEQ ID NO: 137811 - DNA, 20 bp, Artificial Sequence
  Description of Artificial Sequence: Synthetic oligonucleotide
  Target: ATXN1; (+) strand; PAM type: NRG; PAM sequence: CAG
gaatgagatcatgtccttta

SEQ ID NO: 137812 - DNA, 20 bp, Artificial Sequence
  Description of Artificial Sequence: Synthetic oligonucleotide
  Target: ATXN1; (+) strand; PAM type: NRG; PAM sequence: AGG
aatgagatcatgtcctttac

SEQ ID NO: 137813 - DNA, 20 bp, Artificial Sequence
  Description of Artificial Sequence: Synthetic oligonucleotide
  Target: ATXN1; (+) strand; PAM type: NRG; PAM sequence: GGG
atgagatcatgtcctttaca

SEQ ID NO: 137814 - DNA, 20 bp, Artificial Sequence
  Description of Artificial Sequence: Synthetic oligonucleotide
  Target: ATXN1; (+) strand; PAM type: NRG; PAM sequence: TGG
tcatgtcctttacagggaca

SEQ ID NO: 137815 - DNA, 20 bp, Artificial Sequence
  Description of Artificial Sequence: Synthetic oligonucleotide
  Target: ATXN1; (+) strand; PAM type: NRG; PAM sequence: AAG
cctttacagggacatggatg

SEQ ID NO: 137816 - DNA, 20 bp, Artificial Sequence
  Description of Artificial Sequence: Synthetic oligonucleotide
  Target: ATXN1; (+) strand; PAM type: NRG; PAM sequence: TGG
tacagggacatggatgaagc

SEQ ID NO: 137817 - DNA, 20 bp, Artificial Sequence
  Description of Artificial Sequence: Synthetic oligonucleotide
  Target: ATXN1; (+) strand; PAM type: NRG; PAM sequence: CAG
aagctggaaaccatcattct

SEQ ID NO: 137818 - DNA, 20 bp, Artificial Sequence
  Description of Artificial Sequence: Synthetic oligonucleotide
  Target: ATXN1; (+) strand; PAM type: NRG; PAM sequence: CAG
tcattctcagcaaactaacc

SEQ ID NO: 137819 - DNA, 20 bp, Artificial Sequence
  Description of Artificial Sequence: Synthetic oligonucleotide
  Target: ATXN1; (+) strand; PAM type: NRG; PAM sequence: AGG
cattctcagcaaactaaccc

SEQ ID NO: 137820 - DNA, 20 bp, Artificial Sequence
  Description of Artificial Sequence: Synthetic oligonucleotide
  Target: ATXN1; (+) strand; PAM type: NRG; PAM sequence: CAG
tcagcaaactaacccaggaa

SEQ ID NO: 137821 - DNA, 20 bp, Artificial Sequence
  Description of Artificial Sequence: Synthetic oligonucleotide
  Target: ATXN1; (+) strand; PAM type: NRG; PAM sequence: AAG
caccgcatgttctcactcat

SEQ ID NO: 137822 - DNA, 20 bp, Artificial Sequence
  Description of Artificial Sequence: Synthetic oligonucleotide
  Target: ATXN1; (+) strand; PAM type: NRG; PAM sequence: TGG
cgcatgttctcactcataag

SEQ ID NO: 137823 - DNA, 20 bp, Artificial Sequence
  Description of Artificial Sequence: Synthetic oligonucleotide
  Target: ATXN1; (+) strand; PAM type: NRG; PAM sequence: GGG
gcatgttctcactcataagt

SEQ ID NO: 137824 - DNA, 20 bp, Artificial Sequence
  Description of Artificial Sequence: Synthetic oligonucleotide
  Target: ATXN1; (+) strand; PAM type: NRG; PAM sequence: GAG
atgttctcactcataagtgg

SEQ ID NO: 137825 - DNA, 20 bp, Artificial Sequence
  Description of Artificial Sequence: Synthetic oligonucleotide
  Target: ATXN1; (+) strand; PAM type: NRG; PAM sequence: GAG
ataagtgggagtttaacatt

SEQ ID NO: 137826 - DNA, 20 bp, Artificial Sequence
  Description of Artificial Sequence: Synthetic oligonucleotide
  Target: ATXN1; (+) strand; PAM type: NRG; PAM sequence: TGG
agtttaacattgagaacaca

SEQ ID NO: 137827 - DNA, 20 bp, Artificial Sequence
  Description of Artificial Sequence: Synthetic oligonucleotide
  Target: ATXN1; (+) strand; PAM type: NRG; PAM sequence: CAG
acattgagaacacatggaca

SEQ ID NO: 137828 - DNA, 20 bp, Artificial Sequence
  Description of Artificial Sequence: Synthetic oligonucleotide
  Target: ATXN1; (+) strand; PAM type: NRG; PAM sequence: GAG
attgagaacacatggacaca

SEQ ID NO: 137829 - DNA, 20 bp, Artificial Sequence
  Description of Artificial Sequence: Synthetic oligonucleotide
  Target: ATXN1; (+) strand; PAM type: NRG; PAM sequence: GAG
tgagaacacatggacacaga

SEQ ID NO: 137830 - DNA, 20 bp, Artificial Sequence
  Description of Artificial Sequence: Synthetic oligonucleotide
  Target: ATXN1; (+) strand; PAM type: NRG; PAM sequence: AGG
gagaacacatggacacagag

SEQ ID NO: 137831 - DNA, 20 bp, Artificial Sequence
  Description of Artificial Sequence: Synthetic oligonucleotide
  Target: ATXN1; (+) strand; PAM type: NRG; PAM sequence: GGG
agaacacatggacacagaga

SEQ ID NO: 137832 - DNA, 20 bp, Artificial Sequence
  Description of Artificial Sequence: Synthetic oligonucleotide
  Target: ATXN1; (+) strand; PAM type: NRG; PAM sequence: GGG
gaacacatggacacagagag

SEQ ID NO: 137833 - DNA, 20 bp, Artificial Sequence
  Description of Artificial Sequence: Synthetic oligonucleotide
  Target: ATXN1; (+) strand; PAM type: NRG; PAM sequence: CGG
gagaggggaacatcacacac

SEQ ID NO: 137834 - DNA, 20 bp, Artificial Sequence
  Description of Artificial Sequence: Synthetic oligonucleotide
  Target: ATXN1; (+) strand; PAM type: NRG; PAM sequence: GGG
agaggggaacatcacacacc

SEQ ID NO: 137835 - DNA, 20 bp, Artificial Sequence
  Description of Artificial Sequence: Synthetic oligonucleotide
  Target: ATXN1; (+) strand; PAM type: NRG; PAM sequence: GGG
gaggggaacatcacacaccg

SEQ ID NO: 137836 - DNA, 20 bp, Artificial Sequence
  Description of Artificial Sequence: Synthetic oligonucleotide
  Target: ATXN1; (+) strand; PAM type: NRG; PAM sequence: CGG
catcacacaccggggcctgt

SEQ ID NO: 137837 - DNA, 20 bp, Artificial Sequence
  Description of Artificial Sequence: Synthetic oligonucleotide
  Target: ATXN1; (+) strand; PAM type: NRG; PAM sequence: GAG
tcacacaccggggcctgtcg

SEQ ID NO: 137838 - DNA, 20 bp, Artificial Sequence
  Description of Artificial Sequence: Synthetic oligonucleotide
  Target: ATXN1; (+) strand; PAM type: NRG; PAM sequence: AGG
cacacaccggggcctgtcgg

SEQ ID NO: 137839 - DNA, 20 bp, Artificial Sequence
  Description of Artificial Sequence: Synthetic oligonucleotide
  Target: ATXN1; (+) strand; PAM type: NRG; PAM sequence: GGG
acacaccggggcctgtcgga

SEQ ID NO: 137840 - DNA, 20 bp, Artificial Sequence
  Description of Artificial Sequence: Synthetic oligonucleotide
  Target: ATXN1; (+) strand; PAM type: NRG; PAM sequence: GAG
acaccggggcctgtcggagg

SEQ ID NO: 137841 - DNA, 20 bp, Artificial Sequence
  Description of Artificial Sequence: Synthetic oligonucleotide
  Target: ATXN1; (+) strand; PAM type: NRG; PAM sequence: AGG
caccggggcctgtcggaggg

SEQ ID NO: 137842 - DNA, 20 bp, Artificial Sequence
  Description of Artificial Sequence: Synthetic oligonucleotide
  Target: ATXN1; (+) strand; PAM type: NRG; PAM sequence: GGG
accggggcctgtcggaggga

SEQ ID NO: 137843 - DNA, 20 bp, Artificial Sequence
  Description of Artificial Sequence: Synthetic oligonucleotide
  Target: ATXN1; (+) strand; PAM type: NRG; PAM sequence: AAG
ggcctgtcggagggagggac

SEQ ID NO: 137844 - DNA, 20 bp, Artificial Sequence
  Description of Artificial Sequence: Synthetic oligonucleotide
  Target: ATXN1; (+) strand; PAM type: NRG; PAM sequence: AGG
gcctgtcggagggagggaca

SEQ ID NO: 137845 - DNA, 20 bp, Artificial Sequence
  Description of Artificial Sequence: Synthetic oligonucleotide
  Target: ATXN1; (+) strand; PAM type: NRG; PAM sequence: GGG
cctgtcggagggagggacaa

SEQ ID NO: 137846 - DNA, 20 bp, Artificial Sequence
  Description of Artificial Sequence: Synthetic oligonucleotide
  Target: ATXN1; (+) strand; PAM type: NRG; PAM sequence: GGG
ctgtcggagggagggacaag

SEQ ID NO: 137847 - DNA, 20 bp, Artificial Sequence
  Description of Artificial Sequence: Synthetic oligonucleotide
  Target: ATXN1; (+) strand; PAM type: NRG; PAM sequence: GAG
gtcggagggagggacaaggg

SEQ ID NO: 137848 - DNA, 20 bp, Artificial Sequence
  Description of Artificial Sequence: Synthetic oligonucleotide
  Target: ATXN1; (+) strand; PAM type: NRG; PAM sequence: AGG
tcggagggagggacaagggg

SEQ ID NO: 137849 - DNA, 20 bp, Artificial Sequence
  Description of Artificial Sequence: Synthetic oligonucleotide
  Target: ATXN1; (+) strand; PAM type: NRG; PAM sequence: AAG
gagggagggacaaggggagg

SEQ ID NO: 137850 - DNA, 20 bp, Artificial Sequence
  Description of Artificial Sequence: Synthetic oligonucleotide
  Target: ATXN1; (+) strand; PAM type: NRG; PAM sequence: GAG
gggagggacaaggggaggaa

SEQ ID NO: 137851 - DNA, 20 bp, Artificial Sequence
  Description of Artificial Sequence: Synthetic oligonucleotide
  Target: ATXN1; (+) strand; PAM type: NRG; PAM sequence: AAG
acaaggggaggaagagtgtt

SEQ ID NO: 137852 - DNA, 20 bp, Artificial Sequence
  Description of Artificial Sequence: Synthetic oligonucleotide
  Target: ATXN1; (+) strand; PAM type: NRG; PAM sequence: CAG
agacaaataccgaatgcatg

SEQ ID NO: 137853 - DNA, 20 bp, Artificial Sequence
  Description of Artificial Sequence: Synthetic oligonucleotide
  Target: ATXN1; (+) strand; PAM type: NRG; PAM sequence: AGG
gacaaataccgaatgcatgc

SEQ ID NO: 137854 - DNA, 20 bp, Artificial Sequence
  Description of Artificial Sequence: Synthetic oligonucleotide
  Target: ATXN1; (+) strand; PAM type: NRG; PAM sequence: GGG
acaaataccgaatgcatgca

SEQ ID NO: 137855 - DNA, 20 bp, Artificial Sequence
  Description of Artificial Sequence: Synthetic oligonucleotide
  Target: ATXN1; (+) strand; PAM type: NRG; PAM sequence: TAG
tgcatgcagggcttaaaacc

SEQ ID NO: 137856 - DNA, 20 bp, Artificial Sequence
  Description of Artificial Sequence: Synthetic oligonucleotide
  Target: ATXN1; (+) strand; PAM type: NRG; PAM sequence: CAG
agggcttaaaacctagatga

SEQ ID NO: 137857 - DNA, 20 bp, Artificial Sequence
  Description of Artificial Sequence: Synthetic oligonucleotide
  Target: ATXN1; (+) strand; PAM type: NRG; PAM sequence: AGG
gggcttaaaacctagatgac

SEQ ID NO: 137858 - DNA, 20 bp, Artificial Sequence
  Description of Artificial Sequence: Synthetic oligonucleotide
  Target: ATXN1; (+) strand; PAM type: NRG; PAM sequence: TAG
aaacctagatgacaggttga

SEQ ID NO: 137859 - DNA, 20 bp, Artificial Sequence
  Description of Artificial Sequence: Synthetic oligonucleotide
  Target: ATXN1; (+) strand; PAM type: NRG; PAM sequence: AGG
aacctagatgacaggttgat

SEQ ID NO: 137860 - DNA, 20 bp, Artificial Sequence
  Description of Artificial Sequence: Synthetic oligonucleotide
  Target: ATXN1; (+) strand; PAM type: NRG; PAM sequence: CAG
agatgacaggttgataggta

SEQ ID NO: 137861 - DNA, 20 bp, Artificial Sequence
  Description of Artificial Sequence: Synthetic oligonucleotide
  Target: ATXN1; (+) strand; PAM type: NRG; PAM sequence: TGG
ataggtacagcaaaccacta

SEQ ID NO: 137862 - DNA, 20 bp, Artificial Sequence
  Description of Artificial Sequence: Synthetic oligonucleotide
  Target: ATXN1; (+) strand; PAM type: NRG; PAM sequence: AAG
tacctatgtaacaaacctgc

SEQ ID NO: 137863 - DNA, 20 bp, Artificial Sequence
  Description of Artificial Sequence: Synthetic oligonucleotide
  Target: ATXN1; (+) strand; PAM type: NRG; PAM sequence: CAG
caagttctgcacgtgtatcc

SEQ ID NO: 137864 - DNA, 20 bp, Artificial Sequence
  Description of Artificial Sequence: Synthetic oligonucleotide
  Target: ATXN1; (+) strand; PAM type: NRG; PAM sequence: AAG
cacgtgtatcccagaactta

SEQ ID NO: 137865 - DNA, 20 bp, Artificial Sequence
  Description of Artificial Sequence: Synthetic oligonucleotide
  Target: ATXN1; (+) strand; PAM type: NRG; PAM sequence: AAG
aagtaaaacaaacaaaacaa

SEQ ID NO: 137866 - DNA, 20 bp, Artificial Sequence
  Description of Artificial Sequence: Synthetic oligonucleotide
  Target: ATXN1; (+) strand; PAM type: NRG; PAM sequence: CAG
acaaacaaaacaaaagaatt

SEQ ID NO: 137867 - DNA, 20 bp, Artificial Sequence
  Description of Artificial Sequence: Synthetic oligonucleotide
  Target: ATXN1; (+) strand; PAM type: NRG; PAM sequence: AGG
caaacaaaacaaaagaattc

SEQ ID NO: 137868 - DNA, 20 bp, Artificial Sequence
  Description of Artificial Sequence: Synthetic oligonucleotide
  Target: ATXN1; (+) strand; PAM type: NRG; PAM sequence: CAG
acaaaacaaaagaattcagg

SEQ ID NO: 137869 - DNA, 20 bp, Artificial Sequence
  Description of Artificial Sequence: Synthetic oligonucleotide
  Target: ATXN1; (+) strand; PAM type: NRG; PAM sequence: AGG
caaaacaaaagaattcaggc

SEQ ID NO: 137870 - DNA, 20 bp, Artificial Sequence
  Description of Artificial Sequence: Synthetic oligonucleotide
  Target: ATXN1; (+) strand; PAM type: NRG; PAM sequence: GGG
aaaacaaaagaattcaggca

SEQ ID NO: 137871 - DNA, 20 bp, Artificial Sequence
  Description of Artificial Sequence: Synthetic oligonucleotide
  Target: ATXN1; (+) strand; PAM type: NRG; PAM sequence: TGG
aaaagaattcaggcagggtg

SEQ ID NO: 137872 - DNA, 20 bp, Artificial Sequence
  Description of Artificial Sequence: Synthetic oligonucleotide
  Target: ATXN1; (+) strand; PAM type: NRG; PAM sequence: TGG
agaattcaggcagggtgtgg

SEQ ID NO: 137873 - DNA, 20 bp, Artificial Sequence
  Description of Artificial Sequence: Synthetic oligonucleotide
  Target: ATXN1; (+) strand; PAM type: NRG; PAM sequence: CAG
gtggctcatgcctgtaatcc

SEQ ID NO: 137874 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccagcactt

SEQ ID NO: 137875 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagcacttt

SEQ ID NO: 137876 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 137877 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 137878 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggcc

SEQ ID NO: 137879 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggccg

SEQ ID NO: 137880 - DNA, 20 bp, Artificial Sequence
  Description of Artificial Sequence: Synthetic oligonucleotide
  Target: ATXN1; (+) strand; PAM type: NRG; PAM sequence: CAG
agcactttgggaggccgagg

SEQ ID NO: 137881 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccgaggcaga

SEQ ID NO: 137882 - DNA, 20 bp, Artificial Sequence
  Description of Artificial Sequence: Synthetic oligonucleotide
  Target: ATXN1; (+) strand; PAM type: NRG; PAM sequence: GAG
ccgaggcagatggatcacct

SEQ ID NO: 137883 - DNA, 20 bp, Artificial Sequence
  Description of Artificial Sequence: Synthetic oligonucleotide
  Target: ATXN1; (+) strand; PAM type: NRG; PAM sequence: AGG
cgaggcagatggatcacctg

SEQ ID NO: 137884 - DNA, 20 bp, Artificial Sequence
  Description of Artificial Sequence: Synthetic oligonucleotide
  Target: ATXN1; (+) strand; PAM type: NRG; PAM sequence: GAG
gatggatcacctgaggtcac

SEQ ID NO: 137885 - DNA, 20 bp, Artificial Sequence
  Description of Artificial Sequence: Synthetic oligonucleotide
  Target: ATXN1; (+) strand; PAM type: NRG; PAM sequence: CAG
tgaggtcacgagttcgtgac

SEQ ID NO: 137886 - DNA, 20 bp, Artificial Sequence
  Description of Artificial Sequence: Synthetic oligonucleotide
  Target: ATXN1; (+) strand; PAM type: NRG; PAM sequence: TGG
tcacgagttcgtgaccagcc

SEQ ID NO: 137887 - DNA, 20 bp, Artificial Sequence
  Description of Artificial Sequence: Synthetic oligonucleotide
  Target: ATXN1; (+) strand; PAM type: NRG; PAM sequence: TGG
cgtgaccagcctggccaaca

SEQ ID NO: 137888 - DNA, 20 bp, Artificial Sequence
  Description of Artificial Sequence: Synthetic oligonucleotide
  Target: ATXN1; (+) strand; PAM type: NRG; PAM sequence: AAG
cccatctctactaaaaatac

SEQ ID NO: 137889 - DNA, 20 bp, Artificial Sequence
  Description of Artificial Sequence: Synthetic oligonucleotide
  Target: ATXN1; (+) strand; PAM type: NRG; PAM sequence: TAG
ctactaaaaatacaagaaat

SEQ ID NO: 137890 - DNA, 20 bp, Artificial Sequence
  Description of Artificial Sequence: Synthetic oligonucleotide
  Target: ATXN1; (+) strand; PAM type: NRG; PAM sequence: TGG
taaaaatacaagaaattagc

SEQ ID NO: 137891 - DNA, 20 bp, Artificial Sequence
  Description of Artificial Sequence: Synthetic oligonucleotide
  Target: ATXN1; (+) strand; PAM type: NRG; PAM sequence: TGG
tacaagaaattagctggacg

SEQ ID NO: 137892 - DNA, 20 bp, Artificial Sequence
  Description of Artificial Sequence: Synthetic oligonucleotide
  Target: ATXN1; (+) strand; PAM type: NRG; PAM sequence: TGG
aagaaattagctggacgtgg

SEQ ID NO: 137893 - DNA, 20 bp, Artificial Sequence
  Description of Artificial Sequence: Synthetic oligonucleotide
  Target: ATXN1; (+) strand; PAM type: NRG; PAM sequence: TAG
gacgtggtggtacacacctg

SEQ ID NO: 137894 - DNA, 20 bp, Artificial Sequence
  Description of Artificial Sequence: Synthetic oligonucleotide
  Target: ATXN1; (+) strand; PAM type: NRG; PAM sequence: TGG
ggtggtacacacctgtagtc

SEQ ID NO: 137895 - DNA, 20 bp, Artificial Sequence
  Description of Artificial Sequence: Synthetic oligonucleotide
  Target: ATXN1; (+) strand; PAM type: NRG; PAM sequence: GAG
tggtacacacctgtagtctg

SEQ ID NO: 137896 - DNA, 20 bp, Artificial Sequence
  Description of Artificial Sequence: Synthetic oligonucleotide
  Target: ATXN1; (+) strand; PAM type: NRG; PAM sequence: AGG
ggtacacacctgtagtctgg

SEQ ID NO: 137897 - DNA, 20 bp, Artificial Sequence
  Description of Artificial Sequence: Synthetic oligonucleotide
  Target: ATXN1; (+) strand; PAM type: NRG; PAM sequence: AAG
cacctgtagtctggaggctg

SEQ ID NO: 137898 - DNA, 20 bp, Artificial Sequence
  Description of Artificial Sequence: Synthetic oligonucleotide
  Target: ATXN1; (+) strand; PAM type: NRG; PAM sequence: CAG
ctgtagtctggaggctgaag

SEQ ID NO: 137899 - DNA, 20 bp, Artificial Sequence
  Description of Artificial Sequence: Synthetic oligonucleotide
  Target: ATXN1; (+) strand; PAM type: NRG; PAM sequence: AGG
tgtagtctggaggctgaagc

SEQ ID NO: 137900 - DNA, 20 bp, Artificial Sequence
  Description of Artificial Sequence: Synthetic oligonucleotide
  Target: ATXN1; (+) strand; PAM type: NRG; PAM sequence: GAG
tagtctggaggctgaagcag

SEQ ID NO: 137901 - DNA, 20 bp, Artificial Sequence
  Description of Artificial Sequence: Synthetic oligonucleotide
  Target: ATXN1; (+) strand; PAM type: NRG; PAM sequence: CGG
gcaggagaatcgcttgaacc

SEQ ID NO: 137902 - DNA, 20 bp, Artificial Sequence
  Description of Artificial Sequence: Synthetic oligonucleotide
  Target: ATXN1; (+) strand; PAM type: NRG; PAM sequence: GGG
caggagaatcgcttgaaccc

SEQ ID NO: 137903 - DNA, 20 bp, Artificial Sequence
  Description of Artificial Sequence: Synthetic oligonucleotide
  Target: ATXN1; (+) strand; PAM type: NRG; PAM sequence: GAG
ggagaatcgcttgaacccgg

SEQ ID NO: 137904 - DNA, 20 bp, Artificial Sequence
  Description of Artificial Sequence: Synthetic oligonucleotide
  Target: ATXN1; (+) strand; PAM type: NRG; PAM sequence: AGG
gagaatcgcttgaacccggg

SEQ ID NO: 137905 - DNA, 20 bp, Artificial Sequence
  Description of Artificial Sequence: Synthetic oligonucleotide
  Target: ATXN1; (+) strand; PAM type: NRG; PAM sequence: CGG
aatcgcttgaacccgggagg

SEQ ID NO: 137906 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaacccgggaggcg

SEQ ID NO: 137907 - DNA, 20 bp, Artificial Sequence
  Description of Artificial Sequence: Synthetic oligonucleotide
  Target: ATXN1; (+) strand; PAM type: NRG; PAM sequence: AGG
cgcttgaacccgggaggcgg

SEQ ID NO: 137908 - DNA, 20 bp, Artificial Sequence
  Description of Artificial Sequence: Synthetic oligonucleotide
  Target: ATXN1; (+) strand; PAM type: NRG; PAM sequence: CAG
aacccgggaggcggaggttg

SEQ ID NO: 137909 - DNA, 20 bp, Artificial Sequence
  Description of Artificial Sequence: Synthetic oligonucleotide
  Target: ATXN1; (+) strand; PAM type: NRG; PAM sequence: GAG
cgggaggcggaggttgcagt

SEQ ID NO: 137910 - DNA, 20 bp, Artificial Sequence
  Description of Artificial Sequence: Synthetic oligonucleotide
  Target: ATXN1; (+) strand; PAM type: NRG; PAM sequence: AAG
ggcggaggttgcagtgagcc

SEQ ID NO: 137911 - DNA, 20 bp, Artificial Sequence
  Description of Artificial Sequence: Synthetic oligonucleotide
  Target: ATXN1; (+) strand; PAM type: NRG; PAM sequence: CAG
aagatcgtgccactgcactg

SEQ ID NO: 137912 - DNA, 20 bp, Artificial Sequence
  Description of Artificial Sequence: Synthetic oligonucleotide
  Target: ATXN1; (+) strand; PAM type: NRG; PAM sequence: TGG
cgtgccactgcactgcagcc

SEQ ID NO: 137913 - DNA, 20 bp, Artificial Sequence
  Description of Artificial Sequence: Synthetic oligonucleotide
  Target: ATXN1; (+) strand; PAM type: NRG; PAM sequence: GGG
gtgccactgcactgcagcct

SEQ ID NO: 137914 - DNA, 20 bp, Artificial Sequence
  Description of Artificial Sequence: Synthetic oligonucleotide
  Target: ATXN1; (+) strand; PAM type: NRG; PAM sequence: TGG
ccactgcactgcagcctggg

SEQ ID NO: 137915 - DNA, 20 bp, Artificial Sequence
  Description of Artificial Sequence: Synthetic oligonucleotide
  Target: ATXN1; (+) strand; PAM type: NRG; PAM sequence: CAG
ctgcactgcagcctgggtgg

SEQ ID NO: 137916 - DNA, 20 bp, Artificial Sequence
  Description of Artificial Sequence: Synthetic oligonucleotide
  Target: ATXN1; (+) strand; PAM type: NRG; PAM sequence: GAG
gcactgcagcctgggtggca

SEQ ID NO: 137917 - DNA, 20 bp, Artificial Sequence
  Description of Artificial Sequence: Synthetic oligonucleotide
  Target: ATXN1; (+) strand; PAM type: NRG; PAM sequence: GAG
tgcagcctgggtggcagagc

SEQ ID NO: 137918 - DNA, 20 bp, Artificial Sequence
  Description of Artificial Sequence: Synthetic oligonucleotide
  Target: ATXN1; (+) strand; PAM type: NRG; PAM sequence: AAG
gtctcaaaaaaaaaaaaaaa

SEQ ID NO: 137919 - DNA, 20 bp, Artificial Sequence
  Description of Artificial Sequence: Synthetic oligonucleotide
  Target: ATXN1; (+) strand; PAM type: NRG; PAM sequence: AGG
tctcaaaaaaaaaaaaaaaa

SEQ ID NO: 137920 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaaaggattcaactg

SEQ ID NO: 137921 - DNA, 20 bp, Artificial Sequence
  Description of Artificial Sequence: Synthetic oligonucleotide
  Target: ATXN1; (+) strand; PAM type: NRG; PAM sequence: GGG
aaaaaaaaggattcaactgt

SEQ ID NO: 137922 - DNA, 20 bp, Artificial Sequence
  Description of Artificial Sequence: Synthetic oligonucleotide
  Target: ATXN1; (+) strand; PAM type: NRG; PAM sequence: AAG
tcaactgtgggaaaaaaaaa

SEQ ID NO: 137923 - DNA, 20 bp, Artificial Sequence
  Description of Artificial Sequence: Synthetic oligonucleotide
  Target: ATXN1; (+) strand; PAM type: NRG; PAM sequence: CAG
tattaatatgcttgactaca

SEQ ID NO: 137924 - DNA, 20 bp, Artificial Sequence
  Description of Artificial Sequence: Synthetic oligonucleotide
  Target: ATXN1; (+) strand; PAM type: NRG; PAM sequence: AAG
ttgtaaataaaaatcaacgt

SEQ ID NO: 137925 - DNA, 20 bp, Artificial Sequence
  Description of Artificial Sequence: Synthetic oligonucleotide
  Target: ATXN1; (+) strand; PAM type: NRG; PAM sequence: AAG
atcaacgtaagtaaaattca

SEQ ID NO: 137926 - DNA, 20 bp, Artificial Sequence
  Description of Artificial Sequence: Synthetic oligonucleotide
  Target: ATXN1; (+) strand; PAM type: NRG; PAM sequence: AGG
tcaacgtaagtaaaattcaa

SEQ ID NO: 137927 - DNA, 20 bp, Artificial Sequence
  Description of Artificial Sequence: Synthetic oligonucleotide
  Target: ATXN1; (+) strand; PAM type: NRG; PAM sequence: AAG
aaattcaaaggaaaatatca

SEQ ID NO: 137928 - DNA, 20 bp, Artificial Sequence
  Description of Artificial Sequence: Synthetic oligonucleotide
  Target: ATXN1; (+) strand; PAM type: NRG; PAM sequence: TGG
ttcaaaggaaaatatcaaag

SEQ ID NO: 137929 - DNA, 20 bp, Artificial Sequence
  Description of Artificial Sequence: Synthetic oligonucleotide
  Target: ATXN1; (+) strand; PAM type: NRG; PAM sequence: GGG
tcaaaggaaaatatcaaagt

SEQ ID NO: 137930 - DNA, 20 bp, Artificial Sequence
  Description of Artificial Sequence: Synthetic oligonucleotide
  Target: ATXN1; (+) strand; PAM type: NRG; PAM sequence: AAG
atttccaataccattaaaca

SEQ ID NO: 137931 - DNA, 20 bp, Artificial Sequence
  Description of Artificial Sequence: Synthetic oligonucleotide
  Target: ATXN1; (+) strand; PAM type: NRG; PAM sequence: GAG
ttccaataccattaaacaaa

SEQ ID NO: 137932 - DNA, 20 bp, Artificial Sequence
  Description of Artificial Sequence: Synthetic oligonucleotide
  Target: ATXN1; (+) strand; PAM type: NRG; PAM sequence: GAG
aaataaatacatgtaattgt

SEQ ID NO: 137933 - DNA, 20 bp, Artificial Sequence
  Description of Artificial Sequence: Synthetic oligonucleotide
  Target: ATXN1; (+) strand; PAM type: NRG; PAM sequence: AAG
atacatgtaattgtgagtaa

SEQ ID NO: 137934 - DNA, 20 bp, Artificial Sequence
  Description of Artificial Sequence: Synthetic oligonucleotide
  Target: ATXN1; (+) strand; PAM type: NRG; PAM sequence: AGG
tacatgtaattgtgagtaaa

SEQ ID NO: 137935 - DNA, 20 bp, Artificial Sequence
  Description of Artificial Sequence: Synthetic oligonucleotide
  Target: ATXN1; (+) strand; PAM type: NRG; PAM sequence: AAG
agtaaaaggaaaaactttct

SEQ ID NO: 137936 - DNA, 20 bp, Artificial Sequence
  Description of Artificial Sequence: Synthetic oligonucleotide
  Target: ATXN1; (+) strand; PAM type: NRG; PAM sequence: AAG
aaactttctaagacaaaaat

SEQ ID NO: 137937 - DNA, 20 bp, Artificial Sequence
  Description of Artificial Sequence: Synthetic oligonucleotide
  Target: ATXN1; (+) strand; PAM type: NRG; PAM sequence: TGG
aaataagcaatgaacacgaa

SEQ ID NO: 137938 - DNA, 20 bp, Artificial Sequence
  Description of Artificial Sequence: Synthetic oligonucleotide
  Target: ATXN1; (+) strand; PAM type: NRG; PAM sequence: AAG
cacgaatggccaatttaaaa

SEQ ID NO: 137939 - DNA, 20 bp, Artificial Sequence
  Description of Artificial Sequence: Synthetic oligonucleotide
  Target: ATXN1; (+) strand; PAM type: NRG; PAM sequence: CAG
taaaaaagaaatgtaaaaaa

SEQ ID NO: 137940 - DNA, 20 bp, Artificial Sequence
  Description of Artificial Sequence: Synthetic oligonucleotide
  Target: ATXN1; (+) strand; PAM type: NRG; PAM sequence: GAG
aaaaagaaatgtaaaaaaca

SEQ ID NO: 137941 - DNA, 20 bp, Artificial Sequence
  Description of Artificial Sequence: Synthetic oligonucleotide
  Target: ATXN1; (+) strand; PAM type: NRG; PAM sequence: AAG
tgtaaaaaacagagaaacat

SEQ ID NO: 137942 - DNA, 20 bp, Artificial Sequence
  Description of Artificial Sequence: Synthetic oligonucleotide
  Target: ATXN1; (+) strand; PAM type: NRG; PAM sequence: AGG
gtaaaaaacagagaaacata

SEQ ID NO: 137943 - DNA, 20 bp, Artificial Sequence
  Description of Artificial Sequence: Synthetic oligonucleotide
  Target: ATXN1; (+) strand; PAM type: NRG; PAM sequence: AAG
acttgaaactacactaaaaa

SEQ ID NO: 137944 - DNA, 20 bp, Artificial Sequence
  Description of Artificial Sequence: Synthetic oligonucleotide
  Target: ATXN1; (+) strand; PAM type: NRG; PAM sequence: AAG
taaaaaaagcaaattaaaac

SEQ ID NO: 137945 - DNA, 20 bp, Artificial Sequence
  Description of Artificial Sequence: Synthetic oligonucleotide
  Target: ATXN1; (+) strand; PAM type: NRG; PAM sequence: TGG
taatttttaacttatcaaat

SEQ ID NO: 137946 - DNA, 20 bp, Artificial Sequence
  Description of Artificial Sequence: Synthetic oligonucleotide
  Target: ATXN1; (+) strand; PAM type: NRG; PAM sequence: CAG
tttttaacttatcaaattgg

SEQ ID NO: 137947 - DNA, 20 bp, Artificial Sequence
  Description of Artificial Sequence: Synthetic oligonucleotide
  Target: ATXN1; (+) strand; PAM type: NRG; PAM sequence: GAG
tttaacttatcaaattggca

SEQ ID NO: 137948 - DNA, 20 bp, Artificial Sequence
  Description of Artificial Sequence: Synthetic oligonucleotide
  Target: ATXN1; (+) strand; PAM type: NRG; PAM sequence: CAG
gtttcttttttttttaatta

SEQ ID NO: 137949 - DNA, 20 bp, Artificial Sequence
  Description of Artificial Sequence: Synthetic oligonucleotide
  Target: ATXN1; (+) strand; PAM type: NRG; PAM sequence: TAG
ttttttttaattacagtact

SEQ ID NO: 137950 - DNA, 20 bp, Artificial Sequence
  Description of Artificial Sequence: Synthetic oligonucleotide
  Target: ATXN1; (+) strand; PAM type: NRG; PAM sequence: CAG
ttacagtacttagtgttgtc

SEQ ID NO: 137951 - DNA, 20 bp, Artificial Sequence
  Description of Artificial Sequence: Synthetic oligonucleotide
  Target: ATXN1; (+) strand; PAM type: NRG; PAM sequence: GAG
acagtacttagtgttgtcca

SEQ ID NO: 137952 - DNA, 20 bp, Artificial Sequence
  Description of Artificial Sequence: Synthetic oligonucleotide
  Target: ATXN1; (+) strand; PAM type: NRG; PAM sequence: CAG
acttagtgttgtccagagtg

SEQ ID NO: 137953 - DNA, 20 bp, Artificial Sequence
  Description of Artificial Sequence: Synthetic oligonucleotide
  Target: ATXN1; (+) strand; PAM type: NRG; PAM sequence: TGG
cacatgaacgttctttgtca

SEQ ID NO: 137954 - DNA, 20 bp, Artificial Sequence
  Description of Artificial Sequence: Synthetic oligonucleotide
  Target: ATXN1; (+) strand; PAM type: NRG; PAM sequence: TGG
tgaacgttctttgtcatggt

SEQ ID NO: 137955 - DNA, 20 bp, Artificial Sequence
  Description of Artificial Sequence: Synthetic oligonucleotide
  Target: ATXN1; (+) strand; PAM type: NRG; PAM sequence: AAG
cgttctttgtcatggttggc

SEQ ID NO: 137956 - DNA, 20 bp, Artificial Sequence
  Description of Artificial Sequence: Synthetic oligonucleotide
  Target: ATXN1; (+) strand; PAM type: NRG; PAM sequence: AAG
gtcatggttggcaagtgctc

SEQ ID NO: 137957 - DNA, 20 bp, Artificial Sequence
  Description of Artificial Sequence: Synthetic oligonucleotide
  Target: ATXN1; (+) strand; PAM type: NRG; PAM sequence: AAG
atggttggcaagtgctcaag

SEQ ID NO: 137958 - DNA, 20 bp, Artificial Sequence
  Description of Artificial Sequence: Synthetic oligonucleotide
  Target: ATXN1; (+) strand; PAM type: NRG; PAM sequence: GAG
ggttggcaagtgctcaagaa

SEQ ID NO: 137959 - DNA, 20 bp, Artificial Sequence
  Description of Artificial Sequence: Synthetic oligonucleotide
  Target: ATXN1; (+) strand; PAM type: NRG; PAM sequence: AAG
aatttaataacacatatcaa

SEQ ID NO: 137960 - DNA, 20 bp, Artificial Sequence
  Description of Artificial Sequence: Synthetic oligonucleotide
  Target: ATXN1; (+) strand; PAM type: NRG; PAM sequence: AAG
cacatatcaaaagccttata

SEQ ID NO: 137961 - DNA, 20 bp, Artificial Sequence
  Description of Artificial Sequence: Synthetic oligonucleotide
  Target: ATXN1; (+) strand; PAM type: NRG; PAM sequence: AGG
acatatcaaaagccttataa

SEQ ID NO: 137962 - DNA, 20 bp, Artificial Sequence
  Description of Artificial Sequence: Synthetic oligonucleotide
  Target: ATXN1; (+) strand; PAM type: NRG; PAM sequence: GGG
catatcaaaagccttataaa

SEQ ID NO: 137963 - DNA, 20 bp, Artificial Sequence
  Description of Artificial Sequence: Synthetic oligonucleotide
  Target: ATXN1; (+) strand; PAM type: NRG; PAM sequence: GAG
tataaagggccttactattt

SEQ ID NO: 137964 - DNA, 20 bp, Artificial Sequence
  Description of Artificial Sequence: Synthetic oligonucleotide
  Target: ATXN1; (+) strand; PAM type: NRG; PAM sequence: CAG
ggccttactatttgagccac

SEQ ID NO: 137965 - DNA, 20 bp, Artificial Sequence
  Description of Artificial Sequence: Synthetic oligonucleotide
  Target: ATXN1; (+) strand; PAM type: NRG; PAM sequence: TAG
actatttgagccaccagctc

SEQ ID NO: 137966 - DNA, 20 bp, Artificial Sequence
  Description of Artificial Sequence: Synthetic oligonucleotide
  Target: ATXN1; (+) strand; PAM type: NRG; PAM sequence: TGG
tgagccaccagctctagttc

SEQ ID NO: 137967 - DNA, 20 bp, Artificial Sequence
  Description of Artificial Sequence: Synthetic oligonucleotide
  Target: ATXN1; (+) strand; PAM type: NRG; PAM sequence: AAG
tagttctggaaatttatcct

SEQ ID NO: 137968 - DNA, 20 bp, Artificial Sequence
  Description of Artificial Sequence: Synthetic oligonucleotide
  Target: ATXN1; (+) strand; PAM type: NRG; PAM sequence: AGG
agttctggaaatttatccta

SEQ ID NO: 137969 - DNA, 20 bp, Artificial Sequence
  Description of Artificial Sequence: Synthetic oligonucleotide
  Target: ATXN1; (+) strand; PAM type: NRG; PAM sequence: CAG
atttatcctaaggaaacaac

SEQ ID NO: 137970 - DNA, 20 bp, Artificial Sequence
  Description of Artificial Sequence: Synthetic oligonucleotide
  Target: ATXN1; (+) strand; PAM type: NRG; PAM sequence: GAG
ttatcctaaggaaacaacca

SEQ ID NO: 137971 - DNA, 20 bp, Artificial Sequence
  Description of Artificial Sequence: Synthetic oligonucleotide
  Target: ATXN1; (+) strand; PAM type: NRG; PAM sequence: AAG
acaaccagagatgttgaaaa

SEQ ID NO: 137972 - DNA, 20 bp, Artificial Sequence
  Description of Artificial Sequence: Synthetic oligonucleotide
  Target: ATXN1; (+) strand; PAM type: NRG; PAM sequence: AAG
gaaaaaagatatatatgttc

SEQ ID NO: 137973 - DNA, 20 bp, Artificial Sequence
  Description of Artificial Sequence: Synthetic oligonucleotide
  Target: ATXN1; (+) strand; PAM type: NRG; PAM sequence: AAG
aaaagatatatatgttcaag

SEQ ID NO: 137974 - DNA, 20 bp, Artificial Sequence
  Description of Artificial Sequence: Synthetic oligonucleotide
  Target: ATXN1; (+) strand; PAM type: NRG; PAM sequence: CAG
atatatatgttcaagaagtc

SEQ ID NO: 137975 - DNA, 20 bp, Artificial Sequence
  Description of Artificial Sequence: Synthetic oligonucleotide
  Target: ATXN1; (+) strand; PAM type: NRG; PAM sequence: CAG
tatgttcaagaagtccagca

SEQ ID NO: 137976 - DNA, 20 bp, Artificial Sequence
  Description of Artificial Sequence: Synthetic oligonucleotide
  Target: ATXN1; (+) strand; PAM type: NRG; PAM sequence: TAG
agcacagcatcactaaacga

SEQ ID NO: 137977 - DNA, 20 bp, Artificial Sequence
  Description of Artificial Sequence: Synthetic oligonucleotide
  Target: ATXN1; (+) strand; PAM type: NRG; PAM sequence: TGG
ctaaacgatagcacaatatc

SEQ ID NO: 137978 - DNA, 20 bp, Artificial Sequence
  Description of Artificial Sequence: Synthetic oligonucleotide
  Target: ATXN1; (+) strand; PAM type: NRG; PAM sequence: TAG
atatctggaaaattaaatgc

SEQ ID NO: 137979 - DNA, 20 bp, Artificial Sequence
  Description of Artificial Sequence: Synthetic oligonucleotide
  Target: ATXN1; (+) strand; PAM type: NRG; PAM sequence: TAG
aaaattaaatgctagataaa

SEQ ID NO: 137980 - DNA, 20 bp, Artificial Sequence
  Description of Artificial Sequence: Synthetic oligonucleotide
  Target: ATXN1; (+) strand; PAM type: NRG; PAM sequence: TGG
aatgctagataaatagatta

SEQ ID NO: 137981 - DNA, 20 bp, Artificial Sequence
  Description of Artificial Sequence: Synthetic oligonucleotide
  Target: ATXN1; (+) strand; PAM type: NRG; PAM sequence: TGG
ctagataaatagattatgga

SEQ ID NO: 137982 - DNA, 20 bp, Artificial Sequence
  Description of Artificial Sequence: Synthetic oligonucleotide
  Target: ATXN1; (+) strand; PAM type: NRG; PAM sequence: CAG
tagattatggatggaaatta

SEQ ID NO: 137983 - DNA, 20 bp, Artificial Sequence
  Description of Artificial Sequence: Synthetic oligonucleotide
  Target: ATXN1; (+) strand; PAM type: NRG; PAM sequence: GAG
atggaaattacagtatctat

SEQ ID NO: 137984 - DNA, 20 bp, Artificial Sequence
  Description of Artificial Sequence: Synthetic oligonucleotide
  Target: ATXN1; (+) strand; PAM type: NRG; PAM sequence: TAG
gagtgatgtaaaacttacga

SEQ ID NO: 137985 - DNA, 20 bp, Artificial Sequence
  Description of Artificial Sequence: Synthetic oligonucleotide
  Target: ATXN1; (+) strand; PAM type: NRG; PAM sequence: AGG
agtgatgtaaaacttacgat

SEQ ID NO: 137986 - DNA, 20 bp, Artificial Sequence
  Description of Artificial Sequence: Synthetic oligonucleotide
  Target: ATXN1; (+) strand; PAM type: NRG; PAM sequence: AAG
taaaacttacgataggccct

SEQ ID NO: 137987 - DNA, 20 bp, Artificial Sequence
  Description of Artificial Sequence: Synthetic oligonucleotide
  Target: ATXN1; (+) strand; PAM type: NRG; PAM sequence: TGG
ggccctaagatcacactgtg

SEQ ID NO: 137988 - DNA, 20 bp, Artificial Sequence
  Description of Artificial Sequence: Synthetic oligonucleotide
  Target: ATXN1; (+) strand; PAM type: NRG; PAM sequence: GGG
gccctaagatcacactgtgt

SEQ ID NO: 137989 - DNA, 20 bp, Artificial Sequence
  Description of Artificial Sequence: Synthetic oligonucleotide
  Target: ATXN1; (+) strand; PAM type: NRG; PAM sequence: CAG
gtgtgggcttgaaaatcaca

SEQ ID NO: 137990 - DNA, 20 bp, Artificial Sequence
  Description of Artificial Sequence: Synthetic oligonucleotide
  Target: ATXN1; (+) strand; PAM type: NRG; PAM sequence: CAG
tgggcttgaaaatcacacag

SEQ ID NO: 137991 - DNA, 20 bp, Artificial Sequence
  Description of Artificial Sequence: Synthetic oligonucleotide
  Target: ATXN1; (+) strand; PAM type: NRG; PAM sequence: CAG
agcagcatgtttacaatata

SEQ ID NO: 137992 - DNA, 20 bp, Artificial Sequence
  Description of Artificial Sequence: Synthetic oligonucleotide
  Target: ATXN1; (+) strand; PAM type: NRG; PAM sequence: TGG
gtttacaatatacagacccc

SEQ ID NO: 137993 - DNA, 20 bp, Artificial Sequence
  Description of Artificial Sequence: Synthetic oligonucleotide
  Target: ATXN1; (+) strand; PAM type: NRG; PAM sequence: CAG
tacagacccctggtaaatat

SEQ ID NO: 137994 - DNA, 20 bp, Artificial Sequence
  Description of Artificial Sequence: Synthetic oligonucleotide
  Target: ATXN1; (+) strand; PAM type: NRG; PAM sequence: AGG
acagacccctggtaaatatc

SEQ ID NO: 137995 - DNA, 20 bp, Artificial Sequence
  Description of Artificial Sequence: Synthetic oligonucleotide
  Target: ATXN1; (+) strand; PAM type: NRG; PAM sequence: CAG
gacccctggtaaatatcagg

SEQ ID NO: 137996 - DNA, 20 bp, Artificial Sequence
  Description of Artificial Sequence: Synthetic oligonucleotide
  Target: ATXN1; (+) strand; PAM type: NRG; PAM sequence: TAG
cctggtaaatatcaggcagc

SEQ ID NO: 137997 - DNA, 20 bp, Artificial Sequence
  Description of Artificial Sequence: Synthetic oligonucleotide
  Target: ATXN1; (+) strand; PAM type: NRG; PAM sequence: CAG
tcaggcagctagctcacaaa

SEQ ID NO: 137998 - DNA, 20 bp, Artificial Sequence
  Description of Artificial Sequence: Synthetic oligonucleotide
  Target: ATXN1; (+) strand; PAM type: NRG; PAM sequence: CAG
ctagctcacaaacagtaaat

SEQ ID NO: 137999 - DNA, 20 bp, Artificial Sequence
  Description of Artificial Sequence: Synthetic oligonucleotide
  Target: ATXN1; (+) strand; PAM type: NRG; PAM sequence: CAG
acagtaaatcagcatgatcc

SEQ ID NO: 138000 - DNA, 20 bp, Artificial Sequence
  Description of Artificial Sequence: Synthetic oligonucleotide
  Target: ATXN1; (+) strand; PAM type: NRG; PAM sequence: TAG
agttaaaaaatctatatgac

SEQ ID NO: 138001 - DNA, 20 bp, Artificial Sequence
  Description of Artificial Sequence: Synthetic oligonucleotide
  Target: ATXN1; (+) strand; PAM type: NRG; PAM sequence: GAG
ttaaaaaatctatatgacta

SEQ ID NO: 138002 - DNA, 20 bp, Artificial Sequence
  Description of Artificial Sequence: Synthetic oligonucleotide
  Target: ATXN1; (+) strand; PAM type: NRG; PAM sequence: CAG
tgcattcttttctgtatttc

SEQ ID NO: 138003 - DNA, 20 bp, Artificial Sequence
  Description of Artificial Sequence: Synthetic oligonucleotide
  Target: ATXN1; (+) strand; PAM type: NRG; PAM sequence: CAG
atatacatcccttctgtgat

SEQ ID NO: 138004 - DNA, 20 bp, Artificial Sequence
  Description of Artificial Sequence: Synthetic oligonucleotide
  Target: ATXN1; (+) strand; PAM type: NRG; PAM sequence: AGG
tatacatcccttctgtgatc

SEQ ID NO: 138005 - DNA, 20 bp, Artificial Sequence
  Description of Artificial Sequence: Synthetic oligonucleotide
  Target: ATXN1; (+) strand; PAM type: NRG; PAM sequence: GGG
atacatcccttctgtgatca

SEQ ID NO: 138006 - DNA, 20 bp, Artificial Sequence
  Description of Artificial Sequence: Synthetic oligonucleotide
  Target: ATXN1; (+) strand; PAM type: NRG; PAM sequence: TGG
gggaaacaataaacaatttc

SEQ ID NO: 138007 - DNA, 20 bp, Artificial Sequence
  Description of Artificial Sequence: Synthetic oligonucleotide
  Target: ATXN1; (+) strand; PAM type: NRG; PAM sequence: GGG
ggaaacaataaacaatttct

SEQ ID NO: 138008 - DNA, 20 bp, Artificial Sequence
  Description of Artificial Sequence: Synthetic oligonucleotide
  Target: ATXN1; (+) strand; PAM type: NRG; PAM sequence: GGG
gaaacaataaacaatttctg

SEQ ID NO: 138009 - DNA, 20 bp, Artificial Sequence
  Description of Artificial Sequence: Synthetic oligonucleotide
  Target: ATXN1; (+) strand; PAM type: NRG; PAM sequence: TGG
acaatttctggggcatgccc

SEQ ID NO: 138010 - DNA, 20 bp, Artificial Sequence
  Description of Artificial Sequence: Synthetic oligonucleotide
  Target: ATXN1; (+) strand; PAM type: NRG; PAM sequence: GAG
aatttctggggcatgccctg

SEQ ID NO: 138011 - DNA, 20 bp, Artificial Sequence
  Description of Artificial Sequence: Synthetic oligonucleotide
  Target: ATXN1; (+) strand; PAM type: NRG; PAM sequence: CAG
tctggggcatgccctggagt

SEQ ID NO: 138012 - DNA, 20 bp, Artificial Sequence
  Description of Artificial Sequence: Synthetic oligonucleotide
  Target: ATXN1; (+) strand; PAM type: NRG; PAM sequence: TGG
tgccctggagtcagactgct

SEQ ID NO: 138013 - DNA, 20 bp, Artificial Sequence
  Description of Artificial Sequence: Synthetic oligonucleotide
  Target: ATXN1; (+) strand; PAM type: NRG; PAM sequence: TAG
gactgcttggattcaaatca

SEQ ID NO: 138014 - DNA, 20 bp, Artificial Sequence
  Description of Artificial Sequence: Synthetic oligonucleotide
  Target: ATXN1; (+) strand; PAM type: NRG; PAM sequence: TAG
ggattcaaatcatagctcta

SEQ ID NO: 138015 - DNA, 20 bp, Artificial Sequence
  Description of Artificial Sequence: Synthetic oligonucleotide
  Target: ATXN1; (+) strand; PAM type: NRG; PAM sequence: TGG
catagctctatagccatgcg

SEQ ID NO: 138016 - DNA, 20 bp, Artificial Sequence
  Description of Artificial Sequence: Synthetic oligonucleotide
  Target: ATXN1; (+) strand; PAM type: NRG; PAM sequence: TAG
atgcgtggcaacatgcacta

SEQ ID NO: 138017 - DNA, 20 bp, Artificial Sequence
  Description of Artificial Sequence: Synthetic oligonucleotide
  Target: ATXN1; (+) strand; PAM type: NRG; PAM sequence: CAG
ggcaacatgcactatagtcc

SEQ ID NO: 138018 - DNA, 20 bp, Artificial Sequence
  Description of Artificial Sequence: Synthetic oligonucleotide
  Target: ATXN1; (+) strand; PAM type: NRG; PAM sequence: CAG
gcactatagtcccagctaca

SEQ ID NO: 138019 - DNA, 20 bp, Artificial Sequence
  Description of Artificial Sequence: Synthetic oligonucleotide
  Target: ATXN1; (+) strand; PAM type: NRG; PAM sequence: AGG
cactatagtcccagctacac

SEQ ID NO: 138020 - DNA, 20 bp, Artificial Sequence
  Description of Artificial Sequence: Synthetic oligonucleotide
  Target: ATXN1; (+) strand; PAM type: NRG; PAM sequence: GAG
ctatagtcccagctacacag

SEQ ID NO: 138021 - DNA, 20 bp, Artificial Sequence
  Description of Artificial Sequence: Synthetic oligonucleotide
  Target: ATXN1; (+) strand; PAM type: NRG; PAM sequence: AGG
tatagtcccagctacacagg

SEQ ID NO: 138022 - DNA, 20 bp, Artificial Sequence
  Description of Artificial Sequence: Synthetic oligonucleotide
  Target: ATXN1; (+) strand; PAM type: NRG; PAM sequence: GAG
tcccagctacacaggaggct

SEQ ID NO: 138023 - DNA, 20 bp, Artificial Sequence
  Description of Artificial Sequence: Synthetic oligonucleotide
  Target: ATXN1; (+) strand; PAM type: NRG; PAM sequence: AGG
cccagctacacaggaggctg

SEQ ID NO: 138024 - DNA, 20 bp, Artificial Sequence
  Description of Artificial Sequence: Synthetic oligonucleotide
  Target: ATXN1; (+) strand; PAM type: NRG; PAM sequence: GGG
ccagctacacaggaggctga

SEQ ID NO: 138025 - DNA, 20 bp, Artificial Sequence
  Description of Artificial Sequence: Synthetic oligonucleotide
  Target: ATXN1; (+) strand; PAM type: NRG; PAM sequence: GGG
cagctacacaggaggctgag

SEQ ID NO: 138026 - DNA, 20 bp, Artificial Sequence
  Description of Artificial Sequence: Synthetic oligonucleotide
  Target: ATXN1; (+) strand; PAM type: NRG; PAM sequence: AAG
tacacaggaggctgaggggc

SEQ ID NO: 138027 - DNA, 20 bp, Artificial Sequence
  Description of Artificial Sequence: Synthetic oligonucleotide
  Target: ATXN1; (+) strand; PAM type: NRG; PAM sequence: AGG
acacaggaggctgaggggca

SEQ ID NO: 138028 - DNA, 20 bp, Artificial Sequence
  Description of Artificial Sequence: Synthetic oligonucleotide
  Target: ATXN1; (+) strand; PAM type: NRG; PAM sequence: GAG
ctgaggggcaaggatcgctt

SEQ ID NO: 138029 - DNA, 20 bp, Artificial Sequence
  Description of Artificial Sequence: Synthetic oligonucleotide
  Target: ATXN1; (+) strand; PAM type: NRG; PAM sequence: CAG
gggcaaggatcgcttgagcc

SEQ ID NO: 138030 - DNA, 20 bp, Artificial Sequence
  Description of Artificial Sequence: Synthetic oligonucleotide
  Target: ATXN1; (+) strand; PAM type: NRG; PAM sequence: AGG
ggcaaggatcgcttgagccc

SEQ ID NO: 138031 - DNA, 20 bp, Artificial Sequence
  Description of Artificial Sequence: Synthetic oligonucleotide
  Target: ATXN1; (+) strand; PAM type: NRG; PAM sequence: GAG
caaggatcgcttgagcccag

SEQ ID NO: 138032 - DNA, 20 bp, Artificial Sequence
  Description of Artificial Sequence: Synthetic oligonucleotide
  Target: ATXN1; (+) strand; PAM type: NRG; PAM sequence: TGG
gatcgcttgagcccaggagt

SEQ ID NO: 138033 - DNA, 20 bp, Artificial Sequence
  Description of Artificial Sequence: Synthetic oligonucleotide
  Target: ATXN1; (+) strand; PAM type: NRG; PAM sequence: GAG
tcgcttgagcccaggagttg

SEQ ID NO: 138034 - DNA, 20 bp, Artificial Sequence
  Description of Artificial Sequence: Synthetic oligonucleotide
  Target: ATXN1; (+) strand; PAM type: NRG; PAM sequence: AGG
cgcttgagcccaggagttgg

SEQ ID NO: 138035 - DNA, 20 bp, Artificial Sequence
  Description of Artificial Sequence: Synthetic oligonucleotide
  Target: ATXN1; (+) strand; PAM type: NRG; PAM sequence: CAG
tgagcccaggagttggaggc

SEQ ID NO: 138036 - DNA, 20 bp, Artificial Sequence
  Description of Artificial Sequence: Synthetic oligonucleotide
  Target: ATXN1; (+) strand; PAM type: NRG; PAM sequence: GAG
caggagttggaggccagcct

SEQ ID NO: 138037 - DNA, 20 bp, Artificial Sequence
  Description of Artificial Sequence: Synthetic oligonucleotide
  Target: ATXN1; (+) strand; PAM type: NRG; PAM sequence: GAG
gccagcctgagcaacataat

SEQ ID NO: 138038 - DNA, 20 bp, Artificial Sequence
  Description of Artificial Sequence: Synthetic oligonucleotide
  Target: ATXN1; (+) strand; PAM type: NRG; PAM sequence: AAG
cataatgagactccgtctct

SEQ ID NO: 138039 - DNA, 20 bp, Artificial Sequence
  Description of Artificial Sequence: Synthetic oligonucleotide
  Target: ATXN1; (+) strand; PAM type: NRG; PAM sequence: AGG
ataatgagactccgtctcta

SEQ ID NO: 138040 - DNA, 20 bp, Artificial Sequence
  Description of Artificial Sequence: Synthetic oligonucleotide
  Target: ATXN1; (+) strand; PAM type: NRG; PAM sequence: GGG
taatgagactccgtctctaa

SEQ ID NO: 138041 - DNA, 20 bp, Artificial Sequence
  Description of Artificial Sequence: Synthetic oligonucleotide
  Target: ATXN1; (+) strand; PAM type: NRG; PAM sequence: AAG
gtctctaagggaaaaaaaaa

SEQ ID NO: 138042 - DNA, 20 bp, Artificial Sequence
  Description of Artificial Sequence: Synthetic oligonucleotide
  Target: ATXN1; (+) strand; PAM type: NRG; PAM sequence: TAG
aaaaagaaaaaaaaaaaaca

SEQ ID NO: 138043 - DNA, 20 bp, Artificial Sequence
  Description of Artificial Sequence: Synthetic oligonucleotide
  Target: ATXN1; (+) strand; PAM type: NRG; PAM sequence: AAG
aaacatagctctatcacttt

SEQ ID NO: 138044 - DNA, 20 bp, Artificial Sequence
  Description of Artificial Sequence: Synthetic oligonucleotide
  Target: ATXN1; (+) strand; PAM type: NRG; PAM sequence: TGG
cactttaagatctgccacct

SEQ ID NO: 138045 - DNA, 20 bp, Artificial Sequence
  Description of Artificial Sequence: Synthetic oligonucleotide
  Target: ATXN1; (+) strand; PAM type: NRG; PAM sequence: GGG
actttaagatctgccacctt

SEQ ID NO: 138046 - DNA, 20 bp, Artificial Sequence
  Description of Artificial Sequence: Synthetic oligonucleotide
  Target: ATXN1; (+) strand; PAM type: NRG; PAM sequence: AAG
taagatctgccaccttgggc

SEQ ID NO: 138047 - DNA, 20 bp, Artificial Sequence
  Description of Artificial Sequence: Synthetic oligonucleotide
  Target: ATXN1; (+) strand; PAM type: NRG; PAM sequence: GAG
gcaagttgcttatcctctct

SEQ ID NO: 138048 - DNA, 20 bp, Artificial Sequence
  Description of Artificial Sequence: Synthetic oligonucleotide
  Target: ATXN1; (+) strand; PAM type: NRG; PAM sequence: TGG
caacttcctgttctgtcaaa

SEQ ID NO: 138049 - DNA, 20 bp, Artificial Sequence
  Description of Artificial Sequence: Synthetic oligonucleotide
  Target: ATXN1; (+) strand; PAM type: NRG; PAM sequence: GGG
aacttcctgttctgtcaaat

SEQ ID NO: 138050 - DNA, 20 bp, Artificial Sequence
  Description of Artificial Sequence: Synthetic oligonucleotide
  Target: ATXN1; (+) strand; PAM type: NRG; PAM sequence: GGG
acttcctgttctgtcaaatg

SEQ ID NO: 138051 - DNA, 20 bp, Artificial Sequence
  Description of Artificial Sequence: Synthetic oligonucleotide
  Target: ATXN1; (+) strand; PAM type: NRG; PAM sequence: TGG
ggctaataacactatgctgt

SEQ ID NO: 138052 - DNA, 20 bp, Artificial Sequence
  Description of Artificial Sequence: Synthetic oligonucleotide
  Target: ATXN1; (+) strand; PAM type: NRG; PAM sequence: GGG
gctaataacactatgctgtt

SEQ ID NO: 138053 - DNA, 20 bp, Artificial Sequence
  Description of Artificial Sequence: Synthetic oligonucleotide
  Target: ATXN1; (+) strand; PAM type: NRG; PAM sequence: TGG
actatgctgttgggctgctg

SEQ ID NO: 138054 - DNA, 20 bp, Artificial Sequence
  Description of Artificial Sequence: Synthetic oligonucleotide
  Target: ATXN1; (+) strand; PAM type: NRG; PAM sequence: AAG
ttgaattttacatgtatgta

SEQ ID NO: 138055 - DNA, 20 bp, Artificial Sequence
  Description of Artificial Sequence: Synthetic oligonucleotide
  Target: ATXN1; (+) strand; PAM type: NRG; PAM sequence: TAG
ttacatgtatgtaaagcact

SEQ ID NO: 138056 - DNA, 20 bp, Artificial Sequence
  Description of Artificial Sequence: Synthetic oligonucleotide
  Target: ATXN1; (+) strand; PAM type: NRG; PAM sequence: CAG
tgtatgtaaagcacttagta

SEQ ID NO: 138057 - DNA, 20 bp, Artificial Sequence
  Description of Artificial Sequence: Synthetic oligonucleotide
  Target: ATXN1; (+) strand; PAM type: NRG; PAM sequence: TGG
aaagcacttagtacagcatc

SEQ ID NO: 138058 - DNA, 20 bp, Artificial Sequence
  Description of Artificial Sequence: Synthetic oligonucleotide
  Target: ATXN1; (+) strand; PAM type: NRG; PAM sequence: AAG
tacagcatctggaccataat

SEQ ID NO: 138059 - DNA, 20 bp, Artificial Sequence
  Description of Artificial Sequence: Synthetic oligonucleotide
  Target: ATXN1; (+) strand; PAM type: NRG; PAM sequence: GAG
cagcatctggaccataataa

SEQ ID NO: 138060 - DNA, 20 bp, Artificial Sequence
  Description of Artificial Sequence: Synthetic oligonucleotide
  Target: ATXN1; (+) strand; PAM type: NRG; PAM sequence: TAG
aataagagctcattatatat

SEQ ID NO: 138061 - DNA, 20 bp, Artificial Sequence
  Description of Artificial Sequence: Synthetic oligonucleotide
  Target: ATXN1; (+) strand; PAM type: NRG; PAM sequence: CAG
ccccctcaaccaaactttta

SEQ ID NO: 138062 - DNA, 20 bp, Artificial Sequence
  Description of Artificial Sequence: Synthetic oligonucleotide
  Target: ATXN1; (+) strand; PAM type: NRG; PAM sequence: TAG
cctcaaccaaacttttacag

SEQ ID NO: 138063 - DNA, 20 bp, Artificial Sequence
  Description of Artificial Sequence: Synthetic oligonucleotide
  Target: ATXN1; (+) strand; PAM type: NRG; PAM sequence: AGG
ctcaaccaaacttttacagt

SEQ ID NO: 138064 - DNA, 20 bp, Artificial Sequence
  Description of Artificial Sequence: Synthetic oligonucleotide
  Target: ATXN1; (+) strand; PAM type: NRG; PAM sequence: GAG
caaccaaacttttacagtag

SEQ ID NO: 138065 - DNA, 20 bp, Artificial Sequence
  Description of Artificial Sequence: Synthetic oligonucleotide
  Target: ATXN1; (+) strand; PAM type: NRG; PAM sequence: TAG
ccttgatcttatttctatgc

SEQ ID NO: 138066 - DNA, 20 bp, Artificial Sequence
  Description of Artificial Sequence: Synthetic oligonucleotide
  Target: ATXN1; (+) strand; PAM type: NRG; PAM sequence: GAG
ttgatcttatttctatgcta

SEQ ID NO: 138067 - DNA, 20 bp, Artificial Sequence
  Description of Artificial Sequence: Synthetic oligonucleotide
  Target: ATXN1; (+) strand; PAM type: NRG; PAM sequence: AGG
tgatcttatttctatgctag

SEQ ID NO: 138068 - DNA, 20 bp, Artificial Sequence
  Description of Artificial Sequence: Synthetic oligonucleotide
  Target: ATXN1; (+) strand; PAM type: NRG; PAM sequence: AAG
ttatttctatgctagaggaa

SEQ ID NO: 138069 - DNA, 20 bp, Artificial Sequence
  Description of Artificial Sequence: Synthetic oligonucleotide
  Target: ATXN1; (+) strand; PAM type: NRG; PAM sequence: CAG
tttctatgctagaggaaaag

SEQ ID NO: 138070 - DNA, 20 bp, Artificial Sequence
  Description of Artificial Sequence: Synthetic oligonucleotide
  Target: ATXN1; (+) strand; PAM type: NRG; PAM sequence: TAG
ctatgctagaggaaaagcag

SEQ ID NO: 138071 - DNA, 20 bp, Artificial Sequence
  Description of Artificial Sequence: Synthetic oligonucleotide
  Target: ATXN1; (+) strand; PAM type: NRG; PAM sequence: AAG
aggaaaagcagtagtcttca

SEQ ID NO: 138072 - DNA, 20 bp, Artificial Sequence
  Description of Artificial Sequence: Synthetic oligonucleotide
  Target: ATXN1; (+) strand; PAM type: NRG; PAM sequence: AGG
ggaaaagcagtagtcttcaa

SEQ ID NO: 138073 - DNA, 20 bp, Artificial Sequence
  Description of Artificial Sequence: Synthetic oligonucleotide
  Target: ATXN1; (+) strand; PAM type: NRG; PAM sequence: CAG
cacacacacacacacacaca

SEQ ID NO: 138074 - DNA, 20 bp, Artificial Sequence
  Description of Artificial Sequence: Synthetic oligonucleotide
  Target: ATXN1; (+) strand; PAM type: NRG; PAM sequence: TAG
ccaaccataatctatttatc

SEQ ID NO: 138075 - DNA, 20 bp, Artificial Sequence
  Description of Artificial Sequence: Synthetic oligonucleotide
  Target: ATXN1; (+) strand; PAM type: NRG; PAM sequence: CAG
ttatctagcattcaattctc

SEQ ID NO: 138076 - DNA, 20 bp, Artificial Sequence
  Description of Artificial Sequence: Synthetic oligonucleotide
  Target: ATXN1; (+) strand; PAM type: NRG; PAM sequence: TAG
ccagatattgtgctatcgtt

SEQ ID NO: 138077 - DNA, 20 bp, Artificial Sequence
  Description of Artificial Sequence: Synthetic oligonucleotide
  Target: ATXN1; (+) strand; PAM type: NRG; PAM sequence: TGG
atcgtttagtgatgctgtgc

SEQ ID NO: 138078 - DNA, 20 bp, Artificial Sequence
  Description of Artificial Sequence: Synthetic oligonucleotide
  Target: ATXN1; (+) strand; PAM type: NRG; PAM sequence: TGG
atatcttttttcaacatctc

SEQ ID NO: 138079 - DNA, 20 bp, Artificial Sequence
  Description of Artificial Sequence: Synthetic oligonucleotide
  Target: ATXN1; (+) strand; PAM type: NRG; PAM sequence: TAG
aacatctctggttgtttcct

SEQ ID NO: 138080 - DNA, 20 bp, Artificial Sequence
  Description of Artificial Sequence: Synthetic oligonucleotide
  Target: ATXN1; (+) strand; PAM type: NRG; PAM sequence: AGG
acatctctggttgtttcctt

SEQ ID NO: 138081 - DNA, 20 bp, Artificial Sequence
  Description of Artificial Sequence: Synthetic oligonucleotide
  Target: ATXN1; (+) strand; PAM type: NRG; PAM sequence: CAG
ctcacacacacatacacaca

SEQ ID NO: 138082 - DNA, 20 bp, Artificial Sequence
  Description of Artificial Sequence: Synthetic oligonucleotide
  Target: ATXN1; (+) strand; PAM type: NRG; PAM sequence: CAG
cacacacatacacacacaga

SEQ ID NO: 138083 - DNA, 20 bp, Artificial Sequence
  Description of Artificial Sequence: Synthetic oligonucleotide
  Target: ATXN1; (+) strand; PAM type: NRG; PAM sequence: GAG
cacacatacacacacagaca

SEQ ID NO: 138084 - DNA, 20 bp, Artificial Sequence
  Description of Artificial Sequence: Synthetic oligonucleotide
  Target: ATXN1; (+) strand; PAM type: NRG; PAM sequence: GAG
cacatacacacacagacaga

SEQ ID NO: 138085 - DNA, 20 bp, Artificial Sequence
  Description of Artificial Sequence: Synthetic oligonucleotide
  Target: ATXN1; (+) strand; PAM type: NRG; PAM sequence: GAG
catacacacacagacagaga

SEQ ID NO: 138086 - DNA, 20 bp, Artificial Sequence
  Description of Artificial Sequence: Synthetic oligonucleotide
  Target: ATXN1; (+) strand; PAM type: NRG; PAM sequence: GAG
tacacacacagacagagaga

SEQ ID NO: 138087 - DNA, 20 bp, Artificial Sequence
  Description of Artificial Sequence: Synthetic oligonucleotide
  Target: ATXN1; (+) strand; PAM type: NRG; PAM sequence: GAG
cacacacagacagagagaga

SEQ ID NO: 138088 - DNA, 20 bp, Artificial Sequence
  Description of Artificial Sequence: Synthetic oligonucleotide
  Target: ATXN1; (+) strand; PAM type: NRG; PAM sequence: AAG
cagacagagagagagagatg

SEQ ID NO: 138089 - DNA, 20 bp, Artificial Sequence
  Description of Artificial Sequence: Synthetic oligonucleotide
  Target: ATXN1; (+) strand; PAM type: NRG; PAM sequence: TAG
agatgaagattctcatatcc

SEQ ID NO: 138090 - DNA, 20 bp, Artificial Sequence
  Description of Artificial Sequence: Synthetic oligonucleotide
  Target: ATXN1; (+) strand; PAM type: NRG; PAM sequence: AGG
gatgaagattctcatatcct

SEQ ID NO: 138091 - DNA, 20 bp, Artificial Sequence
  Description of Artificial Sequence: Synthetic oligonucleotide
  Target: ATXN1; (+) strand; PAM type: NRG; PAM sequence: AAG
ttctcatatcctaggatcct

SEQ ID NO: 138092 - DNA, 20 bp, Artificial Sequence
  Description of Artificial Sequence: Synthetic oligonucleotide
  Target: ATXN1; (+) strand; PAM type: NRG; PAM sequence: TGG
atcctaggatcctaagaaat

SEQ ID NO: 138093 - DNA, 20 bp, Artificial Sequence
  Description of Artificial Sequence: Synthetic oligonucleotide
  Target: ATXN1; (+) strand; PAM type: NRG; PAM sequence: GGG
tcctaggatcctaagaaatt

SEQ ID NO: 138094 - DNA, 20 bp, Artificial Sequence
  Description of Artificial Sequence: Synthetic oligonucleotide
  Target: ATXN1; (+) strand; PAM type: NRG; PAM sequence: GGG
cctaggatcctaagaaattg

SEQ ID NO: 138095 - DNA, 20 bp, Artificial Sequence
  Description of Artificial Sequence: Synthetic oligonucleotide
  Target: ATXN1; (+) strand; PAM type: NRG; PAM sequence: AAG
aatctttaatatgcatcttt

SEQ ID NO: 138096 - DNA, 20 bp, Artificial Sequence
  Description of Artificial Sequence: Synthetic oligonucleotide
  Target: ATXN1; (+) strand; PAM type: NRG; PAM sequence: AGG
atctttaatatgcatcttta

SEQ ID NO: 138097 - DNA, 20 bp, Artificial Sequence
  Description of Artificial Sequence: Synthetic oligonucleotide
  Target: ATXN1; (+) strand; PAM type: NRG; PAM sequence: GAG
ctttaatatgcatctttaag

SEQ ID NO: 138098 - DNA, 20 bp, Artificial Sequence
  Description of Artificial Sequence: Synthetic oligonucleotide
  Target: ATXN1; (+) strand; PAM type: NRG; PAM sequence: GAG
catctttaaggagatcatct

SEQ ID NO: 138099 - DNA, 20 bp, Artificial Sequence
  Description of Artificial Sequence: Synthetic oligonucleotide
  Target: ATXN1; (+) strand; PAM type: NRG; PAM sequence: TGG
ttaaggagatcatctgagtt

SEQ ID NO: 138100 - DNA, 20 bp, Artificial Sequence
  Description of Artificial Sequence: Synthetic oligonucleotide
  Target: ATXN1; (+) strand; PAM type: NRG; PAM sequence: AAG
catctgagtttggtcaaccc

SEQ ID NO: 138101 - DNA, 20 bp, Artificial Sequence
  Description of Artificial Sequence: Synthetic oligonucleotide
  Target: ATXN1; (+) strand; PAM type: NRG; PAM sequence: AAG
agtttggtcaacccaagtcg

SEQ ID NO: 138102 - DNA, 20 bp, Artificial Sequence
  Description of Artificial Sequence: Synthetic oligonucleotide
  Target: ATXN1; (+) strand; PAM type: NRG; PAM sequence: GAG
tttggtcaacccaagtcgaa

SEQ ID NO: 138103 - DNA, 20 bp, Artificial Sequence
  Description of Artificial Sequence: Synthetic oligonucleotide
  Target: ATXN1; (+) strand; PAM type: NRG; PAM sequence: AGG
ttggtcaacccaagtcgaag

SEQ ID NO: 138104 - DNA, 20 bp, Artificial Sequence
  Description of Artificial Sequence: Synthetic oligonucleotide
  Target: ATXN1; (+) strand; PAM type: NRG; PAM sequence: AAG
tcgaagaggtacgttatata

SEQ ID NO: 138105 - DNA, 20 bp, Artificial Sequence
  Description of Artificial Sequence: Synthetic oligonucleotide
  Target: ATXN1; (+) strand; PAM type: NRG; PAM sequence: AAG
aagaggtacgttatataaag

SEQ ID NO: 138106 - DNA, 20 bp, Artificial Sequence
  Description of Artificial Sequence: Synthetic oligonucleotide
  Target: ATXN1; (+) strand; PAM type: NRG; PAM sequence: TAG
ggtacgttatataaagaagc

SEQ ID NO: 138107 - DNA, 20 bp, Artificial Sequence
  Description of Artificial Sequence: Synthetic oligonucleotide
  Target: ATXN1; (+) strand; PAM type: NRG; PAM sequence: AAG
ataaagaagctagatgatct

SEQ ID NO: 138108 - DNA, 20 bp, Artificial Sequence
  Description of Artificial Sequence: Synthetic oligonucleotide
  Target: ATXN1; (+) strand; PAM type: NRG; PAM sequence: CAG
agctagatgatctaagaaaa

SEQ ID NO: 138109 - DNA, 20 bp, Artificial Sequence
  Description of Artificial Sequence: Synthetic oligonucleotide
  Target: ATXN1; (+) strand; PAM type: NRG; PAM sequence: GAG
ctagatgatctaagaaaaca

SEQ ID NO: 138110 - DNA, 20 bp, Artificial Sequence
  Description of Artificial Sequence: Synthetic oligonucleotide
  Target: ATXN1; (+) strand; PAM type: NRG; PAM sequence: AGG
tagatgatctaagaaaacag

SEQ ID NO: 138111 - DNA, 20 bp, Artificial Sequence
  Description of Artificial Sequence: Synthetic oligonucleotide
  Target: ATXN1; (+) strand; PAM type: NRG; PAM sequence: CAG
aaacagaggttgttgatcat

SEQ ID NO: 138112 - DNA, 20 bp, Artificial Sequence
  Description of Artificial Sequence: Synthetic oligonucleotide
  Target: ATXN1; (+) strand; PAM type: NRG; PAM sequence: TGG
agaggttgttgatcatcagt

SEQ ID NO: 138113 - DNA, 20 bp, Artificial Sequence
  Description of Artificial Sequence: Synthetic oligonucleotide
  Target: ATXN1; (+) strand; PAM type: NRG; PAM sequence: AAG
gcccatatatgcccccccaa

SEQ ID NO: 138114 - DNA, 20 bp, Artificial Sequence
  Description of Artificial Sequence: Synthetic oligonucleotide
  Target: ATXN1; (+) strand; PAM type: NRG; PAM sequence: AGG
cccatatatgcccccccaaa

SEQ ID NO: 138115 - DNA, 20 bp, Artificial Sequence
  Description of Artificial Sequence: Synthetic oligonucleotide
  Target: ATXN1; (+) strand; PAM type: NRG; PAM sequence: TAG
tatgcccccccaaaaggctt

SEQ ID NO: 138116 - DNA, 20 bp, Artificial Sequence
  Description of Artificial Sequence: Synthetic oligonucleotide
  Target: ATXN1; (+) strand; PAM type: NRG; PAM sequence: TGG
caaaaggctttagccctcca

SEQ ID NO: 138117 - DNA, 20 bp, Artificial Sequence
  Description of Artificial Sequence: Synthetic oligonucleotide
  Target: ATXN1; (+) strand; PAM type: NRG; PAM sequence: CAG
ggctttagccctccatggca

SEQ ID NO: 138118 - DNA, 20 bp, Artificial Sequence
  Description of Artificial Sequence: Synthetic oligonucleotide
  Target: ATXN1; (+) strand; PAM type: NRG; PAM sequence: AGG
gctttagccctccatggcac

SEQ ID NO: 138119 - DNA, 20 bp, Artificial Sequence
  Description of Artificial Sequence: Synthetic oligonucleotide
  Target: ATXN1; (+) strand; PAM type: NRG; PAM sequence: CAG
ccatggcacaggtgtattta

SEQ ID NO: 138120 - DNA, 20 bp, Artificial Sequence
  Description of Artificial Sequence: Synthetic oligonucleotide
  Target: ATXN1; (+) strand; PAM type: NRG; PAM sequence: TGG
ggcacaggtgtatttacagc

SEQ ID NO: 138121 - DNA, 20 bp, Artificial Sequence
  Description of Artificial Sequence: Synthetic oligonucleotide
  Target: ATXN1; (+) strand; PAM type: NRG; PAM sequence: GGG
gcacaggtgtatttacagct

SEQ ID NO: 138122 - DNA, 20 bp, Artificial Sequence
  Description of Artificial Sequence: Synthetic oligonucleotide
  Target: ATXN1; (+) strand; PAM type: NRG; PAM sequence: AAG
tatttacagctgggtgtgca

SEQ ID NO: 138123 - DNA, 20 bp, Artificial Sequence
  Description of Artificial Sequence: Synthetic oligonucleotide
  Target: ATXN1; (+) strand; PAM type: NRG; PAM sequence: AAG
agctgggtgtgcaaagtgcc

SEQ ID NO: 138124 - DNA, 20 bp, Artificial Sequence
  Description of Artificial Sequence: Synthetic oligonucleotide
  Target: ATXN1; (+) strand; PAM type: NRG; PAM sequence: AGG
gctgggtgtgcaaagtgcca

SEQ ID NO: 138125 - DNA, 20 bp, Artificial Sequence
  Description of Artificial Sequence: Synthetic oligonucleotide
  Target: ATXN1; (+) strand; PAM type: NRG; PAM sequence: GAG
tgggtgtgcaaagtgccaag

SEQ ID NO: 138126 - DNA, 20 bp, Artificial Sequence
  Description of Artificial Sequence: Synthetic oligonucleotide
  Target: ATXN1; (+) strand; PAM type: NRG; PAM sequence: AGG
gggtgtgcaaagtgccaagg

SEQ ID NO: 138127 - DNA, 20 bp, Artificial Sequence
  Description of Artificial Sequence: Synthetic oligonucleotide
  Target: ATXN1; (+) strand; PAM type: NRG; PAM sequence: TGG
agtgccaaggaggatgccac

SEQ ID NO: 138128 - DNA, 20 bp, Artificial Sequence
  Description of Artificial Sequence: Synthetic oligonucleotide
  Target: ATXN1; (+) strand; PAM type: NRG; PAM sequence: GGG
gtgccaaggaggatgccact

SEQ ID NO: 138129 - DNA, 20 bp, Artificial Sequence
  Description of Artificial Sequence: Synthetic oligonucleotide
  Target: ATXN1; (+) strand; PAM type: NRG; PAM sequence: CAG
aggaggatgccactgggttt

SEQ ID NO: 138130 - DNA, 20 bp, Artificial Sequence
  Description of Artificial Sequence: Synthetic oligonucleotide
  Target: ATXN1; (+) strand; PAM type: NRG; PAM sequence: AAG
aggatgccactgggtttcag

SEQ ID NO: 138131 - DNA, 20 bp, Artificial Sequence
  Description of Artificial Sequence: Synthetic oligonucleotide
  Target: ATXN1; (+) strand; PAM type: NRG; PAM sequence: AGG
ggatgccactgggtttcaga

SEQ ID NO: 138132 - DNA, 20 bp, Artificial Sequence
  Description of Artificial Sequence: Synthetic oligonucleotide
  Target: ATXN1; (+) strand; PAM type: NRG; PAM sequence: GAG
atgccactgggtttcagaag

SEQ ID NO: 138133 - DNA, 20 bp, Artificial Sequence
  Description of Artificial Sequence: Synthetic oligonucleotide
  Target: ATXN1; (+) strand; PAM type: NRG; PAM sequence: CAG
ctgggtttcagaaggagccc

SEQ ID NO: 138134 - DNA, 20 bp, Artificial Sequence
  Description of Artificial Sequence: Synthetic oligonucleotide
  Target: ATXN1; (+) strand; PAM type: NRG; PAM sequence: AAG
gtttcagaaggagccccaga

SEQ ID NO: 138135 - DNA, 20 bp, Artificial Sequence
  Description of Artificial Sequence: Synthetic oligonucleotide
  Target: ATXN1; (+) strand; PAM type: NRG; PAM sequence: AGG
tttcagaaggagccccagaa

SEQ ID NO: 138136 - DNA, 20 bp, Artificial Sequence
  Description of Artificial Sequence: Synthetic oligonucleotide
  Target: ATXN1; (+) strand; PAM type: NRG; PAM sequence: GGG
ttcagaaggagccccagaaa

SEQ ID NO: 138137 - DNA, 20 bp, Artificial Sequence
  Description of Artificial Sequence: Synthetic oligonucleotide
  Target: ATXN1; (+) strand; PAM type: NRG; PAM sequence: GAG
cagaaggagccccagaaagg

SEQ ID NO: 138138 - DNA, 20 bp, Artificial Sequence
  Description of Artificial Sequence: Synthetic oligonucleotide
  Target: ATXN1; (+) strand; PAM type: NRG; PAM sequence: CAG
aggagccccagaaagggagt

SEQ ID NO: 138139 - DNA, 20 bp, Artificial Sequence
  Description of Artificial Sequence: Synthetic oligonucleotide
  Target: ATXN1; (+) strand; PAM type: NRG; PAM sequence: AGG
ggagccccagaaagggagtc

SEQ ID NO: 138140 - DNA, 20 bp, Artificial Sequence
  Description of Artificial Sequence: Synthetic oligonucleotide
  Target: ATXN1; (+) strand; PAM type: NRG; PAM sequence: AAG
gaaagggagtcaggctgcat

SEQ ID NO: 138141 - DNA, 20 bp, Artificial Sequence
  Description of Artificial Sequence: Synthetic oligonucleotide
  Target: ATXN1; (+) strand; PAM type: NRG; PAM sequence: TAG
gagtcaggctgcataagttc

SEQ ID NO: 138142 - DNA, 20 bp, Artificial Sequence
  Description of Artificial Sequence: Synthetic oligonucleotide
  Target: ATXN1; (+) strand; PAM type: NRG; PAM sequence: AGG
agtcaggctgcataagttct

SEQ ID NO: 138143 - DNA, 20 bp, Artificial Sequence
  Description of Artificial Sequence: Synthetic oligonucleotide
  Target: ATXN1; (+) strand; PAM type: NRG; PAM sequence: TGG
aggacccccacctactccgc

SEQ ID NO: 138144 - DNA, 20 bp, Artificial Sequence
  Description of Artificial Sequence: Synthetic oligonucleotide
  Target: ATXN1; (+) strand; PAM type: NRG; PAM sequence: CAG
cccccacctactccgctggc

SEQ ID NO: 138145 - DNA, 20 bp, Artificial Sequence
  Description of Artificial Sequence: Synthetic oligonucleotide
  Target: ATXN1; (+) strand; PAM type: NRG; PAM sequence: TGG
ccgctggccagcaccacatg

SEQ ID NO: 138146 - DNA, 20 bp, Artificial Sequence
  Description of Artificial Sequence: Synthetic oligonucleotide
  Target: ATXN1; (+) strand; PAM type: NRG; PAM sequence: CAG
cagcaccacatgtggtccca

SEQ ID NO: 138147 - DNA, 20 bp, Artificial Sequence
  Description of Artificial Sequence: Synthetic oligonucleotide
  Target: ATXN1; (+) strand; PAM type: NRG; PAM sequence: AGG
agcaccacatgtggtcccac

SEQ ID NO: 138148 - DNA, 20 bp, Artificial Sequence
  Description of Artificial Sequence: Synthetic oligonucleotide
  Target: ATXN1; (+) strand; PAM type: NRG; PAM sequence: AAG
aggactacactctcctctat

SEQ ID NO: 138149 - DNA, 20 bp, Artificial Sequence
  Description of Artificial Sequence: Synthetic oligonucleotide
  Target: ATXN1; (+) strand; PAM type: NRG; PAM sequence: AAG
tacactctcctctataagca

SEQ ID NO: 138150 - DNA, 20 bp, Artificial Sequence
  Description of Artificial Sequence: Synthetic oligonucleotide
  Target: ATXN1; (+) strand; PAM type: NRG; PAM sequence: AGG
acactctcctctataagcaa

SEQ ID NO: 138151 - DNA, 20 bp, Artificial Sequence
  Description of Artificial Sequence: Synthetic oligonucleotide
  Target: ATXN1; (+) strand; PAM type: NRG; PAM sequence: GAG
actctcctctataagcaaag

SEQ ID NO: 138152 - DNA, 20 bp, Artificial Sequence
  Description of Artificial Sequence: Synthetic oligonucleotide
  Target: ATXN1; (+) strand; PAM type: NRG; PAM sequence: TGG
ataagcaaaggagaactctc

SEQ ID NO: 138153 - DNA, 20 bp, Artificial Sequence
  Description of Artificial Sequence: Synthetic oligonucleotide
  Target: ATXN1; (+) strand; PAM type: NRG; PAM sequence: GGG
taagcaaaggagaactctct

SEQ ID NO: 138154 - DNA, 20 bp, Artificial Sequence
  Description of Artificial Sequence: Synthetic oligonucleotide
  Target: ATXN1; (+) strand; PAM type: NRG; PAM sequence: GGG
aagcaaaggagaactctctg

SEQ ID NO: 138155 - DNA, 20 bp, Artificial Sequence
  Description of Artificial Sequence: Synthetic oligonucleotide
  Target: ATXN1; (+) strand; PAM type: NRG; PAM sequence: TAG
gaactctctggggccctttc

SEQ ID NO: 138156 - DNA, 20 bp, Artificial Sequence
  Description of Artificial Sequence: Synthetic oligonucleotide
  Target: ATXN1; (+) strand; PAM type: NRG; PAM sequence: GAG
ctggggccctttctagatct

SEQ ID NO: 138157 - DNA, 20 bp, Artificial Sequence
  Description of Artificial Sequence: Synthetic oligonucleotide
  Target: ATXN1; (+) strand; PAM type: NRG; PAM sequence: AGG
tggggccctttctagatctg

SEQ ID NO: 138158 - DNA, 20 bp, Artificial Sequence
  Description of Artificial Sequence: Synthetic oligonucleotide
  Target: ATXN1; (+) strand; PAM type: NRG; PAM sequence: AAG
agatctgaggtcctactaaa

SEQ ID NO: 138159 - DNA, 20 bp, Artificial Sequence
  Description of Artificial Sequence: Synthetic oligonucleotide
  Target: ATXN1; (+) strand; PAM type: NRG; PAM sequence: AGG
gatctgaggtcctactaaaa

SEQ ID NO: 138160 - DNA, 20 bp, Artificial Sequence
  Description of Artificial Sequence: Synthetic oligonucleotide
  Target: ATXN1; (+) strand; PAM type: NRG; PAM sequence: GGG
atctgaggtcctactaaaaa

SEQ ID NO: 138161 - DNA, 20 bp, Artificial Sequence
  Description of Artificial Sequence: Synthetic oligonucleotide
  Target: ATXN1; (+) strand; PAM type: NRG; PAM sequence: CAG
actaaaaagggtgacaacct

SEQ ID NO: 138162 - DNA, 20 bp, Artificial Sequence
  Description of Artificial Sequence: Synthetic oligonucleotide
  Target: ATXN1; (+) strand; PAM type: NRG; PAM sequence: TAG
acaacctcagctctgaacat

SEQ ID NO: 138163 - DNA, 20 bp, Artificial Sequence
  Description of Artificial Sequence: Synthetic oligonucleotide
  Target: ATXN1; (+) strand; PAM type: NRG; PAM sequence: AAG
gttgttttatttcaactcca

SEQ ID NO: 138164 - DNA, 20 bp, Artificial Sequence
  Description of Artificial Sequence: Synthetic oligonucleotide
  Target: ATXN1; (+) strand; PAM type: NRG; PAM sequence: TGG
gttttatttcaactccaaag

SEQ ID NO: 138165 - DNA, 20 bp, Artificial Sequence
  Description of Artificial Sequence: Synthetic oligonucleotide
  Target: ATXN1; (+) strand; PAM type: NRG; PAM sequence: GGG
ttttatttcaactccaaagt

SEQ ID NO: 138166 - DNA, 20 bp, Artificial Sequence
  Description of Artificial Sequence: Synthetic oligonucleotide
  Target: ATXN1; (+) strand; PAM type: NRG; PAM sequence: AAG
ctacatcccgaaacaaatga

SEQ ID NO: 138167 - DNA, 20 bp, Artificial Sequence
  Description of Artificial Sequence: Synthetic oligonucleotide
  Target: ATXN1; (+) strand; PAM type: NRG; PAM sequence: AAG
aacaaatgaaagaaaattaa

SEQ ID NO: 138168 - DNA, 20 bp, Artificial Sequence
  Description of Artificial Sequence: Synthetic oligonucleotide
  Target: ATXN1; (+) strand; PAM type: NRG; PAM sequence: AAG
agaaaattaaaagataaata

SEQ ID NO: 138169 - DNA, 20 bp, Artificial Sequence
  Description of Artificial Sequence: Synthetic oligonucleotide
  Target: ATXN1; (+) strand; PAM type: NRG; PAM sequence: TGG
aaagataaataaagcattcc

SEQ ID NO: 138170 - DNA, 20 bp, Artificial Sequence
  Description of Artificial Sequence: Synthetic oligonucleotide
  Target: ATXN1; (+) strand; PAM type: NRG; PAM sequence: AAG
agcattcctggcatccatga

SEQ ID NO: 138171 - DNA, 20 bp, Artificial Sequence
  Description of Artificial Sequence: Synthetic oligonucleotide
  Target: ATXN1; (+) strand; PAM type: NRG; PAM sequence: CAG
tttccctgttcatgttattt

SEQ ID NO: 138172 - DNA, 20 bp, Artificial Sequence
  Description of Artificial Sequence: Synthetic oligonucleotide
  Target: ATXN1; (+) strand; PAM type: NRG; PAM sequence: TAG
tcatgttatttcagtaaatc

SEQ ID NO: 138173 - DNA, 20 bp, Artificial Sequence
  Description of Artificial Sequence: Synthetic oligonucleotide
  Target: ATXN1; (+) strand; PAM type: NRG; PAM sequence: CAG
tgttatttcagtaaatctag

SEQ ID NO: 138174 - DNA, 20 bp, Artificial Sequence
  Description of Artificial Sequence: Synthetic oligonucleotide
  Target: ATXN1; (+) strand; PAM type: NRG; PAM sequence: TAG
tttcagtaaatctagcagtg

SEQ ID NO: 138175 - DNA, 20 bp, Artificial Sequence
  Description of Artificial Sequence: Synthetic oligonucleotide
  Target: ATXN1; (+) strand; PAM type: NRG; PAM sequence: AAG
agtaaatctagcagtgtaga

SEQ ID NO: 138176 - DNA, 20 bp, Artificial Sequence
  Description of Artificial Sequence: Synthetic oligonucleotide
  Target: ATXN1; (+) strand; PAM type: NRG; PAM sequence: GAG
taaatctagcagtgtagaaa

SEQ ID NO: 138177 - DNA, 20 bp, Artificial Sequence
  Description of Artificial Sequence: Synthetic oligonucleotide
  Target: ATXN1; (+) strand; PAM type: NRG; PAM sequence: GAG
cagtgtagaaagagacaaat

SEQ ID NO: 138178 - DNA, 20 bp, Artificial Sequence
  Description of Artificial Sequence: Synthetic oligonucleotide
  Target: ATXN1; (+) strand; PAM type: NRG; PAM sequence: CAG
tagaaagagacaaatgagcg

SEQ ID NO: 138179 - DNA, 20 bp, Artificial Sequence
  Description of Artificial Sequence: Synthetic oligonucleotide
  Target: ATXN1; (+) strand; PAM type: NRG; PAM sequence: AAG
gacaaatgagcgcagattac

SEQ ID NO: 138180 - DNA, 20 bp, Artificial Sequence
  Description of Artificial Sequence: Synthetic oligonucleotide
  Target: ATXN1; (+) strand; PAM type: NRG; PAM sequence: AGG
acaaatgagcgcagattaca

SEQ ID NO: 138181 - DNA, 20 bp, Artificial Sequence
  Description of Artificial Sequence: Synthetic oligonucleotide
  Target: ATXN1; (+) strand; PAM type: NRG; PAM sequence: CAG
aatgagcgcagattacaagg

SEQ ID NO: 138182 - DNA, 20 bp, Artificial Sequence
  Description of Artificial Sequence: Synthetic oligonucleotide
  Target: ATXN1; (+) strand; PAM type: NRG; PAM sequence: CGG
attacaaggcagcacctgtt

SEQ ID NO: 138183 - DNA, 20 bp, Artificial Sequence
  Description of Artificial Sequence: Synthetic oligonucleotide
  Target: ATXN1; (+) strand; PAM type: NRG; PAM sequence: GAG
tacaaggcagcacctgttcg

SEQ ID NO: 138184 - DNA, 20 bp, Artificial Sequence
  Description of Artificial Sequence: Synthetic oligonucleotide
  Target: ATXN1; (+) strand; PAM type: NRG; PAM sequence: AAG
gcagcacctgttcggagccc

SEQ ID NO: 138185 - DNA, 20 bp, Artificial Sequence
  Description of Artificial Sequence: Synthetic oligonucleotide
  Target: ATXN1; (+) strand; PAM type: NRG; PAM sequence: AGG
cagcacctgttcggagccca

SEQ ID NO: 138186 - DNA, 20 bp, Artificial Sequence
  Description of Artificial Sequence: Synthetic oligonucleotide
  Target: ATXN1; (+) strand; PAM type: NRG; PAM sequence: TAG
tgttcggagcccaaggtcat

SEQ ID NO: 138187 - DNA, 20 bp, Artificial Sequence
  Description of Artificial Sequence: Synthetic oligonucleotide
  Target: ATXN1; (+) strand; PAM type: NRG; PAM sequence: TAG
ccaaggtcattagatgccat

SEQ ID NO: 138188 - DNA, 20 bp, Artificial Sequence
  Description of Artificial Sequence: Synthetic oligonucleotide
  Target: ATXN1; (+) strand; PAM type: NRG; PAM sequence: TGG
tcattagatgccattagcaa

SEQ ID NO: 138189 - DNA, 20 bp, Artificial Sequence
  Description of Artificial Sequence: Synthetic oligonucleotide
  Target: ATXN1; (+) strand; PAM type: NRG; PAM sequence: AAG
atgccattagcaatggcata

SEQ ID NO: 138190 - DNA, 20 bp, Artificial Sequence
  Description of Artificial Sequence: Synthetic oligonucleotide
  Target: ATXN1; (+) strand; PAM type: NRG; PAM sequence: TAG
ggcataaagacacatgcatt

SEQ ID NO: 138191 - DNA, 20 bp, Artificial Sequence
  Description of Artificial Sequence: Synthetic oligonucleotide
  Target: ATXN1; (+) strand; PAM type: NRG; PAM sequence: AGG
gcataaagacacatgcattt

SEQ ID NO: 138192 - DNA, 20 bp, Artificial Sequence
  Description of Artificial Sequence: Synthetic oligonucleotide
  Target: ATXN1; (+) strand; PAM type: NRG; PAM sequence: GAG
ataaagacacatgcatttag

SEQ ID NO: 138193 - DNA, 20 bp, Artificial Sequence
  Description of Artificial Sequence: Synthetic oligonucleotide
  Target: ATXN1; (+) strand; PAM type: NRG; PAM sequence: CAG
catgcatttaggagataacg

SEQ ID NO: 138194 - DNA, 20 bp, Artificial Sequence
  Description of Artificial Sequence: Synthetic oligonucleotide
  Target: ATXN1; (+) strand; PAM type: NRG; PAM sequence: CAG
atttaggagataacgcagct

SEQ ID NO: 138195 - DNA, 20 bp, Artificial Sequence
  Description of Artificial Sequence: Synthetic oligonucleotide
  Target: ATXN1; (+) strand; PAM type: NRG; PAM sequence: TGG
taggagataacgcagctcag

SEQ ID NO: 138196 - DNA, 20 bp, Artificial Sequence
  Description of Artificial Sequence: Synthetic oligonucleotide
  Target: ATXN1; (+) strand; PAM type: NRG; PAM sequence: GGG
aggagataacgcagctcagt

SEQ ID NO: 138197 - DNA, 20 bp, Artificial Sequence
  Description of Artificial Sequence: Synthetic oligonucleotide
  Target: ATXN1; (+) strand; PAM type: NRG; PAM sequence: CGG
cttccttcttgacaccttgt

SEQ ID NO: 138198 - DNA, 20 bp, Artificial Sequence
  Description of Artificial Sequence: Synthetic oligonucleotide
  Target: ATXN1; (+) strand; PAM type: NRG; PAM sequence: CAG
caccttgtcggctgctctca

SEQ ID NO: 138199 - DNA, 20 bp, Artificial Sequence
  Description of Artificial Sequence: Synthetic oligonucleotide
  Target: ATXN1; (+) strand; PAM type: NRG; PAM sequence: CAG
ctgctctcacagacctgctt

SEQ ID NO: 138200 - DNA, 20 bp, Artificial Sequence
  Description of Artificial Sequence: Synthetic oligonucleotide
  Target: ATXN1; (+) strand; PAM type: NRG; PAM sequence: CAG
tcacagacctgcttcagtct

SEQ ID NO: 138201 - DNA, 20 bp, Artificial Sequence
  Description of Artificial Sequence: Synthetic oligonucleotide
  Target: ATXN1; (+) strand; PAM type: NRG; PAM sequence: GAG
acagacctgcttcagtctca

SEQ ID NO: 138202 - DNA, 20 bp, Artificial Sequence
  Description of Artificial Sequence: Synthetic oligonucleotide
  Target: ATXN1; (+) strand; PAM type: NRG; PAM sequence: CAG
cctgcttcagtctcagagcc

SEQ ID NO: 138203 - DNA, 20 bp, Artificial Sequence
  Description of Artificial Sequence: Synthetic oligonucleotide
  Target: ATXN1; (+) strand; PAM type: NRG; PAM sequence: TAG
cagtctcagagcccagacaa

SEQ ID NO: 138204 - DNA, 20 bp, Artificial Sequence
  Description of Artificial Sequence: Synthetic oligonucleotide
  Target: ATXN1; (+) strand; PAM type: NRG; PAM sequence: CGG
ccagacaatagcactaaaca

SEQ ID NO: 138205 - DNA, 20 bp, Artificial Sequence
  Description of Artificial Sequence: Synthetic oligonucleotide
  Target: ATXN1; (+) strand; PAM type: NRG; PAM sequence: AAG
acaatagcactaaacacggc

SEQ ID NO: 138206 - DNA, 20 bp, Artificial Sequence
  Description of Artificial Sequence: Synthetic oligonucleotide
  Target: ATXN1; (+) strand; PAM type: NRG; PAM sequence: AGG
caatagcactaaacacggca

SEQ ID NO: 138207 - DNA, 20 bp, Artificial Sequence
  Description of Artificial Sequence: Synthetic oligonucleotide
  Target: ATXN1; (+) strand; PAM type: NRG; PAM sequence: GGG
aatagcactaaacacggcaa

SEQ ID NO: 138208 - DNA, 20 bp, Artificial Sequence
  Description of Artificial Sequence: Synthetic oligonucleotide
  Target: ATXN1; (+) strand; PAM type: NRG; PAM sequence: TAG
actaaacacggcaagggcgt

SEQ ID NO: 138209 - DNA, 20 bp, Artificial Sequence
  Description of Artificial Sequence: Synthetic oligonucleotide
  Target: ATXN1; (+) strand; PAM type: NRG; PAM sequence: AAG
acggcaagggcgttagctgc

SEQ ID NO: 138210 - DNA, 20 bp, Artificial Sequence
  Description of Artificial Sequence: Synthetic oligonucleotide
  Target: ATXN1; (+) strand; PAM type: NRG; PAM sequence: GAG
ggcaagggcgttagctgcaa

SEQ ID NO: 138211 - DNA, 20 bp, Artificial Sequence
  Description of Artificial Sequence: Synthetic oligonucleotide
  Target: ATXN1; (+) strand; PAM type: NRG; PAM sequence: AGG
gcaagggcgttagctgcaag

SEQ ID NO: 138212 - DNA, 20 bp, Artificial Sequence
  Description of Artificial Sequence: Synthetic oligonucleotide
  Target: ATXN1; (+) strand; PAM type: NRG; PAM sequence: TGG
tagctgcaagaggctgaaat

SEQ ID NO: 138213 - DNA, 20 bp, Artificial Sequence
  Description of Artificial Sequence: Synthetic oligonucleotide
  Target: ATXN1; (+) strand; PAM type: NRG; PAM sequence: GAG
attggctgaacctgaaatat

SEQ ID NO: 138214 - DNA, 20 bp, Artificial Sequence
  Description of Artificial Sequence: Synthetic oligonucleotide
  Target: ATXN1; (+) strand; PAM type: NRG; PAM sequence: AAG
ctgaacctgaaatatgagta

SEQ ID NO: 138215 - DNA, 20 bp, Artificial Sequence
  Description of Artificial Sequence: Synthetic oligonucleotide
  Target: ATXN1; (+) strand; PAM type: NRG; PAM sequence: CAG
aagtctttgtatatgcaaaa

SEQ ID NO: 138216 - DNA, 20 bp, Artificial Sequence
  Description of Artificial Sequence: Synthetic oligonucleotide
  Target: ATXN1; (+) strand; PAM type: NRG; PAM sequence: TAG
ttgtatatgcaaaacagaaa

SEQ ID NO: 138217 - DNA, 20 bp, Artificial Sequence
  Description of Artificial Sequence: Synthetic oligonucleotide
  Target: ATXN1; (+) strand; PAM type: NRG; PAM sequence: AAG
caaaacagaaatagccctaa

SEQ ID NO: 138218 - DNA, 20 bp, Artificial Sequence
  Description of Artificial Sequence: Synthetic oligonucleotide
  Target: ATXN1; (+) strand; PAM type: NRG; PAM sequence: AGG
aaaacagaaatagccctaaa

SEQ ID NO: 138219 - DNA, 20 bp, Artificial Sequence
  Description of Artificial Sequence: Synthetic oligonucleotide
  Target: ATXN1; (+) strand; PAM type: NRG; PAM sequence: GAG
aacagaaatagccctaaaag

SEQ ID NO: 138220 - DNA, 20 bp, Artificial Sequence
  Description of Artificial Sequence: Synthetic oligonucleotide
  Target: ATXN1; (+) strand; PAM type: NRG; PAM sequence: AAG
agacacaactatttatcaaa

SEQ ID NO: 138221 - DNA, 20 bp, Artificial Sequence
  Description of Artificial Sequence: Synthetic oligonucleotide
  Target: ATXN1; (+) strand; PAM type: NRG; PAM sequence: AGG
gacacaactatttatcaaaa

SEQ ID NO: 138222 - DNA, 20 bp, Artificial Sequence
  Description of Artificial Sequence: Synthetic oligonucleotide
  Target: ATXN1; (+) strand; PAM type: NRG; PAM sequence: CAG
atttatcaaaaaggtgcata

SEQ ID NO: 138223 - DNA, 20 bp, Artificial Sequence
  Description of Artificial Sequence: Synthetic oligonucleotide
  Target: ATXN1; (+) strand; PAM type: NRG; PAM sequence: GAG
ttatcaaaaaggtgcataca

SEQ ID NO: 138224 - DNA, 20 bp, Artificial Sequence
  Description of Artificial Sequence: Synthetic oligonucleotide
  Target: ATXN1; (+) strand; PAM type: NRG; PAM sequence: AAG
gtgcatacagagaattaaac

SEQ ID NO: 138225 - DNA, 20 bp, Artificial Sequence
  Description of Artificial Sequence: Synthetic oligonucleotide
  Target: ATXN1; (+) strand; PAM type: NRG; PAM sequence: AGG
tgcatacagagaattaaaca

SEQ ID NO: 138226 - DNA, 20 bp, Artificial Sequence
  Description of Artificial Sequence: Synthetic oligonucleotide
  Target: ATXN1; (+) strand; PAM type: NRG; PAM sequence: CAG
tacagagaattaaacaaggc

SEQ ID NO: 138227 - DNA, 20 bp, Artificial Sequence
  Description of Artificial Sequence: Synthetic oligonucleotide
  Target: ATXN1; (+) strand; PAM type: NRG; PAM sequence: AGG
acagagaattaaacaaggcc

SEQ ID NO: 138228 - DNA, 20 bp, Artificial Sequence
  Description of Artificial Sequence: Synthetic oligonucleotide
  Target: ATXN1; (+) strand; PAM type: NRG; PAM sequence: CGG
gaattaaacaaggccaggcc

SEQ ID NO: 138229 - DNA, 20 bp, Artificial Sequence
  Description of Artificial Sequence: Synthetic oligonucleotide
  Target: ATXN1; (+) strand; PAM type: NRG; PAM sequence: CGG
ttaaacaaggccaggcccgg

SEQ ID NO: 138230 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatcccaacactt

SEQ ID NO: 138231 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccaacacttt

SEQ ID NO: 138232 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccaacactttgg

SEQ ID NO: 138233 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccaacactttggg

SEQ ID NO: 138234 - DNA, 20 bp, Artificial Sequence
  Description of Artificial Sequence: Synthetic oligonucleotide
  Target: ATXN1; (+) strand; PAM type: NRG; PAM sequence: AAG
tcccaacactttgggaggcc

SEQ ID NO: 138235 - DNA, 20 bp, Artificial Sequence
  Description of Artificial Sequence: Synthetic oligonucleotide
  Target: ATXN1; (+) strand; PAM type: NRG; PAM sequence: AGG
cccaacactttgggaggcca

SEQ ID NO: 138236 - DNA, 20 bp, Artificial Sequence
  Description of Artificial Sequence: Synthetic oligonucleotide
  Target: ATXN1; (+) strand; PAM type: NRG; PAM sequence: CAG
aacactttgggaggccaagg

SEQ ID NO: 138237 - DNA, 20 bp, Artificial Sequence
  Description of Artificial Sequence: Synthetic oligonucleotide
  Target: ATXN1; (+) strand; PAM type: NRG; PAM sequence: AGG
acactttgggaggccaaggc

SEQ ID NO: 138238 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggccaaggcagg

SEQ ID NO: 138239 - DNA, 20 bp, Artificial Sequence
  Description of Artificial Sequence: Synthetic oligonucleotide
  Target: ATXN1; (+) strand; PAM type: NRG; PAM sequence: GAG
ccaaggcaggtggatcacct

SEQ ID NO: 138240 - DNA, 20 bp, Artificial Sequence
  Description of Artificial Sequence: Synthetic oligonucleotide
  Target: ATXN1; (+) strand; PAM type: NRG; PAM sequence: AGG
caaggcaggtggatcacctg

SEQ ID NO: 138241 - DNA, 20 bp, Artificial Sequence
  Description of Artificial Sequence: Synthetic oligonucleotide
  Target: ATXN1; (+) strand; PAM type: NRG; PAM sequence: CAG
gcaggtggatcacctgaggt

SEQ ID NO: 138242 - DNA, 20 bp, Artificial Sequence
  Description of Artificial Sequence: Synthetic oligonucleotide
  Target: ATXN1; (+) strand; PAM type: NRG; PAM sequence: AGG
caggtggatcacctgaggtc

SEQ ID NO: 138243 - DNA, 20 bp, Artificial Sequence
  Description of Artificial Sequence: Synthetic oligonucleotide
  Target: ATXN1; (+) strand; PAM type: NRG; PAM sequence: GAG
ggtggatcacctgaggtcag

SEQ ID NO: 138244 - DNA, 20 bp, Artificial Sequence
  Description of Artificial Sequence: Synthetic oligonucleotide
  Target: ATXN1; (+) strand; PAM type: NRG; PAM sequence: AAG
tcacctgaggtcaggagttc

SEQ ID NO: 138245 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcaagaccaccc

SEQ ID NO: 138246 - DNA, 20 bp, Artificial Sequence
  Description of Artificial Sequence: Synthetic oligonucleotide
  Target: ATXN1; (+) strand; PAM type: NRG; PAM sequence: TGG
caagaccaccctggccaaca

SEQ ID NO: 138247 - DNA, 20 bp, Artificial Sequence
  Description of Artificial Sequence: Synthetic oligonucleotide
  Target: ATXN1; (+) strand; PAM type: NRG; PAM sequence: GAG
agaccaccctggccaacatg

SEQ ID NO: 138248 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaaaat

SEQ ID NO: 138249 - DNA, 20 bp, Artificial Sequence
  Description of Artificial Sequence: Synthetic oligonucleotide
  Target: ATXN1; (+) strand; PAM type: NRG; PAM sequence: TGG
ctaaaaatacaaaaattagc

SEQ ID NO: 138250 - DNA, 20 bp, Artificial Sequence
  Description of Artificial Sequence: Synthetic oligonucleotide
  Target: ATXN1; (+) strand; PAM type: NRG; PAM sequence: GGG
taaaaatacaaaaattagct

SEQ ID NO: 138251 - DNA, 20 bp, Artificial Sequence
  Description of Artificial Sequence: Synthetic oligonucleotide
  Target: ATXN1; (+) strand; PAM type: NRG; PAM sequence: TGG
atacaaaaattagctgggtg

SEQ ID NO: 138252 - DNA, 20 bp, Artificial Sequence
  Description of Artificial Sequence: Synthetic oligonucleotide
  Target: ATXN1; (+) strand; PAM type: NRG; PAM sequence: TGG
caaaaattagctgggtgtgg

SEQ ID NO: 138253 - DNA, 20 bp, Artificial Sequence
  Description of Artificial Sequence: Synthetic oligonucleotide
  Target: ATXN1; (+) strand; PAM type: NRG; PAM sequence: CAG
gtggtgcacacctgtaatcc

SEQ ID NO: 138254 - DNA, 20 bp, Artificial Sequence
  Description of Artificial Sequence: Synthetic oligonucleotide
  Target: ATXN1; (+) strand; PAM type: NRG; PAM sequence: TAG
acacctgtaatcccagctac

SEQ ID NO: 138255 - DNA, 20 bp, Artificial Sequence
  Description of Artificial Sequence: Synthetic oligonucleotide
  Target: ATXN1; (+) strand; PAM type: NRG; PAM sequence: AGG
cacctgtaatcccagctact

SEQ ID NO: 138256 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccagctacta

SEQ ID NO: 138257 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctactagg

SEQ ID NO: 138258 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctactaggg

SEQ ID NO: 138259 - DNA, 20 bp, Artificial Sequence
  Description of Artificial Sequence: Synthetic oligonucleotide
  Target: ATXN1; (+) strand; PAM type: NRG; PAM sequence: GAG
tcccagctactagggaggct

SEQ ID NO: 138260 - DNA, 20 bp, Artificial Sequence
  Description of Artificial Sequence: Synthetic oligonucleotide
  Target: ATXN1; (+) strand; PAM type: NRG; PAM sequence: AGG
cccagctactagggaggctg

SEQ ID NO: 138261 - DNA, 20 bp, Artificial Sequence
  Description of Artificial Sequence: Synthetic oligonucleotide
  Target: ATXN1; (+) strand; PAM type: NRG; PAM sequence: CGG
gggaggctgaggcttgaacc

SEQ ID NO: 138262 - DNA, 20 bp, Artificial Sequence
  Description of Artificial Sequence: Synthetic oligonucleotide
  Target: ATXN1; (+) strand; PAM type: NRG; PAM sequence: GGG
ggaggctgaggcttgaaccc

SEQ ID NO: 138263 - DNA, 20 bp, Artificial Sequence
  Description of Artificial Sequence: Synthetic oligonucleotide
  Target: ATXN1; (+) strand; PAM type: NRG; PAM sequence: GAG
aggctgaggcttgaacccgg

SEQ ID NO: 138264 - DNA, 20 bp, Artificial Sequence
  Description of Artificial Sequence: Synthetic oligonucleotide
  Target: ATXN1; (+) strand; PAM type: NRG; PAM sequence: AGG
ggctgaggcttgaacccggg

SEQ ID NO: 138265 - DNA, 20 bp, Artificial Sequence
  Description of Artificial Sequence: Synthetic oligonucleotide
  Target: ATXN1; (+) strand; PAM type: NRG; PAM sequence: TGG
ggcttgaacccgggaggcaa

SEQ ID NO: 138266 - DNA, 20 bp, Artificial Sequence
  Description of Artificial Sequence: Synthetic oligonucleotide
  Target: ATXN1; (+) strand; PAM type: NRG; PAM sequence: GAG
cttgaacccgggaggcaatg

SEQ ID NO: 138267 - DNA, 20 bp, Artificial Sequence
  Description of Artificial Sequence: Synthetic oligonucleotide
  Target: ATXN1; (+) strand; PAM type: NRG; PAM sequence: AGG
ttgaacccgggaggcaatgg

SEQ ID NO: 138268 - DNA, 20 bp, Artificial Sequence
  Description of Artificial Sequence: Synthetic oligonucleotide
  Target: ATXN1; (+) strand; PAM type: NRG; PAM sequence: CAG
ccgggaggcaatggaggttg

SEQ ID NO: 138269 - DNA, 20 bp, Artificial Sequence
  Description of Artificial Sequence: Synthetic oligonucleotide
  Target: ATXN1; (+) strand; PAM type: NRG; PAM sequence: GAG
gaggcaatggaggttgcagt

SEQ ID NO: 138270 - DNA, 20 bp, Artificial Sequence
  Description of Artificial Sequence: Synthetic oligonucleotide
  Target: ATXN1; (+) strand; PAM type: NRG; PAM sequence: AAG
aatggaggttgcagtgagcc

SEQ ID NO: 138271 - DNA, 20 bp, Artificial Sequence
  Description of Artificial Sequence: Synthetic oligonucleotide
  Target: ATXN1; (+) strand; PAM type: NRG; PAM sequence: CAG
aagatcgtgccactgcactc

SEQ ID NO: 138272 - DNA, 20 bp, Artificial Sequence
  Description of Artificial Sequence: Synthetic oligonucleotide
  Target: ATXN1; (+) strand; PAM type: NRG; PAM sequence: TGG
cgtgccactgcactccagcc

SEQ ID NO: 138273 - DNA, 20 bp, Artificial Sequence
  Description of Artificial Sequence: Synthetic oligonucleotide
  Target: ATXN1; (+) strand; PAM type: NRG; PAM sequence: GGG
gtgccactgcactccagcct

SEQ ID NO: 138274 - DNA, 20 bp, Artificial Sequence
  Description of Artificial Sequence: Synthetic oligonucleotide
  Target: ATXN1; (+) strand; PAM type: NRG; PAM sequence: GAG
gccactgcactccagcctgg

SEQ ID NO: 138275 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggaga

SEQ ID NO: 138276 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggagaca

SEQ ID NO: 138277 - DNA, 20 bp, Artificial Sequence
  Description of Artificial Sequence: Synthetic oligonucleotide
  Target: ATXN1; (+) strand; PAM type: NRG; PAM sequence: GAG
tccagcctgggagacagagc

SEQ ID NO: 138278 - DNA, 20 bp, Artificial Sequence
  Description of Artificial Sequence: Synthetic oligonucleotide
  Target: ATXN1; (+) strand; PAM type: NRG; PAM sequence: AAG
catctcaaaaacaaaaaaca

SEQ ID NO: 138279 - DNA, 20 bp, Artificial Sequence
  Description of Artificial Sequence: Synthetic oligonucleotide
  Target: ATXN1; (+) strand; PAM type: NRG; PAM sequence: GAG
caaagaattaaacaaatgat

SEQ ID NO: 138280 - DNA, 20 bp, Artificial Sequence
  Description of Artificial Sequence: Synthetic oligonucleotide
  Target: ATXN1; (+) strand; PAM type: NRG; PAM sequence: TAG
ttaaacaaatgatgagttga

SEQ ID NO: 138281 - DNA, 20 bp, Artificial Sequence
  Description of Artificial Sequence: Synthetic oligonucleotide
  Target: ATXN1; (+) strand; PAM type: NRG; PAM sequence: AAG
tgatgagttgatagcccgaa

SEQ ID NO: 138282 - DNA, 20 bp, Artificial Sequence
  Description of Artificial Sequence: Synthetic oligonucleotide
  Target: ATXN1; (+) strand; PAM type: NRG; PAM sequence: AAG
tgagttgatagcccgaaaag

SEQ ID NO: 138283 - DNA, 20 bp, Artificial Sequence
  Description of Artificial Sequence: Synthetic oligonucleotide
  Target: ATXN1; (+) strand; PAM type: NRG; PAM sequence: AAG
tgatagcccgaaaagaagaa

SEQ ID NO: 138284 - DNA, 20 bp, Artificial Sequence
  Description of Artificial Sequence: Synthetic oligonucleotide
  Target: ATXN1; (+) strand; PAM type: NRG; PAM sequence: AAG
tgcaaaaataaataaataaa

SEQ ID NO: 138285 - DNA, 20 bp, Artificial Sequence
  Description of Artificial Sequence: Synthetic oligonucleotide
  Target: ATXN1; (+) strand; PAM type: NRG; PAM sequence: GAG
taaataaataaaaagtcact

SEQ ID NO: 138286 - DNA, 20 bp, Artificial Sequence
  Description of Artificial Sequence: Synthetic oligonucleotide
  Target: ATXN1; (+) strand; PAM type: NRG; PAM sequence: TAG
aataaaaagtcactgagaac

SEQ ID NO: 138287 - DNA, 20 bp, Artificial Sequence
  Description of Artificial Sequence: Synthetic oligonucleotide
  Target: ATXN1; (+) strand; PAM type: NRG; PAM sequence: CAG
aaaaagtcactgagaactag

SEQ ID NO: 138288 - DNA, 20 bp, Artificial Sequence
  Description of Artificial Sequence: Synthetic oligonucleotide
  Target: ATXN1; (+) strand; PAM type: NRG; PAM sequence: CAG
aagtcactgagaactagcag

SEQ ID NO: 138289 - DNA, 20 bp, Artificial Sequence
  Description of Artificial Sequence: Synthetic oligonucleotide
  Target: ATXN1; (+) strand; PAM type: NRG; PAM sequence: TAG
tgagaactagcagcagatga

SEQ ID NO: 138290 - DNA, 20 bp, Artificial Sequence
  Description of Artificial Sequence: Synthetic oligonucleotide
  Target: ATXN1; (+) strand; PAM type: NRG; PAM sequence: AGG
gagaactagcagcagatgat

SEQ ID NO: 138291 - DNA, 20 bp, Artificial Sequence
  Description of Artificial Sequence: Synthetic oligonucleotide
  Target: ATXN1; (+) strand; PAM type: NRG; PAM sequence: CAG
aactagcagcagatgatagg

SEQ ID NO: 138292 - DNA, 20 bp, Artificial Sequence
  Description of Artificial Sequence: Synthetic oligonucleotide
  Target: ATXN1; (+) strand; PAM type: NRG; PAM sequence: AAG
gcagcagatgataggcagaa

SEQ ID NO: 138293 - DNA, 20 bp, Artificial Sequence
  Description of Artificial Sequence: Synthetic oligonucleotide
  Target: ATXN1; (+) strand; PAM type: NRG; PAM sequence: TGG
gcagatgataggcagaaaag

SEQ ID NO: 138294 - DNA, 20 bp, Artificial Sequence
  Description of Artificial Sequence: Synthetic oligonucleotide
  Target: ATXN1; (+) strand; PAM type: NRG; PAM sequence: GAG
agatgataggcagaaaagtg

SEQ ID NO: 138295 - DNA, 20 bp, Artificial Sequence
  Description of Artificial Sequence: Synthetic oligonucleotide
  Target: ATXN1; (+) strand; PAM type: NRG; PAM sequence: TAG
tgataggcagaaaagtggag

SEQ ID NO: 138296 - DNA, 20 bp, Artificial Sequence
  Description of Artificial Sequence: Synthetic oligonucleotide
  Target: ATXN1; (+) strand; PAM type: NRG; PAM sequence: AAG
ggcagaaaagtggagtagtt

SEQ ID NO: 138297 - DNA, 20 bp, Artificial Sequence
  Description of Artificial Sequence: Synthetic oligonucleotide
  Target: ATXN1; (+) strand; PAM type: NRG; PAM sequence: CAG
aagtggagtagttaagacaa

SEQ ID NO: 138298 - DNA, 20 bp, Artificial Sequence
  Description of Artificial Sequence: Synthetic oligonucleotide
  Target: ATXN1; (+) strand; PAM type: NRG; PAM sequence: AGG
agtggagtagttaagacaac

SEQ ID NO: 138299 - DNA, 20 bp, Artificial Sequence
  Description of Artificial Sequence: Synthetic oligonucleotide
  Target: ATXN1; (+) strand; PAM type: NRG; PAM sequence: TGG
gtagttaagacaacaggctt

SEQ ID NO: 138300 - DNA, 20 bp, Artificial Sequence
  Description of Artificial Sequence: Synthetic oligonucleotide
  Target: ATXN1; (+) strand; PAM type: NRG; PAM sequence: CAG
aagacaacaggctttggtgt

SEQ ID NO: 138301 - DNA, 20 bp, Artificial Sequence
  Description of Artificial Sequence: Synthetic oligonucleotide
  Target: ATXN1; (+) strand; PAM type: NRG; PAM sequence: AGG
agacaacaggctttggtgtc

SEQ ID NO: 138302 - DNA, 20 bp, Artificial Sequence
  Description of Artificial Sequence: Synthetic oligonucleotide
  Target: ATXN1; (+) strand; PAM type: NRG; PAM sequence: TGG
ggctttggtgtcaggcacac

SEQ ID NO: 138303 - DNA, 20 bp, Artificial Sequence
  Description of Artificial Sequence: Synthetic oligonucleotide
  Target: ATXN1; (+) strand; PAM type: NRG; PAM sequence: TAG
ggcacactggctttgaattc

SEQ ID NO: 138304 - DNA, 20 bp, Artificial Sequence
  Description of Artificial Sequence: Synthetic oligonucleotide
  Target: ATXN1; (+) strand; PAM type: NRG; PAM sequence: AAG
ttctagcctccaccacccac

SEQ ID NO: 138305 - DNA, 20 bp, Artificial Sequence
  Description of Artificial Sequence: Synthetic oligonucleotide
  Target: ATXN1; (+) strand; PAM type: NRG; PAM sequence: TGG
agcctccaccacccacaagc

SEQ ID NO: 138306 - DNA, 20 bp, Artificial Sequence
  Description of Artificial Sequence: Synthetic oligonucleotide
  Target: ATXN1; (+) strand; PAM type: NRG; PAM sequence: GGG
gcctccaccacccacaagct

SEQ ID NO: 138307 - DNA, 20 bp, Artificial Sequence
  Description of Artificial Sequence: Synthetic oligonucleotide
  Target: ATXN1; (+) strand; PAM type: NRG; PAM sequence: TGG
acccacaagctgggtaaatg

SEQ ID NO: 138308 - DNA, 20 bp, Artificial Sequence
  Description of Artificial Sequence: Synthetic oligonucleotide
  Target: ATXN1; (+) strand; PAM type: NRG; PAM sequence: GGG
cccacaagctgggtaaatgt

SEQ ID NO: 138309 - DNA, 20 bp, Artificial Sequence
  Description of Artificial Sequence: Synthetic oligonucleotide
  Target: ATXN1; (+) strand; PAM type: NRG; PAM sequence: GAG
caagctgggtaaatgtgggc

SEQ ID NO: 138310 - DNA, 20 bp, Artificial Sequence
  Description of Artificial Sequence: Synthetic oligonucleotide
  Target: ATXN1; (+) strand; PAM type: NRG; PAM sequence: TAG
gctgggtaaatgtgggcgag

SEQ ID NO: 138311 - DNA, 20 bp, Artificial Sequence
  Description of Artificial Sequence: Synthetic oligonucleotide
  Target: ATXN1; (+) strand; PAM type: NRG; PAM sequence: GAG
gcgagtagtttaatctatct

SEQ ID NO: 138312 - DNA, 20 bp, Artificial Sequence
  Description of Artificial Sequence: Synthetic oligonucleotide
  Target: ATXN1; (+) strand; PAM type: NRG; PAM sequence: TAG
ccaccatttttaaaaatctg

SEQ ID NO: 138313 - DNA, 20 bp, Artificial Sequence
  Description of Artificial Sequence: Synthetic oligonucleotide
  Target: ATXN1; (+) strand; PAM type: NRG; PAM sequence: TAG
atttttaaaaatctgtagaa

SEQ ID NO: 138314 - DNA, 20 bp, Artificial Sequence
  Description of Artificial Sequence: Synthetic oligonucleotide
  Target: ATXN1; (+) strand; PAM type: NRG; PAM sequence: CAG
aaaaatctgtagaatagtaa

SEQ ID NO: 138315 - DNA, 20 bp, Artificial Sequence
  Description of Artificial Sequence: Synthetic oligonucleotide
  Target: ATXN1; (+) strand; PAM type: NRG; PAM sequence: AAG
taacagcaataactacctca

SEQ ID NO: 138316 - DNA, 20 bp, Artificial Sequence
  Description of Artificial Sequence: Synthetic oligonucleotide
  Target: ATXN1; (+) strand; PAM type: NRG; PAM sequence: GAG
acagcaataactacctcaaa

SEQ ID NO: 138317 - DNA, 20 bp, Artificial Sequence
  Description of Artificial Sequence: Synthetic oligonucleotide
  Target: ATXN1; (+) strand; PAM type: NRG; PAM sequence: TGG
taactacctcaaagagttgt

SEQ ID NO: 138318 - DNA, 20 bp, Artificial Sequence
  Description of Artificial Sequence: Synthetic oligonucleotide
  Target: ATXN1; (+) strand; PAM type: NRG; PAM sequence: GGG
aactacctcaaagagttgtt

SEQ ID NO: 138319 - DNA, 20 bp, Artificial Sequence
  Description of Artificial Sequence: Synthetic oligonucleotide
  Target: ATXN1; (+) strand; PAM type: NRG; PAM sequence: CAG
aaagagttgttgggctaatt

SEQ ID NO: 138320 - DNA, 20 bp, Artificial Sequence
  Description of Artificial Sequence: Synthetic oligonucleotide
  Target: ATXN1; (+) strand; PAM type: NRG; PAM sequence: AGG
aagagttgttgggctaattc

SEQ ID NO: 138321 - DNA, 20 bp, Artificial Sequence
  Description of Artificial Sequence: Synthetic oligonucleotide
  Target: ATXN1; (+) strand; PAM type: NRG; PAM sequence: CAG
tgatgatcactgattatgat

SEQ ID NO: 138322 - DNA, 20 bp, Artificial Sequence
  Description of Artificial Sequence: Synthetic oligonucleotide
  Target: ATXN1; (+) strand; PAM type: NRG; PAM sequence: GAG
gatcactgattatgatcagt

SEQ ID NO: 138323 - DNA, 20 bp, Artificial Sequence
  Description of Artificial Sequence: Synthetic oligonucleotide
  Target: ATXN1; (+) strand; PAM type: NRG; PAM sequence: TAG
gattatgatcagtgagcttc

SEQ ID NO: 138324 - DNA, 20 bp, Artificial Sequence
  Description of Artificial Sequence: Synthetic oligonucleotide
  Target: ATXN1; (+) strand; PAM type: NRG; PAM sequence: AGG
attatgatcagtgagcttct

SEQ ID NO: 138325 - DNA, 20 bp, Artificial Sequence
  Description of Artificial Sequence: Synthetic oligonucleotide
  Target: ATXN1; (+) strand; PAM type: NRG; PAM sequence: CAG
cagtgagcttctaggtgtga

SEQ ID NO: 138326 - DNA, 20 bp, Artificial Sequence
  Description of Artificial Sequence: Synthetic oligonucleotide
  Target: ATXN1; (+) strand; PAM type: NRG; PAM sequence: AGG
agtgagcttctaggtgtgac

SEQ ID NO: 138327 - DNA, 20 bp, Artificial Sequence
  Description of Artificial Sequence: Synthetic oligonucleotide
  Target: ATXN1; (+) strand; PAM type: NRG; PAM sequence: CAG
gcttctaggtgtgacaggcc

SEQ ID NO: 138328 - DNA, 20 bp, Artificial Sequence
  Description of Artificial Sequence: Synthetic oligonucleotide
  Target: ATXN1; (+) strand; PAM type: NRG; PAM sequence: TGG
acaggcccagttttaaacac

SEQ ID NO: 138329 - DNA, 20 bp, Artificial Sequence
  Description of Artificial Sequence: Synthetic oligonucleotide
  Target: ATXN1; (+) strand; PAM type: NRG; PAM sequence: AAG
tttaaacactggaaatacac

SEQ ID NO: 138330 - DNA, 20 bp, Artificial Sequence
  Description of Artificial Sequence: Synthetic oligonucleotide
  Target: ATXN1; (+) strand; PAM type: NRG; PAM sequence: CAG
cactggaaatacacaagtga

SEQ ID NO: 138331 - DNA, 20 bp, Artificial Sequence
  Description of Artificial Sequence: Synthetic oligonucleotide
  Target: ATXN1; (+) strand; PAM type: NRG; PAM sequence: AAG
aatacacaagtgacagatgt

SEQ ID NO: 138332 - DNA, 20 bp, Artificial Sequence
  Description of Artificial Sequence: Synthetic oligonucleotide
  Target: ATXN1; (+) strand; PAM type: NRG; PAM sequence: TGG
acaagtgacagatgtaagca

SEQ ID NO: 138333 - DNA, 20 bp, Artificial Sequence
  Description of Artificial Sequence: Synthetic oligonucleotide
  Target: ATXN1; (+) strand; PAM type: NRG; PAM sequence: GGG
caagtgacagatgtaagcat

SEQ ID NO: 138334 - DNA, 20 bp, Artificial Sequence
  Description of Artificial Sequence: Synthetic oligonucleotide
  Target: ATXN1; (+) strand; PAM type: NRG; PAM sequence: CAG
aagcatgggctctgcttcca

SEQ ID NO: 138335 - DNA, 20 bp, Artificial Sequence
  Description of Artificial Sequence: Synthetic oligonucleotide
  Target: ATXN1; (+) strand; PAM type: NRG; PAM sequence: TAG
ttaacatcactctcaaattt

SEQ ID NO: 138336 - DNA, 20 bp, Artificial Sequence
  Description of Artificial Sequence: Synthetic oligonucleotide
  Target: ATXN1; (+) strand; PAM type: NRG; PAM sequence: GAG
ctctcaaattttagtgaaat

SEQ ID NO: 138337 - DNA, 20 bp, Artificial Sequence
  Description of Artificial Sequence: Synthetic oligonucleotide
  Target: ATXN1; (+) strand; PAM type: NRG; PAM sequence: AAG
caaattttagtgaaatgaga

SEQ ID NO: 138338 - DNA, 20 bp, Artificial Sequence
  Description of Artificial Sequence: Synthetic oligonucleotide
  Target: ATXN1; (+) strand; PAM type: NRG; PAM sequence: AAG
gtgaaatgagaaagacaaac

SEQ ID NO: 138339 - DNA, 20 bp, Artificial Sequence
  Description of Artificial Sequence: Synthetic oligonucleotide
  Target: ATXN1; (+) strand; PAM type: NRG; PAM sequence: AAG
aaagacaaacaagtatgtgt

SEQ ID NO: 138340 - DNA, 20 bp, Artificial Sequence
  Description of Artificial Sequence: Synthetic oligonucleotide
  Target: ATXN1; (+) strand; PAM type: NRG; PAM sequence: AAG
caagtatgtgtaagtgcaat

SEQ ID NO: 138341 - DNA, 20 bp, Artificial Sequence
  Description of Artificial Sequence: Synthetic oligonucleotide
  Target: ATXN1; (+) strand; PAM type: NRG; PAM sequence: AGG
aagtatgtgtaagtgcaata

SEQ ID NO: 138342 - DNA, 20 bp, Artificial Sequence
  Description of Artificial Sequence: Synthetic oligonucleotide
  Target: ATXN1; (+) strand; PAM type: NRG; PAM sequence: CGG
gcaataaggaaaaattaaac

SEQ ID NO: 138343 - DNA, 20 bp, Artificial Sequence
  Description of Artificial Sequence: Synthetic oligonucleotide
  Target: ATXN1; (+) strand; PAM type: NRG; PAM sequence: AAG
aaggaaaaattaaaccggtg

SEQ ID NO: 138344 - DNA, 20 bp, Artificial Sequence
  Description of Artificial Sequence: Synthetic oligonucleotide
  Target: ATXN1; (+) strand; PAM type: NRG; PAM sequence: AGG
aggaaaaattaaaccggtga

SEQ ID NO: 138345 - DNA, 20 bp, Artificial Sequence
  Description of Artificial Sequence: Synthetic oligonucleotide
  Target: ATXN1; (+) strand; PAM type: NRG; PAM sequence: GGG
ggaaaaattaaaccggtgaa

SEQ ID NO: 138346 - DNA, 20 bp, Artificial Sequence
  Description of Artificial Sequence: Synthetic oligonucleotide
  Target: ATXN1; (+) strand; PAM type: NRG; PAM sequence: GGG
gaaaaattaaaccggtgaag

SEQ ID NO: 138347 - DNA, 20 bp, Artificial Sequence
  Description of Artificial Sequence: Synthetic oligonucleotide
  Target: ATXN1; (+) strand; PAM type: NRG; PAM sequence: GAG
tgaaggggataaaaactgat

SEQ ID NO: 138348 - DNA, 20 bp, Artificial Sequence
  Description of Artificial Sequence: Synthetic oligonucleotide
  Target: ATXN1; (+) strand; PAM type: NRG; PAM sequence: AGG
gaaggggataaaaactgatg

SEQ ID NO: 138349 - DNA, 20 bp, Artificial Sequence
  Description of Artificial Sequence: Synthetic oligonucleotide
  Target: ATXN1; (+) strand; PAM type: NRG; PAM sequence: GGG
aaggggataaaaactgatga

SEQ ID NO: 138350 - DNA, 20 bp, Artificial Sequence
  Description of Artificial Sequence: Synthetic oligonucleotide
  Target: ATXN1; (+) strand; PAM type: NRG; PAM sequence: TAG
aactgatgagggtgttattt

SEQ ID NO: 138351 - DNA, 20 bp, Artificial Sequence
  Description of Artificial Sequence: Synthetic oligonucleotide
  Target: ATXN1; (+) strand; PAM type: NRG; PAM sequence: GAG
ctgatgagggtgttatttta

SEQ ID NO: 138352 - DNA, 20 bp, Artificial Sequence
  Description of Artificial Sequence: Synthetic oligonucleotide
  Target: ATXN1; (+) strand; PAM type: NRG; PAM sequence: AAG
tgttattttagagtaatgca

SEQ ID NO: 138353 - DNA, 20 bp, Artificial Sequence
  Description of Artificial Sequence: Synthetic oligonucleotide
  Target: ATXN1; (+) strand; PAM type: NRG; PAM sequence: GAG
tagagtaatgcaaagaccct

SEQ ID NO: 138354 - DNA, 20 bp, Artificial Sequence
  Description of Artificial Sequence: Synthetic oligonucleotide
  Target: ATXN1; (+) strand; PAM type: NRG; PAM sequence: AGG
agagtaatgcaaagaccctg

SEQ ID NO: 138355 - DNA, 20 bp, Artificial Sequence
  Description of Artificial Sequence: Synthetic oligonucleotide
  Target: ATXN1; (+) strand; PAM type: NRG; PAM sequence: GGG
gagtaatgcaaagaccctga

SEQ ID NO: 138356 - DNA, 20 bp, Artificial Sequence
  Description of Artificial Sequence: Synthetic oligonucleotide
  Target: ATXN1; (+) strand; PAM type: NRG; PAM sequence: GAG
gtaatgcaaagaccctgagg

SEQ ID NO: 138357 - DNA, 20 bp, Artificial Sequence
  Description of Artificial Sequence: Synthetic oligonucleotide
  Target: ATXN1; (+) strand; PAM type: NRG; PAM sequence: AGG
taatgcaaagaccctgaggg

SEQ ID NO: 138358 - DNA, 20 bp, Artificial Sequence
  Description of Artificial Sequence: Synthetic oligonucleotide
  Target: ATXN1; (+) strand; PAM type: NRG; PAM sequence: CGG
aggaacatgtttgcattaaa

SEQ ID NO: 138359 - DNA, 20 bp, Artificial Sequence
  Description of Artificial Sequence: Synthetic oligonucleotide
  Target: ATXN1; (+) strand; PAM type: NRG; PAM sequence: AAG
acatgtttgcattaaacggt

SEQ ID NO: 138360 - DNA, 20 bp, Artificial Sequence
  Description of Artificial Sequence: Synthetic oligonucleotide
  Target: ATXN1; (+) strand; PAM type: NRG; PAM sequence: AGG
catgtttgcattaaacggta

SEQ ID NO: 138361 - DNA, 20 bp, Artificial Sequence
  Description of Artificial Sequence: Synthetic oligonucleotide
  Target: ATXN1; (+) strand; PAM type: NRG; PAM sequence: GAG
tgtttgcattaaacggtaag

SEQ ID NO: 138362 - DNA, 20 bp, Artificial Sequence
  Description of Artificial Sequence: Synthetic oligonucleotide
  Target: ATXN1; (+) strand; PAM type: NRG; PAM sequence: TAG
gcattaaacggtaaggagct

SEQ ID NO: 138363 - DNA, 20 bp, Artificial Sequence
  Description of Artificial Sequence: Synthetic oligonucleotide
  Target: ATXN1; (+) strand; PAM type: NRG; PAM sequence: CAG
aaacggtaaggagcttagct

SEQ ID NO: 138364 - DNA, 20 bp, Artificial Sequence
  Description of Artificial Sequence: Synthetic oligonucleotide
  Target: ATXN1; (+) strand; PAM type: NRG; PAM sequence: AGG
aacggtaaggagcttagctc

SEQ ID NO: 138365 - DNA, 20 bp, Artificial Sequence
  Description of Artificial Sequence: Synthetic oligonucleotide
  Target: ATXN1; (+) strand; PAM type: NRG; PAM sequence: GGG
acggtaaggagcttagctca

SEQ ID NO: 138366 - DNA, 20 bp, Artificial Sequence
  Description of Artificial Sequence: Synthetic oligonucleotide
  Target: ATXN1; (+) strand; PAM type: NRG; PAM sequence: TAG
gctcataaaaccatgtgctc

SEQ ID NO: 138367 - DNA, 20 bp, Artificial Sequence
  Description of Artificial Sequence: Synthetic oligonucleotide
  Target: ATXN1; (+) strand; PAM type: NRG; PAM sequence: AGG
ctcataaaaccatgtgctct

SEQ ID NO: 138368 - DNA, 20 bp, Artificial Sequence
  Description of Artificial Sequence: Synthetic oligonucleotide
  Target: ATXN1; (+) strand; PAM type: NRG; PAM sequence: GAG
cataaaaccatgtgctctag

SEQ ID NO: 138369 - DNA, 20 bp, Artificial Sequence
  Description of Artificial Sequence: Synthetic oligonucleotide
  Target: ATXN1; (+) strand; PAM type: NRG; PAM sequence: TGG
aaaccatgtgctctaggaga

SEQ ID NO: 138370 - DNA, 20 bp, Artificial Sequence
  Description of Artificial Sequence: Synthetic oligonucleotide
  Target: ATXN1; (+) strand; PAM type: NRG; PAM sequence: TGG
ggtgatgatgatgatgacca

SEQ ID NO: 138371 - DNA, 20 bp, Artificial Sequence
  Description of Artificial Sequence: Synthetic oligonucleotide
  Target: ATXN1; (+) strand; PAM type: NRG; PAM sequence: TGG
gatgatgatgatgaccatgg

SEQ ID NO: 138372 - DNA, 20 bp, Artificial Sequence
  Description of Artificial Sequence: Synthetic oligonucleotide
  Target: ATXN1; (+) strand; PAM type: NRG; PAM sequence: TGG
gatgatgatgaccatggtgg

SEQ ID NO: 138373 - DNA, 20 bp, Artificial Sequence
  Description of Artificial Sequence: Synthetic oligonucleotide
  Target: ATXN1; (+) strand; PAM type: NRG; PAM sequence: TGG
gatgatgaccatggtggtgg

SEQ ID NO: 138374 - DNA, 20 bp, Artificial Sequence
  Description of Artificial Sequence: Synthetic oligonucleotide
  Target: ATXN1; (+) strand; PAM type: NRG; PAM sequence: TGG
gatgaccatggtggtggtgg

SEQ ID NO: 138375 - DNA, 20 bp, Artificial Sequence
  Description of Artificial Sequence: Synthetic oligonucleotide
  Target: ATXN1; (+) strand; PAM type: NRG; PAM sequence: TGG
gaccatggtggtggtggtgg

SEQ ID NO: 138376 - DNA, 20 bp, Artificial Sequence
  Description of Artificial Sequence: Synthetic oligonucleotide
  Target: ATXN1; (+) strand; PAM type: NRG; PAM sequence: TGG
atggtggtggtggtggtggt

SEQ ID NO: 138377 - DNA, 20 bp, Artificial Sequence
  Description of Artificial Sequence: Synthetic oligonucleotide
  Target: ATXN1; (+) strand; PAM type: NRG; PAM sequence: TGG
gtggtggtggtggtggttgg

SEQ ID NO: 138378 - DNA, 20 bp, Artificial Sequence
  Description of Artificial Sequence: Synthetic oligonucleotide
  Target: ATXN1; (+) strand; PAM type: NRG; PAM sequence: TGG
gtggtggtggtggttggtgg

SEQ ID NO: 138379 - DNA, 20 bp, Artificial Sequence
  Description of Artificial Sequence: Synthetic oligonucleotide
  Target: ATXN1; (+) strand; PAM type: NRG; PAM sequence: AAG
tctcataacgataaccaaac

SEQ ID NO: 138380 - DNA, 20 bp, Artificial Sequence
  Description of Artificial Sequence: Synthetic oligonucleotide
  Target: ATXN1; (+) strand; PAM type: NRG; PAM sequence: AAG
taacgataaccaaacaagca

SEQ ID NO: 138381 - DNA, 20 bp, Artificial Sequence
  Description of Artificial Sequence: Synthetic oligonucleotide
  Target: ATXN1; (+) strand; PAM type: NRG; PAM sequence: GAG
acgataaccaaacaagcaaa

SEQ ID NO: 138382 - DNA, 20 bp, Artificial Sequence
  Description of Artificial Sequence: Synthetic oligonucleotide
  Target: ATXN1; (+) strand; PAM type: NRG; PAM sequence: AAG
accaaacaagcaaagagtac

SEQ ID NO: 138383 - DNA, 20 bp, Artificial Sequence
  Description of Artificial Sequence: Synthetic oligonucleotide
  Target: ATXN1; (+) strand; PAM type: NRG; PAM sequence: AGG
ccaaacaagcaaagagtaca

SEQ ID NO: 138384 - DNA, 20 bp, Artificial Sequence
  Description of Artificial Sequence: Synthetic oligonucleotide
  Target: ATXN1; (+) strand; PAM type: NRG; PAM sequence: GGG
caaacaagcaaagagtacaa

SEQ ID NO: 138385 - DNA, 20 bp, Artificial Sequence
  Description of Artificial Sequence: Synthetic oligonucleotide
  Target: ATXN1; (+) strand; PAM type: NRG; PAM sequence: TAG
gagtacaagggatgtgcgaa

SEQ ID NO: 138386 - DNA, 20 bp, Artificial Sequence
  Description of Artificial Sequence: Synthetic oligonucleotide
  Target: ATXN1; (+) strand; PAM type: NRG; PAM sequence: AGG
agtacaagggatgtgcgaat

SEQ ID NO: 138387 - DNA, 20 bp, Artificial Sequence
  Description of Artificial Sequence: Synthetic oligonucleotide
  Target: ATXN1; (+) strand; PAM type: NRG; PAM sequence: CAG
aagggatgtgcgaataggta

SEQ ID NO: 138388 - DNA, 20 bp, Artificial Sequence
  Description of Artificial Sequence: Synthetic oligonucleotide
  Target: ATXN1; (+) strand; PAM type: NRG; PAM sequence: AAG
gaataggtacagcccacatt

SEQ ID NO: 138389 - DNA, 20 bp, Artificial Sequence
  Description of Artificial Sequence: Synthetic oligonucleotide
  Target: ATXN1; (+) strand; PAM type: NRG; PAM sequence: AAG
ggtacagcccacattaagta

SEQ ID NO: 138390 - DNA, 20 bp, Artificial Sequence
  Description of Artificial Sequence: Synthetic oligonucleotide
  Target: ATXN1; (+) strand; PAM type: NRG; PAM sequence: TAG
aagaaatgaactgacaaaat

SEQ ID NO: 138391 - DNA, 20 bp, Artificial Sequence
  Description of Artificial Sequence: Synthetic oligonucleotide
  Target: ATXN1; (+) strand; PAM type: NRG; PAM sequence: CAG
gacaaaattagtatcgaaca

SEQ ID NO: 138392 - DNA, 20 bp, Artificial Sequence
  Description of Artificial Sequence: Synthetic oligonucleotide
  Target: ATXN1; (+) strand; PAM type: NRG; PAM sequence: AGG
acaaaattagtatcgaacac

SEQ ID NO: 138393 - DNA, 20 bp, Artificial Sequence
  Description of Artificial Sequence: Synthetic oligonucleotide
  Target: ATXN1; (+) strand; PAM type: NRG; PAM sequence: AAG
aaattagtatcgaacacagg

SEQ ID NO: 138394 - DNA, 20 bp, Artificial Sequence
  Description of Artificial Sequence: Synthetic oligonucleotide
  Target: ATXN1; (+) strand; PAM type: NRG; PAM sequence: TAG
cgaacacaggaagtactaat

SEQ ID NO: 138395 - DNA, 20 bp, Artificial Sequence
  Description of Artificial Sequence: Synthetic oligonucleotide
  Target: ATXN1; (+) strand; PAM type: NRG; PAM sequence: AAG
tgactaattttcatttatta

SEQ ID NO: 138396 - DNA, 20 bp, Artificial Sequence
  Description of Artificial Sequence: Synthetic oligonucleotide
  Target: ATXN1; (+) strand; PAM type: NRG; PAM sequence: CAG
ttttcatttattaaagactg

SEQ ID NO: 138397 - DNA, 20 bp, Artificial Sequence
  Description of Artificial Sequence: Synthetic oligonucleotide
  Target: ATXN1; (+) strand; PAM type: NRG; PAM sequence: TAG
aaagactgcagttctatttt

SEQ ID NO: 138398 - DNA, 20 bp, Artificial Sequence
  Description of Artificial Sequence: Synthetic oligonucleotide
  Target: ATXN1; (+) strand; PAM type: NRG; PAM sequence: AAG
ccttcaatctaacatcattc

SEQ ID NO: 138399 - DNA, 20 bp, Artificial Sequence
  Description of Artificial Sequence: Synthetic oligonucleotide
  Target: ATXN1; (+) strand; PAM type: NRG; PAM sequence: AAG
aatctaacatcattcaagaa

SEQ ID NO: 138400 - DNA, 20 bp, Artificial Sequence
  Description of Artificial Sequence: Synthetic oligonucleotide
  Target: ATXN1; (+) strand; PAM type: NRG; PAM sequence: CAG
tctctccaaaaattctattt

SEQ ID NO: 138401 - DNA, 20 bp, Artificial Sequence
  Description of Artificial Sequence: Synthetic oligonucleotide
  Target: ATXN1; (+) strand; PAM type: NRG; PAM sequence: AGG
ctctccaaaaattctatttc

SEQ ID NO: 138402 - DNA, 20 bp, Artificial Sequence
  Description of Artificial Sequence: Synthetic oligonucleotide
  Target: ATXN1; (+) strand; PAM type: NRG; PAM sequence: AAG
tcaggaatgtaaatttttaa

SEQ ID NO: 138403 - DNA, 20 bp, Artificial Sequence
  Description of Artificial Sequence: Synthetic oligonucleotide
  Target: ATXN1; (+) strand; PAM type: NRG; PAM sequence: AAG
gaatgtaaatttttaaaagt

SEQ ID NO: 138404 - DNA, 20 bp, Artificial Sequence
  Description of Artificial Sequence: Synthetic oligonucleotide
  Target: ATXN1; (+) strand; PAM type: NRG; PAM sequence: GAG
atgtaaatttttaaaagtaa

SEQ ID NO: 138405 - DNA, 20 bp, Artificial Sequence
  Description of Artificial Sequence: Synthetic oligonucleotide
  Target: ATXN1; (+) strand; PAM type: NRG; PAM sequence: CAG
atgcatgatttctttttacc

SEQ ID NO: 138406 - DNA, 20 bp, Artificial Sequence
  Description of Artificial Sequence: Synthetic oligonucleotide
  Target: ATXN1; (+) strand; PAM type: NRG; PAM sequence: TGG
ttacccagccatctttctgt

SEQ ID NO: 138407 - DNA, 20 bp, Artificial Sequence
  Description of Artificial Sequence: Synthetic oligonucleotide
  Target: ATXN1; (+) strand; PAM type: NRG; PAM sequence: TAG
gccatctttctgttggtttt

SEQ ID NO: 138408 - DNA, 20 bp, Artificial Sequence
  Description of Artificial Sequence: Synthetic oligonucleotide
  Target: ATXN1; (+) strand; PAM type: NRG; PAM sequence: CAG
tctgttggtttttagcctgc

SEQ ID NO: 138409 - DNA, 20 bp, Artificial Sequence
  Description of Artificial Sequence: Synthetic oligonucleotide
  Target: ATXN1; (+) strand; PAM type: NRG; PAM sequence: TAG
gttggtttttagcctgccag

SEQ ID NO: 138410 - DNA, 20 bp, Artificial Sequence
  Description of Artificial Sequence: Synthetic oligonucleotide
  Target: ATXN1; (+) strand; PAM type: NRG; PAM sequence: AAG
agtgtgtatgtgatatttta

SEQ ID NO: 138411 - DNA, 20 bp, Artificial Sequence
  Description of Artificial Sequence: Synthetic oligonucleotide
  Target: ATXN1; (+) strand; PAM type: NRG; PAM sequence: CAG
tattttaaagacttactatg

SEQ ID NO: 138412 - DNA, 20 bp, Artificial Sequence
  Description of Artificial Sequence: Synthetic oligonucleotide
  Target: ATXN1; (+) strand; PAM type: NRG; PAM sequence: AGG
attttaaagacttactatgc

SEQ ID NO: 138413 - DNA, 20 bp, Artificial Sequence
  Description of Artificial Sequence: Synthetic oligonucleotide
  Target: ATXN1; (+) strand; PAM type: NRG; PAM sequence: GGG
ttttaaagacttactatgca

SEQ ID NO: 138414 - DNA, 20 bp, Artificial Sequence
  Description of Artificial Sequence: Synthetic oligonucleotide
  Target: ATXN1; (+) strand; PAM type: NRG; PAM sequence: TAG
gacttactatgcagggtact

SEQ ID NO: 138415 - DNA, 20 bp, Artificial Sequence
  Description of Artificial Sequence: Synthetic oligonucleotide
  Target: ATXN1; (+) strand; PAM type: NRG; PAM sequence: GAG
ggtacttagaaatttcatat

SEQ ID NO: 138416 - DNA, 20 bp, Artificial Sequence
  Description of Artificial Sequence: Synthetic oligonucleotide
  Target: ATXN1; (+) strand; PAM type: NRG; PAM sequence: TGG
tttcatatgagcatttaaaa

SEQ ID NO: 138417 - DNA, 20 bp, Artificial Sequence
  Description of Artificial Sequence: Synthetic oligonucleotide
  Target: ATXN1; (+) strand; PAM type: NRG; PAM sequence: CAG
catatgagcatttaaaatgg

SEQ ID NO: 138418 - DNA, 20 bp, Artificial Sequence
  Description of Artificial Sequence: Synthetic oligonucleotide
  Target: ATXN1; (+) strand; PAM type: NRG; PAM sequence: TAG
agcatttaaaatggcagaaa

SEQ ID NO: 138419 - DNA, 20 bp, Artificial Sequence
  Description of Artificial Sequence: Synthetic oligonucleotide
  Target: ATXN1; (+) strand; PAM type: NRG; PAM sequence: TGG
tttaaaatggcagaaatagc

SEQ ID NO: 138420 - DNA, 20 bp, Artificial Sequence
  Description of Artificial Sequence: Synthetic oligonucleotide
  Target: ATXN1; (+) strand; PAM type: NRG; PAM sequence: TAG
aaaatggcagaaatagctgg

SEQ ID NO: 138421 - DNA, 20 bp, Artificial Sequence
  Description of Artificial Sequence: Synthetic oligonucleotide
  Target: ATXN1; (+) strand; PAM type: NRG; PAM sequence: CAG
ttcatttccacatgtactct

SEQ ID NO: 138422 - DNA, 20 bp, Artificial Sequence
  Description of Artificial Sequence: Synthetic oligonucleotide
  Target: ATXN1; (+) strand; PAM type: NRG; PAM sequence: CAG
ttccacatgtactctcagaa

SEQ ID NO: 138423 - DNA, 20 bp, Artificial Sequence
  Description of Artificial Sequence: Synthetic oligonucleotide
  Target: ATXN1; (+) strand; PAM type: NRG; PAM sequence: GAG
ccacatgtactctcagaaca

SEQ ID NO: 138424 - DNA, 20 bp, Artificial Sequence
  Description of Artificial Sequence: Synthetic oligonucleotide
  Target: ATXN1; (+) strand; PAM type: NRG; PAM sequence: GAG
ctctcagaacagagaaaaac

SEQ ID NO: 138425 - DNA, 20 bp, Artificial Sequence
  Description of Artificial Sequence: Synthetic oligonucleotide
  Target: ATXN1; (+) strand; PAM type: NRG; PAM sequence: AAG
gttctaatccatgtctttct

SEQ ID NO: 138426 - DNA, 20 bp, Artificial Sequence
  Description of Artificial Sequence: Synthetic oligonucleotide
  Target: ATXN1; (+) strand; PAM type: NRG; PAM sequence: TAG
tccatgtctttctaagcttc

SEQ ID NO: 138427 - DNA, 20 bp, Artificial Sequence
  Description of Artificial Sequence: Synthetic oligonucleotide
  Target: ATXN1; (+) strand; PAM type: NRG; PAM sequence: CAG
ccttttttttttaactgtct

SEQ ID NO: 138428 - DNA, 20 bp, Artificial Sequence
  Description of Artificial Sequence: Synthetic oligonucleotide
  Target: ATXN1; (+) strand; PAM type: NRG; PAM sequence: AGG
cttttttttttaactgtctc

SEQ ID NO: 138429 - DNA, 20 bp, Artificial Sequence
  Description of Artificial Sequence: Synthetic oligonucleotide
  Target: ATXN1; (+) strand; PAM type: NRG; PAM sequence: GGG
ttttttttttaactgtctca

SEQ ID NO: 138430 - DNA, 20 bp, Artificial Sequence
  Description of Artificial Sequence: Synthetic oligonucleotide
  Target: ATXN1; (+) strand; PAM type: NRG; PAM sequence: TGG
tttctgcaacgtaacttttt

SEQ ID NO: 138431 - DNA, 20 bp, Artificial Sequence
  Description of Artificial Sequence: Synthetic oligonucleotide
  Target: ATXN1; (+) strand; PAM type: NRG; PAM sequence: CAG
taacttttttggcttcatat

SEQ ID NO: 138432 - DNA, 20 bp, Artificial Sequence
  Description of Artificial Sequence: Synthetic oligonucleotide
  Target: ATXN1; (+) strand; PAM type: NRG; PAM sequence: AGG
aacttttttggcttcatatc

SEQ ID NO: 138433 - DNA, 20 bp, Artificial Sequence
  Description of Artificial Sequence: Synthetic oligonucleotide
  Target: ATXN1; (+) strand; PAM type: NRG; PAM sequence: TAG
gtatctatattgctcctata

SEQ ID NO: 138434 - DNA, 20 bp, Artificial Sequence
  Description of Artificial Sequence: Synthetic oligonucleotide
  Target: ATXN1; (+) strand; PAM type: NRG; PAM sequence: TAG
atattgctcctatatagttt

SEQ ID NO: 138435 - DNA, 20 bp, Artificial Sequence
  Description of Artificial Sequence: Synthetic oligonucleotide
  Target: ATXN1; (+) strand; PAM type: NRG; PAM sequence: AAG
tttcactttaataaacattc

SEQ ID NO: 138436 - DNA, 20 bp, Artificial Sequence
  Description of Artificial Sequence: Synthetic oligonucleotide
  Target: ATXN1; (+) strand; PAM type: NRG; PAM sequence: TAG
cactttaataaacattcaag

SEQ ID NO: 138437 - DNA, 20 bp, Artificial Sequence
  Description of Artificial Sequence: Synthetic oligonucleotide
  Target: ATXN1; (+) strand; PAM type: NRG; PAM sequence: TGG
taataaacattcaagtagtt

SEQ ID NO: 138438 - DNA, 20 bp, Artificial Sequence
  Description of Artificial Sequence: Synthetic oligonucleotide
  Target: ATXN1; (+) strand; PAM type: NRG; PAM sequence: GGG
aataaacattcaagtagttt

SEQ ID NO: 138439 - DNA, 20 bp, Artificial Sequence
  Description of Artificial Sequence: Synthetic oligonucleotide
  Target: ATXN1; (+) strand; PAM type: NRG; PAM sequence: AAG
aaccattattaacacaaata

SEQ ID NO: 138440 - DNA, 20 bp, Artificial Sequence
  Description of Artificial Sequence: Synthetic oligonucleotide
  Target: ATXN1; (+) strand; PAM type: NRG; PAM sequence: TGG
taacacaaataaagctgtgc

SEQ ID NO: 138441 - DNA, 20 bp, Artificial Sequence
  Description of Artificial Sequence: Synthetic oligonucleotide
  Target: ATXN1; (+) strand; PAM type: NRG; PAM sequence: GAG
acacaaataaagctgtgctg

SEQ ID NO: 138442 - DNA, 20 bp, Artificial Sequence
  Description of Artificial Sequence: Synthetic oligonucleotide
  Target: ATXN1; (+) strand; PAM type: NRG; PAM sequence: GAG
acaaataaagctgtgctgga

SEQ ID NO: 138443 - DNA, 20 bp, Artificial Sequence
  Description of Artificial Sequence: Synthetic oligonucleotide
  Target: ATXN1; (+) strand; PAM type: NRG; PAM sequence: TGG
tggagagcctccatgtctcg

SEQ ID NO: 138444 - DNA, 20 bp, Artificial Sequence
  Description of Artificial Sequence: Synthetic oligonucleotide
  Target: ATXN1; (+) strand; PAM type: NRG; PAM sequence: CAG
cctccatgtctcgtggtata

SEQ ID NO: 138445 - DNA, 20 bp, Artificial Sequence
  Description of Artificial Sequence: Synthetic oligonucleotide
  Target: ATXN1; (+) strand; PAM type: NRG; PAM sequence: CAG
atgtctcgtggtatacagta

SEQ ID NO: 138446 - DNA, 20 bp, Artificial Sequence
  Description of Artificial Sequence: Synthetic oligonucleotide
  Target: ATXN1; (+) strand; PAM type: NRG; PAM sequence: AAG
tctcgtggtatacagtacag

SEQ ID NO: 138447 - DNA, 20 bp, Artificial Sequence
  Description of Artificial Sequence: Synthetic oligonucleotide
  Target: ATXN1; (+) strand; PAM type: NRG; PAM sequence: TAG
gtatacagtacagaagtctc

SEQ ID NO: 138448 - DNA, 20 bp, Artificial Sequence
  Description of Artificial Sequence: Synthetic oligonucleotide
  Target: ATXN1; (+) strand; PAM type: NRG; PAM sequence: AGG
tatacagtacagaagtctct

SEQ ID NO: 138449 - DNA, 20 bp, Artificial Sequence
  Description of Artificial Sequence: Synthetic oligonucleotide
  Target: ATXN1; (+) strand; PAM type: NRG; PAM sequence: TAG
agaagtctctaggaaacacc

SEQ ID NO: 138450 - DNA, 20 bp, Artificial Sequence
  Description of Artificial Sequence: Synthetic oligonucleotide
  Target: ATXN1; (+) strand; PAM type: NRG; PAM sequence: AAG
agtctctaggaaacacctag

SEQ ID NO: 138451 - DNA, 20 bp, Artificial Sequence
  Description of Artificial Sequence: Synthetic oligonucleotide
  Target: ATXN1; (+) strand; PAM type: NRG; PAM sequence: AGG
gtctctaggaaacacctaga

SEQ ID NO: 138452 - DNA, 20 bp, Artificial Sequence
  Description of Artificial Sequence: Synthetic oligonucleotide
  Target: ATXN1; (+) strand; PAM type: NRG; PAM sequence: GAG
cacctagaaggaaaattgct

SEQ ID NO: 138453 - DNA, 20 bp, Artificial Sequence
  Description of Artificial Sequence: Synthetic oligonucleotide
  Target: ATXN1; (+) strand; PAM type: NRG; PAM sequence: CAG
gaaggaaaattgctgagtca

SEQ ID NO: 138454 - DNA, 20 bp, Artificial Sequence
  Description of Artificial Sequence: Synthetic oligonucleotide
  Target: ATXN1; (+) strand; PAM type: NRG; PAM sequence: AGG
aaggaaaattgctgagtcac

SEQ ID NO: 138455 - DNA, 20 bp, Artificial Sequence
  Description of Artificial Sequence: Synthetic oligonucleotide
  Target: ATXN1; (+) strand; PAM type: NRG; PAM sequence: GGG
aggaaaattgctgagtcaca

SEQ ID NO: 138456 - DNA, 20 bp, Artificial Sequence
  Description of Artificial Sequence: Synthetic oligonucleotide
  Target: ATXN1; (+) strand; PAM type: NRG; PAM sequence: TGG
acacatttgtttttgttaac

SEQ ID NO: 138457 - DNA, 20 bp, Artificial Sequence
  Description of Artificial Sequence: Synthetic oligonucleotide
  Target: ATXN1; (+) strand; PAM type: NRG; PAM sequence: TGG
tacctaactgtctttctaaa

SEQ ID NO: 138458 - DNA, 20 bp, Artificial Sequence
  Description of Artificial Sequence: Synthetic oligonucleotide
  Target: ATXN1; (+) strand; PAM type: NRG; PAM sequence: CAG
gtaccaatgaatattcctat

SEQ ID NO: 138459 - DNA, 20 bp, Artificial Sequence
  Description of Artificial Sequence: Synthetic oligonucleotide
  Target: ATXN1; (+) strand; PAM type: NRG; PAM sequence: CAG
ccaatgaatattcctatcag

SEQ ID NO: 138460 - DNA, 20 bp, Artificial Sequence
  Description of Artificial Sequence: Synthetic oligonucleotide
  Target: ATXN1; (+) strand; PAM type: NRG; PAM sequence: TGG
gaaatgccatttttcaaact

SEQ ID NO: 138461 - DNA, 20 bp, Artificial Sequence
  Description of Artificial Sequence: Synthetic oligonucleotide
  Target: ATXN1; (+) strand; PAM type: NRG; PAM sequence: TGG
tggaccaaaatattcattac

SEQ ID NO: 138462 - DNA, 20 bp, Artificial Sequence
  Description of Artificial Sequence: Synthetic oligonucleotide
  Target: ATXN1; (+) strand; PAM type: NRG; PAM sequence: GGG
ggaccaaaatattcattact

SEQ ID NO: 138463 - DNA, 20 bp, Artificial Sequence
  Description of Artificial Sequence: Synthetic oligonucleotide
  Target: ATXN1; (+) strand; PAM type: NRG; PAM sequence: CAG
atattcattactgggaactc

SEQ ID NO: 138464 - DNA, 20 bp, Artificial Sequence
  Description of Artificial Sequence: Synthetic oligonucleotide
  Target: ATXN1; (+) strand; PAM type: NRG; PAM sequence: AAG
gggaactccagatctcaaat

SEQ ID NO: 138465 - DNA, 20 bp, Artificial Sequence
  Description of Artificial Sequence: Synthetic oligonucleotide
  Target: ATXN1; (+) strand; PAM type: NRG; PAM sequence: AAG
ctccagatctcaaataagtc

SEQ ID NO: 138466 - DNA, 20 bp, Artificial Sequence
  Description of Artificial Sequence: Synthetic oligonucleotide
  Target: ATXN1; (+) strand; PAM type: NRG; PAM sequence: CAG
atctcaaataagtcaagtgt

SEQ ID NO: 138467 - DNA, 20 bp, Artificial Sequence
  Description of Artificial Sequence: Synthetic oligonucleotide
  Target: ATXN1; (+) strand; PAM type: NRG; PAM sequence: TGG
gtcagttccatctatcgctt

SEQ ID NO: 138468 - DNA, 20 bp, Artificial Sequence
  Description of Artificial Sequence: Synthetic oligonucleotide
  Target: ATXN1; (+) strand; PAM type: NRG; PAM sequence: CAG
aactgttctttgaacaaatc

SEQ ID NO: 138469 - DNA, 20 bp, Artificial Sequence
  Description of Artificial Sequence: Synthetic oligonucleotide
  Target: ATXN1; (+) strand; PAM type: NRG; PAM sequence: AAG
tttgaacaaatccagacttg

SEQ ID NO: 138470 - DNA, 20 bp, Artificial Sequence
  Description of Artificial Sequence: Synthetic oligonucleotide
  Target: ATXN1; (+) strand; PAM type: NRG; PAM sequence: TAG
tttccattctgttaaatttc

SEQ ID NO: 138471 - DNA, 20 bp, Artificial Sequence
  Description of Artificial Sequence: Synthetic oligonucleotide
  Target: ATXN1; (+) strand; PAM type: NRG; PAM sequence: AAG
ctcatcacaatcaactacgc

SEQ ID NO: 138472 - DNA, 20 bp, Artificial Sequence
  Description of Artificial Sequence: Synthetic oligonucleotide
  Target: ATXN1; (+) strand; PAM type: NRG; PAM sequence: AAG
gcaagcaaacaataccccat

SEQ ID NO: 138473 - DNA, 20 bp, Artificial Sequence
  Description of Artificial Sequence: Synthetic oligonucleotide
  Target: ATXN1; (+) strand; PAM type: NRG; PAM sequence: AAG
taccccataagaacaacaat

SEQ ID NO: 138474 - DNA, 20 bp, Artificial Sequence
  Description of Artificial Sequence: Synthetic oligonucleotide
  Target: ATXN1; (+) strand; PAM type: NRG; PAM sequence: TGG
aataagtaatcacatattgc

SEQ ID NO: 138475 - DNA, 20 bp, Artificial Sequence
  Description of Artificial Sequence: Synthetic oligonucleotide
  Target: ATXN1; (+) strand; PAM type: NRG; PAM sequence: CAG
taatcacatattgctggctc

SEQ ID NO: 138476 - DNA, 20 bp, Artificial Sequence
  Description of Artificial Sequence: Synthetic oligonucleotide
  Target: ATXN1; (+) strand; PAM type: NRG; PAM sequence: AGG
aatcacatattgctggctcc

SEQ ID NO: 138477 - DNA, 20 bp, Artificial Sequence
  Description of Artificial Sequence: Synthetic oligonucleotide
  Target: ATXN1; (+) strand; PAM type: NRG; PAM sequence: AAG
cacatattgctggctccagg

SEQ ID NO: 138478 - DNA, 20 bp, Artificial Sequence
  Description of Artificial Sequence: Synthetic oligonucleotide
  Target: ATXN1; (+) strand; PAM type: NRG; PAM sequence: AAG
tggctccaggaagcaaaatg

SEQ ID NO: 138479 - DNA, 20 bp, Artificial Sequence
  Description of Artificial Sequence: Synthetic oligonucleotide
  Target: ATXN1; (+) strand; PAM type: NRG; PAM sequence: AAG
aaatgaagacatttaaatta

SEQ ID NO: 138480 - DNA, 20 bp, Artificial Sequence
  Description of Artificial Sequence: Synthetic oligonucleotide
  Target: ATXN1; (+) strand; PAM type: NRG; PAM sequence: TGG
acatgcttacaaaaatattc

SEQ ID NO: 138481 - DNA, 20 bp, Artificial Sequence
  Description of Artificial Sequence: Synthetic oligonucleotide
  Target: ATXN1; (+) strand; PAM type: NRG; PAM sequence: AAG
caattaatctgaaccaaact

SEQ ID NO: 138482 - DNA, 20 bp, Artificial Sequence
  Description of Artificial Sequence: Synthetic oligonucleotide
  Target: ATXN1; (+) strand; PAM type: NRG; PAM sequence: TAG
gaaccaaactaagaataatc

SEQ ID NO: 138483 - DNA, 20 bp, Artificial Sequence
  Description of Artificial Sequence: Synthetic oligonucleotide
  Target: ATXN1; (+) strand; PAM type: NRG; PAM sequence: TAG
cccaatcttctgttcccatt

SEQ ID NO: 138484 - DNA, 20 bp, Artificial Sequence
  Description of Artificial Sequence: Synthetic oligonucleotide
  Target: ATXN1; (+) strand; PAM type: NRG; PAM sequence: TGG
ttctgttcccatttagttca

SEQ ID NO: 138485 - DNA, 20 bp, Artificial Sequence
  Description of Artificial Sequence: Synthetic oligonucleotide
  Target: ATXN1; (+) strand; PAM type: NRG; PAM sequence: CGG
agttcatggcatttttataa

SEQ ID NO: 138486 - DNA, 20 bp, Artificial Sequence
  Description of Artificial Sequence: Synthetic oligonucleotide
  Target: ATXN1; (+) strand; PAM type: NRG; PAM sequence: GGG
gttcatggcatttttataac

SEQ ID NO: 138487 - DNA, 20 bp, Artificial Sequence
  Description of Artificial Sequence: Synthetic oligonucleotide
  Target: ATXN1; (+) strand; PAM type: NRG; PAM sequence: CAG
atttttataacgggacttgc

SEQ ID NO: 138488 - DNA, 20 bp, Artificial Sequence
  Description of Artificial Sequence: Synthetic oligonucleotide
  Target: ATXN1; (+) strand; PAM type: NRG; PAM sequence: AAG
tataacgggacttgccagat

SEQ ID NO: 138489 - DNA, 20 bp, Artificial Sequence
  Description of Artificial Sequence: Synthetic oligonucleotide
  Target: ATXN1; (+) strand; PAM type: NRG; PAM sequence: AAG
aacgggacttgccagataag

SEQ ID NO: 138490 - DNA, 20 bp, Artificial Sequence
  Description of Artificial Sequence: Synthetic oligonucleotide
  Target: ATXN1; (+) strand; PAM type: NRG; PAM sequence: GAG
taagaagcatgtgtgtgtct

SEQ ID NO: 138491 - DNA, 20 bp, Artificial Sequence
  Description of Artificial Sequence: Synthetic oligonucleotide
  Target: ATXN1; (+) strand; PAM type: NRG; PAM sequence: AAG
catgtgtgtgtctgagaact

SEQ ID NO: 138492 - DNA, 20 bp, Artificial Sequence
  Description of Artificial Sequence: Synthetic oligonucleotide
  Target: ATXN1; (+) strand; PAM type: NRG; PAM sequence: AGG
atgtgtgtgtctgagaacta

SEQ ID NO: 138493 - DNA, 20 bp, Artificial Sequence
  Description of Artificial Sequence: Synthetic oligonucleotide
  Target: ATXN1; (+) strand; PAM type: NRG; PAM sequence: AAG
tgtctgagaactaaggaaaa

SEQ ID NO: 138494 - DNA, 20 bp, Artificial Sequence
  Description of Artificial Sequence: Synthetic oligonucleotide
  Target: ATXN1; (+) strand; PAM type: NRG; PAM sequence: AGG
gtctgagaactaaggaaaaa

SEQ ID NO: 138495 - DNA, 20 bp, Artificial Sequence
  Description of Artificial Sequence: Synthetic oligonucleotide
  Target: ATXN1; (+) strand; PAM type: NRG; PAM sequence: TGG
agaactaaggaaaaaaggat

SEQ ID NO: 138496 - DNA, 20 bp, Artificial Sequence
  Description of Artificial Sequence: Synthetic oligonucleotide
  Target: ATXN1; (+) strand; PAM type: NRG; PAM sequence: TAG
aaaaacatatccgatgtgaa

SEQ ID NO: 138497 - DNA, 20 bp, Artificial Sequence
  Description of Artificial Sequence: Synthetic oligonucleotide
  Target: ATXN1; (+) strand; PAM type: NRG; PAM sequence: CAG
ctaaaaaccattcaattctg

SEQ ID NO: 138498 - DNA, 20 bp, Artificial Sequence
  Description of Artificial Sequence: Synthetic oligonucleotide
  Target: ATXN1; (+) strand; PAM type: NRG; PAM sequence: CAG
cagtttgtgaattatatccc

SEQ ID NO: 138499 - DNA, 20 bp, Artificial Sequence
  Description of Artificial Sequence: Synthetic oligonucleotide
  Target: ATXN1; (+) strand; PAM type: NRG; PAM sequence: AAG
ttgtgaattatatccccaga

SEQ ID NO: 138500 - DNA, 20 bp, Artificial Sequence
  Description of Artificial Sequence: Synthetic oligonucleotide
  Target: ATXN1; (+) strand; PAM type: NRG; PAM sequence: TGG
gaattatatccccagaaagc

SEQ ID NO: 138501 - DNA, 20 bp, Artificial Sequence
  Description of Artificial Sequence: Synthetic oligonucleotide
  Target: ATXN1; (+) strand; PAM type: NRG; PAM sequence: TAG
gaaagctggtattaataata

SEQ ID NO: 138502 - DNA, 20 bp, Artificial Sequence
  Description of Artificial Sequence: Synthetic oligonucleotide
  Target: ATXN1; (+) strand; PAM type: NRG; PAM sequence: CAG
agctggtattaataatatag

SEQ ID NO: 138503 - DNA, 20 bp, Artificial Sequence
  Description of Artificial Sequence: Synthetic oligonucleotide
  Target: ATXN1; (+) strand; PAM type: NRG; PAM sequence: AAG
gtattaataatatagcagct

SEQ ID NO: 138504 - DNA, 20 bp, Artificial Sequence
  Description of Artificial Sequence: Synthetic oligonucleotide
  Target: ATXN1; (+) strand; PAM type: NRG; PAM sequence: AAG
atatagcagctaagtgaaat

SEQ ID NO: 138505 - DNA, 20 bp, Artificial Sequence
  Description of Artificial Sequence: Synthetic oligonucleotide
  Target: ATXN1; (+) strand; PAM type: NRG; PAM sequence: CAG
agcagctaagtgaaataagc

SEQ ID NO: 138506 - DNA, 20 bp, Artificial Sequence
  Description of Artificial Sequence: Synthetic oligonucleotide
  Target: ATXN1; (+) strand; PAM type: NRG; PAM sequence: AAG
gtgaaataagccagtcataa

SEQ ID NO: 138507 - DNA, 20 bp, Artificial Sequence
  Description of Artificial Sequence: Synthetic oligonucleotide
  Target: ATXN1; (+) strand; PAM type: NRG; PAM sequence: AGG
tgaaataagccagtcataaa

SEQ ID NO: 138508 - DNA, 20 bp, Artificial Sequence
  Description of Artificial Sequence: Synthetic oligonucleotide
  Target: ATXN1; (+) strand; PAM type: NRG; PAM sequence: GAG
ctgtatgattcaccctctat

SEQ ID NO: 138509 - DNA, 20 bp, Artificial Sequence
  Description of Artificial Sequence: Synthetic oligonucleotide
  Target: ATXN1; (+) strand; PAM type: NRG; PAM sequence: AGG
tgtatgattcaccctctatg

SEQ ID NO: 138510 - DNA, 20 bp, Artificial Sequence
  Description of Artificial Sequence: Synthetic oligonucleotide
  Target: ATXN1; (+) strand; PAM type: NRG; PAM sequence: TAG
ttcaccctctatgaggtatc

SEQ ID NO: 138511 - DNA, 20 bp, Artificial Sequence
  Description of Artificial Sequence: Synthetic oligonucleotide
  Target: ATXN1; (+) strand; PAM type: NRG; PAM sequence: GAG
caccctctatgaggtatcta

SEQ ID NO: 138512 - DNA, 20 bp, Artificial Sequence
  Description of Artificial Sequence: Synthetic oligonucleotide
  Target: ATXN1; (+) strand; PAM type: NRG; PAM sequence: TAG
cctctatgaggtatctagag

SEQ ID NO: 138513 - DNA, 20 bp, Artificial Sequence
  Description of Artificial Sequence: Synthetic oligonucleotide
  Target: ATXN1; (+) strand; PAM type: NRG; PAM sequence: TAG
atctagagtagacattgtca

SEQ ID NO: 138514 - DNA, 20 bp, Artificial Sequence
  Description of Artificial Sequence: Synthetic oligonucleotide
  Target: ATXN1; (+) strand; PAM type: NRG; PAM sequence: TGG
agtagacattgtcatagaaa

SEQ ID NO: 138515 - DNA, 20 bp, Artificial Sequence
  Description of Artificial Sequence: Synthetic oligonucleotide
  Target: ATXN1; (+) strand; PAM type: NRG; PAM sequence: AAG
acattgtcatagaaatggaa

SEQ ID NO: 138516 - DNA, 20 bp, Artificial Sequence
  Description of Artificial Sequence: Synthetic oligonucleotide
  Target: ATXN1; (+) strand; PAM type: NRG; PAM sequence: CAG
ttgtcatagaaatggaaaag

SEQ ID NO: 138517 - DNA, 20 bp, Artificial Sequence
  Description of Artificial Sequence: Synthetic oligonucleotide
  Target: ATXN1; (+) strand; PAM type: NRG; PAM sequence: AAG
gaaatggaaaagcagttgcc

SEQ ID NO: 138518 - DNA, 20 bp, Artificial Sequence
  Description of Artificial Sequence: Synthetic oligonucleotide
  Target: ATXN1; (+) strand; PAM type: NRG; PAM sequence: AGG
aaatggaaaagcagttgcca

SEQ ID NO: 138519 - DNA, 20 bp, Artificial Sequence
  Description of Artificial Sequence: Synthetic oligonucleotide
  Target: ATXN1; (+) strand; PAM type: NRG; PAM sequence: GGG
aatggaaaagcagttgccaa

SEQ ID NO: 138520 - DNA, 20 bp, Artificial Sequence
  Description of Artificial Sequence: Synthetic oligonucleotide
  Target: ATXN1; (+) strand; PAM type: NRG; PAM sequence: TGG
aaaagcagttgccaagggct

SEQ ID NO: 138521 - DNA, 20 bp, Artificial Sequence
  Description of Artificial Sequence: Synthetic oligonucleotide
  Target: ATXN1; (+) strand; PAM type: NRG; PAM sequence: GGG
aaagcagttgccaagggctt

SEQ ID NO: 138522 - DNA, 20 bp, Artificial Sequence
  Description of Artificial Sequence: Synthetic oligonucleotide
  Target: ATXN1; (+) strand; PAM type: NRG; PAM sequence: GGG
aagcagttgccaagggcttg

SEQ ID NO: 138523 - DNA, 20 bp, Artificial Sequence
  Description of Artificial Sequence: Synthetic oligonucleotide
  Target: ATXN1; (+) strand; PAM type: NRG; PAM sequence: GGG
agcagttgccaagggcttgg

SEQ ID NO: 138524 - DNA, 20 bp, Artificial Sequence
  Description of Artificial Sequence: Synthetic oligonucleotide
  Target: ATXN1; (+) strand; PAM type: NRG; PAM sequence: GAG
cagttgccaagggcttgggg

SEQ ID NO: 138525 - DNA, 20 bp, Artificial Sequence
  Description of Artificial Sequence: Synthetic oligonucleotide
  Target: ATXN1; (+) strand; PAM type: NRG; PAM sequence: AAG
ttgccaagggcttgggggag

SEQ ID NO: 138526 - DNA, 20 bp, Artificial Sequence
  Description of Artificial Sequence: Synthetic oligonucleotide
  Target: ATXN1; (+) strand; PAM type: NRG; PAM sequence: AGG
tgccaagggcttgggggaga

SEQ ID NO: 138527 - DNA, 20 bp, Artificial Sequence
  Description of Artificial Sequence: Synthetic oligonucleotide
  Target: ATXN1; (+) strand; PAM type: NRG; PAM sequence: GGG
gccaagggcttgggggagaa

SEQ ID NO: 138528 - DNA, 20 bp, Artificial Sequence
  Description of Artificial Sequence: Synthetic oligonucleotide
  Target: ATXN1; (+) strand; PAM type: NRG; PAM sequence: AAG
gggcttgggggagaagggaa

SEQ ID NO: 138529 - DNA, 20 bp, Artificial Sequence
  Description of Artificial Sequence: Synthetic oligonucleotide
  Target: ATXN1; (+) strand; PAM type: NRG; PAM sequence: AAG
cttgggggagaagggaaaag

SEQ ID NO: 138530 - DNA, 20 bp, Artificial Sequence
  Description of Artificial Sequence: Synthetic oligonucleotide
  Target: ATXN1; (+) strand; PAM type: NRG; PAM sequence: GAG
tgggggagaagggaaaagaa

SEQ ID NO: 138531 - DNA, 20 bp, Artificial Sequence
  Description of Artificial Sequence: Synthetic oligonucleotide
  Target: ATXN1; (+) strand; PAM type: NRG; PAM sequence: TGG
aaagaagagttgctatttaa

SEQ ID NO: 138532 - DNA, 20 bp, Artificial Sequence
  Description of Artificial Sequence: Synthetic oligonucleotide
  Target: ATXN1; (+) strand; PAM type: NRG; PAM sequence: GGG
aagaagagttgctatttaat

SEQ ID NO: 138533 - DNA, 20 bp, Artificial Sequence
  Description of Artificial Sequence: Synthetic oligonucleotide
  Target: ATXN1; (+) strand; PAM type: NRG; PAM sequence: TAG
aagagttgctatttaatggg

SEQ ID NO: 138534 - DNA, 20 bp, Artificial Sequence
  Description of Artificial Sequence: Synthetic oligonucleotide
  Target: ATXN1; (+) strand; PAM type: NRG; PAM sequence: AAG
tttcaattttgcaaaataaa

SEQ ID NO: 138535 - DNA, 20 bp, Artificial Sequence
  Description of Artificial Sequence: Synthetic oligonucleotide
  Target: ATXN1; (+) strand; PAM type: NRG; PAM sequence: GAG
tcaattttgcaaaataaaaa

SEQ ID NO: 138536 - DNA, 20 bp, Artificial Sequence
  Description of Artificial Sequence: Synthetic oligonucleotide
  Target: ATXN1; (+) strand; PAM type: NRG; PAM sequence: TGG
ttgcaaaataaaaagagttc

SEQ ID NO: 138537 - DNA, 20 bp, Artificial Sequence
  Description of Artificial Sequence: Synthetic oligonucleotide
  Target: ATXN1; (+) strand; PAM type: NRG; PAM sequence: GGG
tgcaaaataaaaagagttct

SEQ ID NO: 138538 - DNA, 20 bp, Artificial Sequence
  Description of Artificial Sequence: Synthetic oligonucleotide
  Target: ATXN1; (+) strand; PAM type: NRG; PAM sequence: TGG
aaataaaaagagttctgggt

SEQ ID NO: 138539 - DNA, 20 bp, Artificial Sequence
  Description of Artificial Sequence: Synthetic oligonucleotide
  Target: ATXN1; (+) strand; PAM type: NRG; PAM sequence: GGG
aataaaaagagttctgggtt

SEQ ID NO: 138540 - DNA, 20 bp, Artificial Sequence
  Description of Artificial Sequence: Synthetic oligonucleotide
  Target: ATXN1; (+) strand; PAM type: NRG; PAM sequence: TGG
aaagagttctgggttgggcg

SEQ ID NO: 138541 - DNA, 20 bp, Artificial Sequence
  Description of Artificial Sequence: Synthetic oligonucleotide
  Target: ATXN1; (+) strand; PAM type: NRG; PAM sequence: TGG
gagttctgggttgggcgtgg

SEQ ID NO: 138542 - DNA, 20 bp, Artificial Sequence
  Description of Artificial Sequence: Synthetic oligonucleotide
  Target: ATXN1; (+) strand; PAM type: NRG; PAM sequence: CAG
gtggctcgcacctgtaatcc

SEQ ID NO: 138543 - DNA, 20 bp, Artificial Sequence
  Description of Artificial Sequence: Synthetic oligonucleotide
  Target: ATXN1; (+) strand; PAM type: NRG; PAM sequence: TGG
cacctgtaatcccagcactt

SEQ ID NO: 138544 - DNA, 20 bp, Artificial Sequence
  Description of Artificial Sequence: Synthetic oligonucleotide
  Target: ATXN1; (+) strand; PAM type: NRG; PAM sequence: GGG
acctgtaatcccagcacttt

SEQ ID NO: 138545 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagcactttgg

SEQ ID NO: 138546 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 138547 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggcc

SEQ ID NO: 138548 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggccg

SEQ ID NO: 138549 - DNA, 20 bp, Artificial Sequence
  Description of Artificial Sequence: Synthetic oligonucleotide
  Target: ATXN1; (+) strand; PAM type: NRG; PAM sequence: TGG
agcactttgggaggccgagg

SEQ ID NO: 138550 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccgaggt

SEQ ID NO: 138551 - DNA, 20 bp, Artificial Sequence
  Description of Artificial Sequence: Synthetic oligonucleotide
  Target: ATXN1; (+) strand; PAM type: NRG; PAM sequence: CAG
ctttgggaggccgaggtggg

SEQ ID NO: 138552 - DNA, 20 bp, Artificial Sequence
  Description of Artificial Sequence: Synthetic oligonucleotide
  Target: ATXN1; (+) strand; PAM type: NRG; PAM sequence: GAG
ccgaggtgggcagatcacct

SEQ ID NO: 138553 - DNA, 20 bp, Artificial Sequence
  Description of Artificial Sequence: Synthetic oligonucleotide
  Target: ATXN1; (+) strand; PAM type: NRG; PAM sequence: AGG
cgaggtgggcagatcacctg

SEQ ID NO: 138554 - DNA, 20 bp, Artificial Sequence
  Description of Artificial Sequence: Synthetic oligonucleotide
  Target: ATXN1; (+) strand; PAM type: NRG; PAM sequence: CAG
gtgggcagatcacctgaggt

SEQ ID NO: 138555 - DNA, 20 bp, Artificial Sequence
  Description of Artificial Sequence: Synthetic oligonucleotide
  Target: ATXN1; (+) strand; PAM type: NRG; PAM sequence: AGG
tgggcagatcacctgaggtc

SEQ ID NO: 138556 - DNA, 20 bp, Artificial Sequence
  Description of Artificial Sequence: Synthetic oligonucleotide
  Target: ATXN1; (+) strand; PAM type: NRG; PAM sequence: GAG
ggcagatcacctgaggtcag

SEQ ID NO: 138557 - DNA, 20 bp, Artificial Sequence
  Description of Artificial Sequence: Synthetic oligonucleotide
  Target: ATXN1; (+) strand; PAM type: NRG; PAM sequence: GAG
tcacctgaggtcaggagttt

SEQ ID NO: 138558 - DNA, 20 bp, Artificial Sequence
  Description of Artificial Sequence: Synthetic oligonucleotide
  Target: ATXN1; (+) strand; PAM type: NRG; PAM sequence: TGG
tcaggagtttgagaccaacc

SEQ ID NO: 138559 - DNA, 20 bp, Artificial Sequence
  Description of Artificial Sequence: Synthetic oligonucleotide
  Target: ATXN1; (+) strand; PAM type: NRG; PAM sequence: TGG
tgagaccaacctggccaaca

SEQ ID NO: 138560 - DNA, 20 bp, Artificial Sequence
  Description of Artificial Sequence: Synthetic oligonucleotide
  Target: ATXN1; (+) strand; PAM type: NRG; PAM sequence: CAG
ccctgtctctactaaaaata

SEQ ID NO: 138561 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacagaaat

SEQ ID NO: 138562 - DNA, 20 bp, Artificial Sequence
  Description of Artificial Sequence: Synthetic oligonucleotide
  Target: ATXN1; (+) strand; PAM type: NRG; PAM sequence: CAG
ctaaaaatacagaaattagc

SEQ ID NO: 138563 - DNA, 20 bp, Artificial Sequence
  Description of Artificial Sequence: Synthetic oligonucleotide
  Target: ATXN1; (+) strand; PAM type: NRG; PAM sequence: AGG
taaaaatacagaaattagcc

SEQ ID NO: 138564 - DNA, 20 bp, Artificial Sequence
  Description of Artificial Sequence: Synthetic oligonucleotide
  Target: ATXN1; (+) strand; PAM type: NRG; PAM sequence: TGG
cagaaattagccaggcgtcg

SEQ ID NO: 138565 - DNA, 20 bp, Artificial Sequence
  Description of Artificial Sequence: Synthetic oligonucleotide
  Target: ATXN1; (+) strand; PAM type: NRG; PAM sequence: CAG
aaattagccaggcgtcgtgg

SEQ ID NO: 138566 - DNA, 20 bp, Artificial Sequence
  Description of Artificial Sequence: Synthetic oligonucleotide
  Target: ATXN1; (+) strand; PAM type: NRG; PAM sequence: AGG
aattagccaggcgtcgtggc

SEQ ID NO: 138567 - DNA, 20 bp, Artificial Sequence
  Description of Artificial Sequence: Synthetic oligonucleotide
  Target: ATXN1; (+) strand; PAM type: NRG; PAM sequence: CAG
gtggcaggttcctgtaatcc

SEQ ID NO: 138568 - DNA, 20 bp, Artificial Sequence
  Description of Artificial Sequence: Synthetic oligonucleotide
  Target: ATXN1; (+) strand; PAM type: NRG; PAM sequence: TGG
ttcctgtaatcccagctact

SEQ ID NO: 138569 - DNA, 20 bp, Artificial Sequence
  Description of Artificial Sequence: Synthetic oligonucleotide
  Target: ATXN1; (+) strand; PAM type: NRG; PAM sequence: GGG
tcctgtaatcccagctactt

SEQ ID NO: 138570 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctacttgg

SEQ ID NO: 138571 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctacttggg

SEQ ID NO: 138572 - DNA, 20 bp, Artificial Sequence
  Description of Artificial Sequence: Synthetic oligonucleotide
  Target: ATXN1; (+) strand; PAM type: NRG; PAM sequence: TGG
atcccagctacttgggaggc

SEQ ID NO: 138573 - DNA, 20 bp, Artificial Sequence
  Description of Artificial Sequence: Synthetic oligonucleotide
  Target: ATXN1; (+) strand; PAM type: NRG; PAM sequence: GGG
tcccagctacttgggaggct

SEQ ID NO: 138574 - DNA, 20 bp, Artificial Sequence
  Description of Artificial Sequence: Synthetic oligonucleotide
  Target: ATXN1; (+) strand; PAM type: NRG; PAM sequence: GGG
cccagctacttgggaggctg

SEQ ID NO: 138575 - DNA, 20 bp, Artificial Sequence
  Description of Artificial Sequence: Synthetic oligonucleotide
  Target: ATXN1; (+) strand; PAM type: NRG; PAM sequence: CAG
agctacttgggaggctgggg

SEQ ID NO: 138576 - DNA, 20 bp, Artificial Sequence
  Description of Artificial Sequence: Synthetic oligonucleotide
  Target: ATXN1; (+) strand; PAM type: NRG; PAM sequence: AGG
gctacttgggaggctggggc

SEQ ID NO: 138577 - DNA, 20 bp, Artificial Sequence
  Description of Artificial Sequence: Synthetic oligonucleotide
  Target: ATXN1; (+) strand; PAM type: NRG; PAM sequence: GAG
tacttgggaggctggggcag

SEQ ID NO: 138578 - DNA, 20 bp, Artificial Sequence
  Description of Artificial Sequence: Synthetic oligonucleotide
  Target: ATXN1; (+) strand; PAM type: NRG; PAM sequence: AGG
acttgggaggctggggcagg

SEQ ID NO: 138579 - DNA, 20 bp, Artificial Sequence
  Description of Artificial Sequence: Synthetic oligonucleotide
  Target: ATXN1; (+) strand; PAM type: NRG; PAM sequence: CAG
gcaggaggatcacttgaacc

SEQ ID NO: 138580 - DNA, 20 bp, Artificial Sequence
  Description of Artificial Sequence: Synthetic oligonucleotide
  Target: ATXN1; (+) strand; PAM type: NRG; PAM sequence: AGG
caggaggatcacttgaaccc

SEQ ID NO: 138581 - DNA, 20 bp, Artificial Sequence
  Description of Artificial Sequence: Synthetic oligonucleotide
  Target: ATXN1; (+) strand; PAM type: NRG; PAM sequence: AAG
gaggatcacttgaacccagg

SEQ ID NO: 138582 - DNA, 20 bp, Artificial Sequence
  Description of Artificial Sequence: Synthetic oligonucleotide
  Target: ATXN1; (+) strand; PAM type: NRG; PAM sequence: CAG
gatcacttgaacccaggaag

SEQ ID NO: 138583 - DNA, 20 bp, Artificial Sequence
  Description of Artificial Sequence: Synthetic oligonucleotide
  Target: ATXN1; (+) strand; PAM type: NRG; PAM sequence: GAG
tcacttgaacccaggaagca

SEQ ID NO: 138584 - DNA, 20 bp, Artificial Sequence
  Description of Artificial Sequence: Synthetic oligonucleotide
  Target: ATXN1; (+) strand; PAM type: NRG; PAM sequence: AGG
cacttgaacccaggaagcag

SEQ ID NO: 138585 - DNA, 20 bp, Artificial Sequence
  Description of Artificial Sequence: Synthetic oligonucleotide
  Target: ATXN1; (+) strand; PAM type: NRG; PAM sequence: CAG
aacccaggaagcagaggttg

SEQ ID NO: 138586 - DNA, 20 bp, Artificial Sequence
  Description of Artificial Sequence: Synthetic oligonucleotide
  Target: ATXN1; (+) strand; PAM type: NRG; PAM sequence: GAG
agcagaggttgcagtgaact

SEQ ID NO: 138587 - DNA, 20 bp, Artificial Sequence
  Description of Artificial Sequence: Synthetic oligonucleotide
  Target: ATXN1; (+) strand; PAM type: NRG; PAM sequence: CAG
gagatcacaccatcacactc

SEQ ID NO: 138588 - DNA, 20 bp, Artificial Sequence
  Description of Artificial Sequence: Synthetic oligonucleotide
  Target: ATXN1; (+) strand; PAM type: NRG; PAM sequence: TGG
cacaccatcacactccagcc

SEQ ID NO: 138589 - DNA, 20 bp, Artificial Sequence
  Description of Artificial Sequence: Synthetic oligonucleotide
  Target: ATXN1; (+) strand; PAM type: NRG; PAM sequence: GGG
acaccatcacactccagcct

SEQ ID NO: 138590 - DNA, 20 bp, Artificial Sequence
  Description of Artificial Sequence: Synthetic oligonucleotide
  Target: ATXN1; (+) strand; PAM type: NRG; PAM sequence: GGG
caccatcacactccagcctg

SEQ ID NO: 138591 - DNA, 20 bp, Artificial Sequence
  Description of Artificial Sequence: Synthetic oligonucleotide
  Target: ATXN1; (+) strand; PAM type: NRG; PAM sequence: GGG
accatcacactccagcctgg

SEQ ID NO: 138592 - DNA, 20 bp, Artificial Sequence
  Description of Artificial Sequence: Synthetic oligonucleotide
  Target: ATXN1; (+) strand; PAM type: NRG; PAM sequence: GAG
cacactccagcctgggggat

SEQ ID NO: 138593 - DNA, 20 bp, Artificial Sequence
  Description of Artificial Sequence: Synthetic oligonucleotide
  Target: ATXN1; (+) strand; PAM type: NRG; PAM sequence: GAG
cactccagcctgggggatga

SEQ ID NO: 138594 - DNA, 20 bp, Artificial Sequence
  Description of Artificial Sequence: Synthetic oligonucleotide
  Target: ATXN1; (+) strand; PAM type: NRG; PAM sequence: GAG
ccagcctgggggatgagagc

SEQ ID NO: 138595 - DNA, 20 bp, Artificial Sequence
  Description of Artificial Sequence: Synthetic oligonucleotide
  Target: ATXN1; (+) strand; PAM type: NRG; PAM sequence: AAG
tgagagcgagactttgtctc

SEQ ID NO: 138596 - DNA, 20 bp, Artificial Sequence
  Description of Artificial Sequence: Synthetic oligonucleotide
  Target: ATXN1; (+) strand; PAM type: NRG; PAM sequence: AAG
caagaaaaaaaaaaaaaaaa

SEQ ID NO: 138597 - DNA, 20 bp, Artificial Sequence
  Description of Artificial Sequence: Synthetic oligonucleotide
  Target: ATXN1; (+) strand; PAM type: NRG; PAM sequence: GAG
agaaaaaaaaaaaaaaaaaa

SEQ ID NO: 138598 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaaaaaaaagagttc

SEQ ID NO: 138599 - DNA, 20 bp, Artificial Sequence
  Description of Artificial Sequence: Synthetic oligonucleotide
  Target: ATXN1; (+) strand; PAM type: NRG; PAM sequence: GAG
aaaaaaaaaaaagagttctg

SEQ ID NO: 138600 - DNA, 20 bp, Artificial Sequence
  Description of Artificial Sequence: Synthetic oligonucleotide
  Target: ATXN1; (+) strand; PAM type: NRG; PAM sequence: TGG
aaaaaaaagagttctggaga

SEQ ID NO: 138601 - DNA, 20 bp, Artificial Sequence
  Description of Artificial Sequence: Synthetic oligonucleotide
  Target: ATXN1; (+) strand; PAM type: NRG; PAM sequence: TGG
aaaagagttctggagatgga

SEQ ID NO: 138602 - DNA, 20 bp, Artificial Sequence
  Description of Artificial Sequence: Synthetic oligonucleotide
  Target: ATXN1; (+) strand; PAM type: NRG; PAM sequence: TGG
agagttctggagatggatgg

SEQ ID NO: 138603 - DNA, 20 bp, Artificial Sequence
  Description of Artificial Sequence: Synthetic oligonucleotide
  Target: ATXN1; (+) strand; PAM type: NRG; PAM sequence: CAG
ctggagatggatggtggtga

SEQ ID NO: 138604 - DNA, 20 bp, Artificial Sequence
  Description of Artificial Sequence: Synthetic oligonucleotide
  Target: ATXN1; (+) strand; PAM type: NRG; PAM sequence: CAG
gttgtacaacaatgtgaatt

SEQ ID NO: 138605 - DNA, 20 bp, Artificial Sequence
  Description of Artificial Sequence: Synthetic oligonucleotide
  Target: ATXN1; (+) strand; PAM type: NRG; PAM sequence: TGG
accactgaatgtacacttga

SEQ ID NO: 138606 - DNA, 20 bp, Artificial Sequence
  Description of Artificial Sequence: Synthetic oligonucleotide
  Target: ATXN1; (+) strand; PAM type: NRG; PAM sequence: AAG
tgaatgtacacttgatggtg

SEQ ID NO: 138607 - DNA, 20 bp, Artificial Sequence
  Description of Artificial Sequence: Synthetic oligonucleotide
  Target: ATXN1; (+) strand; PAM type: NRG; PAM sequence: CGG
tgtacacttgatggtgaaga

SEQ ID NO: 138608 - DNA, 20 bp, Artificial Sequence
  Description of Artificial Sequence: Synthetic oligonucleotide
  Target: ATXN1; (+) strand; PAM type: NRG; PAM sequence: TAG
ggtgaagacggtcaatttta

SEQ ID NO: 138609 - DNA, 20 bp, Artificial Sequence
  Description of Artificial Sequence: Synthetic oligonucleotide
  Target: ATXN1; (+) strand; PAM type: NRG; PAM sequence: TGG
atgccttttgccacaatgta

SEQ ID NO: 138610 - DNA, 20 bp, Artificial Sequence
  Description of Artificial Sequence: Synthetic oligonucleotide
  Target: ATXN1; (+) strand; PAM type: NRG; PAM sequence: AAG
tggtttatttatttacttaa

SEQ ID NO: 138611 - DNA, 20 bp, Artificial Sequence
  Description of Artificial Sequence: Synthetic oligonucleotide
  Target: ATXN1; (+) strand; PAM type: NRG; PAM sequence: AAG
atttatttacttaaaagcaa

SEQ ID NO: 138612 - DNA, 20 bp, Artificial Sequence
  Description of Artificial Sequence: Synthetic oligonucleotide
  Target: ATXN1; (+) strand; PAM type: NRG; PAM sequence: TGG
tatttacttaaaagcaaaag

SEQ ID NO: 138613 - DNA, 20 bp, Artificial Sequence
  Description of Artificial Sequence: Synthetic oligonucleotide
  Target: ATXN1; (+) strand; PAM type: NRG; PAM sequence: CGG
ttacttaaaagcaaaagtgg

SEQ ID NO: 138614 - DNA, 20 bp, Artificial Sequence
  Description of Artificial Sequence: Synthetic oligonucleotide
  Target: ATXN1; (+) strand; PAM type: NRG; PAM sequence: CAG
aaagtggcggtgttttgttt

SEQ ID NO: 138615 - DNA, 20 bp, Artificial Sequence
  Description of Artificial Sequence: Synthetic oligonucleotide
  Target: ATXN1; (+) strand; PAM type: NRG; PAM sequence: TAG
gcggtgttttgtttcagtat

SEQ ID NO: 138616 - DNA, 20 bp, Artificial Sequence
  Description of Artificial Sequence: Synthetic oligonucleotide
  Target: ATXN1; (+) strand; PAM type: NRG; PAM sequence: AGG
cggtgttttgtttcagtatt

SEQ ID NO: 138617 - DNA, 20 bp, Artificial Sequence
  Description of Artificial Sequence: Synthetic oligonucleotide
  Target: ATXN1; (+) strand; PAM type: NRG; PAM sequence: CGG
gttttgtttcagtattaggt

SEQ ID NO: 138618 - DNA, 20 bp, Artificial Sequence
  Description of Artificial Sequence: Synthetic oligonucleotide
  Target: ATXN1; (+) strand; PAM type: NRG; PAM sequence: GGG
ttttgtttcagtattaggtc

SEQ ID NO: 138619 - DNA, 20 bp, Artificial Sequence
  Description of Artificial Sequence: Synthetic oligonucleotide
  Target: ATXN1; (+) strand; PAM type: NRG; PAM sequence: AAG
ttcagtattaggtcgggttc

SEQ ID NO: 138620 - DNA, 20 bp, Artificial Sequence
  Description of Artificial Sequence: Synthetic oligonucleotide
  Target: ATXN1; (+) strand; PAM type: NRG; PAM sequence: CAG
ttaggtcgggttcaagcaaa

SEQ ID NO: 138621 - DNA, 20 bp, Artificial Sequence
  Description of Artificial Sequence: Synthetic oligonucleotide
  Target: ATXN1; (+) strand; PAM type: NRG; PAM sequence: AAG
ggtcgggttcaagcaaacag

SEQ ID NO: 138622 - DNA, 20 bp, Artificial Sequence
  Description of Artificial Sequence: Synthetic oligonucleotide
  Target: ATXN1; (+) strand; PAM type: NRG; PAM sequence: AGG
gtcgggttcaagcaaacaga

SEQ ID NO: 138623 - DNA, 20 bp, Artificial Sequence
  Description of Artificial Sequence: Synthetic oligonucleotide
  Target: ATXN1; (+) strand; PAM type: NRG; PAM sequence: GGG
tcgggttcaagcaaacagaa

SEQ ID NO: 138624 - DNA, 20 bp, Artificial Sequence
  Description of Artificial Sequence: Synthetic oligonucleotide
  Target: ATXN1; (+) strand; PAM type: NRG; PAM sequence: TAG
atcatatacattctgcacca

SEQ ID NO: 138625 - DNA, 20 bp, Artificial Sequence
  Description of Artificial Sequence: Synthetic oligonucleotide
  Target: ATXN1; (+) strand; PAM type: NRG; PAM sequence: GAG
tacattctgcaccatagatt

SEQ ID NO: 138626 - DNA, 20 bp, Artificial Sequence
  Description of Artificial Sequence: Synthetic oligonucleotide
  Target: ATXN1; (+) strand; PAM type: NRG; PAM sequence: AAG
caccatttttttatttttat

SEQ ID NO: 138627 - DNA, 20 bp, Artificial Sequence
  Description of Artificial Sequence: Synthetic oligonucleotide
  Target: ATXN1; (+) strand; PAM type: NRG; PAM sequence: CAG
ttataagctataccaaattt

SEQ ID NO: 138628 - DNA, 20 bp, Artificial Sequence
  Description of Artificial Sequence: Synthetic oligonucleotide
  Target: ATXN1; (+) strand; PAM type: NRG; PAM sequence: CAG
tcagtgcacaaatgctataa

SEQ ID NO: 138629 - DNA, 20 bp, Artificial Sequence
  Description of Artificial Sequence: Synthetic oligonucleotide
  Target: ATXN1; (+) strand; PAM type: NRG; PAM sequence: TGG
tgctataacagcacatactg

SEQ ID NO: 138630 - DNA, 20 bp, Artificial Sequence
  Description of Artificial Sequence: Synthetic oligonucleotide
  Target: ATXN1; (+) strand; PAM type: NRG; PAM sequence: GGG
gctataacagcacatactgt

SEQ ID NO: 138631 - DNA, 20 bp, Artificial Sequence
  Description of Artificial Sequence: Synthetic oligonucleotide
  Target: ATXN1; (+) strand; PAM type: NRG; PAM sequence: GAG
taacagcacatactgtgggt

SEQ ID NO: 138632 - DNA, 20 bp, Artificial Sequence
  Description of Artificial Sequence: Synthetic oligonucleotide
  Target: ATXN1; (+) strand; PAM type: NRG; PAM sequence: AAG
gagaatataaaaaattgtga

SEQ ID NO: 138633 - DNA, 20 bp, Artificial Sequence
  Description of Artificial Sequence: Synthetic oligonucleotide
  Target: ATXN1; (+) strand; PAM type: NRG; PAM sequence: AAG
taaaaaattgtgaaagtcta

SEQ ID NO: 138634 - DNA, 20 bp, Artificial Sequence
  Description of Artificial Sequence: Synthetic oligonucleotide
  Target: ATXN1; (+) strand; PAM type: NRG; PAM sequence: AAG
cacaacgactctgcaaaaac

SEQ ID NO: 138635 - DNA, 20 bp, Artificial Sequence
  Description of Artificial Sequence: Synthetic oligonucleotide
  Target: ATXN1; (+) strand; PAM type: NRG; PAM sequence: AGG
acaacgactctgcaaaaaca

SEQ ID NO: 138636 - DNA, 20 bp, Artificial Sequence
  Description of Artificial Sequence: Synthetic oligonucleotide
  Target: ATXN1; (+) strand; PAM type: NRG; PAM sequence: GGG
caacgactctgcaaaaacaa

SEQ ID NO: 138637 - DNA, 20 bp, Artificial Sequence
  Description of Artificial Sequence: Synthetic oligonucleotide
  Target: ATXN1; (+) strand; PAM type: NRG; PAM sequence: CAG
taactgaatatgccacaatt

SEQ ID NO: 138638 - DNA, 20 bp, Artificial Sequence
  Description of Artificial Sequence: Synthetic oligonucleotide
  Target: ATXN1; (+) strand; PAM type: NRG; PAM sequence: GAG
aatgctactaccatatgccc

SEQ ID NO: 138639 - DNA, 20 bp, Artificial Sequence
  Description of Artificial Sequence: Synthetic oligonucleotide
  Target: ATXN1; (+) strand; PAM type: NRG; PAM sequence: AGG
atgctactaccatatgcccg

SEQ ID NO: 138640 - DNA, 20 bp, Artificial Sequence
  Description of Artificial Sequence: Synthetic oligonucleotide
  Target: ATXN1; (+) strand; PAM type: NRG; PAM sequence: GGG
tgctactaccatatgcccga

SEQ ID NO: 138641 - DNA, 20 bp, Artificial Sequence
  Description of Artificial Sequence: Synthetic oligonucleotide
  Target: ATXN1; (+) strand; PAM type: NRG; PAM sequence: GGG
gctactaccatatgcccgag

SEQ ID NO: 138642 - DNA, 20 bp, Artificial Sequence
  Description of Artificial Sequence: Synthetic oligonucleotide
  Target: ATXN1; (+) strand; PAM type: NRG; PAM sequence: GAG
accatatgcccgaggggact

SEQ ID NO: 138643 - DNA, 20 bp, Artificial Sequence
  Description of Artificial Sequence: Synthetic oligonucleotide
  Target: ATXN1; (+) strand; PAM type: NRG; PAM sequence: CAG
aggggactgagtcacacttg

SEQ ID NO: 138644 - DNA, 20 bp, Artificial Sequence
  Description of Artificial Sequence: Synthetic oligonucleotide
  Target: ATXN1; (+) strand; PAM type: NRG; PAM sequence: CAG
tttaaattctcatcaaactg

SEQ ID NO: 138645 - DNA, 20 bp, Artificial Sequence
  Description of Artificial Sequence: Synthetic oligonucleotide
  Target: ATXN1; (+) strand; PAM type: NRG; PAM sequence: CAG
tttgtttctgccactgatcg

SEQ ID NO: 138646 - DNA, 20 bp, Artificial Sequence
  Description of Artificial Sequence: Synthetic oligonucleotide
  Target: ATXN1; (+) strand; PAM type: NRG; PAM sequence: CAG
atgaaatacttgtttttgaa

SEQ ID NO: 138647 - DNA, 20 bp, Artificial Sequence
  Description of Artificial Sequence: Synthetic oligonucleotide
  Target: ATXN1; (+) strand; PAM type: NRG; PAM sequence: AAG
tacttgtttttgaacagcct

SEQ ID NO: 138648 - DNA, 20 bp, Artificial Sequence
  Description of Artificial Sequence: Synthetic oligonucleotide
  Target: ATXN1; (+) strand; PAM type: NRG; PAM sequence: AGG
acttgtttttgaacagccta

SEQ ID NO: 138649 - DNA, 20 bp, Artificial Sequence
  Description of Artificial Sequence: Synthetic oligonucleotide
  Target: ATXN1; (+) strand; PAM type: NRG; PAM sequence: CGG
tttttgaacagcctaaggtt

SEQ ID NO: 138650 - DNA, 20 bp, Artificial Sequence
  Description of Artificial Sequence: Synthetic oligonucleotide
  Target: ATXN1; (+) strand; PAM type: NRG; PAM sequence: GAG
tttgaacagcctaaggttcg

SEQ ID NO: 138651 - DNA, 20 bp, Artificial Sequence
  Description of Artificial Sequence: Synthetic oligonucleotide
  Target: ATXN1; (+) strand; PAM type: NRG; PAM sequence: AGG
ttgaacagcctaaggttcgg

SEQ ID NO: 138652 - DNA, 20 bp, Artificial Sequence
  Description of Artificial Sequence: Synthetic oligonucleotide
  Target: ATXN1; (+) strand; PAM type: NRG; PAM sequence: TGG
aaaaaactgtcaacgattac

SEQ ID NO: 138653 - DNA, 20 bp, Artificial Sequence
  Description of Artificial Sequence: Synthetic oligonucleotide
  Target: ATXN1; (+) strand; PAM type: NRG; PAM sequence: GGG
aaaaactgtcaacgattact

SEQ ID NO: 138654 - DNA, 20 bp, Artificial Sequence
  Description of Artificial Sequence: Synthetic oligonucleotide
  Target: ATXN1; (+) strand; PAM type: NRG; PAM sequence: TGG
ctgtcaacgattactgggaa

SEQ ID NO: 138655 - DNA, 20 bp, Artificial Sequence
  Description of Artificial Sequence: Synthetic oligonucleotide
  Target: ATXN1; (+) strand; PAM type: NRG; PAM sequence: CAG
gattactgggaatggaaaaa

SEQ ID NO: 138656 - DNA, 20 bp, Artificial Sequence
  Description of Artificial Sequence: Synthetic oligonucleotide
  Target: ATXN1; (+) strand; PAM type: NRG; PAM sequence: AAG
ctgggaatggaaaaacagcc

SEQ ID NO: 138657 - DNA, 20 bp, Artificial Sequence
  Description of Artificial Sequence: Synthetic oligonucleotide
  Target: ATXN1; (+) strand; PAM type: NRG; PAM sequence: TAG
tttgatgccatccttatgcc

SEQ ID NO: 138658 - DNA, 20 bp, Artificial Sequence
  Description of Artificial Sequence: Synthetic oligonucleotide
  Target: ATXN1; (+) strand; PAM type: NRG; PAM sequence: AAG
ctcccactcccacatcgatc

SEQ ID NO: 138659 - DNA, 20 bp, Artificial Sequence
  Description of Artificial Sequence: Synthetic oligonucleotide
  Target: ATXN1; (+) strand; PAM type: NRG; PAM sequence: GAG
cactcccacatcgatcaagt

SEQ ID NO: 138660 - DNA, 20 bp, Artificial Sequence
  Description of Artificial Sequence: Synthetic oligonucleotide
  Target: ATXN1; (+) strand; PAM type: NRG; PAM sequence: AAG
tgcatctcttccttctttca

SEQ ID NO: 138661 - DNA, 20 bp, Artificial Sequence
  Description of Artificial Sequence: Synthetic oligonucleotide
  Target: ATXN1; (+) strand; PAM type: NRG; PAM sequence: AAG
ttctctatgattctataatg

SEQ ID NO: 138662 - DNA, 20 bp, Artificial Sequence
  Description of Artificial Sequence: Synthetic oligonucleotide
  Target: ATXN1; (+) strand; PAM type: NRG; PAM sequence: AGG
tctctatgattctataatga

SEQ ID NO: 138663 - DNA, 20 bp, Artificial Sequence
  Description of Artificial Sequence: Synthetic oligonucleotide
  Target: ATXN1; (+) strand; PAM type: NRG; PAM sequence: CAG
ctatgattctataatgaagg

SEQ ID NO: 138664 - DNA, 20 bp, Artificial Sequence
  Description of Artificial Sequence: Synthetic oligonucleotide
  Target: ATXN1; (+) strand; PAM type: NRG; PAM sequence: CAG
aatgaaggcagctgtgatta

SEQ ID NO: 138665 - DNA, 20 bp, Artificial Sequence
  Description of Artificial Sequence: Synthetic oligonucleotide
  Target: ATXN1; (+) strand; PAM type: NRG; PAM sequence: CAG
gaaggcagctgtgattacag

SEQ ID NO: 138666 - DNA, 20 bp, Artificial Sequence
  Description of Artificial Sequence: Synthetic oligonucleotide
  Target: ATXN1; (+) strand; PAM type: NRG; PAM sequence: AAG
ggcagctgtgattacagcag

SEQ ID NO: 138667 - DNA, 20 bp, Artificial Sequence
  Description of Artificial Sequence: Synthetic oligonucleotide
  Target: ATXN1; (+) strand; PAM type: NRG; PAM sequence: AAG
ctgtgattacagcagaagtg

SEQ ID NO: 138668 - DNA, 20 bp, Artificial Sequence
  Description of Artificial Sequence: Synthetic oligonucleotide
  Target: ATXN1; (+) strand; PAM type: NRG; PAM sequence: AAG
tgattacagcagaagtgaag

SEQ ID NO: 138669 - DNA, 20 bp, Artificial Sequence
  Description of Artificial Sequence: Synthetic oligonucleotide
  Target: ATXN1; (+) strand; PAM type: NRG; PAM sequence: GAG
attacagcagaagtgaagaa

SEQ ID NO: 138670 - DNA, 20 bp, Artificial Sequence
  Description of Artificial Sequence: Synthetic oligonucleotide
  Target: ATXN1; (+) strand; PAM type: NRG; PAM sequence: GAG
tacagcagaagtgaagaaga

SEQ ID NO: 138671 - DNA, 20 bp, Artificial Sequence
  Description of Artificial Sequence: Synthetic oligonucleotide
  Target: ATXN1; (+) strand; PAM type: NRG; PAM sequence: TGG
gaagagagtactacctaccc

SEQ ID NO: 138672 - DNA, 20 bp, Artificial Sequence
  Description of Artificial Sequence: Synthetic oligonucleotide
  Target: ATXN1; (+) strand; PAM type: NRG; PAM sequence: GGG
aagagagtactacctaccct

SEQ ID NO: 138673 - DNA, 20 bp, Artificial Sequence
  Description of Artificial Sequence: Synthetic oligonucleotide
  Target: ATXN1; (+) strand; PAM type: NRG; PAM sequence: GAG
gagagtactacctaccctgg

SEQ ID NO: 138674 - DNA, 20 bp, Artificial Sequence
  Description of Artificial Sequence: Synthetic oligonucleotide
  Target: ATXN1; (+) strand; PAM type: NRG; PAM sequence: AAG
gtactacctaccctgggagc

SEQ ID NO: 138675 - DNA, 20 bp, Artificial Sequence
  Description of Artificial Sequence: Synthetic oligonucleotide
  Target: ATXN1; (+) strand; PAM type: NRG; PAM sequence: TGG
cctgggagcaagttaattta

SEQ ID NO: 138676 - DNA, 20 bp, Artificial Sequence
  Description of Artificial Sequence: Synthetic oligonucleotide
  Target: ATXN1; (+) strand; PAM type: NRG; PAM sequence: TAG
agcaagttaatttatggcca

SEQ ID NO: 138677 - DNA, 20 bp, Artificial Sequence
  Description of Artificial Sequence: Synthetic oligonucleotide
  Target: ATXN1; (+) strand; PAM type: NRG; PAM sequence: AGG
gcaagttaatttatggccat

SEQ ID NO: 138678 - DNA, 20 bp, Artificial Sequence
  Description of Artificial Sequence: Synthetic oligonucleotide
  Target: ATXN1; (+) strand; PAM type: NRG; PAM sequence: TAG
atttatggccataggcccac

SEQ ID NO: 138679 - DNA, 20 bp, Artificial Sequence
  Description of Artificial Sequence: Synthetic oligonucleotide
  Target: ATXN1; (+) strand; PAM type: NRG; PAM sequence: AGG
tttatggccataggcccact

SEQ ID NO: 138680 - DNA, 20 bp, Artificial Sequence
  Description of Artificial Sequence: Synthetic oligonucleotide
  Target: ATXN1; (+) strand; PAM type: NRG; PAM sequence: GGG
ttatggccataggcccacta

SEQ ID NO: 138681 - DNA, 20 bp, Artificial Sequence
  Description of Artificial Sequence: Synthetic oligonucleotide
  Target: ATXN1; (+) strand; PAM type: NRG; PAM sequence: AAG
tatatgatttttccatcatt

SEQ ID NO: 138682 - DNA, 20 bp, Artificial Sequence
  Description of Artificial Sequence: Synthetic oligonucleotide
  Target: ATXN1; (+) strand; PAM type: NRG; PAM sequence: CAG
ccatcattaagaatcttcaa

SEQ ID NO: 138683 - DNA, 20 bp, Artificial Sequence
  Description of Artificial Sequence: Synthetic oligonucleotide
  Target: ATXN1; (+) strand; PAM type: NRG; PAM sequence: CAG
ttaagaatcttcaacagtcc

SEQ ID NO: 138684 - DNA, 20 bp, Artificial Sequence
  Description of Artificial Sequence: Synthetic oligonucleotide
  Target: ATXN1; (+) strand; PAM type: NRG; PAM sequence: AAG
tcttcaacagtcccagatgc

SEQ ID NO: 138685 - DNA, 20 bp, Artificial Sequence
  Description of Artificial Sequence: Synthetic oligonucleotide
  Target: ATXN1; (+) strand; PAM type: NRG; PAM sequence: AGG
cttcaacagtcccagatgca

SEQ ID NO: 138686 - DNA, 20 bp, Artificial Sequence
  Description of Artificial Sequence: Synthetic oligonucleotide
  Target: ATXN1; (+) strand; PAM type: NRG; PAM sequence: AAG
caacagtcccagatgcaagg

SEQ ID NO: 138687 - DNA, 20 bp, Artificial Sequence
  Description of Artificial Sequence: Synthetic oligonucleotide
  Target: ATXN1; (+) strand; PAM type: NRG; PAM sequence: CAG
agtcccagatgcaaggaaga

SEQ ID NO: 138688 - DNA, 20 bp, Artificial Sequence
  Description of Artificial Sequence: Synthetic oligonucleotide
  Target: ATXN1; (+) strand; PAM type: NRG; PAM sequence: AGG
gtcccagatgcaaggaagac

SEQ ID NO: 138689 - DNA, 20 bp, Artificial Sequence
  Description of Artificial Sequence: Synthetic oligonucleotide
  Target: ATXN1; (+) strand; PAM type: NRG; PAM sequence: TGG
gcaaggaagacaggccatcc

SEQ ID NO: 138690 - DNA, 20 bp, Artificial Sequence
  Description of Artificial Sequence: Synthetic oligonucleotide
  Target: ATXN1; (+) strand; PAM type: NRG; PAM sequence: GAG
aaggaagacaggccatcctg

SEQ ID NO: 138691 - DNA, 20 bp, Artificial Sequence
  Description of Artificial Sequence: Synthetic oligonucleotide
  Target: ATXN1; (+) strand; PAM type: NRG; PAM sequence: AGG
aggaagacaggccatcctgg

SEQ ID NO: 138692 - DNA, 20 bp, Artificial Sequence
  Description of Artificial Sequence: Synthetic oligonucleotide
  Target: ATXN1; (+) strand; PAM type: NRG; PAM sequence: GGG
ggaagacaggccatcctgga

SEQ ID NO: 138693 - DNA, 20 bp, Artificial Sequence
  Description of Artificial Sequence: Synthetic oligonucleotide
  Target: ATXN1; (+) strand; PAM type: NRG; PAM sequence: GGG
gaagacaggccatcctggag

SEQ ID NO: 138694 - DNA, 20 bp, Artificial Sequence
  Description of Artificial Sequence: Synthetic oligonucleotide
  Target: ATXN1; (+) strand; PAM type: NRG; PAM sequence: GGG
aagacaggccatcctggagg

SEQ ID NO: 138695 - DNA, 20 bp, Artificial Sequence
  Description of Artificial Sequence: Synthetic oligonucleotide
  Target: ATXN1; (+) strand; PAM type: NRG; PAM sequence: TAG
caggccatcctggagggggc

SEQ ID NO: 138696 - DNA, 20 bp, Artificial Sequence
  Description of Artificial Sequence: Synthetic oligonucleotide
  Target: ATXN1; (+) strand; PAM type: NRG; PAM sequence: AGG
aggccatcctggagggggct

SEQ ID NO: 138697 - DNA, 20 bp, Artificial Sequence
  Description of Artificial Sequence: Synthetic oligonucleotide
  Target: ATXN1; (+) strand; PAM type: NRG; PAM sequence: GGG
ggccatcctggagggggcta

SEQ ID NO: 138698 - DNA, 20 bp, Artificial Sequence
  Description of Artificial Sequence: Synthetic oligonucleotide
  Target: ATXN1; (+) strand; PAM type: NRG; PAM sequence: TAG
cctggagggggctagggatt

SEQ ID NO: 138699 - DNA, 20 bp, Artificial Sequence
  Description of Artificial Sequence: Synthetic oligonucleotide
  Target: ATXN1; (+) strand; PAM type: NRG; PAM sequence: AGG
ctggagggggctagggattt

SEQ ID NO: 138700 - DNA, 20 bp, Artificial Sequence
  Description of Artificial Sequence: Synthetic oligonucleotide
  Target: ATXN1; (+) strand; PAM type: NRG; PAM sequence: GGG
tggagggggctagggattta

SEQ ID NO: 138701 - DNA, 20 bp, Artificial Sequence
  Description of Artificial Sequence: Synthetic oligonucleotide
  Target: ATXN1; (+) strand; PAM type: NRG; PAM sequence: TGG
gggggctagggatttaggga

SEQ ID NO: 138702 - DNA, 20 bp, Artificial Sequence
  Description of Artificial Sequence: Synthetic oligonucleotide
  Target: ATXN1; (+) strand; PAM type: NRG; PAM sequence: AAG
atggcattcctattatttac

SEQ ID NO: 138703 - DNA, 20 bp, Artificial Sequence
  Description of Artificial Sequence: Synthetic oligonucleotide
  Target: ATXN1; (+) strand; PAM type: NRG; PAM sequence: AGG
tggcattcctattatttaca

SEQ ID NO: 138704 - DNA, 20 bp, Artificial Sequence
  Description of Artificial Sequence: Synthetic oligonucleotide
  Target: ATXN1; (+) strand; PAM type: NRG; PAM sequence: GAG
cctattatttacaaggcgct

SEQ ID NO: 138705 - DNA, 20 bp, Artificial Sequence
  Description of Artificial Sequence: Synthetic oligonucleotide
  Target: ATXN1; (+) strand; PAM type: NRG; PAM sequence: TAG
ttatttacaaggcgctgagt

SEQ ID NO: 138706 - DNA, 20 bp, Artificial Sequence
  Description of Artificial Sequence: Synthetic oligonucleotide
  Target: ATXN1; (+) strand; PAM type: NRG; PAM sequence: CAG
ttacaaggcgctgagttaga

SEQ ID NO: 138707 - DNA, 20 bp, Artificial Sequence
  Description of Artificial Sequence: Synthetic oligonucleotide
  Target: ATXN1; (+) strand; PAM type: NRG; PAM sequence: TGG
agacagaccatgtgtgacca

SEQ ID NO: 138708 - DNA, 20 bp, Artificial Sequence
  Description of Artificial Sequence: Synthetic oligonucleotide
  Target: ATXN1; (+) strand; PAM type: NRG; PAM sequence: CAG
gtgaccatggtgttcctgct

SEQ ID NO: 138709 - DNA, 20 bp, Artificial Sequence
  Description of Artificial Sequence: Synthetic oligonucleotide
  Target: ATXN1; (+) strand; PAM type: NRG; PAM sequence: AAG
accatggtgttcctgctcag

SEQ ID NO: 138710 - DNA, 20 bp, Artificial Sequence
  Description of Artificial Sequence: Synthetic oligonucleotide
  Target: ATXN1; (+) strand; PAM type: NRG; PAM sequence: TGG
tcagaagcttacaatcgctt

SEQ ID NO: 138711 - DNA, 20 bp, Artificial Sequence
  Description of Artificial Sequence: Synthetic oligonucleotide
  Target: ATXN1; (+) strand; PAM type: NRG; PAM sequence: GAG
agaagcttacaatcgctttg

SEQ ID NO: 138712 - DNA, 20 bp, Artificial Sequence
  Description of Artificial Sequence: Synthetic oligonucleotide
  Target: ATXN1; (+) strand; PAM type: NRG; PAM sequence: GAG
aagcttacaatcgctttgga

SEQ ID NO: 138713 - DNA, 20 bp, Artificial Sequence
  Description of Artificial Sequence: Synthetic oligonucleotide
  Target: ATXN1; (+) strand; PAM type: NRG; PAM sequence: AGG
agcttacaatcgctttggag

SEQ ID NO: 138714 - DNA, 20 bp, Artificial Sequence
  Description of Artificial Sequence: Synthetic oligonucleotide
  Target: ATXN1; (+) strand; PAM type: NRG; PAM sequence: AAG
tacaatcgctttggagaggc

SEQ ID NO: 138715 - DNA, 20 bp, Artificial Sequence
  Description of Artificial Sequence: Synthetic oligonucleotide
  Target: ATXN1; (+) strand; PAM type: NRG; PAM sequence: AGG
acaatcgctttggagaggca

SEQ ID NO: 138716 - DNA, 20 bp, Artificial Sequence
  Description of Artificial Sequence: Synthetic oligonucleotide
  Target: ATXN1; (+) strand; PAM type: NRG; PAM sequence: CAG
ggcaaggcatttatcatgca

SEQ ID NO: 138717 - DNA, 20 bp, Artificial Sequence
  Description of Artificial Sequence: Synthetic oligonucleotide
  Target: ATXN1; (+) strand; PAM type: NRG; PAM sequence: GAG
caaggcatttatcatgcaca

SEQ ID NO: 138718 - DNA, 20 bp, Artificial Sequence
  Description of Artificial Sequence: Synthetic oligonucleotide
  Target: ATXN1; (+) strand; PAM type: NRG; PAM sequence: GAG
aggcatttatcatgcacaga

SEQ ID NO: 138719 - DNA, 20 bp, Artificial Sequence
  Description of Artificial Sequence: Synthetic oligonucleotide
  Target: ATXN1; (+) strand; PAM type: NRG; PAM sequence: TAG
catgcacagagagctgataa

SEQ ID NO: 138720 - DNA, 20 bp, Artificial Sequence
  Description of Artificial Sequence: Synthetic oligonucleotide
  Target: ATXN1; (+) strand; PAM type: NRG; PAM sequence: CAG
gcacagagagctgataatag

SEQ ID NO: 138721 - DNA, 20 bp, Artificial Sequence
  Description of Artificial Sequence: Synthetic oligonucleotide
  Target: ATXN1; (+) strand; PAM type: NRG; PAM sequence: AGG
cacagagagctgataatagc

SEQ ID NO: 138722 - DNA, 20 bp, Artificial Sequence
  Description of Artificial Sequence: Synthetic oligonucleotide
  Target: ATXN1; (+) strand; PAM type: NRG; PAM sequence: CAG
atagcaggcaatttttcaat

SEQ ID NO: 138723 - DNA, 20 bp, Artificial Sequence
  Description of Artificial Sequence: Synthetic oligonucleotide
  Target: ATXN1; (+) strand; PAM type: NRG; PAM sequence: CAG
tcaatcagcatacatttatt

SEQ ID NO: 138724 - DNA, 20 bp, Artificial Sequence
  Description of Artificial Sequence: Synthetic oligonucleotide
  Target: ATXN1; (+) strand; PAM type: NRG; PAM sequence: AAG
tattcagcaaatatttactg

SEQ ID NO: 138725 - DNA, 20 bp, Artificial Sequence
  Description of Artificial Sequence: Synthetic oligonucleotide
  Target: ATXN1; (+) strand; PAM type: NRG; PAM sequence: CAG
actgaagacctactaaatgc

SEQ ID NO: 138726 - DNA, 20 bp, Artificial Sequence
  Description of Artificial Sequence: Synthetic oligonucleotide
  Target: ATXN1; (+) strand; PAM type: NRG; PAM sequence: AGG
ctgaagacctactaaatgcc

SEQ ID NO: 138727 - DNA, 20 bp, Artificial Sequence
  Description of Artificial Sequence: Synthetic oligonucleotide
  Target: ATXN1; (+) strand; PAM type: NRG; PAM sequence: CAG
ctaaatgccaggcacgatgc

SEQ ID NO: 138728 - DNA, 20 bp, Artificial Sequence
  Description of Artificial Sequence: Synthetic oligonucleotide
  Target: ATXN1; (+) strand; PAM type: NRG; PAM sequence: TAG
ccaggcacgatgccagacat

SEQ ID NO: 138729 - DNA, 20 bp, Artificial Sequence
  Description of Artificial Sequence: Synthetic oligonucleotide
  Target: ATXN1; (+) strand; PAM type: NRG; PAM sequence: AGG
caggcacgatgccagacatt

SEQ ID NO: 138730 - DNA, 20 bp, Artificial Sequence
  Description of Artificial Sequence: Synthetic oligonucleotide
  Target: ATXN1; (+) strand; PAM type: NRG; PAM sequence: GGG
aggcacgatgccagacatta

SEQ ID NO: 138731 - DNA, 20 bp, Artificial Sequence
  Description of Artificial Sequence: Synthetic oligonucleotide
  Target: ATXN1; (+) strand; PAM type: NRG; PAM sequence: AAG
ttagggacaaaaatatgact

SEQ ID NO: 138732 - DNA, 20 bp, Artificial Sequence
  Description of Artificial Sequence: Synthetic oligonucleotide
  Target: ATXN1; (+) strand; PAM type: NRG; PAM sequence: TGG
acaaaaatatgactaagatg

SEQ ID NO: 138733 - DNA, 20 bp, Artificial Sequence
  Description of Artificial Sequence: Synthetic oligonucleotide
  Target: ATXN1; (+) strand; PAM type: NRG; PAM sequence: CAG
atatgactaagatgtggtcc

SEQ ID NO: 138734 - DNA, 20 bp, Artificial Sequence
  Description of Artificial Sequence: Synthetic oligonucleotide
  Target: ATXN1; (+) strand; PAM type: NRG; PAM sequence: CAG
tgactaagatgtggtcccag

SEQ ID NO: 138735 - DNA, 20 bp, Artificial Sequence
  Description of Artificial Sequence: Synthetic oligonucleotide
  Target: ATXN1; (+) strand; PAM type: NRG; PAM sequence: GAG
actaagatgtggtcccagca

SEQ ID NO: 138736 - DNA, 20 bp, Artificial Sequence
  Description of Artificial Sequence: Synthetic oligonucleotide
  Target: ATXN1; (+) strand; PAM type: NRG; PAM sequence: CAG
atgtggtcccagcagagaaa

SEQ ID NO: 138737 - DNA, 20 bp, Artificial Sequence
  Description of Artificial Sequence: Synthetic oligonucleotide
  Target: ATXN1; (+) strand; PAM type: NRG; PAM sequence: TGG
ggtcccagcagagaaacaga

SEQ ID NO: 138738 - DNA, 20 bp, Artificial Sequence
  Description of Artificial Sequence: Synthetic oligonucleotide
  Target: ATXN1; (+) strand; PAM type: NRG; PAM sequence: GGG
gtcccagcagagaaacagat

SEQ ID NO: 138739 - DNA, 20 bp, Artificial Sequence
  Description of Artificial Sequence: Synthetic oligonucleotide
  Target: ATXN1; (+) strand; PAM type: NRG; PAM sequence: GGG
tcccagcagagaaacagatg

SEQ ID NO: 138740 - DNA, 20 bp, Artificial Sequence
  Description of Artificial Sequence: Synthetic oligonucleotide
  Target: ATXN1; (+) strand; PAM type: NRG; PAM sequence: TAG
gaaacagatggggttccgta

SEQ ID NO: 138741 - DNA, 20 bp, Artificial Sequence
  Description of Artificial Sequence: Synthetic oligonucleotide
  Target: ATXN1; (+) strand; PAM type: NRG; PAM sequence: AAG
cgtatagtaaccatgttatc

SEQ ID NO: 138742 - DNA, 20 bp, Artificial Sequence
  Description of Artificial Sequence: Synthetic oligonucleotide
  Target: ATXN1; (+) strand; PAM type: NRG; PAM sequence: AGG
gtatagtaaccatgttatca

SEQ ID NO: 138743 - DNA, 20 bp, Artificial Sequence
  Description of Artificial Sequence: Synthetic oligonucleotide
  Target: ATXN1; (+) strand; PAM type: NRG; PAM sequence: GAG
atagtaaccatgttatcaag

SEQ ID NO: 138744 - DNA, 20 bp, Artificial Sequence
  Description of Artificial Sequence: Synthetic oligonucleotide
  Target: ATXN1; (+) strand; PAM type: NRG; PAM sequence: CAG
ccatgttatcaaggagtcat

SEQ ID NO: 138745 - DNA, 20 bp, Artificial Sequence
  Description of Artificial Sequence: Synthetic oligonucleotide
  Target: ATXN1; (+) strand; PAM type: NRG; PAM sequence: TAG
aggagtcatcagaatgctac

SEQ ID NO: 138746 - DNA, 20 bp, Artificial Sequence
  Description of Artificial Sequence: Synthetic oligonucleotide
  Target: ATXN1; (+) strand; PAM type: NRG; PAM sequence: TAG
atgctactagatgataaaaa

SEQ ID NO: 138747 - DNA, 20 bp, Artificial Sequence
  Description of Artificial Sequence: Synthetic oligonucleotide
  Target: ATXN1; (+) strand; PAM type: NRG; PAM sequence: CAG
ctactagatgataaaaatag

SEQ ID NO: 138748 - DNA, 20 bp, Artificial Sequence
  Description of Artificial Sequence: Synthetic oligonucleotide
  Target: ATXN1; (+) strand; PAM type: NRG; PAM sequence: CAG
tttcccctcttcgaaaaatg

SEQ ID NO: 138749 - DNA, 20 bp, Artificial Sequence
  Description of Artificial Sequence: Synthetic oligonucleotide
  Target: ATXN1; (+) strand; PAM type: NRG; PAM sequence: GAG
tcccctcttcgaaaaatgca

SEQ ID NO: 138750 - DNA, 20 bp, Artificial Sequence
  Description of Artificial Sequence: Synthetic oligonucleotide
  Target: ATXN1; (+) strand; PAM type: NRG; PAM sequence: CAG
cagagtacacataactaatc

SEQ ID NO: 138751 - DNA, 20 bp, Artificial Sequence
  Description of Artificial Sequence: Synthetic oligonucleotide
  Target: ATXN1; (+) strand; PAM type: NRG; PAM sequence: GAG
acataactaatccagtcact

SEQ ID NO: 138752 - DNA, 20 bp, Artificial Sequence
  Description of Artificial Sequence: Synthetic oligonucleotide
  Target: ATXN1; (+) strand; PAM type: NRG; PAM sequence: GAG
aactaatccagtcactgagt

SEQ ID NO: 138753 - DNA, 20 bp, Artificial Sequence
  Description of Artificial Sequence: Synthetic oligonucleotide
  Target: ATXN1; (+) strand; PAM type: NRG; PAM sequence: TGG
cagtcactgagtgagcattc

SEQ ID NO: 138754 - DNA, 20 bp, Artificial Sequence
  Description of Artificial Sequence: Synthetic oligonucleotide
  Target: ATXN1; (+) strand; PAM type: NRG; PAM sequence: TGG
tggcaatgaaaaaacatatt

SEQ ID NO: 138755 - DNA, 20 bp, Artificial Sequence
  Description of Artificial Sequence: Synthetic oligonucleotide
  Target: ATXN1; (+) strand; PAM type: NRG; PAM sequence: GAG
tgaaaaaacatatttggaat

SEQ ID NO: 138756 - DNA, 20 bp, Artificial Sequence
  Description of Artificial Sequence: Synthetic oligonucleotide
  Target: ATXN1; (+) strand; PAM type: NRG; PAM sequence: TAG
aaacatatttggaatgagaa

SEQ ID NO: 138757 - DNA, 20 bp, Artificial Sequence
  Description of Artificial Sequence: Synthetic oligonucleotide
  Target: ATXN1; (+) strand; PAM type: NRG; PAM sequence: CAG
ggaatgagaatagtgatctt

SEQ ID NO: 138758 - DNA, 20 bp, Artificial Sequence
  Description of Artificial Sequence: Synthetic oligonucleotide
  Target: ATXN1; (+) strand; PAM type: NRG; PAM sequence: TAG
aatagtgatcttcagaactc

SEQ ID NO: 138759 - DNA, 20 bp, Artificial Sequence
  Description of Artificial Sequence: Synthetic oligonucleotide
  Target: ATXN1; (+) strand; PAM type: NRG; PAM sequence: AGG
atagtgatcttcagaactct

SEQ ID NO: 138760 - DNA, 20 bp, Artificial Sequence
  Description of Artificial Sequence: Synthetic oligonucleotide
  Target: ATXN1; (+) strand; PAM type: NRG; PAM sequence: AAG
tcttcagaactctaggtacc

SEQ ID NO: 138761 - DNA, 20 bp, Artificial Sequence
  Description of Artificial Sequence: Synthetic oligonucleotide
  Target: ATXN1; (+) strand; PAM type: NRG; PAM sequence: CAG
actctaggtaccaagcattc

SEQ ID NO: 138762 - DNA, 20 bp, Artificial Sequence
  Description of Artificial Sequence: Synthetic oligonucleotide
  Target: ATXN1; (+) strand; PAM type: NRG; PAM sequence: GAG
ataaatgttctgatcccctt

SEQ ID NO: 138763 - DNA, 20 bp, Artificial Sequence
  Description of Artificial Sequence: Synthetic oligonucleotide
  Target: ATXN1; (+) strand; PAM type: NRG; PAM sequence: TGG
aatgttctgatccccttgag

SEQ ID NO: 138764 - DNA, 20 bp, Artificial Sequence
  Description of Artificial Sequence: Synthetic oligonucleotide
  Target: ATXN1; (+) strand; PAM type: NRG; PAM sequence: CGG
ccccttgagtggcaattgac

SEQ ID NO: 138765 - DNA, 20 bp, Artificial Sequence
  Description of Artificial Sequence: Synthetic oligonucleotide
  Target: ATXN1; (+) strand; PAM type: NRG; PAM sequence: GAG
gcaattgaccggctgacact

SEQ ID NO: 138766 - DNA, 20 bp, Artificial Sequence
  Description of Artificial Sequence: Synthetic oligonucleotide
  Target: ATXN1; (+) strand; PAM type: NRG; PAM sequence: AGG
caattgaccggctgacactg

SEQ ID NO: 138767 - DNA, 20 bp, Artificial Sequence
  Description of Artificial Sequence: Synthetic oligonucleotide
  Target: ATXN1; (+) strand; PAM type: NRG; PAM sequence: TGG
ctgaggcaaacttgccacca

SEQ ID NO: 138768 - DNA, 20 bp, Artificial Sequence
  Description of Artificial Sequence: Synthetic oligonucleotide
  Target: ATXN1; (+) strand; PAM type: NRG; PAM sequence: AAG
aggcaaacttgccaccatgg

SEQ ID NO: 138769 - DNA, 20 bp, Artificial Sequence
  Description of Artificial Sequence: Synthetic oligonucleotide
  Target: ATXN1; (+) strand; PAM type: NRG; PAM sequence: GAG
tggaagatgtgaattaaaac

SEQ ID NO: 138770 - DNA, 20 bp, Artificial Sequence
  Description of Artificial Sequence: Synthetic oligonucleotide
  Target: ATXN1; (+) strand; PAM type: NRG; PAM sequence: AAG
ttaaaacgagtgattgtact

SEQ ID NO: 138771 - DNA, 20 bp, Artificial Sequence
  Description of Artificial Sequence: Synthetic oligonucleotide
  Target: ATXN1; (+) strand; PAM type: NRG; PAM sequence: AGG
taaaacgagtgattgtacta

SEQ ID NO: 138772 - DNA, 20 bp, Artificial Sequence
  Description of Artificial Sequence: Synthetic oligonucleotide
  Target: ATXN1; (+) strand; PAM type: NRG; PAM sequence: TAG
cgagtgattgtactaaggta

SEQ ID NO: 138773 - DNA, 20 bp, Artificial Sequence
  Description of Artificial Sequence: Synthetic oligonucleotide
  Target: ATXN1; (+) strand; PAM type: NRG; PAM sequence: TGG
attgtactaaggtatagaaa

SEQ ID NO: 138774 - DNA, 20 bp, Artificial Sequence
  Description of Artificial Sequence: Synthetic oligonucleotide
  Target: ATXN1; (+) strand; PAM type: NRG; PAM sequence: CAG
tcgtacttcctgtttcataa

SEQ ID NO: 138775 - DNA, 20 bp, Artificial Sequence
  Description of Artificial Sequence: Synthetic oligonucleotide
  Target: ATXN1; (+) strand; PAM type: NRG; PAM sequence: AAG
tgtttcataacagtcctcac

SEQ ID NO: 138776 - DNA, 20 bp, Artificial Sequence
  Description of Artificial Sequence: Synthetic oligonucleotide
  Target: ATXN1; (+) strand; PAM type: NRG; PAM sequence: TAG
taaatgtctgcctttcctga

SEQ ID NO: 138777 - DNA, 20 bp, Artificial Sequence
  Description of Artificial Sequence: Synthetic oligonucleotide
  Target: ATXN1; (+) strand; PAM type: NRG; PAM sequence: AAG
atagactgcaacctgaaaaa

SEQ ID NO: 138778 - DNA, 20 bp, Artificial Sequence
  Description of Artificial Sequence: Synthetic oligonucleotide
  Target: ATXN1; (+) strand; PAM type: NRG; PAM sequence: AGG
tagactgcaacctgaaaaaa

SEQ ID NO: 138779 - DNA, 20 bp, Artificial Sequence
  Description of Artificial Sequence: Synthetic oligonucleotide
  Target: ATXN1; (+) strand; PAM type: NRG; PAM sequence: AAG
actgcaacctgaaaaaaagg

SEQ ID NO: 138780 - DNA, 20 bp, Artificial Sequence
  Description of Artificial Sequence: Synthetic oligonucleotide
  Target: ATXN1; (+) strand; PAM type: NRG; PAM sequence: AGG
ctgcaacctgaaaaaaagga

SEQ ID NO: 138781 - DNA, 20 bp, Artificial Sequence
  Description of Artificial Sequence: Synthetic oligonucleotide
  Target: ATXN1; (+) strand; PAM type: NRG; PAM sequence: TGG
cctgaaaaaaaggaaggaac

SEQ ID NO: 138782 - DNA, 20 bp, Artificial Sequence
  Description of Artificial Sequence: Synthetic oligonucleotide
  Target: ATXN1; (+) strand; PAM type: NRG; PAM sequence: GGG
ctgaaaaaaaggaaggaact

SEQ ID NO: 138783 - DNA, 20 bp, Artificial Sequence
  Description of Artificial Sequence: Synthetic oligonucleotide
  Target: ATXN1; (+) strand; PAM type: NRG; PAM sequence: CAG
aactgggtctcttttattta

SEQ ID NO: 138784 - DNA, 20 bp, Artificial Sequence
  Description of Artificial Sequence: Synthetic oligonucleotide
  Target: ATXN1; (+) strand; PAM type: NRG; PAM sequence: CAG
cttttatttacagttttccc

SEQ ID NO: 138785 - DNA, 20 bp, Artificial Sequence
  Description of Artificial Sequence: Synthetic oligonucleotide
  Target: ATXN1; (+) strand; PAM type: NRG; PAM sequence: TAG
ttacagttttccccagtgcc

SEQ ID NO: 138786 - DNA, 20 bp, Artificial Sequence
  Description of Artificial Sequence: Synthetic oligonucleotide
  Target: ATXN1; (+) strand; PAM type: NRG; PAM sequence: TAG
ctagtacaacgcctgacaca

SEQ ID NO: 138787 - DNA, 20 bp, Artificial Sequence
  Description of Artificial Sequence: Synthetic oligonucleotide
  Target: ATXN1; (+) strand; PAM type: NRG; PAM sequence: AAG
tacaacgcctgacacatagt

SEQ ID NO: 138788 - DNA, 20 bp, Artificial Sequence
  Description of Artificial Sequence: Synthetic oligonucleotide
  Target: ATXN1; (+) strand; PAM type: NRG; PAM sequence: TGG
taagcaattaaaaacattta

SEQ ID NO: 138789 - DNA, 20 bp, Artificial Sequence
  Description of Artificial Sequence: Synthetic oligonucleotide
  Target: ATXN1; (+) strand; PAM type: NRG; PAM sequence: TAG
attaaaaacatttatggcac

SEQ ID NO: 138790 - DNA, 20 bp, Artificial Sequence
  Description of Artificial Sequence: Synthetic oligonucleotide
  Target: ATXN1; (+) strand; PAM type: NRG; PAM sequence: TAG
atggcactagaattttcaat

SEQ ID NO: 138791 - DNA, 20 bp, Artificial Sequence
  Description of Artificial Sequence: Synthetic oligonucleotide
  Target: ATXN1; (+) strand; PAM type: NRG; PAM sequence: TGG
cactagaattttcaattagc

SEQ ID NO: 138792 - DNA, 20 bp, Artificial Sequence
  Description of Artificial Sequence: Synthetic oligonucleotide
  Target: ATXN1; (+) strand; PAM type: NRG; PAM sequence: AAG
gctggctgcatattattgca

SEQ ID NO: 138793 - DNA, 20 bp, Artificial Sequence
  Description of Artificial Sequence: Synthetic oligonucleotide
  Target: ATXN1; (+) strand; PAM type: NRG; PAM sequence: AAG
ttgcaaagttaacatctgaa

SEQ ID NO: 138794 - DNA, 20 bp, Artificial Sequence
  Description of Artificial Sequence: Synthetic oligonucleotide
  Target: ATXN1; (+) strand; PAM type: NRG; PAM sequence: AGG
tgcaaagttaacatctgaaa

SEQ ID NO: 138795 - DNA, 20 bp, Artificial Sequence
  Description of Artificial Sequence: Synthetic oligonucleotide
  Target: ATXN1; (+) strand; PAM type: NRG; PAM sequence: TGG
atctgaaaaggctattaaaa

SEQ ID NO: 138796 - DNA, 20 bp, Artificial Sequence
  Description of Artificial Sequence: Synthetic oligonucleotide
  Target: ATXN1; (+) strand; PAM type: NRG; PAM sequence: AAG
gctattaaaatggtcatgta

SEQ ID NO: 138797 - DNA, 20 bp, Artificial Sequence
  Description of Artificial Sequence: Synthetic oligonucleotide
  Target: ATXN1; (+) strand; PAM type: NRG; PAM sequence: TGG
aaaatggtcatgtaaagact

SEQ ID NO: 138798 - DNA, 20 bp, Artificial Sequence
  Description of Artificial Sequence: Synthetic oligonucleotide
  Target: ATXN1; (+) strand; PAM type: NRG; PAM sequence: TAG
acttggtaaccaatataatc

SEQ ID NO: 138799 - DNA, 20 bp, Artificial Sequence
  Description of Artificial Sequence: Synthetic oligonucleotide
  Target: ATXN1; (+) strand; PAM type: NRG; PAM sequence: GAG
ttactttatttcttgttttt

SEQ ID NO: 138800 - DNA, 20 bp, Artificial Sequence
  Description of Artificial Sequence: Synthetic oligonucleotide
  Target: ATXN1; (+) strand; PAM type: NRG; PAM sequence: CAG
tttatttcttgtttttgagt

SEQ ID NO: 138801 - DNA, 20 bp, Artificial Sequence
  Description of Artificial Sequence: Synthetic oligonucleotide
  Target: ATXN1; (+) strand; PAM type: NRG; PAM sequence: AGG
ttatttcttgtttttgagtc

SEQ ID NO: 138802 - DNA, 20 bp, Artificial Sequence
  Description of Artificial Sequence: Synthetic oligonucleotide
  Target: ATXN1; (+) strand; PAM type: NRG; PAM sequence: GGG
tatttcttgtttttgagtca

SEQ ID NO: 138803 - DNA, 20 bp, Artificial Sequence
  Description of Artificial Sequence: Synthetic oligonucleotide
  Target: ATXN1; (+) strand; PAM type: NRG; PAM sequence: CAG
cagggtcttcctctgttgcc

SEQ ID NO: 138804 - DNA, 20 bp, Artificial Sequence
  Description of Artificial Sequence: Synthetic oligonucleotide
  Target: ATXN1; (+) strand; PAM type: NRG; PAM sequence: AGG
agggtcttcctctgttgccc

SEQ ID NO: 138805 - DNA, 20 bp, Artificial Sequence
  Description of Artificial Sequence: Synthetic oligonucleotide
  Target: ATXN1; (+) strand; PAM type: NRG; PAM sequence: TGG
tcttcctctgttgcccaggc

SEQ ID NO: 138806 - DNA, 20 bp, Artificial Sequence
  Description of Artificial Sequence: Synthetic oligonucleotide
  Target: ATXN1; (+) strand; PAM type: NRG; PAM sequence: GAG
ttcctctgttgcccaggctg

SEQ ID NO: 138807 - DNA, 20 bp, Artificial Sequence
  Description of Artificial Sequence: Synthetic oligonucleotide
  Target: ATXN1; (+) strand; PAM type: NRG; PAM sequence: CAG
ctgttgcccaggctggagtg

SEQ ID NO: 138808 - DNA, 20 bp, Artificial Sequence
  Description of Artificial Sequence: Synthetic oligonucleotide
  Target: ATXN1; (+) strand; PAM type: NRG; PAM sequence: TGG
ttgcccaggctggagtgcag

SEQ ID NO: 138809 - DNA, 20 bp, Artificial Sequence
  Description of Artificial Sequence: Synthetic oligonucleotide
  Target: ATXN1; (+) strand; PAM type: NRG; PAM sequence: TAG
tgcagtggtgcatgtgatct

SEQ ID NO: 138810 - DNA, 20 bp, Artificial Sequence
  Description of Artificial Sequence: Synthetic oligonucleotide
  Target: ATXN1; (+) strand; PAM type: NRG; PAM sequence: CAG
actgcaacctctctgcctcc

SEQ ID NO: 138811 - DNA, 20 bp, Artificial Sequence
  Description of Artificial Sequence: Synthetic oligonucleotide
  Target: ATXN1; (+) strand; PAM type: NRG; PAM sequence: AGG
ctgcaacctctctgcctccc

SEQ ID NO: 138812 - DNA, 20 bp, Artificial Sequence
  Description of Artificial Sequence: Synthetic oligonucleotide
  Target: ATXN1; (+) strand; PAM type: NRG; PAM sequence: AAG
cctctctgcctcccaggttc

SEQ ID NO: 138813 - DNA, 20 bp, Artificial Sequence
  Description of Artificial Sequence: Synthetic oligonucleotide
  Target: ATXN1; (+) strand; PAM type: NRG; PAM sequence: CAG
ttcaagtgattctcctgcct

SEQ ID NO: 138814 - DNA, 20 bp, Artificial Sequence
  Description of Artificial Sequence: Synthetic oligonucleotide
  Target: ATXN1; (+) strand; PAM type: NRG; PAM sequence: AAG
ttctcctgcctcagcctccc

SEQ ID NO: 138815 - DNA, 20 bp, Artificial Sequence
  Description of Artificial Sequence: Synthetic oligonucleotide
  Target: ATXN1; (+) strand; PAM type: NRG; PAM sequence: CAG
tcctgcctcagcctcccaag

SEQ ID NO: 138816 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccaagcagc

SEQ ID NO: 138817 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccaagcagct

SEQ ID NO: 138818 - DNA, 20 bp, Artificial Sequence
  Description of Artificial Sequence: Synthetic oligonucleotide
  Target: ATXN1; (+) strand; PAM type: NRG; PAM sequence: CAG
ctcccaagcagctgggatta

SEQ ID NO: 138819 - DNA, 20 bp, Artificial Sequence
  Description of Artificial Sequence: Synthetic oligonucleotide
  Target: ATXN1; (+) strand; PAM type: NRG; PAM sequence: AGG
tcccaagcagctgggattac

SEQ ID NO: 138820 - DNA, 20 bp, Artificial Sequence
  Description of Artificial Sequence: Synthetic oligonucleotide
  Target: ATXN1; (+) strand; PAM type: NRG; PAM sequence: CAG
caggcacgcaccaccatgcc

SEQ ID NO: 138821 - DNA, 20 bp, Artificial Sequence
  Description of Artificial Sequence: Synthetic oligonucleotide
  Target: ATXN1; (+) strand; PAM type: NRG; PAM sequence: TAG
ccagctaatttttgtttttt

SEQ ID NO: 138822 - DNA, 20 bp, Artificial Sequence
  Description of Artificial Sequence: Synthetic oligonucleotide
  Target: ATXN1; (+) strand; PAM type: NRG; PAM sequence: TAG
gctaatttttgtttttttag

SEQ ID NO: 138823 - DNA, 20 bp, Artificial Sequence
  Description of Artificial Sequence: Synthetic oligonucleotide
  Target: ATXN1; (+) strand; PAM type: NRG; PAM sequence: GAG
taatttttgtttttttagta

SEQ ID NO: 138824 - DNA, 20 bp, Artificial Sequence
  Description of Artificial Sequence: Synthetic oligonucleotide
  Target: ATXN1; (+) strand; PAM type: NRG; PAM sequence: CGG
ttttgtttttttagtagaga

SEQ ID NO: 138825 - DNA, 20 bp, Artificial Sequence
  Description of Artificial Sequence: Synthetic oligonucleotide
  Target: ATXN1; (+) strand; PAM type: NRG; PAM sequence: GGG
tttgtttttttagtagagac

SEQ ID NO: 138826 - DNA, 20 bp, Artificial Sequence
  Description of Artificial Sequence: Synthetic oligonucleotide
  Target: ATXN1; (+) strand; PAM type: NRG; PAM sequence: GGG
ttgtttttttagtagagacg

SEQ ID NO: 138827 - DNA, 20 bp, Artificial Sequence
  Description of Artificial Sequence: Synthetic oligonucleotide
  Target: ATXN1; (+) strand; PAM type: NRG; PAM sequence: TGG
gagacggggtttcaccatgt

SEQ ID NO: 138828 - DNA, 20 bp, Artificial Sequence
  Description of Artificial Sequence: Synthetic oligonucleotide
  Target: ATXN1; (+) strand; PAM type: NRG; PAM sequence: CAG
cggggtttcaccatgttggc

SEQ ID NO: 138829 - DNA, 20 bp, Artificial Sequence
  Description of Artificial Sequence: Synthetic oligonucleotide
  Target: ATXN1; (+) strand; PAM type: NRG; PAM sequence: AGG
ggggtttcaccatgttggcc

SEQ ID NO: 138830 - DNA, 20 bp, Artificial Sequence
  Description of Artificial Sequence: Synthetic oligonucleotide
  Target: ATXN1; (+) strand; PAM type: NRG; PAM sequence: CAG
tgttcacgaactcctgacct

SEQ ID NO: 138831 - DNA, 20 bp, Artificial Sequence
  Description of Artificial Sequence: Synthetic oligonucleotide
  Target: ATXN1; (+) strand; PAM type: NRG; PAM sequence: CGG
gatgatgtgcccacccacct

SEQ ID NO: 138832 - DNA, 20 bp, Artificial Sequence
  Description of Artificial Sequence: Synthetic oligonucleotide
  Target: ATXN1; (+) strand; PAM type: NRG; PAM sequence: AAG
ccacccacctcggcctccca

SEQ ID NO: 138833 - DNA, 20 bp, Artificial Sequence
  Description of Artificial Sequence: Synthetic oligonucleotide
  Target: ATXN1; (+) strand; PAM type: NRG; PAM sequence: GAG
cctcggcctcccaaagtact

SEQ ID NO: 138834 - DNA, 20 bp, Artificial Sequence
  Description of Artificial Sequence: Synthetic oligonucleotide
  Target: ATXN1; (+) strand; PAM type: NRG; PAM sequence: CAG
ctcccaaagtactgagatta

SEQ ID NO: 138835 - DNA, 20 bp, Artificial Sequence
  Description of Artificial Sequence: Synthetic oligonucleotide
  Target: ATXN1; (+) strand; PAM type: NRG; PAM sequence: AGG
tcccaaagtactgagattac

SEQ ID NO: 138836 - DNA, 20 bp, Artificial Sequence
  Description of Artificial Sequence: Synthetic oligonucleotide
  Target: ATXN1; (+) strand; PAM type: NRG; PAM sequence: GAG
agtactgagattacaggcat

SEQ ID NO: 138837 - DNA, 20 bp, Artificial Sequence
  Description of Artificial Sequence: Synthetic oligonucleotide
  Target: ATXN1; (+) strand; PAM type: NRG; PAM sequence: CAG
caggcatgagccactgcgcc

SEQ ID NO: 138838 - DNA, 20 bp, Artificial Sequence
  Description of Artificial Sequence: Synthetic oligonucleotide
  Target: ATXN1; (+) strand; PAM type: NRG; PAM sequence: TGG
catgagccactgcgcccagc

SEQ ID NO: 138839 - DNA, 20 bp, Artificial Sequence
  Description of Artificial Sequence: Synthetic oligonucleotide
  Target: ATXN1; (+) strand; PAM type: NRG; PAM sequence: AAG
acttaatcaactaatgaatc

SEQ ID NO: 138840 - DNA, 20 bp, Artificial Sequence
  Description of Artificial Sequence: Synthetic oligonucleotide
  Target: ATXN1; (+) strand; PAM type: NRG; PAM sequence: TGG
taatgaatcaagttaactta

SEQ ID NO: 138841 - DNA, 20 bp, Artificial Sequence
  Description of Artificial Sequence: Synthetic oligonucleotide
  Target: ATXN1; (+) strand; PAM type: NRG; PAM sequence: TGG
taacttatggatactgttac

SEQ ID NO: 138842 - DNA, 20 bp, Artificial Sequence
  Description of Artificial Sequence: Synthetic oligonucleotide
  Target: ATXN1; (+) strand; PAM type: NRG; PAM sequence: AAG
cactcaaaattcatgtgttg

SEQ ID NO: 138843 - DNA, 20 bp, Artificial Sequence
  Description of Artificial Sequence: Synthetic oligonucleotide
  Target: ATXN1; (+) strand; PAM type: NRG; PAM sequence: CAG
tgtgttgaagccctaacttc

SEQ ID NO: 138844 - DNA, 20 bp, Artificial Sequence
  Description of Artificial Sequence: Synthetic oligonucleotide
  Target: ATXN1; (+) strand; PAM type: NRG; PAM sequence: CAG
agccctaacttccagtttct

SEQ ID NO: 138845 - DNA, 20 bp, Artificial Sequence
  Description of Artificial Sequence: Synthetic oligonucleotide
  Target: ATXN1; (+) strand; PAM type: NRG; PAM sequence: TGG
tctcagaatataactgtatt

SEQ ID NO: 138846 - DNA, 20 bp, Artificial Sequence
  Description of Artificial Sequence: Synthetic oligonucleotide
  Target: ATXN1; (+) strand; PAM type: NRG; PAM sequence: TGG
atataactgtatttggaaat

SEQ ID NO: 138847 - DNA, 20 bp, Artificial Sequence
  Description of Artificial Sequence: Synthetic oligonucleotide
  Target: ATXN1; (+) strand; PAM type: NRG; PAM sequence: GAG
atttggaaattggacctttt

SEQ ID NO: 138848 - DNA, 20 bp, Artificial Sequence
  Description of Artificial Sequence: Synthetic oligonucleotide
  Target: ATXN1; (+) strand; PAM type: NRG; PAM sequence: GAG
ttggaaattggaccttttga

SEQ ID NO: 138849 - DNA, 20 bp, Artificial Sequence
  Description of Artificial Sequence: Synthetic oligonucleotide
  Target: ATXN1; (+) strand; PAM type: NRG; PAM sequence: AGG
tggaaattggaccttttgag

SEQ ID NO: 138850 - DNA, 20 bp, Artificial Sequence
  Description of Artificial Sequence: Synthetic oligonucleotide
  Target: ATXN1; (+) strand; PAM type: NRG; PAM sequence: AAG
agaggtaattaaaacaaaat

SEQ ID NO: 138851 - DNA, 20 bp, Artificial Sequence
  Description of Artificial Sequence: Synthetic oligonucleotide
  Target: ATXN1; (+) strand; PAM type: NRG; PAM sequence: AGG
gaggtaattaaaacaaaata

SEQ ID NO: 138852 - DNA, 20 bp, Artificial Sequence
  Description of Artificial Sequence: Synthetic oligonucleotide
  Target: ATXN1; (+) strand; PAM type: NRG; PAM sequence: AAG
aacaaaataaggtcatatga

SEQ ID NO: 138853 - DNA, 20 bp, Artificial Sequence
  Description of Artificial Sequence: Synthetic oligonucleotide
  Target: ATXN1; (+) strand; PAM type: NRG; PAM sequence: AGG
acaaaataaggtcatatgaa

SEQ ID NO: 138854 - DNA, 20 bp, Artificial Sequence
  Description of Artificial Sequence: Synthetic oligonucleotide
  Target: ATXN1; (+) strand; PAM type: NRG; PAM sequence: GGG
caaaataaggtcatatgaaa

SEQ ID NO: 138855 - DNA, 20 bp, Artificial Sequence
  Description of Artificial Sequence: Synthetic oligonucleotide
  Target: ATXN1; (+) strand; PAM type: NRG; PAM sequence: TGG
gggccctattccactatgac

SEQ ID NO: 138856 - DNA, 20 bp, Artificial Sequence
  Description of Artificial Sequence: Synthetic oligonucleotide
  Target: ATXN1; (+) strand; PAM type: NRG; PAM sequence: CAG
tatgactggtgtccttgtaa

SEQ ID NO: 138857 - DNA, 20 bp, Artificial Sequence
  Description of Artificial Sequence: Synthetic oligonucleotide
  Target: ATXN1; (+) strand; PAM type: NRG; PAM sequence: AGG
atgactggtgtccttgtaac

SEQ ID NO: 138858 - DNA, 20 bp, Artificial Sequence
  Description of Artificial Sequence: Synthetic oligonucleotide
  Target: ATXN1; (+) strand; PAM type: NRG; PAM sequence: GAG
gactggtgtccttgtaacag

SEQ ID NO: 138859 - DNA, 20 bp, Artificial Sequence
  Description of Artificial Sequence: Synthetic oligonucleotide
  Target: ATXN1; (+) strand; PAM type: NRG; PAM sequence: TGG
gtgtccttgtaacaggagac

SEQ ID NO: 138860 - DNA, 20 bp, Artificial Sequence
  Description of Artificial Sequence: Synthetic oligonucleotide
  Target: ATXN1; (+) strand; PAM type: NRG; PAM sequence: GGG
tgtccttgtaacaggagact

SEQ ID NO: 138861 - DNA, 20 bp, Artificial Sequence
  Description of Artificial Sequence: Synthetic oligonucleotide
  Target: ATXN1; (+) strand; PAM type: NRG; PAM sequence: CAG
tgtaacaggagactgggaca

SEQ ID NO: 138862 - DNA, 20 bp, Artificial Sequence
  Description of Artificial Sequence: Synthetic oligonucleotide
  Target: ATXN1; (+) strand; PAM type: NRG; PAM sequence: TGG
aggagactgggacacagact

SEQ ID NO: 138863 - DNA, 20 bp, Artificial Sequence
  Description of Artificial Sequence: Synthetic oligonucleotide
  Target: ATXN1; (+) strand; PAM type: NRG; PAM sequence: GAG
gagactgggacacagacttg

SEQ ID NO: 138864 - DNA, 20 bp, Artificial Sequence
  Description of Artificial Sequence: Synthetic oligonucleotide
  Target: ATXN1; (+) strand; PAM type: NRG; PAM sequence: AGG
agactgggacacagacttgg

SEQ ID NO: 138865 - DNA, 20 bp, Artificial Sequence
  Description of Artificial Sequence: Synthetic oligonucleotide
  Target: ATXN1; (+) strand; PAM type: NRG; PAM sequence: GGG
gactgggacacagacttgga

SEQ ID NO: 138866 - DNA, 20 bp, Artificial Sequence
  Description of Artificial Sequence: Synthetic oligonucleotide
  Target: ATXN1; (+) strand; PAM type: NRG; PAM sequence: AAG
tgggacacagacttggaggg

SEQ ID NO: 138867 - DNA, 20 bp, Artificial Sequence
  Description of Artificial Sequence: Synthetic oligonucleotide
  Target: ATXN1; (+) strand; PAM type: NRG; PAM sequence: GAG
agacttggagggaagcccac

SEQ ID NO: 138868 - DNA, 20 bp, Artificial Sequence
  Description of Artificial Sequence: Synthetic oligonucleotide
  Target: ATXN1; (+) strand; PAM type: NRG; PAM sequence: GAG
acttggagggaagcccacga

SEQ ID NO: 138869 - DNA, 20 bp, Artificial Sequence
  Description of Artificial Sequence: Synthetic oligonucleotide
  Target: ATXN1; (+) strand; PAM type: NRG; PAM sequence: AGG
cttggagggaagcccacgag

SEQ ID NO: 138870 - DNA, 20 bp, Artificial Sequence
  Description of Artificial Sequence: Synthetic oligonucleotide
  Target: ATXN1; (+) strand; PAM type: NRG; PAM sequence: CAG
gggaagcccacgagaggaca

SEQ ID NO: 138871 - DNA, 20 bp, Artificial Sequence
  Description of Artificial Sequence: Synthetic oligonucleotide
  Target: ATXN1; (+) strand; PAM type: NRG; PAM sequence: AGG
ggaagcccacgagaggacac

SEQ ID NO: 138872 - DNA, 20 bp, Artificial Sequence
  Description of Artificial Sequence: Synthetic oligonucleotide
  Target: ATXN1; (+) strand; PAM type: NRG; PAM sequence: GGG
gaagcccacgagaggacaca

SEQ ID NO: 138873 - DNA, 20 bp, Artificial Sequence
  Description of Artificial Sequence: Synthetic oligonucleotide
  Target: ATXN1; (+) strand; PAM type: NRG; PAM sequence: GGG
aagcccacgagaggacacag

SEQ ID NO: 138874 - DNA, 20 bp, Artificial Sequence
  Description of Artificial Sequence: Synthetic oligonucleotide
  Target: ATXN1; (+) strand; PAM type: NRG; PAM sequence: GGG
agcccacgagaggacacagg

SEQ ID NO: 138875 - DNA, 20 bp, Artificial Sequence
  Description of Artificial Sequence: Synthetic oligonucleotide
  Target: ATXN1; (+) strand; PAM type: NRG; PAM sequence: AAG
ccacgagaggacacaggggg

SEQ ID NO: 138876 - DNA, 20 bp, Artificial Sequence
  Description of Artificial Sequence: Synthetic oligonucleotide
  Target: ATXN1; (+) strand; PAM type: NRG; PAM sequence: TGG
gagaggacacagggggaaga

SEQ ID NO: 138877 - DNA, 20 bp, Artificial Sequence
  Description of Artificial Sequence: Synthetic oligonucleotide
  Target: ATXN1; (+) strand; PAM type: NRG; PAM sequence: AAG
gggggaagatggccatctgc

SEQ ID NO: 138878 - DNA, 20 bp, Artificial Sequence
  Description of Artificial Sequence: Synthetic oligonucleotide
  Target: ATXN1; (+) strand; PAM type: NRG; PAM sequence: AAG
aagatggccatctgcaagcc

SEQ ID NO: 138879 - DNA, 20 bp, Artificial Sequence
  Description of Artificial Sequence: Synthetic oligonucleotide
  Target: ATXN1; (+) strand; PAM type: NRG; PAM sequence: AGG
agatggccatctgcaagcca

SEQ ID NO: 138880 - DNA, 20 bp, Artificial Sequence
  Description of Artificial Sequence: Synthetic oligonucleotide
  Target: ATXN1; (+) strand; PAM type: NRG; PAM sequence: GAG
atggccatctgcaagccaag

SEQ ID NO: 138881 - DNA, 20 bp, Artificial Sequence
  Description of Artificial Sequence: Synthetic oligonucleotide
  Target: ATXN1; (+) strand; PAM type: NRG; PAM sequence: AAG
gccatctgcaagccaaggag

SEQ ID NO: 138882 - DNA, 20 bp, Artificial Sequence
  Description of Artificial Sequence: Synthetic oligonucleotide
  Target: ATXN1; (+) strand; PAM type: NRG; PAM sequence: AGG
ccatctgcaagccaaggaga

SEQ ID NO: 138883 - DNA, 20 bp, Artificial Sequence
  Description of Artificial Sequence: Synthetic oligonucleotide
  Target: ATXN1; (+) strand; PAM type: NRG; PAM sequence: CAG
caagccaaggagaaggactt

SEQ ID NO: 138884 - DNA, 20 bp, Artificial Sequence
  Description of Artificial Sequence: Synthetic oligonucleotide
  Target: ATXN1; (+) strand; PAM type: NRG; PAM sequence: AAG
gccaaggagaaggacttcag

SEQ ID NO: 138885 - DNA, 20 bp, Artificial Sequence
  Description of Artificial Sequence: Synthetic oligonucleotide
  Target: ATXN1; (+) strand; PAM type: NRG; PAM sequence: AGG
ccaaggagaaggacttcaga

SEQ ID NO: 138886 - DNA, 20 bp, Artificial Sequence
  Description of Artificial Sequence: Synthetic oligonucleotide
  Target: ATXN1; (+) strand; PAM type: NRG; PAM sequence: TAG
catttcaaacttactgtctc

SEQ ID NO: 138887 - DNA, 20 bp, Artificial Sequence
  Description of Artificial Sequence: Synthetic oligonucleotide
  Target: ATXN1; (+) strand; PAM type: NRG; PAM sequence: AAG
cttactgtctctagaatcat

SEQ ID NO: 138888 - DNA, 20 bp, Artificial Sequence
  Description of Artificial Sequence: Synthetic oligonucleotide
  Target: ATXN1; (+) strand; PAM type: NRG; PAM sequence: AAG
ctctagaatcataagaaaat

SEQ ID NO: 138889 - DNA, 20 bp, Artificial Sequence
  Description of Artificial Sequence: Synthetic oligonucleotide
  Target: ATXN1; (+) strand; PAM type: NRG; PAM sequence: AAG
aaaataagtttgtgctgttt

SEQ ID NO: 138890 - DNA, 20 bp, Artificial Sequence
  Description of Artificial Sequence: Synthetic oligonucleotide
  Target: ATXN1; (+) strand; PAM type: NRG; PAM sequence: CAG
tttgtgctgtttaagccact

SEQ ID NO: 138891 - DNA, 20 bp, Artificial Sequence
  Description of Artificial Sequence: Synthetic oligonucleotide
  Target: ATXN1; (+) strand; PAM type: NRG; PAM sequence: TGG
gctgtttaagccactcagtc

SEQ ID NO: 138892 - DNA, 20 bp, Artificial Sequence
  Description of Artificial Sequence: Synthetic oligonucleotide
  Target: ATXN1; (+) strand; PAM type: NRG; PAM sequence: GGG
ctgtttaagccactcagtct

SEQ ID NO: 138893 - DNA, 20 bp, Artificial Sequence
  Description of Artificial Sequence: Synthetic oligonucleotide
  Target: ATXN1; (+) strand; PAM type: NRG; PAM sequence: TGG
cagtctgggttactttgtta

SEQ ID NO: 138894 - DNA, 20 bp, Artificial Sequence
  Description of Artificial Sequence: Synthetic oligonucleotide
  Target: ATXN1; (+) strand; PAM type: NRG; PAM sequence: TAG
tctgggttactttgttatgg

SEQ ID NO: 138895 - DNA, 20 bp, Artificial Sequence
  Description of Artificial Sequence: Synthetic oligonucleotide
  Target: ATXN1; (+) strand; PAM type: NRG; PAM sequence: CAG
tggtagacctcgcaaactga

SEQ ID NO: 138896 - DNA, 20 bp, Artificial Sequence
  Description of Artificial Sequence: Synthetic oligonucleotide
  Target: ATXN1; (+) strand; PAM type: NRG; PAM sequence: AAG
ctcgcaaactgacagatact

SEQ ID NO: 138897 - DNA, 20 bp, Artificial Sequence
  Description of Artificial Sequence: Synthetic oligonucleotide
  Target: ATXN1; (+) strand; PAM type: NRG; PAM sequence: GAG
cagatactaagcccttgttt

SEQ ID NO: 138898 - DNA, 20 bp, Artificial Sequence
  Description of Artificial Sequence: Synthetic oligonucleotide
  Target: ATXN1; (+) strand; PAM type: NRG; PAM sequence: TGG
tactaagcccttgtttgaga

SEQ ID NO: 138899 - DNA, 20 bp, Artificial Sequence
  Description of Artificial Sequence: Synthetic oligonucleotide
  Target: ATXN1; (+) strand; PAM type: NRG; PAM sequence: GAG
ctaagcccttgtttgagatg

SEQ ID NO: 138900 - DNA, 20 bp, Artificial Sequence
  Description of Artificial Sequence: Synthetic oligonucleotide
  Target: ATXN1; (+) strand; PAM type: NRG; PAM sequence: TGG
ccttgtttgagatggagctg

SEQ ID NO: 138901 - DNA, 20 bp, Artificial Sequence
  Description of Artificial Sequence: Synthetic oligonucleotide
  Target: ATXN1; (+) strand; PAM type: NRG; PAM sequence: TGG
tggagctgtggccctataaa

SEQ ID NO: 138902 - DNA, 20 bp, Artificial Sequence
  Description of Artificial Sequence: Synthetic oligonucleotide
  Target: ATXN1; (+) strand; PAM type: NRG; PAM sequence: TAG
ggccctataaatggctattt

SEQ ID NO: 138903 - DNA, 20 bp, Artificial Sequence
  Description of Artificial Sequence: Synthetic oligonucleotide
  Target: ATXN1; (+) strand; PAM type: NRG; PAM sequence: AAG
ctataaatggctattttaga

SEQ ID NO: 138904 - DNA, 20 bp, Artificial Sequence
  Description of Artificial Sequence: Synthetic oligonucleotide
  Target: ATXN1; (+) strand; PAM type: NRG; PAM sequence: TGG
tttagaaagacaatgtgaac

SEQ ID NO: 138905 - DNA, 20 bp, Artificial Sequence
  Description of Artificial Sequence: Synthetic oligonucleotide
  Target: ATXN1; (+) strand; PAM type: NRG; PAM sequence: CAG
agaaagacaatgtgaactgg

SEQ ID NO: 138906 - DNA, 20 bp, Artificial Sequence
  Description of Artificial Sequence: Synthetic oligonucleotide
  Target: ATXN1; (+) strand; PAM type: NRG; PAM sequence: CGG
acaatgtgaactggcagcaa

SEQ ID NO: 138907 - DNA, 20 bp, Artificial Sequence
  Description of Artificial Sequence: Synthetic oligonucleotide
  Target: ATXN1; (+) strand; PAM type: NRG; PAM sequence: TGG
tgaactggcagcaacggtac

SEQ ID NO: 138908 - DNA, 20 bp, Artificial Sequence
  Description of Artificial Sequence: Synthetic oligonucleotide
  Target: ATXN1; (+) strand; PAM type: NRG; PAM sequence: CAG
tggcagcaacggtactggaa

SEQ ID NO: 138909 - DNA, 20 bp, Artificial Sequence
  Description of Artificial Sequence: Synthetic oligonucleotide
  Target: ATXN1; (+) strand; PAM type: NRG; PAM sequence: AGG
ggcagcaacggtactggaac

SEQ ID NO: 138910 - DNA, 20 bp, Artificial Sequence
  Description of Artificial Sequence: Synthetic oligonucleotide
  Target: ATXN1; (+) strand; PAM type: NRG; PAM sequence: GAG
aacggtactggaacaggaat

SEQ ID NO: 138911 - DNA, 20 bp, Artificial Sequence
  Description of Artificial Sequence: Synthetic oligonucleotide
  Target: ATXN1; (+) strand; PAM type: NRG; PAM sequence: AGG
acggtactggaacaggaatg

SEQ ID NO: 138912 - DNA, 20 bp, Artificial Sequence
  Description of Artificial Sequence: Synthetic oligonucleotide
  Target: ATXN1; (+) strand; PAM type: NRG; PAM sequence: GAG
ggtactggaacaggaatgag

SEQ ID NO: 138913 - DNA, 20 bp, Artificial Sequence
  Description of Artificial Sequence: Synthetic oligonucleotide
  Target: ATXN1; (+) strand; PAM type: NRG; PAM sequence: TGG
ggagtccatatgtccacttc

SEQ ID NO: 138914 - DNA, 20 bp, Artificial Sequence
  Description of Artificial Sequence: Synthetic oligonucleotide
  Target: ATXN1; (+) strand; PAM type: NRG; PAM sequence: CAG
catatgtccacttctggttc

SEQ ID NO: 138915 - DNA, 20 bp, Artificial Sequence
  Description of Artificial Sequence: Synthetic oligonucleotide
  Target: ATXN1; (+) strand; PAM type: NRG; PAM sequence: TGG
ctggttccagtctgacttct

SEQ ID NO: 138916 - DNA, 20 bp, Artificial Sequence
  Description of Artificial Sequence: Synthetic oligonucleotide
  Target: ATXN1; (+) strand; PAM type: NRG; PAM sequence: AAG
tccagtctgacttcttggtc

SEQ ID NO: 138917 - DNA, 20 bp, Artificial Sequence
  Description of Artificial Sequence: Synthetic oligonucleotide
  Target: ATXN1; (+) strand; PAM type: NRG; PAM sequence: GAG
caagccatttttacttctct

SEQ ID NO: 138918 - DNA, 20 bp, Artificial Sequence
  Description of Artificial Sequence: Synthetic oligonucleotide
  Target: ATXN1; (+) strand; PAM type: NRG; PAM sequence: TAG
tctctttcctcctttaaata

SEQ ID NO: 138919 - DNA, 20 bp, Artificial Sequence
  Description of Artificial Sequence: Synthetic oligonucleotide
  Target: ATXN1; (+) strand; PAM type: NRG; PAM sequence: AAG
ctttcctcctttaaatatag

SEQ ID NO: 138920 - DNA, 20 bp, Artificial Sequence
  Description of Artificial Sequence: Synthetic oligonucleotide
  Target: ATXN1; (+) strand; PAM type: NRG; PAM sequence: TAG
ctcctttaaatatagaagtt

SEQ ID NO: 138921 - DNA, 20 bp, Artificial Sequence
  Description of Artificial Sequence: Synthetic oligonucleotide
  Target: ATXN1; (+) strand; PAM type: NRG; PAM sequence: GAG
tatagaagtttagatcacat

SEQ ID NO: 138922 - DNA, 20 bp, Artificial Sequence
  Description of Artificial Sequence: Synthetic oligonucleotide
  Target: ATXN1; (+) strand; PAM type: NRG; PAM sequence: GAG
gtttagatcacatgagctct

SEQ ID NO: 138923 - DNA, 20 bp, Artificial Sequence
  Description of Artificial Sequence: Synthetic oligonucleotide
  Target: ATXN1; (+) strand; PAM type: NRG; PAM sequence: CAG
atcacatgagctctgagttt

SEQ ID NO: 138924 - DNA, 20 bp, Artificial Sequence
  Description of Artificial Sequence: Synthetic oligonucleotide
  Target: ATXN1; (+) strand; PAM type: NRG; PAM sequence: AGG
tcacatgagctctgagtttc

SEQ ID NO: 138925 - DNA, 20 bp, Artificial Sequence
  Description of Artificial Sequence: Synthetic oligonucleotide
  Target: ATXN1; (+) strand; PAM type: NRG; PAM sequence: TAG
gctctgagtttcaggtgacc

SEQ ID NO: 138926 - DNA, 20 bp, Artificial Sequence
  Description of Artificial Sequence: Synthetic oligonucleotide
  Target: ATXN1; (+) strand; PAM type: NRG; PAM sequence: TGG
tcaggtgacctagaactgta

SEQ ID NO: 138927 - DNA, 20 bp, Artificial Sequence
  Description of Artificial Sequence: Synthetic oligonucleotide
  Target: ATXN1; (+) strand; PAM type: NRG; PAM sequence: CAG
tagaactgtatggttctatg

SEQ ID NO: 138928 - DNA, 20 bp, Artificial Sequence
  Description of Artificial Sequence: Synthetic oligonucleotide
  Target: ATXN1; (+) strand; PAM type: NRG; PAM sequence: AAG
caaactcaatgttaccttct

SEQ ID NO: 138929 - DNA, 20 bp, Artificial Sequence
  Description of Artificial Sequence: Synthetic oligonucleotide
  Target: ATXN1; (+) strand; PAM type: NRG; PAM sequence: GAG
aatgttaccttctaagatgt

SEQ ID NO: 138930 - DNA, 20 bp, Artificial Sequence
  Description of Artificial Sequence: Synthetic oligonucleotide
  Target: ATXN1; (+) strand; PAM type: NRG; PAM sequence: GAG
tgttaccttctaagatgtga

SEQ ID NO: 138931 - DNA, 20 bp, Artificial Sequence
  Description of Artificial Sequence: Synthetic oligonucleotide
  Target: ATXN1; (+) strand; PAM type: NRG; PAM sequence: TGG
accttctaagatgtgagaga

SEQ ID NO: 138932 - DNA, 20 bp, Artificial Sequence
  Description of Artificial Sequence: Synthetic oligonucleotide
  Target: ATXN1; (+) strand; PAM type: NRG; PAM sequence: CAG
ctaagatgtgagagatggca

SEQ ID NO: 138933 - DNA, 20 bp, Artificial Sequence
  Description of Artificial Sequence: Synthetic oligonucleotide
  Target: ATXN1; (+) strand; PAM type: NRG; PAM sequence: GAG
aagatgtgagagatggcaca

SEQ ID NO: 138934 - DNA, 20 bp, Artificial Sequence
  Description of Artificial Sequence: Synthetic oligonucleotide
  Target: ATXN1; (+) strand; PAM type: NRG; PAM sequence: AGG
agatgtgagagatggcacag

SEQ ID NO: 138935 - DNA, 20 bp, Artificial Sequence
  Description of Artificial Sequence: Synthetic oligonucleotide
  Target: ATXN1; (+) strand; PAM type: NRG; PAM sequence: TGG
gaggtgtgtctgtttttccc

SEQ ID NO: 138936 - DNA, 20 bp, Artificial Sequence
  Description of Artificial Sequence: Synthetic oligonucleotide
  Target: ATXN1; (+) strand; PAM type: NRG; PAM sequence: GAG
tgtttttccctggctacact

SEQ ID NO: 138937 - DNA, 20 bp, Artificial Sequence
  Description of Artificial Sequence: Synthetic oligonucleotide
  Target: ATXN1; (+) strand; PAM type: NRG; PAM sequence: TGG
ccctggctacactgagccac

SEQ ID NO: 138938 - DNA, 20 bp, Artificial Sequence
  Description of Artificial Sequence: Synthetic oligonucleotide
  Target: ATXN1; (+) strand; PAM type: NRG; PAM sequence: CAG
tggctacactgagccactgg

SEQ ID NO: 138939 - DNA, 20 bp, Artificial Sequence
  Description of Artificial Sequence: Synthetic oligonucleotide
  Target: ATXN1; (+) strand; PAM type: NRG; PAM sequence: TAG
ctacactgagccactggcag

SEQ ID NO: 138940 - DNA, 20 bp, Artificial Sequence
  Description of Artificial Sequence: Synthetic oligonucleotide
  Target: ATXN1; (+) strand; PAM type: NRG; PAM sequence: AGG
tacactgagccactggcagt

SEQ ID NO: 138941 - DNA, 20 bp, Artificial Sequence
  Description of Artificial Sequence: Synthetic oligonucleotide
  Target: ATXN1; (+) strand; PAM type: NRG; PAM sequence: AAG
tatcacccaacatcccatta

SEQ ID NO: 138942 - DNA, 20 bp, Artificial Sequence
  Description of Artificial Sequence: Synthetic oligonucleotide
  Target: ATXN1; (+) strand; PAM type: NRG; PAM sequence: CAG
acccaacatcccattaaaga

SEQ ID NO: 138943 - DNA, 20 bp, Artificial Sequence
  Description of Artificial Sequence: Synthetic oligonucleotide
  Target: ATXN1; (+) strand; PAM type: NRG; PAM sequence: AGG
cccaacatcccattaaagac

SEQ ID NO: 138944 - DNA, 20 bp, Artificial Sequence
  Description of Artificial Sequence: Synthetic oligonucleotide
  Target: ATXN1; (+) strand; PAM type: NRG; PAM sequence: GGG
ccaacatcccattaaagaca

SEQ ID NO: 138945 - DNA, 20 bp, Artificial Sequence
  Description of Artificial Sequence: Synthetic oligonucleotide
  Target: ATXN1; (+) strand; PAM type: NRG; PAM sequence: CGG
cccattaaagacagggtcct

SEQ ID NO: 138946 - DNA, 20 bp, Artificial Sequence
  Description of Artificial Sequence: Synthetic oligonucleotide
  Target: ATXN1; (+) strand; PAM type: NRG; PAM sequence: CAG
ttaaagacagggtcctcggc

SEQ ID NO: 138947 - DNA, 20 bp, Artificial Sequence
  Description of Artificial Sequence: Synthetic oligonucleotide
  Target: ATXN1; (+) strand; PAM type: NRG; PAM sequence: AGG
taaagacagggtcctcggcc

SEQ ID NO: 138948 - DNA, 20 bp, Artificial Sequence
  Description of Artificial Sequence: Synthetic oligonucleotide
  Target: ATXN1; (+) strand; PAM type: NRG; PAM sequence: CGG
acagggtcctcggccaggcg

SEQ ID NO: 138949 - DNA, 20 bp, Artificial Sequence
  Description of Artificial Sequence: Synthetic oligonucleotide
  Target: ATXN1; (+) strand; PAM type: NRG; PAM sequence: TGG
gggtcctcggccaggcgcgg

SEQ ID NO: 138950 - DNA, 20 bp, Artificial Sequence
  Description of Artificial Sequence: Synthetic oligonucleotide
  Target: ATXN1; (+) strand; PAM type: NRG; PAM sequence: CAG
gtggctcacacttgtaatcc

SEQ ID NO: 138951 - DNA, 20 bp, Artificial Sequence
  Description of Artificial Sequence: Synthetic oligonucleotide
  Target: ATXN1; (+) strand; PAM type: NRG; PAM sequence: TGG
cacttgtaatcccagcactt

SEQ ID NO: 138952 - DNA, 20 bp, Artificial Sequence
  Description of Artificial Sequence: Synthetic oligonucleotide
  Target: ATXN1; (+) strand; PAM type: NRG; PAM sequence: GGG
acttgtaatcccagcacttt

SEQ ID NO: 138953 - DNA, 20 bp, Artificial Sequence
  Description of Artificial Sequence: Synthetic oligonucleotide
  Target: ATXN1; (+) strand; PAM type: NRG; PAM sequence: GAG
ttgtaatcccagcactttgg

SEQ ID NO: 138954 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagcactttggg

SEQ ID NO: 138955 - DNA, 20 bp, Artificial Sequence
  Description of Artificial Sequence: Synthetic oligonucleotide
  Target: ATXN1; (+) strand; PAM type: NRG; PAM sequence: GAG
tcccagcactttgggaggcc

SEQ ID NO: 138956 - DNA, 20 bp, Artificial Sequence
  Description of Artificial Sequence: Synthetic oligonucleotide
  Target: ATXN1; (+) strand; PAM type: NRG; PAM sequence: AGG
cccagcactttgggaggccg

SEQ ID NO: 138957 - DNA, 20 bp, Artificial Sequence
  Description of Artificial Sequence: Synthetic oligonucleotide
  Target: ATXN1; (+) strand; PAM type: NRG; PAM sequence: TGG
agcactttgggaggccgagg

SEQ ID NO: 138958 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggccgaggt

SEQ ID NO: 138959 - DNA, 20 bp, Artificial Sequence
  Description of Artificial Sequence: Synthetic oligonucleotide
  Target: ATXN1; (+) strand; PAM type: NRG; PAM sequence: CGG
ctttgggaggccgaggtggg

SEQ ID NO: 138960 - DNA, 20 bp, Artificial Sequence
  Description of Artificial Sequence: Synthetic oligonucleotide
  Target: ATXN1; (+) strand; PAM type: NRG; PAM sequence: GGG
tttgggaggccgaggtgggc

SEQ ID NO: 138961 - DNA, 20 bp, Artificial Sequence
  Description of Artificial Sequence: Synthetic oligonucleotide
  Target: ATXN1; (+) strand; PAM type: NRG; PAM sequence: GAG
ggccgaggtgggcgggtcac

SEQ ID NO: 138962 - DNA, 20 bp, Artificial Sequence
  Description of Artificial Sequence: Synthetic oligonucleotide
  Target: ATXN1; (+) strand; PAM type: NRG; PAM sequence: AGG
gccgaggtgggcgggtcacg

SEQ ID NO: 138963 - DNA, 20 bp, Artificial Sequence
  Description of Artificial Sequence: Synthetic oligonucleotide
  Target: ATXN1; (+) strand; PAM type: NRG; PAM sequence: CAG
aggtgggcgggtcacgaggt

SEQ ID NO: 138964 - DNA, 20 bp, Artificial Sequence
  Description of Artificial Sequence: Synthetic oligonucleotide
  Target: ATXN1; (+) strand; PAM type: NRG; PAM sequence: AGG
ggtgggcgggtcacgaggtc

SEQ ID NO: 138965 - DNA, 20 bp, Artificial Sequence
  Description of Artificial Sequence: Synthetic oligonucleotide
  Target: ATXN1; (+) strand; PAM type: NRG; PAM sequence: GAG
tgggcgggtcacgaggtcag

SEQ ID NO: 138966 - DNA, 20 bp, Artificial Sequence
  Description of Artificial Sequence: Synthetic oligonucleotide
  Target: ATXN1; (+) strand; PAM type: NRG; PAM sequence: GAG
ggtcacgaggtcaggagttt

SEQ ID NO: 138967 - DNA, 20 bp, Artificial Sequence
  Description of Artificial Sequence: Synthetic oligonucleotide
  Target: ATXN1; (+) strand; PAM type: NRG; PAM sequence: TGG
tcaggagtttgagacctgcc

SEQ ID NO: 138968 - DNA, 20 bp, Artificial Sequence
  Description of Artificial Sequence: Synthetic oligonucleotide
  Target: ATXN1; (+) strand; PAM type: NRG; PAM sequence: TGG
tgagacctgcctggccaaca

SEQ ID NO: 138969 - DNA, 20 bp, Artificial Sequence
  Description of Artificial Sequence: Synthetic oligonucleotide
  Target: ATXN1; (+) strand; PAM type: NRG; PAM sequence: TAG
tctactaaaaatacaaacat

SEQ ID NO: 138970 - DNA, 20 bp, Artificial Sequence
  Description of Artificial Sequence: Synthetic oligonucleotide
  Target: ATXN1; (+) strand; PAM type: NRG; PAM sequence: CGG
ctaaaaatacaaacattagc

SEQ ID NO: 138971 - DNA, 20 bp, Artificial Sequence
  Description of Artificial Sequence: Synthetic oligonucleotide
  Target: ATXN1; (+) strand; PAM type: NRG; PAM sequence: GGG
taaaaatacaaacattagcc

SEQ ID NO: 138972 - DNA, 20 bp, Artificial Sequence
  Description of Artificial Sequence: Synthetic oligonucleotide
  Target: ATXN1; (+) strand; PAM type: NRG; PAM sequence: TGG
atacaaacattagccgggtg

SEQ ID NO: 138973 - DNA, 20 bp, Artificial Sequence
  Description of Artificial Sequence: Synthetic oligonucleotide
  Target: ATXN1; (+) strand; PAM type: NRG; PAM sequence: TGG
caaacattagccgggtgtgg

SEQ ID NO: 138974 - DNA, 20 bp, Artificial Sequence
  Description of Artificial Sequence: Synthetic oligonucleotide
  Target: ATXN1; (+) strand; PAM type: NRG; PAM sequence: TAG
gtggctcacgcctgtcatac

SEQ ID NO: 138975 - DNA, 20 bp, Artificial Sequence
  Description of Artificial Sequence: Synthetic oligonucleotide
  Target: ATXN1; (+) strand; PAM type: NRG; PAM sequence: CGG
cgcctgtcatactagctact

SEQ ID NO: 138976 - DNA, 20 bp, Artificial Sequence
  Description of Artificial Sequence: Synthetic oligonucleotide
  Target: ATXN1; (+) strand; PAM type: NRG; PAM sequence: GGG
gcctgtcatactagctactc

SEQ ID NO: 138977 - DNA, 20 bp, Artificial Sequence
  Description of Artificial Sequence: Synthetic oligonucleotide
  Target: ATXN1; (+) strand; PAM type: NRG; PAM sequence: GAG
ctgtcatactagctactcgg

SEQ ID NO: 138978 - DNA, 20 bp, Artificial Sequence
  Description of Artificial Sequence: Synthetic oligonucleotide
  Target: ATXN1; (+) strand; PAM type: NRG; PAM sequence: AGG
tgtcatactagctactcggg

SEQ ID NO: 138979 - DNA, 20 bp, Artificial Sequence
  Description of Artificial Sequence: Synthetic oligonucleotide
  Target: ATXN1; (+) strand; PAM type: NRG; PAM sequence: GAG
tactagctactcgggaggct

SEQ ID NO: 138980 - DNA, 20 bp, Artificial Sequence
  Description of Artificial Sequence: Synthetic oligonucleotide
  Target: ATXN1; (+) strand; PAM type: NRG; PAM sequence: AGG
actagctactcgggaggctg

SEQ ID NO: 138981 - DNA, 20 bp, Artificial Sequence
  Description of Artificial Sequence: Synthetic oligonucleotide
  Target: ATXN1; (+) strand; PAM type: NRG; PAM sequence: CAG
agctactcgggaggctgagg

SEQ ID NO: 138982 - DNA, 20 bp, Artificial Sequence
  Description of Artificial Sequence: Synthetic oligonucleotide
  Target: ATXN1; (+) strand; PAM type: NRG; PAM sequence: AGG
gctactcgggaggctgaggc

SEQ ID NO: 138983 - DNA, 20 bp, Artificial Sequence
  Description of Artificial Sequence: Synthetic oligonucleotide
  Target: ATXN1; (+) strand; PAM type: NRG; PAM sequence: GAG
tactcgggaggctgaggcag

SEQ ID NO: 138984 - DNA, 20 bp, Artificial Sequence
  Description of Artificial Sequence: Synthetic oligonucleotide
  Target: ATXN1; (+) strand; PAM type: NRG; PAM sequence: TGG
gcaggagaatcgcttgaacc

SEQ ID NO: 138985 - DNA, 20 bp, Artificial Sequence
  Description of Artificial Sequence: Synthetic oligonucleotide
  Target: ATXN1; (+) strand; PAM type: NRG; PAM sequence: GGG
caggagaatcgcttgaacct

SEQ ID NO: 138986 - DNA, 20 bp, Artificial Sequence
  Description of Artificial Sequence: Synthetic oligonucleotide
  Target: ATXN1; (+) strand; PAM type: NRG; PAM sequence: GAG
ggagaatcgcttgaacctgg

SEQ ID NO: 138987 - DNA, 20 bp, Artificial Sequence
  Description of Artificial Sequence: Synthetic oligonucleotide
  Target: ATXN1; (+) strand; PAM type: NRG; PAM sequence: AGG
gagaatcgcttgaacctggg

SEQ ID NO: 138988 - DNA, 20 bp, Artificial Sequence
  Description of Artificial Sequence: Synthetic oligonucleotide
  Target: ATXN1; (+) strand; PAM type: NRG; PAM sequence: CAG
aatcgcttgaacctgggagg

SEQ ID NO: 138989 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaacctgggaggca

SEQ ID NO: 138990 - DNA, 20 bp, Artificial Sequence
  Description of Artificial Sequence: Synthetic oligonucleotide
  Target: ATXN1; (+) strand; PAM type: NRG; PAM sequence: AGG
cgcttgaacctgggaggcag

SEQ ID NO: 138991 - DNA, 20 bp, Artificial Sequence
  Description of Artificial Sequence: Synthetic oligonucleotide
  Target: ATXN1; (+) strand; PAM type: NRG; PAM sequence: CAG
aacctgggaggcagaggctg

SEQ ID NO: 138992 - DNA, 20 bp, Artificial Sequence
  Description of Artificial Sequence: Synthetic oligonucleotide
  Target: ATXN1; (+) strand; PAM type: NRG; PAM sequence: GAG
tgggaggcagaggctgcagt

SEQ ID NO: 138993 - DNA, 20 bp, Artificial Sequence
  Description of Artificial Sequence: Synthetic oligonucleotide
  Target: ATXN1; (+) strand; PAM type: NRG; PAM sequence: GAG
ggcagaggctgcagtgagct

SEQ ID NO: 138994 - DNA, 20 bp, Artificial Sequence
  Description of Artificial Sequence: Synthetic oligonucleotide
  Target: ATXN1; (+) strand; PAM type: NRG; PAM sequence: CAG
gagatcatgccactgcactc

SEQ ID NO: 138995 - DNA, 20 bp, Artificial Sequence
  Description of Artificial Sequence: Synthetic oligonucleotide
  Target: ATXN1; (+) strand; PAM type: NRG; PAM sequence: TGG
catgccactgcactccagcc

SEQ ID NO: 138996 - DNA, 20 bp, Artificial Sequence
  Description of Artificial Sequence: Synthetic oligonucleotide
  Target: ATXN1; (+) strand; PAM type: NRG; PAM sequence: GGG
atgccactgcactccagcct

SEQ ID NO: 138997 - DNA, 20 bp, Artificial Sequence
  Description of Artificial Sequence: Synthetic oligonucleotide
  Target: ATXN1; (+) strand; PAM type: NRG; PAM sequence: TGG
ccactgcactccagcctggg

SEQ ID NO: 138998 - DNA, 20 bp, Artificial Sequence
  Description of Artificial Sequence: Synthetic oligonucleotide
  Target: ATXN1; (+) strand; PAM type: NRG; PAM sequence: CAG
ctgcactccagcctgggtgg

SEQ ID NO: 138999 - DNA, 20 bp, Artificial Sequence
  Description of Artificial Sequence: Synthetic oligonucleotide
  Target: ATXN1; (+) strand; PAM type: NRG; PAM sequence: GAG
gcactccagcctgggtggca

SEQ ID NO: 139000 - DNA, 20 bp, Artificial Sequence
  Description of Artificial Sequence: Synthetic oligonucleotide
  Target: ATXN1; (+) strand; PAM type: NRG; PAM sequence: AAG
tccagcctgggtggcagagc

SEQ ID NO: 139001 - DNA, 20 bp, Artificial Sequence
  Description of Artificial Sequence: Synthetic oligonucleotide
  Target: ATXN1; (+) strand; PAM type: NRG; PAM sequence: AAG
cagagcaagactccatctca

SEQ ID NO: 139002 - DNA, 20 bp, Artificial Sequence
  Description of Artificial Sequence: Synthetic oligonucleotide
  Target: ATXN1; (+) strand; PAM type: NRG; PAM sequence: CAG
caaacaaacaaacaaaaaaa

SEQ ID NO: 139003 - DNA, 20 bp, Artificial Sequence
  Description of Artificial Sequence: Synthetic oligonucleotide
  Target: ATXN1; (+) strand; PAM type: NRG; PAM sequence: AGG
aaacaaacaaacaaaaaaac

SEQ ID NO: 139004 - DNA, 20 bp, Artificial Sequence
  Description of Artificial Sequence: Synthetic oligonucleotide
  Target: ATXN1; (+) strand; PAM type: NRG; PAM sequence: CAG
aaaaaaacaggatcctctct

SEQ ID NO: 139005 - DNA, 20 bp, Artificial Sequence
  Description of Artificial Sequence: Synthetic oligonucleotide
  Target: ATXN1; (+) strand; PAM type: NRG; PAM sequence: AAG
aaacaggatcctctctcagc

SEQ ID NO: 139006 - DNA, 20 bp, Artificial Sequence
  Description of Artificial Sequence: Synthetic oligonucleotide
  Target: ATXN1; (+) strand; PAM type: NRG; PAM sequence: AAG
cagcaagtctcctatcacaa

SEQ ID NO: 139007 - DNA, 20 bp, Artificial Sequence
  Description of Artificial Sequence: Synthetic oligonucleotide
  Target: ATXN1; (+) strand; PAM type: NRG; PAM sequence: AGG
agcaagtctcctatcacaaa

SEQ ID NO: 139008 - DNA, 20 bp, Artificial Sequence
  Description of Artificial Sequence: Synthetic oligonucleotide
  Target: ATXN1; (+) strand; PAM type: NRG; PAM sequence: CAG
aaggaatacacatcacaacg

SEQ ID NO: 139009 - DNA, 20 bp, Artificial Sequence
  Description of Artificial Sequence: Synthetic oligonucleotide
  Target: ATXN1; (+) strand; PAM type: NRG; PAM sequence: TGG
acatcacaacgcagccctgc

SEQ ID NO: 139010 - DNA, 20 bp, Artificial Sequence
  Description of Artificial Sequence: Synthetic oligonucleotide
  Target: ATXN1; (+) strand; PAM type: NRG; PAM sequence: CAG
gcagccctgctggaccaccc

SEQ ID NO: 139011 - DNA, 20 bp, Artificial Sequence
  Description of Artificial Sequence: Synthetic oligonucleotide
  Target: ATXN1; (+) strand; PAM type: NRG; PAM sequence: AAG
tgctggaccaccccagctct

SEQ ID NO: 139012 - DNA, 20 bp, Artificial Sequence
  Description of Artificial Sequence: Synthetic oligonucleotide
  Target: ATXN1; (+) strand; PAM type: NRG; PAM sequence: AGG
gctggaccaccccagctcta

SEQ ID NO: 139013 - DNA, 20 bp, Artificial Sequence
  Description of Artificial Sequence: Synthetic oligonucleotide
  Target: ATXN1; (+) strand; PAM type: NRG; PAM sequence: GGG
ctggaccaccccagctctaa

SEQ ID NO: 139014 - DNA, 20 bp, Artificial Sequence
  Description of Artificial Sequence: Synthetic oligonucleotide
  Target: ATXN1; (+) strand; PAM type: NRG; PAM sequence: GGG
tggaccaccccagctctaag

SEQ ID NO: 139015 - DNA, 20 bp, Artificial Sequence
  Description of Artificial Sequence: Synthetic oligonucleotide
  Target: ATXN1; (+) strand; PAM type: NRG; PAM sequence: GGG
ggaccaccccagctctaagg

SEQ ID NO: 139016 - DNA, 20 bp, Artificial Sequence
  Description of Artificial Sequence: Synthetic oligonucleotide
  Target: ATXN1; (+) strand; PAM type: NRG; PAM sequence: GAG
accaccccagctctaagggg

SEQ ID NO: 139017 - DNA, 20 bp, Artificial Sequence
  Description of Artificial Sequence: Synthetic oligonucleotide
  Target: ATXN1; (+) strand; PAM type: NRG; PAM sequence: AGG
ccaccccagctctaaggggg

SEQ ID NO: 139018 - DNA, 20 bp, Artificial Sequence
  Description of Artificial Sequence: Synthetic oligonucleotide
  Target: ATXN1; (+) strand; PAM type: NRG; PAM sequence: GAG
taagggggaggtcaacttgt

SEQ ID NO: 139019 - DNA, 20 bp, Artificial Sequence
  Description of Artificial Sequence: Synthetic oligonucleotide
  Target: ATXN1; (+) strand; PAM type: NRG; PAM sequence: AAG
gaggtcaacttgtgagcaat

SEQ ID NO: 139020 - DNA, 20 bp, Artificial Sequence
  Description of Artificial Sequence: Synthetic oligonucleotide
  Target: ATXN1; (+) strand; PAM type: NRG; PAM sequence: AAG
aacttgtgagcaataagtcg

SEQ ID NO: 139021 - DNA, 20 bp, Artificial Sequence
  Description of Artificial Sequence: Synthetic oligonucleotide
  Target: ATXN1; (+) strand; PAM type: NRG; PAM sequence: AAG
caataagtcgaagcaacatg

SEQ ID NO: 139022 - DNA, 20 bp, Artificial Sequence
  Description of Artificial Sequence: Synthetic oligonucleotide
  Target: ATXN1; (+) strand; PAM type: NRG; PAM sequence: AAG
taagtcgaagcaacatgaag

SEQ ID NO: 139023 - DNA, 20 bp, Artificial Sequence
  Description of Artificial Sequence: Synthetic oligonucleotide
  Target: ATXN1; (+) strand; PAM type: NRG; PAM sequence: AAG
aagcaacatgaagaagaaac

SEQ ID NO: 139024 - DNA, 20 bp, Artificial Sequence
  Description of Artificial Sequence: Synthetic oligonucleotide
  Target: ATXN1; (+) strand; PAM type: NRG; PAM sequence: AGG
agcaacatgaagaagaaaca

SEQ ID NO: 139025 - DNA, 20 bp, Artificial Sequence
  Description of Artificial Sequence: Synthetic oligonucleotide
  Target: ATXN1; (+) strand; PAM type: NRG; PAM sequence: AAG
catgaagaagaaacaaggac

SEQ ID NO: 139026 - DNA, 20 bp, Artificial Sequence
  Description of Artificial Sequence: Synthetic oligonucleotide
  Target: ATXN1; (+) strand; PAM type: NRG; PAM sequence: AGG
atgaagaagaaacaaggaca

SEQ ID NO: 139027 - DNA, 20 bp, Artificial Sequence
  Description of Artificial Sequence: Synthetic oligonucleotide
  Target: ATXN1; (+) strand; PAM type: NRG; PAM sequence: AAG
gaagaaacaaggacaaggtg

SEQ ID NO: 139028 - DNA, 20 bp, Artificial Sequence
  Description of Artificial Sequence: Synthetic oligonucleotide
  Target: ATXN1; (+) strand; PAM type: NRG; PAM sequence: TGG
aacaaggacaaggtgaagaa

SEQ ID NO: 139029 - DNA, 20 bp, Artificial Sequence
  Description of Artificial Sequence: Synthetic oligonucleotide
  Target: ATXN1; (+) strand; PAM type: NRG; PAM sequence: CAG
taattttcatctattccaac

SEQ ID NO: 139030 - DNA, 20 bp, Artificial Sequence
  Description of Artificial Sequence: Synthetic oligonucleotide
  Target: ATXN1; (+) strand; PAM type: NRG; PAM sequence: AAG
ttcatctattccaaccagaa

SEQ ID NO: 139031 - DNA, 20 bp, Artificial Sequence
  Description of Artificial Sequence: Synthetic oligonucleotide
  Target: ATXN1; (+) strand; PAM type: NRG; PAM sequence: GAG
catctattccaaccagaaaa

SEQ ID NO: 139032 - DNA, 20 bp, Artificial Sequence
  Description of Artificial Sequence: Synthetic oligonucleotide
  Target: ATXN1; (+) strand; PAM type: NRG; PAM sequence: AAG
agagctgctcattctgatca

SEQ ID NO: 139033 - DNA, 20 bp, Artificial Sequence
  Description of Artificial Sequence: Synthetic oligonucleotide
  Target: ATXN1; (+) strand; PAM type: NRG; PAM sequence: GAG
ttctgatcaaagatgttaat

SEQ ID NO: 139034 - DNA, 20 bp, Artificial Sequence
  Description of Artificial Sequence: Synthetic oligonucleotide
  Target: ATXN1; (+) strand; PAM type: NRG; PAM sequence: CAG
atgttaatgagccctgcaaa

SEQ ID NO: 139035 - DNA, 20 bp, Artificial Sequence
  Description of Artificial Sequence: Synthetic oligonucleotide
  Target: ATXN1; (+) strand; PAM type: NRG; PAM sequence: TAG
gcaaacagaaattactacaa

SEQ ID NO: 139036 - DNA, 20 bp, Artificial Sequence
  Description of Artificial Sequence: Synthetic oligonucleotide
  Target: ATXN1; (+) strand; PAM type: NRG; PAM sequence: CAG
cagaaattactacaatagaa

SEQ ID NO: 139037 - DNA, 20 bp, Artificial Sequence
  Description of Artificial Sequence: Synthetic oligonucleotide
  Target: ATXN1; (+) strand; PAM type: NRG; PAM sequence: TAG
aaattactacaatagaacag

SEQ ID NO: 139038 - DNA, 20 bp, Artificial Sequence
  Description of Artificial Sequence: Synthetic oligonucleotide
  Target: ATXN1; (+) strand; PAM type: NRG; PAM sequence: TAG
attattttctcctgcaatat

SEQ ID NO: 139039 - DNA, 20 bp, Artificial Sequence
  Description of Artificial Sequence: Synthetic oligonucleotide
  Target: ATXN1; (+) strand; PAM type: NRG; PAM sequence: TAG
gcaatattagcactaatgat

SEQ ID NO: 139040 - DNA, 20 bp, Artificial Sequence
  Description of Artificial Sequence: Synthetic oligonucleotide
  Target: ATXN1; (+) strand; PAM type: NRG; PAM sequence: TAG
aatgattagaaaatcttcaa

SEQ ID NO: 139041 - DNA, 20 bp, Artificial Sequence
  Description of Artificial Sequence: Synthetic oligonucleotide
  Target: ATXN1; (+) strand; PAM type: NRG; PAM sequence: CAG
gattagaaaatcttcaatag

SEQ ID NO: 139042 - DNA, 20 bp, Artificial Sequence
  Description of Artificial Sequence: Synthetic oligonucleotide
  Target: ATXN1; (+) strand; PAM type: NRG; PAM sequence: CAG
gcagcacaaataaaaataaa

SEQ ID NO: 139043 - DNA, 20 bp, Artificial Sequence
  Description of Artificial Sequence: Synthetic oligonucleotide
  Target: ATXN1; (+) strand; PAM type: NRG; PAM sequence: TGG
aataaacagacaccaatcct

SEQ ID NO: 139044 - DNA, 20 bp, Artificial Sequence
  Description of Artificial Sequence: Synthetic oligonucleotide
  Target: ATXN1; (+) strand; PAM type: NRG; PAM sequence: CAG
acagacaccaatccttggta

SEQ ID NO: 139045 - DNA, 20 bp, Artificial Sequence
  Description of Artificial Sequence: Synthetic oligonucleotide
  Target: ATXN1; (+) strand; PAM type: NRG; PAM sequence: CAG
tccttggtacagcctccgta

SEQ ID NO: 139046 - DNA, 20 bp, Artificial Sequence
  Description of Artificial Sequence: Synthetic oligonucleotide
  Target: ATXN1; (+) strand; PAM type: NRG; PAM sequence: TGG
gcctccgtacagatccatac

SEQ ID NO: 139047 - DNA, 20 bp, Artificial Sequence
  Description of Artificial Sequence: Synthetic oligonucleotide
  Target: ATXN1; (+) strand; PAM type: NRG; PAM sequence: CAG
tccatactggactgttcatt

SEQ ID NO: 139048 - DNA, 20 bp, Artificial Sequence
  Description of Artificial Sequence: Synthetic oligonucleotide
  Target: ATXN1; (+) strand; PAM type: NRG; PAM sequence: CAG
tggactgttcattcagcacc

SEQ ID NO: 139049 - DNA, 20 bp, Artificial Sequence
  Description of Artificial Sequence: Synthetic oligonucleotide
  Target: ATXN1; (+) strand; PAM type: NRG; PAM sequence: TGG
tcattcagcacccagtattc

SEQ ID NO: 139050 - DNA, 20 bp, Artificial Sequence
  Description of Artificial Sequence: Synthetic oligonucleotide
  Target: ATXN1; (+) strand; PAM type: NRG; PAM sequence: CAG
ctggaatttgcctattaatg

SEQ ID NO: 139051 - DNA, 20 bp, Artificial Sequence
  Description of Artificial Sequence: Synthetic oligonucleotide
  Target: ATXN1; (+) strand; PAM type: NRG; PAM sequence: AGG
tggaatttgcctattaatgc

SEQ ID NO: 139052 - DNA, 20 bp, Artificial Sequence
  Description of Artificial Sequence: Synthetic oligonucleotide
  Target: ATXN1; (+) strand; PAM type: NRG; PAM sequence: TGG
aatttgcctattaatgcagg

SEQ ID NO: 139053 - DNA, 20 bp, Artificial Sequence
  Description of Artificial Sequence: Synthetic oligonucleotide
  Target: ATXN1; (+) strand; PAM type: NRG; PAM sequence: AAG
ttgcctattaatgcaggtgg

SEQ ID NO: 139054 - DNA, 20 bp, Artificial Sequence
  Description of Artificial Sequence: Synthetic oligonucleotide
  Target: ATXN1; (+) strand; PAM type: NRG; PAM sequence: CAG
cctattaatgcaggtggaag

SEQ ID NO: 139055 - DNA, 20 bp, Artificial Sequence
  Description of Artificial Sequence: Synthetic oligonucleotide
  Target: ATXN1; (+) strand; PAM type: NRG; PAM sequence: TGG
ccaaattcaatgtgaatttt

SEQ ID NO: 139056 - DNA, 20 bp, Artificial Sequence
  Description of Artificial Sequence: Synthetic oligonucleotide
  Target: ATXN1; (+) strand; PAM type: NRG; PAM sequence: TGG
gaatttttggttttgatttt

SEQ ID NO: 139057 - DNA, 20 bp, Artificial Sequence
  Description of Artificial Sequence: Synthetic oligonucleotide
  Target: ATXN1; (+) strand; PAM type: NRG; PAM sequence: AAG
ttgttttgttttgtttcccc

SEQ ID NO: 139058 - DNA, 20 bp, Artificial Sequence
  Description of Artificial Sequence: Synthetic oligonucleotide
  Target: ATXN1; (+) strand; PAM type: NRG; PAM sequence: AGG
tgttttgttttgtttcccca

SEQ ID NO: 139059 - DNA, 20 bp, Artificial Sequence
  Description of Artificial Sequence: Synthetic oligonucleotide
  Target: ATXN1; (+) strand; PAM type: NRG; PAM sequence: CAG
tgttttgtttccccaaggcc

SEQ ID NO: 139060 - DNA, 20 bp, Artificial Sequence
  Description of Artificial Sequence: Synthetic oligonucleotide
  Target: ATXN1; (+) strand; PAM type: NRG; PAM sequence: TGG
gtgcccgtccctaaaatcca

SEQ ID NO: 139061 - DNA, 20 bp, Artificial Sequence
  Description of Artificial Sequence: Synthetic oligonucleotide
  Target: ATXN1; (+) strand; PAM type: NRG; PAM sequence: GGG
tgcccgtccctaaaatccat

SEQ ID NO: 139062 - DNA, 20 bp, Artificial Sequence
  Description of Artificial Sequence: Synthetic oligonucleotide
  Target: ATXN1; (+) strand; PAM type: NRG; PAM sequence: TAG
tcatcaaaatccccgtttct

SEQ ID NO: 139063 - DNA, 20 bp, Artificial Sequence
  Description of Artificial Sequence: Synthetic oligonucleotide
  Target: ATXN1; (+) strand; PAM type: NRG; PAM sequence: AAG
tcaaaatccccgtttcttag

SEQ ID NO: 139064 - DNA, 20 bp, Artificial Sequence
  Description of Artificial Sequence: Synthetic oligonucleotide
  Target: ATXN1; (+) strand; PAM type: NRG; PAM sequence: TAG
cgtttcttagaagctccctc

SEQ ID NO: 139065 - DNA, 20 bp, Artificial Sequence
  Description of Artificial Sequence: Synthetic oligonucleotide
  Target: ATXN1; (+) strand; PAM type: NRG; PAM sequence: GAG
tcttagaagctccctctagt

SEQ ID NO: 139066 - DNA, 20 bp, Artificial Sequence
  Description of Artificial Sequence: Synthetic oligonucleotide
  Target: ATXN1; (+) strand; PAM type: NRG; PAM sequence: TGG
ctctagtgagttacttttac

SEQ ID NO: 139067 - DNA, 20 bp, Artificial Sequence
  Description of Artificial Sequence: Synthetic oligonucleotide
  Target: ATXN1; (+) strand; PAM type: NRG; PAM sequence: AAG
agttacttttactggcaata

SEQ ID NO: 139068 - DNA, 20 bp, Artificial Sequence
  Description of Artificial Sequence: Synthetic oligonucleotide
  Target: ATXN1; (+) strand; PAM type: NRG; PAM sequence: TAG
tggcaataaagaatactaat

SEQ ID NO: 139069 - DNA, 20 bp, Artificial Sequence
  Description of Artificial Sequence: Synthetic oligonucleotide
  Target: ATXN1; (+) strand; PAM type: NRG; PAM sequence: TAG
tcacacacaaacaaatgcat

SEQ ID NO: 139070 - DNA, 20 bp, Artificial Sequence
  Description of Artificial Sequence: Synthetic oligonucleotide
  Target: ATXN1; (+) strand; PAM type: NRG; PAM sequence: AGG
cacacacaaacaaatgcatt

SEQ ID NO: 139071 - DNA, 20 bp, Artificial Sequence
  Description of Artificial Sequence: Synthetic oligonucleotide
  Target: ATXN1; (+) strand; PAM type: NRG; PAM sequence: TAG
cacaaacaaatgcattagga

SEQ ID NO: 139072 - DNA, 20 bp, Artificial Sequence
  Description of Artificial Sequence: Synthetic oligonucleotide
  Target: ATXN1; (+) strand; PAM type: NRG; PAM sequence: AAG
tttaaaataacctatttctt

SEQ ID NO: 139073 - DNA, 20 bp, Artificial Sequence
  Description of Artificial Sequence: Synthetic oligonucleotide
  Target: ATXN1; (+) strand; PAM type: NRG; PAM sequence: TAG
tatttcttaagcttttattt

SEQ ID NO: 139074 - DNA, 20 bp, Artificial Sequence
  Description of Artificial Sequence: Synthetic oligonucleotide
  Target: ATXN1; (+) strand; PAM type: NRG; PAM sequence: AGG
atttcttaagcttttatttt

SEQ ID NO: 139075 - DNA, 20 bp, Artificial Sequence
  Description of Artificial Sequence: Synthetic oligonucleotide
  Target: ATXN1; (+) strand; PAM type: NRG; PAM sequence: CAG
ttaagcttttattttaggtt

SEQ ID NO: 139076 - DNA, 20 bp, Artificial Sequence
  Description of Artificial Sequence: Synthetic oligonucleotide
  Target: ATXN1; (+) strand; PAM type: NRG; PAM sequence: AGG
taagcttttattttaggttc

SEQ ID NO: 139077 - DNA, 20 bp, Artificial Sequence
  Description of Artificial Sequence: Synthetic oligonucleotide
  Target: ATXN1; (+) strand; PAM type: NRG; PAM sequence: GGG
aagcttttattttaggttca

SEQ ID NO: 139078 - DNA, 20 bp, Artificial Sequence
  Description of Artificial Sequence: Synthetic oligonucleotide
  Target: ATXN1; (+) strand; PAM type: NRG; PAM sequence: GGG
agcttttattttaggttcag

SEQ ID NO: 139079 - DNA, 20 bp, Artificial Sequence
  Description of Artificial Sequence: Synthetic oligonucleotide
  Target: ATXN1; (+) strand; PAM type: NRG; PAM sequence: CAG
taggttcaggggtacatgtg

SEQ ID NO: 139080 - DNA, 20 bp, Artificial Sequence
  Description of Artificial Sequence: Synthetic oligonucleotide
  Target: ATXN1; (+) strand; PAM type: NRG; PAM sequence: AGG
aggttcaggggtacatgtgc

SEQ ID NO: 139081 - DNA, 20 bp, Artificial Sequence
  Description of Artificial Sequence: Synthetic oligonucleotide
  Target: ATXN1; (+) strand; PAM type: NRG; PAM sequence: TAG
acatgtgcaggtttattaaa

SEQ ID NO: 139082 - DNA, 20 bp, Artificial Sequence
  Description of Artificial Sequence: Synthetic oligonucleotide
  Target: ATXN1; (+) strand; PAM type: NRG; PAM sequence: TGG
aaatagataaactcatgcca

SEQ ID NO: 139083 - DNA, 20 bp, Artificial Sequence
  Description of Artificial Sequence: Synthetic oligonucleotide
  Target: ATXN1; (+) strand; PAM type: NRG; PAM sequence: GGG
aatagataaactcatgccat

SEQ ID NO: 139084 - DNA, 20 bp, Artificial Sequence
  Description of Artificial Sequence: Synthetic oligonucleotide
  Target: ATXN1; (+) strand; PAM type: NRG; PAM sequence: GGG
atagataaactcatgccatg

SEQ ID NO: 139085 - DNA, 20 bp, Artificial Sequence
  Description of Artificial Sequence: Synthetic oligonucleotide
  Target: ATXN1; (+) strand; PAM type: NRG; PAM sequence: GGG
tagataaactcatgccatgg

SEQ ID NO: 139086 - DNA, 20 bp, Artificial Sequence
  Description of Artificial Sequence: Synthetic oligonucleotide
  Target: ATXN1; (+) strand; PAM type: NRG; PAM sequence: CAG
tgccatgggggtttgttgta

SEQ ID NO: 139087 - DNA, 20 bp, Artificial Sequence
  Description of Artificial Sequence: Synthetic oligonucleotide
  Target: ATXN1; (+) strand; PAM type: NRG; PAM sequence: TGG
atgggggtttgttgtacaga

SEQ ID NO: 139088 - DNA, 20 bp, Artificial Sequence
  Description of Artificial Sequence: Synthetic oligonucleotide
  Target: ATXN1; (+) strand; PAM type: NRG; PAM sequence: CAG
gtacagatggtttcgtcacc

SEQ ID NO: 139089 - DNA, 20 bp, Artificial Sequence
  Description of Artificial Sequence: Synthetic oligonucleotide
  Target: ATXN1; (+) strand; PAM type: NRG; PAM sequence: AAG
ggtttcgtcacccagatact

SEQ ID NO: 139090 - DNA, 20 bp, Artificial Sequence
  Description of Artificial Sequence: Synthetic oligonucleotide
  Target: ATXN1; (+) strand; PAM type: NRG; PAM sequence: TAG
cgtcacccagatactaagcc

SEQ ID NO: 139091 - DNA, 20 bp, Artificial Sequence
  Description of Artificial Sequence: Synthetic oligonucleotide
  Target: ATXN1; (+) strand; PAM type: NRG; PAM sequence: AAG
ctcctccaccctctaccctc

SEQ ID NO: 139092 - DNA, 20 bp, Artificial Sequence
  Description of Artificial Sequence: Synthetic oligonucleotide
  Target: ATXN1; (+) strand; PAM type: NRG; PAM sequence: TAG
ctccaccctctaccctcaag

SEQ ID NO: 139093 - DNA, 20 bp, Artificial Sequence
  Description of Artificial Sequence: Synthetic oligonucleotide
  Target: ATXN1; (+) strand; PAM type: NRG; PAM sequence: AGG
tccaccctctaccctcaagt

SEQ ID NO: 139094 - DNA, 20 bp, Artificial Sequence
  Description of Artificial Sequence: Synthetic oligonucleotide
  Target: ATXN1; (+) strand; PAM type: NRG; PAM sequence: CAG
ctctaccctcaagtaggacc

SEQ ID NO: 139095 - DNA, 20 bp, Artificial Sequence
  Description of Artificial Sequence: Synthetic oligonucleotide
  Target: ATXN1; (+) strand; PAM type: NRG; PAM sequence: GAG
gttcccttctttgtgtccat

SEQ ID NO: 139096 - DNA, 20 bp, Artificial Sequence
  Description of Artificial Sequence: Synthetic oligonucleotide
  Target: ATXN1; (+) strand; PAM type: NRG; PAM sequence: TAG
gtccatgagttctcatcatt

SEQ ID NO: 139097 - DNA, 20 bp, Artificial Sequence
  Description of Artificial Sequence: Synthetic oligonucleotide
  Target: ATXN1; (+) strand; PAM type: NRG; PAM sequence: AAG
atcatttagctcccacttgt

SEQ ID NO: 139098 - DNA, 20 bp, Artificial Sequence
  Description of Artificial Sequence: Synthetic oligonucleotide
  Target: ATXN1; (+) strand; PAM type: NRG; PAM sequence: GAG
tttagctcccacttgtaagt

SEQ ID NO: 139099 - DNA, 20 bp, Artificial Sequence
  Description of Artificial Sequence: Synthetic oligonucleotide
  Target: ATXN1; (+) strand; PAM type: NRG; PAM sequence: CAG
cacttgtaagtgagaacatg

SEQ ID NO: 139100 - DNA, 20 bp, Artificial Sequence
  Description of Artificial Sequence: Synthetic oligonucleotide
  Target: ATXN1; (+) strand; PAM type: NRG; PAM sequence: TAG
aagtgagaacatgcagtatt

SEQ ID NO: 139101 - DNA, 20 bp, Artificial Sequence
  Description of Artificial Sequence: Synthetic oligonucleotide
  Target: ATXN1; (+) strand; PAM type: NRG; PAM sequence: TAG
ttagttttttgttcctgtga

SEQ ID NO: 139102 - DNA, 20 bp, Artificial Sequence
  Description of Artificial Sequence: Synthetic oligonucleotide
  Target: ATXN1; (+) strand; PAM type: NRG; PAM sequence: AAG
tgttcctgtgatagtttgct

SEQ ID NO: 139103 - DNA, 20 bp, Artificial Sequence
  Description of Artificial Sequence: Synthetic oligonucleotide
  Target: ATXN1; (+) strand; PAM type: NRG; PAM sequence: AGG
gttcctgtgatagtttgcta

SEQ ID NO: 139104 - DNA, 20 bp, Artificial Sequence
  Description of Artificial Sequence: Synthetic oligonucleotide
  Target: ATXN1; (+) strand; PAM type: NRG; PAM sequence: TGG
tgatagtttgctaaggataa

SEQ ID NO: 139105 - DNA, 20 bp, Artificial Sequence
  Description of Artificial Sequence: Synthetic oligonucleotide
  Target: ATXN1; (+) strand; PAM type: NRG; PAM sequence: CAG
ttgctaaggataatggcctc

SEQ ID NO: 139106 - DNA, 20 bp, Artificial Sequence
  Description of Artificial Sequence: Synthetic oligonucleotide
  Target: ATXN1; (+) strand; PAM type: NRG; PAM sequence: AAG
ctccttccatactcctgcaa

SEQ ID NO: 139107 - DNA, 20 bp, Artificial Sequence
  Description of Artificial Sequence: Synthetic oligonucleotide
  Target: ATXN1; (+) strand; PAM type: NRG; PAM sequence: TGG
atgatctcattcctttttta

SEQ ID NO: 139108 - DNA, 20 bp, Artificial Sequence
  Description of Artificial Sequence: Synthetic oligonucleotide
  Target: ATXN1; (+) strand; PAM type: NRG; PAM sequence: TAG
attccttttttatggctgca

SEQ ID NO: 139109 - DNA, 20 bp, Artificial Sequence
  Description of Artificial Sequence: Synthetic oligonucleotide
  Target: ATXN1; (+) strand; PAM type: NRG; PAM sequence: TGG
tatggctgcatagtattcca

SEQ ID NO: 139110 - DNA, 20 bp, Artificial Sequence
  Description of Artificial Sequence: Synthetic oligonucleotide
  Target: ATXN1; (+) strand; PAM type: NRG; PAM sequence: TGG
tttgtccaatctgtcattga

SEQ ID NO: 139111 - DNA, 20 bp, Artificial Sequence
  Description of Artificial Sequence: Synthetic oligonucleotide
  Target: ATXN1; (+) strand; PAM type: NRG; PAM sequence: GGG
ttgtccaatctgtcattgat

SEQ ID NO: 139112 - DNA, 20 bp, Artificial Sequence
  Description of Artificial Sequence: Synthetic oligonucleotide
  Target: ATXN1; (+) strand; PAM type: NRG; PAM sequence: TAG
atctgtcattgatgggcatt

SEQ ID NO: 139113 - DNA, 20 bp, Artificial Sequence
  Description of Artificial Sequence: Synthetic oligonucleotide
  Target: ATXN1; (+) strand; PAM type: NRG; PAM sequence: AGG
tctgtcattgatgggcattt

SEQ ID NO: 139114 - DNA, 20 bp, Artificial Sequence
  Description of Artificial Sequence: Synthetic oligonucleotide
  Target: ATXN1; (+) strand; PAM type: NRG; PAM sequence: TAG
tgtgtctttgctactgtgaa

SEQ ID NO: 139115 - DNA, 20 bp, Artificial Sequence
  Description of Artificial Sequence: Synthetic oligonucleotide
  Target: ATXN1; (+) strand; PAM type: NRG; PAM sequence: TGG
cgtgcatgtgtctaaattta

SEQ ID NO: 139116 - DNA, 20 bp, Artificial Sequence
  Description of Artificial Sequence: Synthetic oligonucleotide
  Target: ATXN1; (+) strand; PAM type: NRG; PAM sequence: TAG
gcatgtgtctaaatttatgg

SEQ ID NO: 139117 - DNA, 20 bp, Artificial Sequence
  Description of Artificial Sequence: Synthetic oligonucleotide
  Target: ATXN1; (+) strand; PAM type: NRG; PAM sequence: TGG
tagaatgatttatattcctc

SEQ ID NO: 139118 - DNA, 20 bp, Artificial Sequence
  Description of Artificial Sequence: Synthetic oligonucleotide
  Target: ATXN1; (+) strand; PAM type: NRG; PAM sequence: GGG
agaatgatttatattcctct

SEQ ID NO: 139119 - DNA, 20 bp, Artificial Sequence
  Description of Artificial Sequence: Synthetic oligonucleotide
  Target: ATXN1; (+) strand; PAM type: NRG; PAM sequence: TAG
atgatttatattcctctggg

SEQ ID NO: 139120 - DNA, 20 bp, Artificial Sequence
  Description of Artificial Sequence: Synthetic oligonucleotide
  Target: ATXN1; (+) strand; PAM type: NRG; PAM sequence: CAG
tattcctctgggtagatacc

SEQ ID NO: 139121 - DNA, 20 bp, Artificial Sequence
  Description of Artificial Sequence: Synthetic oligonucleotide
  Target: ATXN1; (+) strand; PAM type: NRG; PAM sequence: TGG
tctgggtagatacccagtaa

SEQ ID NO: 139122 - DNA, 20 bp, Artificial Sequence
  Description of Artificial Sequence: Synthetic oligonucleotide
  Target: ATXN1; (+) strand; PAM type: NRG; PAM sequence: GGG
ctgggtagatacccagtaat

SEQ ID NO: 139123 - DNA, 20 bp, Artificial Sequence
  Description of Artificial Sequence: Synthetic oligonucleotide
  Target: ATXN1; (+) strand; PAM type: NRG; PAM sequence: TGG
atacccagtaatgggattgc

SEQ ID NO: 139124 - DNA, 20 bp, Artificial Sequence
  Description of Artificial Sequence: Synthetic oligonucleotide
  Target: ATXN1; (+) strand; PAM type: NRG; PAM sequence: GGG
tacccagtaatgggattgct

SEQ ID NO: 139125 - DNA, 20 bp, Artificial Sequence
  Description of Artificial Sequence: Synthetic oligonucleotide
  Target: ATXN1; (+) strand; PAM type: NRG; PAM sequence: TGG
aatgggattgctgggtcgaa

SEQ ID NO: 139126 - DNA, 20 bp, Artificial Sequence
  Description of Artificial Sequence: Synthetic oligonucleotide
  Target: ATXN1; (+) strand; PAM type: NRG; PAM sequence: TAG
gggattgctgggtcgaatgg

SEQ ID NO: 139127 - DNA, 20 bp, Artificial Sequence
  Description of Artificial Sequence: Synthetic oligonucleotide
  Target: ATXN1; (+) strand; PAM type: NRG; PAM sequence: TAG
tcgaatggtagttctgcttt

SEQ ID NO: 139128 - DNA, 20 bp, Artificial Sequence
  Description of Artificial Sequence: Synthetic oligonucleotide
  Target: ATXN1; (+) strand; PAM type: NRG; PAM sequence: CAG
gttctgcttttagctctttg

SEQ ID NO: 139129 - DNA, 20 bp, Artificial Sequence
  Description of Artificial Sequence: Synthetic oligonucleotide
  Target: ATXN1; (+) strand; PAM type: NRG; PAM sequence: TGG
tgccacactgccttccacaa

SEQ ID NO: 139130 - DNA, 20 bp, Artificial Sequence
  Description of Artificial Sequence: Synthetic oligonucleotide
  Target: ATXN1; (+) strand; PAM type: NRG; PAM sequence: CAG
ctaatttgtacactcaccaa

SEQ ID NO: 139131 - DNA, 20 bp, Artificial Sequence
  Description of Artificial Sequence: Synthetic oligonucleotide
  Target: ATXN1; (+) strand; PAM type: NRG; PAM sequence: AAG
tacactcaccaacagtgtat

SEQ ID NO: 139132 - DNA, 20 bp, Artificial Sequence
  Description of Artificial Sequence: Synthetic oligonucleotide
  Target: ATXN1; (+) strand; PAM type: NRG; PAM sequence: CAG
ccctttctccgcaacctcat

SEQ ID NO: 139133 - DNA, 20 bp, Artificial Sequence
  Description of Artificial Sequence: Synthetic oligonucleotide
  Target: ATXN1; (+) strand; PAM type: NRG; PAM sequence: TGG
caacctcatcagcatccaac

SEQ ID NO: 139134 - DNA, 20 bp, Artificial Sequence
  Description of Artificial Sequence: Synthetic oligonucleotide
  Target: ATXN1; (+) strand; PAM type: NRG; PAM sequence: CAG
attttttgactttttaacaa

SEQ ID NO: 139135 - DNA, 20 bp, Artificial Sequence
  Description of Artificial Sequence: Synthetic oligonucleotide
  Target: ATXN1; (+) strand; PAM type: NRG; PAM sequence: TGG
ttaacaacagccattctgac

SEQ ID NO: 139136 - DNA, 20 bp, Artificial Sequence
  Description of Artificial Sequence: Synthetic oligonucleotide
  Target: ATXN1; (+) strand; PAM type: NRG; PAM sequence: GAG
acagccattctgactggtat

SEQ ID NO: 139137 - DNA, 20 bp, Artificial Sequence
  Description of Artificial Sequence: Synthetic oligonucleotide
  Target: ATXN1; (+) strand; PAM type: NRG; PAM sequence: TAG
ccattctgactggtatgaga

SEQ ID NO: 139138 - DNA, 20 bp, Artificial Sequence
  Description of Artificial Sequence: Synthetic oligonucleotide
  Target: ATXN1; (+) strand; PAM type: NRG; PAM sequence: CAG
atttgcgttgctctaatgac

SEQ ID NO: 139139 - DNA, 20 bp, Artificial Sequence
  Description of Artificial Sequence: Synthetic oligonucleotide
  Target: ATXN1; (+) strand; PAM type: NRG; PAM sequence: GAG
ctctaatgaccagcgatatt

SEQ ID NO: 139140 - DNA, 20 bp, Artificial Sequence
  Description of Artificial Sequence: Synthetic oligonucleotide
  Target: ATXN1; (+) strand; PAM type: NRG; PAM sequence: TGG
gctgcttttcatattcttat

SEQ ID NO: 139141 - DNA, 20 bp, Artificial Sequence
  Description of Artificial Sequence: Synthetic oligonucleotide
  Target: ATXN1; (+) strand; PAM type: NRG; PAM sequence: AAG
gccatatgtcttcttttgaa

SEQ ID NO: 139142 - DNA, 20 bp, Artificial Sequence
  Description of Artificial Sequence: Synthetic oligonucleotide
  Target: ATXN1; (+) strand; PAM type: NRG; PAM sequence: TGG
gtcctttgctcactttttca

SEQ ID NO: 139143 - DNA, 20 bp, Artificial Sequence
  Description of Artificial Sequence: Synthetic oligonucleotide
  Target: ATXN1; (+) strand; PAM type: NRG; PAM sequence: GGG
tcctttgctcactttttcat

SEQ ID NO: 139144 - DNA, 20 bp, Artificial Sequence
  Description of Artificial Sequence: Synthetic oligonucleotide
  Target: ATXN1; (+) strand; PAM type: NRG; PAM sequence: GGG
cctttgctcactttttcatg

SEQ ID NO: 139145 - DNA, 20 bp, Artificial Sequence
  Description of Artificial Sequence: Synthetic oligonucleotide
  Target: ATXN1; (+) strand; PAM type: NRG; PAM sequence: AAG
tcactttttcatggggttga

SEQ ID NO: 139146 - DNA, 20 bp, Artificial Sequence
  Description of Artificial Sequence: Synthetic oligonucleotide
  Target: ATXN1; (+) strand; PAM type: NRG; PAM sequence: GAG
ccttctccccgcctccccct

SEQ ID NO: 139147 - DNA, 20 bp, Artificial Sequence
  Description of Artificial Sequence: Synthetic oligonucleotide
  Target: ATXN1; (+) strand; PAM type: NRG; PAM sequence: AGG
cttctccccgcctccccctg

SEQ ID NO: 139148 - DNA, 20 bp, Artificial Sequence
  Description of Artificial Sequence: Synthetic oligonucleotide
  Target: ATXN1; (+) strand; PAM type: NRG; PAM sequence: CAG
ctccccgcctccccctgagg

SEQ ID NO: 139149 - DNA, 20 bp, Artificial Sequence
  Description of Artificial Sequence: Synthetic oligonucleotide
  Target: ATXN1; (+) strand; PAM type: NRG; PAM sequence: GAG
ccccgcctccccctgaggca

SEQ ID NO: 139150 - DNA, 20 bp, Artificial Sequence
  Description of Artificial Sequence: Synthetic oligonucleotide
  Target: ATXN1; (+) strand; PAM type: NRG; PAM sequence: CAG
cagagtcatgctctgtcacc

SEQ ID NO: 139151 - DNA, 20 bp, Artificial Sequence
  Description of Artificial Sequence: Synthetic oligonucleotide
  Target: ATXN1; (+) strand; PAM type: NRG; PAM sequence: AGG
agagtcatgctctgtcaccc

SEQ ID NO: 139152 - DNA, 20 bp, Artificial Sequence
  Description of Artificial Sequence: Synthetic oligonucleotide
  Target: ATXN1; (+) strand; PAM type: NRG; PAM sequence: TGG
tcatgctctgtcacccaggc

SEQ ID NO: 139153 - DNA, 20 bp, Artificial Sequence
  Description of Artificial Sequence: Synthetic oligonucleotide
  Target: ATXN1; (+) strand; PAM type: NRG; PAM sequence: GAG
atgctctgtcacccaggctg

SEQ ID NO: 139154 - DNA, 20 bp, Artificial Sequence
  Description of Artificial Sequence: Synthetic oligonucleotide
  Target: ATXN1; (+) strand; PAM type: NRG; PAM sequence: TAG
ctgtcacccaggctggagca

SEQ ID NO: 139155 - DNA, 20 bp, Artificial Sequence
  Description of Artificial Sequence: Synthetic oligonucleotide
  Target: ATXN1; (+) strand; PAM type: NRG; PAM sequence: TGG
tcacccaggctggagcatag

SEQ ID NO: 139156 - DNA, 20 bp, Artificial Sequence
  Description of Artificial Sequence: Synthetic oligonucleotide
  Target: ATXN1; (+) strand; PAM type: NRG; PAM sequence: CGG
ggagcatagtggtgcaatct

SEQ ID NO: 139157 - DNA, 20 bp, Artificial Sequence
  Description of Artificial Sequence: Synthetic oligonucleotide
  Target: ATXN1; (+) strand; PAM type: NRG; PAM sequence: CAG
tcactgcaaccttcgcctcc

SEQ ID NO: 139158 - DNA, 20 bp, Artificial Sequence
  Description of Artificial Sequence: Synthetic oligonucleotide
  Target: ATXN1; (+) strand; PAM type: NRG; PAM sequence: AGG
cactgcaaccttcgcctccc

SEQ ID NO: 139159 - DNA, 20 bp, Artificial Sequence
  Description of Artificial Sequence: Synthetic oligonucleotide
  Target: ATXN1; (+) strand; PAM type: NRG; PAM sequence: AAG
aaccttcgcctcccaggttc

SEQ ID NO: 139160 - DNA, 20 bp, Artificial Sequence
  Description of Artificial Sequence: Synthetic oligonucleotide
  Target: ATXN1; (+) strand; PAM type: NRG; PAM sequence: CAG
ttcaagcaattctcctgcct

SEQ ID NO: 139161 - DNA, 20 bp, Artificial Sequence
  Description of Artificial Sequence: Synthetic oligonucleotide
  Target: ATXN1; (+) strand; PAM type: NRG; PAM sequence: TAG
tcctgcctcagcctcccgcg

SEQ ID NO: 139162 - DNA, 20 bp, Artificial Sequence
  Description of Artificial Sequence: Synthetic oligonucleotide
  Target: ATXN1; (+) strand; PAM type: NRG; PAM sequence: TGG
gcctcagcctcccgcgtagc

SEQ ID NO: 139163 - DNA, 20 bp, Artificial Sequence
  Description of Artificial Sequence: Synthetic oligonucleotide
  Target: ATXN1; (+) strand; PAM type: NRG; PAM sequence: GGG
cctcagcctcccgcgtagct

SEQ ID NO: 139164 - DNA, 20 bp, Artificial Sequence
  Description of Artificial Sequence: Synthetic oligonucleotide
  Target: ATXN1; (+) strand; PAM type: NRG; PAM sequence: CAG
ctcccgcgtagctgggatta

SEQ ID NO: 139165 - DNA, 20 bp, Artificial Sequence
  Description of Artificial Sequence: Synthetic oligonucleotide
  Target: ATXN1; (+) strand; PAM type: NRG; PAM sequence: AGG
tcccgcgtagctgggattac

SEQ ID NO: 139166 - DNA, 20 bp, Artificial Sequence
  Description of Artificial Sequence: Synthetic oligonucleotide
  Target: ATXN1; (+) strand; PAM type: NRG; PAM sequence: CAG
ggattacaggcactcgccac

SEQ ID NO: 139167 - DNA, 20 bp, Artificial Sequence
  Description of Artificial Sequence: Synthetic oligonucleotide
  Target: ATXN1; (+) strand; PAM type: NRG; PAM sequence: CAG
acaggcactcgccaccagcc

SEQ ID NO: 139168 - DNA, 20 bp, Artificial Sequence
  Description of Artificial Sequence: Synthetic oligonucleotide
  Target: ATXN1; (+) strand; PAM type: NRG; PAM sequence: TAG
ctaattgtttttgtattttt

SEQ ID NO: 139169 - DNA, 20 bp, Artificial Sequence
  Description of Artificial Sequence: Synthetic oligonucleotide
  Target: ATXN1; (+) strand; PAM type: NRG; PAM sequence: TAG
attgtttttgtattttttag

SEQ ID NO: 139170 - DNA, 20 bp, Artificial Sequence
  Description of Artificial Sequence: Synthetic oligonucleotide
  Target: ATXN1; (+) strand; PAM type: NRG; PAM sequence: GAG
tgtttttgtattttttagta

SEQ ID NO: 139171 - DNA, 20 bp, Artificial Sequence
  Description of Artificial Sequence: Synthetic oligonucleotide
  Target: ATXN1; (+) strand; PAM type: NRG; PAM sequence: TGG
tttgtattttttagtagaga

SEQ ID NO: 139172 - DNA, 20 bp, Artificial Sequence
  Description of Artificial Sequence: Synthetic oligonucleotide
  Target: ATXN1; (+) strand; PAM type: NRG; PAM sequence: GGG
ttgtattttttagtagagat

SEQ ID NO: 139173 - DNA, 20 bp, Artificial Sequence
  Description of Artificial Sequence: Synthetic oligonucleotide
  Target: ATXN1; (+) strand; PAM type: NRG; PAM sequence: GGG
tgtattttttagtagagatg

SEQ ID NO: 139174 - DNA, 20 bp, Artificial Sequence
  Description of Artificial Sequence: Synthetic oligonucleotide
  Target: ATXN1; (+) strand; PAM type: NRG; PAM sequence: AAG
tggggtttcaccatgtttgc

SEQ ID NO: 139175 - DNA, 20 bp, Artificial Sequence
  Description of Artificial Sequence: Synthetic oligonucleotide
  Target: ATXN1; (+) strand; PAM type: NRG; PAM sequence: AGG
ggggtttcaccatgtttgca

SEQ ID NO: 139176 - DNA, 20 bp, Artificial Sequence
  Description of Artificial Sequence: Synthetic oligonucleotide
  Target: ATXN1; (+) strand; PAM type: NRG; PAM sequence: TGG
tttcaccatgtttgcaaggc

SEQ ID NO: 139177 - DNA, 20 bp, Artificial Sequence
  Description of Artificial Sequence: Synthetic oligonucleotide
  Target: ATXN1; (+) strand; PAM type: NRG; PAM sequence: TGG
actttgtgatctgcccacct

SEQ ID NO: 139178 - DNA, 20 bp, Artificial Sequence
  Description of Artificial Sequence: Synthetic oligonucleotide
  Target: ATXN1; (+) strand; PAM type: NRG; PAM sequence: AAG
ctgcccaccttggcctttca

SEQ ID NO: 139179 - DNA, 20 bp, Artificial Sequence
  Description of Artificial Sequence: Synthetic oligonucleotide
  Target: ATXN1; (+) strand; PAM type: NRG; PAM sequence: TGG
accttggcctttcaaagtgc

SEQ ID NO: 139180 - DNA, 20 bp, Artificial Sequence
  Description of Artificial Sequence: Synthetic oligonucleotide
  Target: ATXN1; (+) strand; PAM type: NRG; PAM sequence: GGG
ccttggcctttcaaagtgct

SEQ ID NO: 139181 - DNA, 20 bp, Artificial Sequence
  Description of Artificial Sequence: Synthetic oligonucleotide
  Target: ATXN1; (+) strand; PAM type: NRG; PAM sequence: CGG
ttttaaaaatatatatattt

SEQ ID NO: 139182 - DNA, 20 bp, Artificial Sequence
  Description of Artificial Sequence: Synthetic oligonucleotide
  Target: ATXN1; (+) strand; PAM type: NRG; PAM sequence: CAG
aaaaatatatatatttcggc

SEQ ID NO: 139183 - DNA, 20 bp, Artificial Sequence
  Description of Artificial Sequence: Synthetic oligonucleotide
  Target: ATXN1; (+) strand; PAM type: NRG; PAM sequence: AGG
aaaatatatatatttcggcc

SEQ ID NO: 139184 - DNA, 20 bp, Artificial Sequence
  Description of Artificial Sequence: Synthetic oligonucleotide
  Target: ATXN1; (+) strand; PAM type: NRG; PAM sequence: AAG
tatatatatttcggccaggc

SEQ ID NO: 139185 - DNA, 20 bp, Artificial Sequence
  Description of Artificial Sequence: Synthetic oligonucleotide
  Target: ATXN1; (+) strand; PAM type: NRG; PAM sequence: AGG
atatatatttcggccaggca

SEQ ID NO: 139186 - DNA, 20 bp, Artificial Sequence
  Description of Artificial Sequence: Synthetic oligonucleotide
  Target: ATXN1; (+) strand; PAM type: NRG; PAM sequence: TGG
tatatttcggccaggcaagg

SEQ ID NO: 139187 - DNA, 20 bp, Artificial Sequence
  Description of Artificial Sequence: Synthetic oligonucleotide
  Target: ATXN1; (+) strand; PAM type: NRG; PAM sequence: TGG
tgcctgtaatccctgcactt

SEQ ID NO: 139188 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatccctgcacttt

SEQ ID NO: 139189 - DNA, 20 bp, Artificial Sequence
  Description of Artificial Sequence: Synthetic oligonucleotide
  Target: ATXN1; (+) strand; PAM type: NRG; PAM sequence: GAG
ctgtaatccctgcactttgg

SEQ ID NO: 139190 - DNA, 20 bp, Artificial Sequence
  Description of Artificial Sequence: Synthetic oligonucleotide
  Target: ATXN1; (+) strand; PAM type: NRG; PAM sequence: AGG
tgtaatccctgcactttggg

SEQ ID NO: 139191 - DNA, 20 bp, Artificial Sequence
  Description of Artificial Sequence: Synthetic oligonucleotide
  Target: ATXN1; (+) strand; PAM type: NRG; PAM sequence: AAG
ccctgcactttgggaggctg

SEQ ID NO: 139192 - DNA, 20 bp, Artificial Sequence
  Description of Artificial Sequence: Synthetic oligonucleotide
  Target: ATXN1; (+) strand; PAM type: NRG; PAM sequence: TGG
tgcactttgggaggctgaag

SEQ ID NO: 139193 - DNA, 20 bp, Artificial Sequence
  Description of Artificial Sequence: Synthetic oligonucleotide
  Target: ATXN1; (+) strand; PAM type: NRG; PAM sequence: GGG
gcactttgggaggctgaagt

SEQ ID NO: 139194 - DNA, 20 bp, Artificial Sequence
  Description of Artificial Sequence: Synthetic oligonucleotide
  Target: ATXN1; (+) strand; PAM type: NRG; PAM sequence: TGG
ctttgggaggctgaagtggg

SEQ ID NO: 139195 - DNA, 20 bp, Artificial Sequence
  Description of Artificial Sequence: Synthetic oligonucleotide
  Target: ATXN1; (+) strand; PAM type: NRG; PAM sequence: GAG
ctgaagtgggtggatcccct

SEQ ID NO: 139196 - DNA, 20 bp, Artificial Sequence
  Description of Artificial Sequence: Synthetic oligonucleotide
  Target: ATXN1; (+) strand; PAM type: NRG; PAM sequence: AGG
tgaagtgggtggatcccctg

SEQ ID NO: 139197 - DNA, 20 bp, Artificial Sequence
  Description of Artificial Sequence: Synthetic oligonucleotide
  Target: ATXN1; (+) strand; PAM type: NRG; PAM sequence: CAG
gtgggtggatcccctgaggt

SEQ ID NO: 139198 - DNA, 20 bp, Artificial Sequence
  Description of Artificial Sequence: Synthetic oligonucleotide
  Target: ATXN1; (+) strand; PAM type: NRG; PAM sequence: AGG
tgggtggatcccctgaggtc

SEQ ID NO: 139199 - DNA, 20 bp, Artificial Sequence
  Description of Artificial Sequence: Synthetic oligonucleotide
  Target: ATXN1; (+) strand; PAM type: NRG; PAM sequence: GAG
ggtggatcccctgaggtcag

SEQ ID NO: 139200 - DNA, 20 bp, Artificial Sequence
  Description of Artificial Sequence: Synthetic oligonucleotide
  Target: ATXN1; (+) strand; PAM type: NRG; PAM sequence: GAG
tcccctgaggtcaggagttc

SEQ ID NO: 139201 - DNA, 20 bp, Artificial Sequence
  Description of Artificial Sequence: Synthetic oligonucleotide
  Target: ATXN1; (+) strand; PAM type: NRG; PAM sequence: TGG
tcaggagttcgagaccatcc

SEQ ID NO: 139202 - DNA, 20 bp, Artificial Sequence
  Description of Artificial Sequence: Synthetic oligonucleotide
  Target: ATXN1; (+) strand; PAM type: NRG; PAM sequence: TAG
ctactaaaaatacaaaaaac

SEQ ID NO: 139203 - DNA, 20 bp, Artificial Sequence
  Description of Artificial Sequence: Synthetic oligonucleotide
  Target: ATXN1; (+) strand; PAM type: NRG; PAM sequence: TGG
taaaaatacaaaaaactagc

SEQ ID NO: 139204 - DNA, 20 bp, Artificial Sequence
  Description of Artificial Sequence: Synthetic oligonucleotide
  Target: ATXN1; (+) strand; PAM type: NRG; PAM sequence: TGG
tacaaaaaactagctggacg

SEQ ID NO: 139205 - DNA, 20 bp, Artificial Sequence
  Description of Artificial Sequence: Synthetic oligonucleotide
  Target: ATXN1; (+) strand; PAM type: NRG; PAM sequence: TGG
aaaaaactagctggacgtgg

SEQ ID NO: 139206 - DNA, 20 bp, Artificial Sequence
  Description of Artificial Sequence: Synthetic oligonucleotide
  Target: ATXN1; (+) strand; PAM type: NRG; PAM sequence: CAG
gtggtgtgcgcctgtaatcc

SEQ ID NO: 139207 - DNA, 20 bp, Artificial Sequence
  Description of Artificial Sequence: Synthetic oligonucleotide
  Target: ATXN1; (+) strand; PAM type: NRG; PAM sequence: TGG
cgcctgtaatcccagctact

SEQ ID NO: 139208 - DNA, 20 bp, Artificial Sequence
  Description of Artificial Sequence: Synthetic oligonucleotide
  Target: ATXN1; (+) strand; PAM type: NRG; PAM sequence: GGG
gcctgtaatcccagctactt

SEQ ID NO: 139209 - DNA, 20 bp, Artificial Sequence
  Description of Artificial Sequence: Synthetic oligonucleotide
  Target: ATXN1; (+) strand; PAM type: NRG; PAM sequence: GAG
ctgtaatcccagctacttgg

SEQ ID NO: 139210 - DNA, 20 bp, Artificial Sequence
  Description of Artificial Sequence: Synthetic oligonucleotide
  Target: ATXN1; (+) strand; PAM type: NRG; PAM sequence: AGG
tgtaatcccagctacttggg

SEQ ID NO: 139211 - DNA, 20 bp, Artificial Sequence
  Description of Artificial Sequence: Synthetic oligonucleotide
  Target: ATXN1; (+) strand; PAM type: NRG; PAM sequence: GAG
tcccagctacttgggaggct

SEQ ID NO: 139212 - DNA, 20 bp, Artificial Sequence
  Description of Artificial Sequence: Synthetic oligonucleotide
  Target: ATXN1; (+) strand; PAM type: NRG; PAM sequence: AGG
cccagctacttgggaggctg

SEQ ID NO: 139213 - DNA, 20 bp, Artificial Sequence
  Description of Artificial Sequence: Synthetic oligonucleotide
  Target: ATXN1; (+) strand; PAM type: NRG; PAM sequence: CAG
agctacttgggaggctgagg

SEQ ID NO: 139214 - DNA, 20 bp, Artificial Sequence
  Description of Artificial Sequence: Synthetic oligonucleotide
  Target: ATXN1; (+) strand; PAM type: NRG; PAM sequence: AGG
gctacttgggaggctgaggc

SEQ ID NO: 139215 - DNA, 20 bp, Artificial Sequence
  Description of Artificial Sequence: Synthetic oligonucleotide
  Target: ATXN1; (+) strand; PAM type: NRG; PAM sequence: GAG
tacttgggaggctgaggcag

SEQ ID NO: 139216 - DNA, 20 bp, Artificial Sequence
  Description of Artificial Sequence: Synthetic oligonucleotide
  Target: ATXN1; (+) strand; PAM type: NRG; PAM sequence: CAG
gcaggagaatcgcttgaacc

SEQ ID NO: 139217 - DNA, 20 bp, Artificial Sequence
  Description of Artificial Sequence: Synthetic oligonucleotide
  Target: ATXN1; (+) strand; PAM type: NRG; PAM sequence: AGG
caggagaatcgcttgaaccc

SEQ ID NO: 139218 - DNA, 20 bp, Artificial Sequence
  Description of Artificial Sequence: Synthetic oligonucleotide
  Target: ATXN1; (+) strand; PAM type: NRG; PAM sequence: GAG
ggagaatcgcttgaacccag

SEQ ID NO: 139219 - DNA, 20 bp, Artificial Sequence
  Description of Artificial Sequence: Synthetic oligonucleotide
  Target: ATXN1; (+) strand; PAM type: NRG; PAM sequence: AGG
gagaatcgcttgaacccagg

SEQ ID NO: 139220 - DNA, 20 bp, Artificial Sequence
  Description of Artificial Sequence: Synthetic oligonucleotide
  Target: ATXN1; (+) strand; PAM type: NRG; PAM sequence: CAG
aatcgcttgaacccaggagg

SEQ ID NO: 139221 - DNA, 20 bp, Artificial Sequence
  Description of Artificial Sequence: Synthetic oligonucleotide
  Target: ATXN1; (+) strand; PAM type: NRG; PAM sequence: GAG
tcgcttgaacccaggaggca

SEQ ID NO: 139222 - DNA, 20 bp, Artificial Sequence
  Description of Artificial Sequence: Synthetic oligonucleotide
  Target: ATXN1; (+) strand; PAM type: NRG; PAM sequence: AGG
cgcttgaacccaggaggcag

SEQ ID NO: 139223 - DNA, 20 bp, Artificial Sequence
  Description of Artificial Sequence: Synthetic oligonucleotide
  Target: ATXN1; (+) strand; PAM type: NRG; PAM sequence: CAG
aacccaggaggcagaggttg

SEQ ID NO: 139224 - DNA, 20 bp, Artificial Sequence
  Description of Artificial Sequence: Synthetic oligonucleotide
  Target: ATXN1; (+) strand; PAM type: NRG; PAM sequence: GAG
caggaggcagaggttgcagt

SEQ ID NO: 139225 - DNA, 20 bp, Artificial Sequence
  Description of Artificial Sequence: Synthetic oligonucleotide
  Target: ATXN1; (+) strand; PAM type: NRG; PAM sequence: GAG
ggcagaggttgcagtgagcc

SEQ ID NO: 139226 - DNA, 20 bp, Artificial Sequence
  Description of Artificial Sequence: Synthetic oligonucleotide
  Target: ATXN1; (+) strand; PAM type: NRG; PAM sequence: CAG
gagatcacaccactgcactc

SEQ ID NO: 139227 - DNA, 20 bp, Artificial Sequence
  Description of Artificial Sequence: Synthetic oligonucleotide
  Target: ATXN1; (+) strand; PAM type: NRG; PAM sequence: TGG
cacaccactgcactccagcc

SEQ ID NO: 139228 - DNA, 20 bp, Artificial Sequence
  Description of Artificial Sequence: Synthetic oligonucleotide
  Target: ATXN1; (+) strand; PAM type: NRG; PAM sequence: GGG
acaccactgcactccagcct

SEQ ID NO: 139229 - DNA, 20 bp, Artificial Sequence
  Description of Artificial Sequence: Synthetic oligonucleotide
  Target: ATXN1; (+) strand; PAM type: NRG; PAM sequence: AAG
cactccagcctgggcaacaa

SEQ ID NO: 139230 - DNA, 20 bp, Artificial Sequence
  Description of Artificial Sequence: Synthetic oligonucleotide
  Target: ATXN1; (+) strand; PAM type: NRG; PAM sequence: TAG
atttcttaatgttgccttct

SEQ ID NO: 139231 - DNA, 20 bp, Artificial Sequence
  Description of Artificial Sequence: Synthetic oligonucleotide
  Target: ATXN1; (+) strand; PAM type: NRG; PAM sequence: GAG
ttcttaatgttgccttctta

SEQ ID NO: 139232 - DNA, 20 bp, Artificial Sequence
  Description of Artificial Sequence: Synthetic oligonucleotide
  Target: ATXN1; (+) strand; PAM type: NRG; PAM sequence: TGG
gagtctgtataaccttcttc

SEQ ID NO: 139233 - DNA, 20 bp, Artificial Sequence
  Description of Artificial Sequence: Synthetic oligonucleotide
  Target: ATXN1; (+) strand; PAM type: NRG; PAM sequence: AAG
ctgtataaccttcttctgga

SEQ ID NO: 139234 - DNA, 20 bp, Artificial Sequence
  Description of Artificial Sequence: Synthetic oligonucleotide
  Target: ATXN1; (+) strand; PAM type: NRG; PAM sequence: AGG
tgtataaccttcttctggaa

SEQ ID NO: 139235 - DNA, 20 bp, Artificial Sequence
  Description of Artificial Sequence: Synthetic oligonucleotide
  Target: ATXN1; (+) strand; PAM type: NRG; PAM sequence: GGG
gtataaccttcttctggaaa

SEQ ID NO: 139236 - DNA, 20 bp, Artificial Sequence
  Description of Artificial Sequence: Synthetic oligonucleotide
  Target: ATXN1; (+) strand; PAM type: NRG; PAM sequence: TAG
ttaacatcttgcccatttat

SEQ ID NO: 139237 - DNA, 20 bp, Artificial Sequence
  Description of Artificial Sequence: Synthetic oligonucleotide
  Target: ATXN1; (+) strand; PAM type: NRG; PAM sequence: AAG
cccatttattagatattata

SEQ ID NO: 139238 - DNA, 20 bp, Artificial Sequence
  Description of Artificial Sequence: Synthetic oligonucleotide
  Target: ATXN1; (+) strand; PAM type: NRG; PAM sequence: AGG
ccatttattagatattataa

SEQ ID NO: 139239 - DNA, 20 bp, Artificial Sequence
  Description of Artificial Sequence: Synthetic oligonucleotide
  Target: ATXN1; (+) strand; PAM type: NRG; PAM sequence: AAG
tattagatattataaaggtt

SEQ ID NO: 139240 - DNA, 20 bp, Artificial Sequence
  Description of Artificial Sequence: Synthetic oligonucleotide
  Target: ATXN1; (+) strand; PAM type: NRG; PAM sequence: AAG
ttaagatgaaaatgcttccc

SEQ ID NO: 139241 - DNA, 20 bp, Artificial Sequence
  Description of Artificial Sequence: Synthetic oligonucleotide
  Target: ATXN1; (+) strand; PAM type: NRG; PAM sequence: AGG
taagatgaaaatgcttccca

SEQ ID NO: 139242 - DNA, 20 bp, Artificial Sequence
  Description of Artificial Sequence: Synthetic oligonucleotide
  Target: ATXN1; (+) strand; PAM type: NRG; PAM sequence: GGG
aagatgaaaatgcttcccaa

SEQ ID NO: 139243 - DNA, 20 bp, Artificial Sequence
  Description of Artificial Sequence: Synthetic oligonucleotide
  Target: ATXN1; (+) strand; PAM type: NRG; PAM sequence: CGG
tcatataaatcatgtctgta

SEQ ID NO: 139244 - DNA, 20 bp, Artificial Sequence
  Description of Artificial Sequence: Synthetic oligonucleotide
  Target: ATXN1; (+) strand; PAM type: NRG; PAM sequence: GGG
catataaatcatgtctgtac

SEQ ID NO: 139245 - DNA, 20 bp, Artificial Sequence
  Description of Artificial Sequence: Synthetic oligonucleotide
  Target: ATXN1; (+) strand; PAM type: NRG; PAM sequence: CAG
ataaatcatgtctgtacggg

SEQ ID NO: 139246 - DNA, 20 bp, Artificial Sequence
  Description of Artificial Sequence: Synthetic oligonucleotide
  Target: ATXN1; (+) strand; PAM type: NRG; PAM sequence: AAG
tctgtacgggcagaatcaca

SEQ ID NO: 139247 - DNA, 20 bp, Artificial Sequence
  Description of Artificial Sequence: Synthetic oligonucleotide
  Target: ATXN1; (+) strand; PAM type: NRG; PAM sequence: TAG
tacgggcagaatcacaaagc

SEQ ID NO: 139248 - DNA, 20 bp, Artificial Sequence
  Description of Artificial Sequence: Synthetic oligonucleotide
  Target: ATXN1; (+) strand; PAM type: NRG; PAM sequence: TGG
gcagaatcacaaagctagaa

SEQ ID NO: 139249 - DNA, 20 bp, Artificial Sequence
  Description of Artificial Sequence: Synthetic oligonucleotide
  Target: ATXN1; (+) strand; PAM type: NRG; PAM sequence: GGG
cagaatcacaaagctagaat

SEQ ID NO: 139250 - DNA, 20 bp, Artificial Sequence
  Description of Artificial Sequence: Synthetic oligonucleotide
  Target: ATXN1; (+) strand; PAM type: NRG; PAM sequence: GAG
cacaaagctagaatgggtct

SEQ ID NO: 139251 - DNA, 20 bp, Artificial Sequence
  Description of Artificial Sequence: Synthetic oligonucleotide
  Target: ATXN1; (+) strand; PAM type: NRG; PAM sequence: AGG
acaaagctagaatgggtctg

SEQ ID NO: 139252 - DNA, 20 bp, Artificial Sequence
  Description of Artificial Sequence: Synthetic oligonucleotide
  Target: ATXN1; (+) strand; PAM type: NRG; PAM sequence: CAG
ggtctgaggactcctcctct

SEQ ID NO: 139253 - DNA, 20 bp, Artificial Sequence
  Description of Artificial Sequence: Synthetic oligonucleotide
  Target: ATXN1; (+) strand; PAM type: NRG; PAM sequence: AGG
gtctgaggactcctcctctc

SEQ ID NO: 139254 - DNA, 20 bp, Artificial Sequence
  Description of Artificial Sequence: Synthetic oligonucleotide
  Target: ATXN1; (+) strand; PAM type: NRG; PAM sequence: TGG
aggcaacttccttccaactg

SEQ ID NO: 139255 - DNA, 20 bp, Artificial Sequence
  Description of Artificial Sequence: Synthetic oligonucleotide
  Target: ATXN1; (+) strand; PAM type: NRG; PAM sequence: GGG
ggcaacttccttccaactgt

SEQ ID NO: 139256 - DNA, 20 bp, Artificial Sequence
  Description of Artificial Sequence: Synthetic oligonucleotide
  Target: ATXN1; (+) strand; PAM type: NRG; PAM sequence: TGG
tccaactgtgggcattccct

SEQ ID NO: 139257 - DNA, 20 bp, Artificial Sequence
  Description of Artificial Sequence: Synthetic oligonucleotide
  Target: ATXN1; (+) strand; PAM type: NRG; PAM sequence: GGG
ccaactgtgggcattccctt

SEQ ID NO: 139258 - DNA, 20 bp, Artificial Sequence
  Description of Artificial Sequence: Synthetic oligonucleotide
  Target: ATXN1; (+) strand; PAM type: NRG; PAM sequence: TGG
tgattcacccaacattcact

SEQ ID NO: 139259 - DNA, 20 bp, Artificial Sequence
  Description of Artificial Sequence: Synthetic oligonucleotide
  Target: ATXN1; (+) strand; PAM type: NRG; PAM sequence: GGG
gattcacccaacattcactt

SEQ ID NO: 139260 - DNA, 20 bp, Artificial Sequence
  Description of Artificial Sequence: Synthetic oligonucleotide
  Target: ATXN1; (+) strand; PAM type: NRG; PAM sequence: GAG
ctgcattgtatgactctctt

SEQ ID NO: 139261 - DNA, 20 bp, Artificial Sequence
  Description of Artificial Sequence: Synthetic oligonucleotide
  Target: ATXN1; (+) strand; PAM type: NRG; PAM sequence: AGG
tgcattgtatgactctcttg

SEQ ID NO: 139262 - DNA, 20 bp, Artificial Sequence
  Description of Artificial Sequence: Synthetic oligonucleotide
  Target: ATXN1; (+) strand; PAM type: NRG; PAM sequence: CAG
tatgactctcttgaggcaaa

SEQ ID NO: 139263 - DNA, 20 bp, Artificial Sequence
  Description of Artificial Sequence: Synthetic oligonucleotide
  Target: ATXN1; (+) strand; PAM type: NRG; PAM sequence: AGG
atgactctcttgaggcaaac

SEQ ID NO: 139264 - DNA, 20 bp, Artificial Sequence
  Description of Artificial Sequence: Synthetic oligonucleotide
  Target: ATXN1; (+) strand; PAM type: NRG; PAM sequence: AAG
aaaaacctgtatctgccctc

SEQ ID NO: 139265 - DNA, 20 bp, Artificial Sequence
  Description of Artificial Sequence: Synthetic oligonucleotide
  Target: ATXN1; (+) strand; PAM type: NRG; PAM sequence: AGG
aaaacctgtatctgccctca

SEQ ID NO: 139266 - DNA, 20 bp, Artificial Sequence
  Description of Artificial Sequence: Synthetic oligonucleotide
  Target: ATXN1; (+) strand; PAM type: NRG; PAM sequence: GGG
aaacctgtatctgccctcaa

SEQ ID NO: 139267 - DNA, 20 bp, Artificial Sequence
  Description of Artificial Sequence: Synthetic oligonucleotide
  Target: ATXN1; (+) strand; PAM type: NRG; PAM sequence: GGG
aacctgtatctgccctcaag

SEQ ID NO: 139268 - DNA, 20 bp, Artificial Sequence
  Description of Artificial Sequence: Synthetic oligonucleotide
  Target: ATXN1; (+) strand; PAM type: NRG; PAM sequence: GAG
cctgtatctgccctcaaggg

SEQ ID NO: 139269 - DNA, 20 bp, Artificial Sequence
  Description of Artificial Sequence: Synthetic oligonucleotide
  Target: ATXN1; (+) strand; PAM type: NRG; PAM sequence: TAG
ccctcaaggggagtccctcc

SEQ ID NO: 139270 - DNA, 20 bp, Artificial Sequence
  Description of Artificial Sequence: Synthetic oligonucleotide
  Target: ATXN1; (+) strand; PAM type: NRG; PAM sequence: GAG
ctcaaggggagtccctccta

SEQ ID NO: 139271 - DNA, 20 bp, Artificial Sequence
  Description of Artificial Sequence: Synthetic oligonucleotide
  Target: ATXN1; (+) strand; PAM type: NRG; PAM sequence: AGG
tcaaggggagtccctcctag

SEQ ID NO: 139272 - DNA, 20 bp, Artificial Sequence
  Description of Artificial Sequence: Synthetic oligonucleotide
  Target: ATXN1; (+) strand; PAM type: NRG; PAM sequence: GAG
aaggggagtccctcctagag

SEQ ID NO: 139273 - DNA, 20 bp, Artificial Sequence
  Description of Artificial Sequence: Synthetic oligonucleotide
  Target: ATXN1; (+) strand; PAM type: NRG; PAM sequence: AGG
aggggagtccctcctagagg

SEQ ID NO: 139274 - DNA, 20 bp, Artificial Sequence
  Description of Artificial Sequence: Synthetic oligonucleotide
  Target: ATXN1; (+) strand; PAM type: NRG; PAM sequence: TAG
tccctcctagaggaggacac

SEQ ID NO: 139275 - DNA, 20 bp, Artificial Sequence
  Description of Artificial Sequence: Synthetic oligonucleotide
  Target: ATXN1; (+) strand; PAM type: NRG; PAM sequence: AAG
gccataccgttgttatgctg

SEQ ID NO: 139276 - DNA, 20 bp, Artificial Sequence
  Description of Artificial Sequence: Synthetic oligonucleotide
  Target: ATXN1; (+) strand; PAM type: NRG; PAM sequence: GAG
cgttgttatgctgaagttgc

SEQ ID NO: 139277 - DNA, 20 bp, Artificial Sequence
  Description of Artificial Sequence: Synthetic oligonucleotide
  Target: ATXN1; (+) strand; PAM type: NRG; PAM sequence: AGG
gttgttatgctgaagttgcg

SEQ ID NO: 139278 - DNA, 20 bp, Artificial Sequence
  Description of Artificial Sequence: Synthetic oligonucleotide
  Target: ATXN1; (+) strand; PAM type: NRG; PAM sequence: CAG
gaagttgcgaggtccattta

SEQ ID NO: 139279 - DNA, 20 bp, Artificial Sequence
  Description of Artificial Sequence: Synthetic oligonucleotide
  Target: ATXN1; (+) strand; PAM type: NRG; PAM sequence: CAG
gcgaggtccatttacagaac

SEQ ID NO: 139280 - DNA, 20 bp, Artificial Sequence
  Description of Artificial Sequence: Synthetic oligonucleotide
  Target: ATXN1; (+) strand; PAM type: NRG; PAM sequence: TAG
acagaaccagccttatcact

SEQ ID NO: 139281 - DNA, 20 bp, Artificial Sequence
  Description of Artificial Sequence: Synthetic oligonucleotide
  Target: ATXN1; (+) strand; PAM type: NRG; PAM sequence: TAG
agccttatcacttagcaata

SEQ ID NO: 139282 - DNA, 20 bp, Artificial Sequence
  Description of Artificial Sequence: Synthetic oligonucleotide
  Target: ATXN1; (+) strand; PAM type: NRG; PAM sequence: AAG
acatacccataaaaaaattc

SEQ ID NO: 139283 - DNA, 20 bp, Artificial Sequence
  Description of Artificial Sequence: Synthetic oligonucleotide
  Target: ATXN1; (+) strand; PAM type: NRG; PAM sequence: AGG
catacccataaaaaaattca

SEQ ID NO: 139284 - DNA, 20 bp, Artificial Sequence
  Description of Artificial Sequence: Synthetic oligonucleotide
  Target: ATXN1; (+) strand; PAM type: NRG; PAM sequence: GGG
atacccataaaaaaattcaa

SEQ ID NO: 139285 - DNA, 20 bp, Artificial Sequence
  Description of Artificial Sequence: Synthetic oligonucleotide
  Target: ATXN1; (+) strand; PAM type: NRG; PAM sequence: AAG
ataaaaaaattcaagggcct

SEQ ID NO: 139286 - DNA, 20 bp, Artificial Sequence
  Description of Artificial Sequence: Synthetic oligonucleotide
  Target: ATXN1; (+) strand; PAM type: NRG; PAM sequence: GAG
aaaaattcaagggcctaagt

SEQ ID NO: 139287 - DNA, 20 bp, Artificial Sequence
  Description of Artificial Sequence: Synthetic oligonucleotide
  Target: ATXN1; (+) strand; PAM type: NRG; PAM sequence: TGG
aattcaagggcctaagtgag

SEQ ID NO: 139288 - DNA, 20 bp, Artificial Sequence
  Description of Artificial Sequence: Synthetic oligonucleotide
  Target: ATXN1; (+) strand; PAM type: NRG; PAM sequence: TGG
taagtgagtggatgataatg

SEQ ID NO: 139289 - DNA, 20 bp, Artificial Sequence
  Description of Artificial Sequence: Synthetic oligonucleotide
  Target: ATXN1; (+) strand; PAM type: NRG; PAM sequence: AAG
gtggatgataatgtggtcca

SEQ ID NO: 139290 - DNA, 20 bp, Artificial Sequence
  Description of Artificial Sequence: Synthetic oligonucleotide
  Target: ATXN1; (+) strand; PAM type: NRG; PAM sequence: AGG
tggatgataatgtggtccaa

SEQ ID NO: 139291 - DNA, 20 bp, Artificial Sequence
  Description of Artificial Sequence: Synthetic oligonucleotide
  Target: ATXN1; (+) strand; PAM type: NRG; PAM sequence: CAG
atgtggtccaaaggtgtgca

SEQ ID NO: 139292 - DNA, 20 bp, Artificial Sequence
  Description of Artificial Sequence: Synthetic oligonucleotide
  Target: ATXN1; (+) strand; PAM type: NRG; PAM sequence: GAG
ggtgtgcacagacatatgct

SEQ ID NO: 139293 - DNA, 20 bp, Artificial Sequence
  Description of Artificial Sequence: Synthetic oligonucleotide
  Target: ATXN1; (+) strand; PAM type: NRG; PAM sequence: TAG
cagacatatgctgagtcact

SEQ ID NO: 139294 - DNA, 20 bp, Artificial Sequence
  Description of Artificial Sequence: Synthetic oligonucleotide
  Target: ATXN1; (+) strand; PAM type: NRG; PAM sequence: TGG
acatatgctgagtcacttag

SEQ ID NO: 139295 - DNA, 20 bp, Artificial Sequence
  Description of Artificial Sequence: Synthetic oligonucleotide
  Target: ATXN1; (+) strand; PAM type: NRG; PAM sequence: GGG
catatgctgagtcacttagt

SEQ ID NO: 139296 - DNA, 20 bp, Artificial Sequence
  Description of Artificial Sequence: Synthetic oligonucleotide
  Target: ATXN1; (+) strand; PAM type: NRG; PAM sequence: CAG
tcacttagtgggctgatcaa

SEQ ID NO: 139297 - DNA, 20 bp, Artificial Sequence
  Description of Artificial Sequence: Synthetic oligonucleotide
  Target: ATXN1; (+) strand; PAM type: NRG; PAM sequence: AGG
cacttagtgggctgatcaac

SEQ ID NO: 139298 - DNA, 20 bp, Artificial Sequence
  Description of Artificial Sequence: Synthetic oligonucleotide
  Target: ATXN1; (+) strand; PAM type: NRG; PAM sequence: GGG
acttagtgggctgatcaaca

SEQ ID NO: 139299 - DNA, 20 bp, Artificial Sequence
  Description of Artificial Sequence: Synthetic oligonucleotide
  Target: ATXN1; (+) strand; PAM type: NRG; PAM sequence: GGG
cttagtgggctgatcaacag

SEQ ID NO: 139300 - DNA, 20 bp, Artificial Sequence
  Description of Artificial Sequence: Synthetic oligonucleotide
  Target: ATXN1; (+) strand; PAM type: NRG; PAM sequence: TGG
gctgatcaacaggggattca

SEQ ID NO: 139301 - DNA, 20 bp, Artificial Sequence
  Description of Artificial Sequence: Synthetic oligonucleotide
  Target: ATXN1; (+) strand; PAM type: NRG; PAM sequence: GAG
tgatcaacaggggattcatg

SEQ ID NO: 139302 - DNA, 20 bp, Artificial Sequence
  Description of Artificial Sequence: Synthetic oligonucleotide
  Target: ATXN1; (+) strand; PAM type: NRG; PAM sequence: AGG
gatcaacaggggattcatgg

SEQ ID NO: 139303 - DNA, 20 bp, Artificial Sequence
  Description of Artificial Sequence: Synthetic oligonucleotide
  Target: ATXN1; (+) strand; PAM type: NRG; PAM sequence: AAG
acaggggattcatggaggaa

SEQ ID NO: 139304 - DNA, 20 bp, Artificial Sequence
  Description of Artificial Sequence: Synthetic oligonucleotide
  Target: ATXN1; (+) strand; PAM type: NRG; PAM sequence: CAG
attcatggaggaaaagctaa

SEQ ID NO: 139305 - DNA, 20 bp, Artificial Sequence
  Description of Artificial Sequence: Synthetic oligonucleotide
  Target: ATXN1; (+) strand; PAM type: NRG; PAM sequence: AAG
catggaggaaaagctaacag

SEQ ID NO: 139306 - DNA, 20 bp, Artificial Sequence
  Description of Artificial Sequence: Synthetic oligonucleotide
  Target: ATXN1; (+) strand; PAM type: NRG; PAM sequence: CAG
ctccaatgcattgatgatat

SEQ ID NO: 139307 - DNA, 20 bp, Artificial Sequence
  Description of Artificial Sequence: Synthetic oligonucleotide
  Target: ATXN1; (+) strand; PAM type: NRG; PAM sequence: GAG
ccaatgcattgatgatatca

SEQ ID NO: 139308 - DNA, 20 bp, Artificial Sequence
  Description of Artificial Sequence: Synthetic oligonucleotide
  Target: ATXN1; (+) strand; PAM type: NRG; PAM sequence: CAG
ttgatgatatcagagcatga

SEQ ID NO: 139309 - DNA, 20 bp, Artificial Sequence
  Description of Artificial Sequence: Synthetic oligonucleotide
  Target: ATXN1; (+) strand; PAM type: NRG; PAM sequence: AGG
tgatgatatcagagcatgac

SEQ ID NO: 139310 - DNA, 20 bp, Artificial Sequence
  Description of Artificial Sequence: Synthetic oligonucleotide
  Target: ATXN1; (+) strand; PAM type: NRG; PAM sequence: AAG
atatcagagcatgacaggtc

SEQ ID NO: 139311 - DNA, 20 bp, Artificial Sequence
  Description of Artificial Sequence: Synthetic oligonucleotide
  Target: ATXN1; (+) strand; PAM type: NRG; PAM sequence: GAG
atcagagcatgacaggtcaa

SEQ ID NO: 139312 - DNA, 20 bp, Artificial Sequence
  Description of Artificial Sequence: Synthetic oligonucleotide
  Target: ATXN1; (+) strand; PAM type: NRG; PAM sequence: GAG
cagagcatgacaggtcaaga

SEQ ID NO: 139313 - DNA, 20 bp, Artificial Sequence
  Description of Artificial Sequence: Synthetic oligonucleotide
  Target: ATXN1; (+) strand; PAM type: NRG; PAM sequence: AAG
aggtcaagagagcctcctgc

SEQ ID NO: 139314 - DNA, 20 bp, Artificial Sequence
  Description of Artificial Sequence: Synthetic oligonucleotide
  Target: ATXN1; (+) strand; PAM type: NRG; PAM sequence: CGG
tcatctgctcaactgtgaat

SEQ ID NO: 139315 - DNA, 20 bp, Artificial Sequence
  Description of Artificial Sequence: Synthetic oligonucleotide
  Target: ATXN1; (+) strand; PAM type: NRG; PAM sequence: GAG
tcaactgtgaatcggcatct

SEQ ID NO: 139316 - DNA, 20 bp, Artificial Sequence
  Description of Artificial Sequence: Synthetic oligonucleotide
  Target: ATXN1; (+) strand; PAM type: NRG; PAM sequence: AAG
gaatcggcatctgagaaaat

SEQ ID NO: 139317 - DNA, 20 bp, Artificial Sequence
  Description of Artificial Sequence: Synthetic oligonucleotide
  Target: ATXN1; (+) strand; PAM type: NRG; PAM sequence: AAG
cctcccaaacaccaacatta

SEQ ID NO: 139318 - DNA, 20 bp, Artificial Sequence
  Description of Artificial Sequence: Synthetic oligonucleotide
  Target: ATXN1; (+) strand; PAM type: NRG; PAM sequence: TGG
aaagcaatgcattattaaaa

SEQ ID NO: 139319 - DNA, 20 bp, Artificial Sequence
  Description of Artificial Sequence: Synthetic oligonucleotide
  Target: ATXN1; (+) strand; PAM type: NRG; PAM sequence: GAG
agcaatgcattattaaaatg

SEQ ID NO: 139320 - DNA, 20 bp, Artificial Sequence
  Description of Artificial Sequence: Synthetic oligonucleotide
  Target: ATXN1; (+) strand; PAM type: NRG; PAM sequence: AGG
gcaatgcattattaaaatgg

SEQ ID NO: 139321 - DNA, 20 bp, Artificial Sequence
  Description of Artificial Sequence: Synthetic oligonucleotide
  Target: ATXN1; (+) strand; PAM type: NRG; PAM sequence: CAG
attattaaaatggaggttct

SEQ ID NO: 139322 - DNA, 20 bp, Artificial Sequence
  Description of Artificial Sequence: Synthetic oligonucleotide
  Target: ATXN1; (+) strand; PAM type: NRG; PAM sequence: AGG
ttattaaaatggaggttctc

SEQ ID NO: 139323 - DNA, 20 bp, Artificial Sequence
  Description of Artificial Sequence: Synthetic oligonucleotide
  Target: ATXN1; (+) strand; PAM type: NRG; PAM sequence: TAG
ttaaaatggaggttctcagg

SEQ ID NO: 139324 - DNA, 20 bp, Artificial Sequence
  Description of Artificial Sequence: Synthetic oligonucleotide
  Target: ATXN1; (+) strand; PAM type: NRG; PAM sequence: TAG
actcatgcaatcataaacat

SEQ ID NO: 139325 - DNA, 20 bp, Artificial Sequence
  Description of Artificial Sequence: Synthetic oligonucleotide
  Target: ATXN1; (+) strand; PAM type: NRG; PAM sequence: CAG
atcataaacattagaatatg

SEQ ID NO: 139326 - DNA, 20 bp, Artificial Sequence
  Description of Artificial Sequence: Synthetic oligonucleotide
  Target: ATXN1; (+) strand; PAM type: NRG; PAM sequence: AAG
aaacattagaatatgcagca

SEQ ID NO: 139327 - DNA, 20 bp, Artificial Sequence
  Description of Artificial Sequence: Synthetic oligonucleotide
  Target: ATXN1; (+) strand; PAM type: NRG; PAM sequence: GAG
acattagaatatgcagcaaa

SEQ ID NO: 139328 - DNA, 20 bp, Artificial Sequence
  Description of Artificial Sequence: Synthetic oligonucleotide
  Target: ATXN1; (+) strand; PAM type: NRG; PAM sequence: CAG
aaagagataatgatacttgt
